United States Patent 10,888,096 (BIOPESTICIDES FOR POTATO LATE BLIGHT DISEASE) - sequence listing, part 10

SEQ ID NO: 24 - DNA, 416736 bp, Arthrobacter sp. OY3WO11
atctagctgccgaagtgtgcgcggggtggtccttcggggagcttgtcgaggatgtcctcggccaccctgcgcaccttgatgttgcggtggcttgaagccttggccaggatggcaaacgcctcgtggtaggagcacctgttctgggccatgattactccgcaggccacgttgatggaggtccggctgtccagggctgagcgcaggtccgtggcggtggacctggctgaatgcagactgaccgcaacttccaggctctttgccgcgagaccggcgaagccgcgggcttcggcaatggcctgcagcgggaacgccttggcgtcctgggcaaacaacgccagggcggcaggtgtgtcaaccgggccggacccgtcgccgtcggcatcgggtgccacccgaagcctgatccccatggcgctgccgaaacctgccatctgcagttgggtggaataacgcggccagcggaaatcaccgttgcgctggagaactgctaccggatggtggccggccagcacctcgtgcaaagggccctcgccagcctgctgctcccactccaggagctccacaacgtcccctgaggtgccggtaattgcggaactcctcttcggctggtggaccacaacgccgcattcgatccgcaggcccgtggcccggacaattgtccggacggctgcggcggcgaggacatcaagggagtcgcggaggctgtgcgtcccgctgaccagatcgaggaggagggcgtccggggcgccgctgtccgcaagccctgtctcgcctgccggggccggagccgccggcccgggctgggccggtcgatggcccgcacccttctgcgcacgaagagggccggcgacggctgggggagaggccttggtctcaaaggcctcctcgtcgccggccccgtttagtacccgtgccctgcgggccgggaaagccgaacttatgttttgtgcgtgcattgcagtctcacaccccctcgtgagacaagtactacgagtcagaagacgtcttgcctctgagttgaacttagttcggccattcaccccggtgaatccgtaaggagtacccgattttgagattaggtactacttggatatctgcccggcgcccctcctttcccccgttgccgcaggtggggtgcgaatagggcctcgcagttgcccggcctgcttccactgccagttttcgtacgaatgcttgactcctgccgcggcacgctcaagaatgttttctataacgttatagaaaaaatgagaaacgaggatgttttcgtgaccgctgctgaaccagccaccgccaaaatcaccatggaccccgccttcgccgtggggccggtccggcggcgcactttcggtgcctttgtggagcaccttggccgttgtgtgtacaccggtatcttcgagccggagcacccgaaggccgacgacgacggcttccgcagcgacgtgctggaactgacccgcgaactcggagtgtccacagtccgctatcccggcggcaacttcgtctccggctaccgctgggaggacggggttggcccggccgacaaacgtccggtacggctggacctcgcctggcactccaccgaccccaacctggtgggcgtggacgaattcgccaagtggtcagccaaggcaggcgtcgaacccatgatggccgtgaacctgggcacccgcggcacgcaggaagcgcttgacctcctggagtactgcaacatcgacggcggcacggccttctcggaccagcgccgggccaacggcgcggagaacggctacggcatcagaatgtggtgcctgggcaacgaaatggacggcccgtggcagatcggccacaagaacgccctcgaatacgggcggctggcggcagacaccgcccgcggcatgcggatgatcgatcccggccttgaacttgtggcgtgcggcagctccggacccaccatggacaccttcggtgagtgggagcgcgttgtcctctccgaaacctacgagctggtggacctcatctcggcccaccagtatttcgaggactttggcgacctgcaggaacacctctccgccgggcaccggatggaagccttcatccatgacatcgtgagccacatcgaccacgtgaagtcggtgaagaagtcaacccggcaggtcaacatctcctttgatgagtggaacgtgtggcacatgagccgcgacgagtcccgcgcacccaccgggaaggactggccggtggccccggtcctccttgaggacacctacacggtagcggacgccgtcgtcgtcggggacctgctgatcaccctgctcaagaacacggaccgcgtccactcagccagcctggcccagctggtcaatgtcatcgcgcccatcatgaccgagcccggcggccgcgcctggaagcagaccaccttccacccgtttgcgctcacgtcccgccacgcctccgggacggtgcttcagctcgccgtcgagtccccgctggccagcggcggtaagaccgcagacttcgccgccgtgtccgccgtcgccacgtacgacgctgacaagggtgaagccgtggtgttcgccgtcaaccgctctgccacggatgcgctgggcttggacgccgtggtgtccggcctgggcagcgtgcgcgtgctcgaagcggtcacctacgccaacaaggacccgtactggcaggcaaccgctgatgattcgacgtcggtcctgcccacggaaaacgtcaccgtcaaaactgacggcggcaggctcactgtggacctgccggccgtgtcctggtccatgatccggctggccgtcaaccagtagccatccggacccaggggaggggacagcatgacggcggcgcccctcctctgggaggatgggcggcatggaactgcacatcacgggcgatcccgccgcggacaagttgttgagcgaggacgccttcgcgctgctgacaggcatgctgctggaccagcaggtgaccatggaatcggccttcgccggcccggagaaaatcaggaccaggatcgggtccgtggagcccggggcgatcgcctcccaggattcacaggccttcgtggagatgttcaaggaacggccggccgtccaccgcttccccggctcgatggcggcgagggtccaggcgctcgccgaaaccgtgcagaacgagtgggacggcgacgccaccgccatctggaccaggggcaacccggacggcgccgaggtgctgcgccggctgaaggccctgcccggcttcggtgagcagaaagccaggatcttccttgcactgctcggcaagcagtgcggactgcaggcgccggggtggcgtgaggctgccggccactatggagaggaaggctcccatctctccgtggctgacatcgtggacccggaatccctcgccaaggtgcgggccagcaagcaggcagccaaggcggccgcgaaagctgcgaaggcctgaccttcccttcataagccgtgccgcagtgaccgtgcctgaccggcgcgtgcagcctggccgccaaattctgcaacgatgtatggcaggaactggcggaaccacctaaaggagccatgatggcggtcaccatgaatgacgttgcgagggcggcgggggtgtcgctcaagacggtctccaacgtgctcaacgactacgagttcattcgccctgccaccaagaagcgggtccaggacgccatcgcggagctgggctatgaggcgaacctgacggcccggagcctgcgctcggggaaaaccaggatgctcggcctggtactgtccgacctctcagccccgtactacgccgaacttgcctccaggctgatgaaggccgcctcccgccgcggctaccgggtcctggtggagcagtcggacgcagtgggcgaggtggaactgaatgccctgcagggccccttccggcagctcaccgacggcttgctgttcaccccgctggtcattgccgcggacaccattgccgaccgcctgggcaagaagcccctggttttgctgggtgaacacatcctggaccccaggttcgaccttgtcaccatgaaaaacggcgaagccgctgcagccctcaccgcccacctgctggcgggaggccgccgccggattgccgtcatcggggcgcacccggacgagtccgccggcagcgcgggcctgcgcctcaacggctaccgcaaggcacttgatgaagccggtgtacctttcgacgcggcactggtggccccgtgcgagtggcgccgggacaacggcgccgccgccgtagcggggctgctggacaagggggtggagttcgacgccgtgttcggcctgaacgatgtcctggcgctgggtgccatgcacgaactgctgatccgcggcgtccgggtgccccaggatgttgcggtggcagggttcgacgacatcgacgaggcccggttcgcctcgccttccctgaccaccgtctccccgggcatggaggagatcgcggaacgctccatcggcctgctgatcgaccggatcgaggggcgggaggcggaggaccaggcagcgcacatcgaagccgaattccagctgaaggtccgcgagtcggcaccctaggtgttctgaaccaggtttcgcccgcccaacctcggggtacttttccggcagagcaacgaggaaaggtggccacatgattgcccttcttgtcattgacatgcagaacgcgtttttcgaggcgccggaacttgccgcgcagcaggagcagctggtggcgtcctgcaacaggctgatggagggcttcgaagcgagcgggcacaaagtcctgctggtggggacggaacacgagcgggacaaatccacctggtcactgaacatgctggacgacgaccaaggcttcattttccgcggcaccagccaggcccaggcggtgtccggcctcgccgccgcgggcctgccccagttgaccaaaacgcgggacagcgcgtttgtgggaaccaacctgctggccaggctgcgcaactggggcgctgaggagatcgtgctcgccggggtgtccacgcacaactgcatcgcgcagaccggggcggatgcgttcgcacacaacatccgcgtcacgtacgccaaggatgcgatggcctccgaggacagccaggacgcagcggacatgctgcgtatcctctccacgagctaccgccagcccgtccagtccaatgacgagatcctggcgcggctcggtcagccgtaataccccggctgcctccggcggtgacgcccgctgccggtcttcgccgctgagcctccccaccttttggagggcacgacggcgcgtcccggccacgcgccgtcgtcctcgccttccagagcgtgaaacctggggaaattcagcggcccgcaccggtgcctggtgagtggagagccgggcataacaaacctgaaacgtggcggaaacgtccgcaacctactgtgggtcccacgccgccgcgagcggccagctgaagggaccaacatgcatctgatgccgcgcgagcaggaaaagcttttgatcgtggtggccgccgacctcgcgcgccgccgccaggcccgcggcctcaagctcaactaccccgaggctgtggccatcatcagctatgaactgatcgagggtgcccgcgacggccgcagcgttgccgacctcatgagctacgggaccaccctgctgggcagggaggacgtcatggaaggggtgcccgaaatgatccatgacgtccagatcgaggcaaccttccccgacggcaccaaactcgtcaccgtccacgaccccatccgctgagagggcaggccatgattccaggagagtacgtcctccggcccgagccggtgacggccaacgccgggcgcgaggccattgacgtcggggtgacgaataccggagaccggcccgtgcaggtgggctcgcacttccactttgccgaggcaaacgccgcgctggccttcgaccgggacgccgcctacgggcggcgcctggacatccccgccgggaccgcggcacggttcgagccgggggactcccgaaacgtccggctgatcgaactggccggaacccgcgaggtgtacgggctcagcaatgccgtcaacggaaagctcgacggcgggacccgcccgggcgggttcgtcacggaaggggacggccagtgagcttcgagattccccgcaggcagtacgcggacctgtacggcccgacgacgggcgacgccatccgcctggcggacaccgacctgttcctggagatcgagaaggacctcaccgtgtacggcgaggaggttgtcttcggcggcggcaaggtgatccgtgacggcatgggccagaacggccaggtggtgcgggatgaggacgtcccggacaccgtgatcacgaacgccgtgatcctggactacaccggcatctacaaggcggacgtcgccatcagggacggccatatcttcaagatcggcaaggccggcaacccgcagatcgccgacggcgtggacatcgtgatcggcgcgagcaccgaaatcattgccggcgaacgcaagatcctcacggccgggggagtggacacccacatccacttcatctccccggaccagatccccacggcgctgaccagcggcatcaccaccatgatcggtggcggcaccggcccggctgaaggcaccaaggccaccaccgtgacgcccggaaagtggcacatccagcgcatgctgcaggctgccgaaggcttccccgtgaacatcgggctgttcggcaagggccacgcatccgccgtcgaacccctggctgagcagatccgcgccggggccatcgggttgaaggtccacgaggactggggctccaccacctcctcgatcgacacctccctcaccgtggccgacgagtacgacgtgcaggtggccatccacacggacaccctcaacgagtgcggtttcgtggaggacactatccgcgccatcaacggccgcgtcatccacaccttccacaccgagggtgccggaggcgggcacgcgccggacatcatcaaaatcgccgggatgcccaacgtcctgccggcgtccaccaaccccacgcttccctatacgcgcaacaccatcgaagagcacctggacatgctcatggtgtgccaccacctcaacccggacatccccgaggacgttgccttcgccgattcccggatccgcgccgagaccattgccgccgaggacgtcctgcaggacctgggaatcttctccatcacctcctcggactcccaggcgatgggccgggtgggcgaggtgatcacccgcacgtggcaggtggcggacaagatgaagaagcaacggggtgtgctggcaaaccccgccggtacggcagatgacgacggcggcgcgcacggcagcgcgggcagcgacaacttccgcctcaagcgctacgtggccaagtacaccatcaacccggccatcgcccagggcatcgcggactccgtgggctccgtggaggtgggcaagttcgcggacctggtcctctgggatcctgccttctttggcgtcaagccggagctggtgctcaaaggcgggcagatcgcctacgcactgatgggggatgccaacgcctccatccccaccccgcagccgcgcaccatgcggcccatgttcgccgcgttcgggaaagccgtgcagcagtgctccatcacgttcctgtccaaggccgcgatcgacgccggcgttcccgccgagcttgggctcgagaaagtcatccggcccgtttccggcatccgttccctcaccaaggcggacctgaagtacaacgacgccacccccgacatccaggtggatccggaaacgtaccaggtaaaggtcgacggcgaagacgtcacctgcgaaccatccgacgtgctgcccatggcccagcgctacttcctcttctgatttcttccaagccctcggagacccagtgatcatcgaaaaagtcctcggcaacctgcacgaactcccggacccggatacctatgccaacctgcaccaggagaaagtggtgcttcccagcgcccagctggtcaaacggatccaacgcgccaccacggaccacggcaaggaaatcggcatccggctcccgtccggctccggcgacctgcgcgacggggacatcctgcacgtcgaggacgccaacatgatcgtggtgtccgtgctgcccaccgacgtcctggtgatcgcaccgcggaccatccacgagatgggcgtcgtggcacactccctcggcaaccggcacctccaggcccagttcttcgacggtgcttcggagtacggggccgaggtcatggtgtgcgcctacgaccacaccgtcgaggactaccttctccacgtgggtgcgccctactcccggcaggaacgcgtcatgcccgttcctttccgccatgctgaacattcgcactaaacccctccccgtttccccggcttgggacgccgcgagggatatggggccgtgcccgtccccaggcgctcccaatcctcgcaagctcggatcggggccctcgcgccagtgggcccctcgcgcggcccgccacgccgcggccccatatccctcgcgtcgcttgcgcttctcaccttgggcgcggcttcagtgagcgggtaccagctggcgctgcagcagcttggcgattccgctttgcctactggggcctttgctcactctcttggttttgagacttatgtcgacgccggtgtggtccgtgatgaggcttcttttggagtgtggttgtccgcgttcatctttcagtcgcttacttactctgacgggttggccatccggttcttctatgagggtgttgacctcggtgaactcgatgctctgctctcggcgtcgctgctgccgcggcaggtccgggaagccagcgtcaagatgggcttgcggctgctcgagatcggggcggaggtcttcccgtcgccggagctggaactgtaccgggacctggtgaccaccggccgggccgcggggcaccagccgctggcgttcgccgtcgtcgcccgctccctgggagtgccgctgccggaagcgctcgccgcctacctttttgccaccgtcacctctttgacgcagaacgccgtccgcgccatcccgctcggccagaacgccggccagcggctgcttcggcaggcggccgacggcgttgctgccgccgtcgaacggataccgcacctgacgccggacgacttcggggccgtcacccccggactggaaatttcacaaatgcggcacgaacgccaacgtgcccggatgttcatgagctgaccgtgtttataaattcaggaggaaccatggctgaacccatcaaaatcggcatcggcggacccgtcggggcgggcaagacccagctcgtggagcggctcacccggcacatgagcggcgagatctccatggccgccatcaccaacgacatctacaccatcgaggacgccaaaatcctggccgctaacggcatcctccccgtggaccgcatcattggcgtcgaaaccggcggctgcccgcacaccgccatccgcgaagacacctccatgaacaccgccgccatcgaggaactcaaagcccgccacccggacctgcaggtcatcttcgtcgaatccggcggcgacaacctctccgccaccttcagccccgaactcgtggacttctccatctacatcatcgacgtggcccagggcgaaaagatcccccgtaaagccggccagggcatgatcaagtccgacctcttcatcatcaacaaaaccgacctcgcaccccacgtcggtgccgacctcgcagtcatggaaagggactccaaggaattccgcggagccaagccgttctgcttcaccaacctcaaaaccgacgaagggctcgacgccgtcatcgaatgggtacggcgcgacgtcctgatgctcgacctggccttatgagcacgacggcggccgcaactcagacgatcccggcaccagagtccgggctgggtccggcggcttcgccgaatttggggccgtgcccgtcccctggcgctcccaatcctcgcaagctcggatcgggaccctcgcgccagtgggcccctcacgagtgccaccacgccgcggcccccaaatccggcctcgccgcctctgcagtcaggtcaccgatgggcgagctggagcttcgggtcgccgtgcgtggtcagaggtccgtggccgcgcatcagtatcatcggggcgccttgagggtgttgaggccgcactatctcgatgactcggggcaggtttgttatgtggtcgtgaatcctggcggggcctatcttggcgctgatcttttcctgctggatgttgaggttgctgactctgcctctttgctgctgactacccagtccgctacgaaggtgtaccggactcctggatccttcgccgagcagcggatgaacctccggctgggggagggggcccggctggagctcatgccggaccagctcatcgcctaccgggaggccagctaccggcagcacacgcacatcactgtgcggccgtcgtcgtccctggtcatggctgaagtggtgactccgggatggtcgccggacggggccgccttccggtacgaggaggtccggctgcgcaacagcatccgggtggaaggaccggacggaaaccggctcctggccctggacaacctcctgatccggccgccggcaggcgacgtcacgggcatggggttcatggagggcttcagccacgtgggctcgctgctggtggtggatccacgggtggaccaggcgctcgccgacgacctgaacgccctggccccggaccacggtgcccgcaccggcatttccctgacccgtacggtttcggggaccaccggcctggtactgcgcgccctgtccaacagcacgggggaactgaacaacctgcttgctgcctgcacgtccctcctccggaaacggtggcaccggcaggaaccgctgaacctgaggaagcactgacgatggccgtcacgaacatcaccacgctctaccgggaccgggaggcactgccgctgcggacccgcctgttgttcaccttcggtgccgtggccgcactgcacgcggccgccgtcgtgctcctgctggccggcaacgccgccggatccggtgcggagccgctcatctgggggctggtgctcacggcctacctggcgggcgtcaagcacagctacgactgggaccacctcgctgcgatcgacaactctacgcgcaaattcgtggcgcagcgccaggacccggtcagcgtgggcttcgccttcagcctcgggcacagttcggtggtgacgctggcggggatcctggtgattgccggcgccggcatggtgggccaattgatgcaggacgggaccacgggcaatctggtgctaggcctgattggaagcggggtttcggggctgttcctgctggcgatgggcctgttcaacggctcggccttcgcccggtcagcgcgggcctaccgccgggcgcgggcgggggcggaggtagaccccagagaccttgaaccccagggacttgtggcgcggctgctggcccggccgctgtccagggtgcggcggccgcggaacatctacgtgatcggattcctgttcgggctgggcttcgataccgccaccaccattgggctgctgatgatgacgacggcggcctcgctggccggggtgccaccgttcgcgctgctcgcgcttccgctggcgttcacggccgcgatgaccctttgcgattcgctgaacggggtggccatgatgcggatgtaccgttctgccctggacaacccgcagcggcggctgggcttcgatgccgtggtcaccggcatctcagcggtgtccgccctgttcatcgcggtgatcacgctgggcggtttcgccaacgccgccttcgcgctggaggatcccctgacggtgtggctgggatccatcgacctgggcgacgccggcctgctgctggtggcgctgctgctggccgtgtggggagcagcgggagtgaaggggcgcctggcgggcagcggcaggcactaagcggcacaggcgctgcgcggaaaagggctgggcagttcaggcggccacccggcccctggtctgccggtgctgcctgctcttcccctgggcccggcgcggcgcgcgcgtgcccgcgaggacctgcccgccgtccggaatggcggagtctgcgtggacctggactccgtgctcgatcaggaccccggagccgatccgcgaatggctgccgatgttcacccggtttccaatcaccgttccccgtccgatgcgtacgccgtcgccaataatggcacgctcgccgatcgtggcatcccggtcaatccagctgccgtggccgatccggcacccggaacccacctttgctcccggctccacatacgtcattggtccgacgcgggtactttccgggaccgaggctccgggggcaacgagcccgccgccgttggcatgccggacgtaccgggtgaccttcccggcgtcgtcctccactgaaacaaacttcgcgttcattcaatccctcgttaaccggagcggcacttcagccgcacattgggttaacggttcacaactcaaagggattcccgaacggcgccgggcagctcttccgctacggcgagacctccgcgtgctgcgcgccttcttccgggtcaggggcggcatcctcctccgtcagcagcagggccgtcccctggtaggcaggcagttcgaggaagaaactgtgcagatcgtcaacctggccaactgtggcgccgctgaacaggtcgtgtacggtggcgccgggtaccaggtggctggactggatgctgccggaaatgtcctggtcggagaaattcagcacggtcacctccagcgctccgctcccaagctggatgaccatcaccagcaggccacggtgcgaaacgcccggcacgtccagcagggccccggtggcgatgccgtgttcttcacggacagccaggatctgctggagccgcctggcgtaggagccggggttctgcagctggtcggggagcgggccgtagaggctgcgggcccgcggcatgccggaggaggaggattccgcatccgggctggtgcccatgatgtcgtgcgccccgcggttgatccagcgggtgtcgccctgggccgtgagttcctcgacgcgcttgcggtccagcgcggtgatgccggcaaggtcccagccggacagggcaaagacgccgggctgcagggcgttgtacatggagaggaggatgtgcacatccaggatctgcgcctcctgctccggagtgatcgcgtcagggtcctggacccccagggcggccatgatgaagctgaccgttgtacaggcgatcccgttggtggtgaacaatgcgttgtagggggcgttctccccggtgaggcgctcacgcatggtctgctggacttgctccgcgagctgtgctcccgtgagctcctggccgttgagctcgaacatctcgtcccggtgcccggcagcgaagtgcatcagctcgtaggtcagttcgtcatggttctgcagtgcgtggaccagcgacgcctggtccactccgatctccatggacaggcggagcgtcaggcgcagcaactcggtatctgcggtgaccagcgcgtagtggtacgccggccgtgtgatgaagtcgtaggaaaggtccgggcctgcttccgaggtggccttgatgtcgtcgatggtcaggttcagctcctggaaggagaaccctcccaccttgcggatcatggacccgatgagctggttggctgcctcggacagcgggtgcccctcggaccagcccggctgctcctcggcgcttttctccacgcccaggaagccgttcgcatcaagcctgagcgcgccggtgccaaggtcaaccagggaatgcagcgcgtcaccaaccaccaggcgcatcccggcgaaggtgggatccagccagttgatggagggctggcccgccttgaagtagtggaggtagacccagcggcgggttttccctgtggtgtcaacgatcgcccgggtggcgctccagttcgtttccttgacgccgggctcgtagaagatgacccgctgcagccgaccgatgatgtatccggccttctgcagggcctgttcggaatcggggctcaggtttaccgagtcctgcccttcggggacgtccgggagcaggtgccagtcctcctccgggatgtcgatcatgtggtagatccccgggtagtcccggaaattcatttcggcgaggcggaagtcggcgcccttcccggtgtggccgggaacaatgtcatcaataatcgttccgccgtggtcggcggccaccgtgcacatcgagcggaattcgtcctccgtgccaaacaccggatcgatcgccatgctgatccggtcaaagtgcccgtccacgctgggggtctgggaccagccgctgatgccgccggccagtttgaccgggcccgtgtggatggccctgatcccgatttcgctgaaagcttcccacatggccggatcgcccagggcagagaggaaggactggctggacctggtgatgaaggagagggggtacgcggtgaaccacaccggtgcgcgctcgacggcggcccgggggttgggatgtgcgtaggagttctgccacatgctggcctgccctgagagctgccgggcaagcgtgttggcgtctcccagcatggcctggttccgcagccattcgacgtacgccgcattccgtccatcgaattcgaaggacggcctggtggcaaagtattggcgccggcgcgcggtcggcctcagcgccttggggcgggccggataaagatgttcatcgaaattgacgtccgggtccactgagggttcagcagctgcttcctcgttttcgccggcaacggtctccgcttcaaaaactccgtcgctggtcttcggttcccgcattgagtcctctttctacagttggtcccgcggtcccaaggcgtagtgcctggccacccggctcttagtccaacgtacccgggggcggccggactattcgcgcgaattacgaaactaccaagtagaaactaagacacaaggttcgcggcggccgtgtccattgccgggggggtgtgtttgcggccggcctgttcctacactggggtgatgatcacagtcgctggaagcgtggaaaccaacctgtccgcagagaaggcctttgcctttttgagccagttcgagaacacccccaagtgggatcccaacactcctgtcatggataaagtcactccggggccggtggccgtggggcacaagtaccacgccgaagccgagttccggggtaagaggcaaagcctggtctacgaggtcatcgagctgacggacaaccacatcaagctgcgcggcgagaacaaaacagtcacctccttcgattccatcgacgtcagccccgagggggccggctcggtggtgaagtacacggccgagttcagcatcaaaggacccgccaagatcatccagccgctcctgaagcctgccttcatgtcgctccgggatcccgccctgaacgggatccgggacacgctcaactcgctggcagcagcctgacggcttcgaagaactcccggatctcccggcgggggtcggcggccactcggggctcctcgtccaggatcatcgtggcccgcaacgtaccgtactccggccaggccagcccgggtgttccgggatttccggcctgagcgaaggaagcccacgcgccgctcatggcgttgctgagtgacgttggcgccttgccgcgcgtgaggaaggctgcctgggggctgtccacgtgccggaacacaaaagggatgtccagcgcgtggcaggctcccagctttccgcccatggcagggctgcaccaggtgaaaaggtaggagtagttcctgccctcggatccgctccgcgcgtcgaggagcctgttgctgggctgccggtaaacagaatctgcaatggcggcctccaggagctccttgcctgccggttccctgtccgacagccgggtgagcgccgccgcatagccggaggccgccgtcggcgggacccaggcgccggacagcacggctgcggcacggtccgggtagtccggatccgctgcagtgtcaggacgcatctcgacggcgaatgagccctcgttcaggttggtgccgatcagcaggtccaccccggtgttgagtccgccgcgaaccgcgtccaggggcggcagcggaagcgagggtgtgccaacggtgggctggaatggcagcggaacggcgaatgtcgctgccgccgtccgctgcaccagttgctcctgcgcatccaggatccgttcaacgggcagggcaagaatctccccggcccgggccatgtccaggccgcacagctccaggaactccccgcacacgcgggcggactcctgctgggtgcggtagcgttccgcggtgccgctttgcatgatggcgcgcctgaaaaggcccgacgacggcatgcccaggagggtgccgacggccgccgccccggccgactccccaaacagcgtgacgttgccggggtcgccgccgaaagccccaatgttgccctgcacccagcgcagcgcttcgaccaggtccaggaggccgaggtttgaggaatcctcgtaacctggccccagaacgtccgccaggtgcaggaagcccagtgcgcccagccggtagttgaccgtaaccaccaccgtgcccgtcgcagcggcgaggctgccgccgtcgtacattgcgtcactgttggagcccgagaggtaggcgccgccatgaacccacaccatcacgggcctggcagtgcccatcccgggcgtccagatgttcaggttgaggcagtcctgctcgctccacgtccgcggttcctggcccggcggggcgggggactccgggttctgcggcgctgccggaccgggcgccgtgcagtctcgcaccccctgccagggagctgcaggtaccggcgggcggaagcgccgggatcctgacggcggcccggcgtacggtatccccaggaaacggtggacggttgcttcttccacagtcaccgtggttccgcggacggttcccgtgcgtgggtgggcgtctgtcatggttgacaccttaggtctttcccggaggcggacaggaattgctccggcacttccgctgcatggtggggtgggggccccgcgatccagtaagtgggttgtggtgttggtcaggccagctgggcagcaggctcccgcactgcctgcgcagcaaactcccgggcccgtccgcccagccagtgggcgctttccttcgggatccgttcctgggtttcccggtccactgcaatgaggccgaatttcggtccgtagccgaacacccattcgtagttgtcgaaggccgtccacgcaatgtagccccggacagcgatgccgtcagcaatgcaggaggcaacgccgtcgaccgccgtcctgagatagcccacgcgctgcgtgtcatcctcggtggccaggccgttctccgtgaccatcacgggaatgccggcgatccggtgtgcctccctgatggtcacctcgagggcctgcgggtagatttcctcacccatctggttggtttccgcgccgtccggtgccggctcgtgcccgtccgggccgtagacagtgcggccgtaggtctggatccccacaaagtcgtcgccgcgggaggcttccagaaagcgctcgttgacgttgcggcgcacgcggtcagcgatttcctggccgccctcgatggactggatgtcagagttcgcgagcgtccaaccaaccagcagctccggccggcgggccttgatggcagcggtggcggcacggtgcgcagccagtttcacctcgaatccggcctccgtggagcaaaactggaagggtgccacggtgctggcgtccacgccgaggcgctgggctgctgcggcccacaccggcacggagccgcggttttccggggcttccccgccgatgccgaaggactccagcagccacggcaggttcggctcattcagggtgcaggcgacgccgataaggtcccccagatgcgtcatcacccgatcgcagtagcgggcaaagagctccgcagtccgggagccttcccagccgccgagggccagcagccagcgcggggacgtgaagtggtggaacgtgaccacggggacgaggccatgctcgtggcaggcctcgagcatgcggcggtagtggtccagctcggccgtggagaagagtccttcttccggctcgatgcgcgcccattcgacggagaagcggtagctggtgaaccccaggcttgcgatcagtgcgatgtcctcgcggtagcggtggtagtggtccaccgcatctcccgacggttcggagaacatgctgccggggaggtgctccaggaaccaggtgtcgctgttgacgttgttcccctccacctggtggccggcgctggcgacgccccagaggaagtcctgcgggaatggtgatgccgtggtcatgtggttcctttcgggtcagcgccgacgaacagcgcacggggcctctctgccctggcttccaatcctttcccgtgaggtgaccggggccacaatactttttcaatcaatgacattctcatgtgagcgcccagtacgcccggccgatgctggtggagagccggcgagcagccagcccccaaaactgttcttctccgatgtcacatcagaatgcaaaggcgcactacatgaaactcctgaactccactgcccgtgcgagctccgccgttctggccggcgcgctcctgctgggatcgttgaccgcctgtggcggcggctccagccaggccactgcaaaagtggataccagcacgctgaccctcgccatcgacagcgactcggcctcgttcggcttcgacccgctgcgcgtctcggctgcccagcgacagttctttgagggcctctacgaaagcctgatggctttgcagccggacggctcggccggtccgggcctggccaaggagttcagctacaacgcagacaacacggtcctgacgctcaccctcaaggacgatgtgaccttcacggatggctcaaagctcgacgccgagctggtcaaggcgaacctggaccgccggtctgaccccgcattgagcgcgtactcggcagttgccaagggcggcgcccaggaaatcacctccgttgacgtggtcagccccacccaggtggccctgaccttcgccaagccccagccgggattcgagaagaacctggcatccaccaccggcatgatcgtgggcaagaacggcgtcgccgactccgccagcctcgccgcgaccccggcaggctccggcccctacacgctggatccctccaccgtgaagggcaacaagtatgtcctggtgaagaatgcggacagcccggaagcttccaagtacgccttcgacaaggtcatcttcagtgtggtccaggatccccaggcgcgggcaaacgcgctggtgtccggccaggcggatgtggcaatgctgacttcctccaccgtcgacttcgccaagtccaagggagtaggtgtgtcccagatcggcggcacggtcaacaccatgatctcctttgacaagatcggcaagaccgccccggcgttcgccgaggagaaggtccgccaggcgatccagtacgccatcaaccgccaggcccttgtggatgcgctgcacaagggtgacatccccgcctggaacgccctgcccaaggactccgccggcttcaccaaggacctcgagaccacgtttgcctacgacccggaaaaggccaagagcctgctggccgaggccggctacccggaaggcttcgacttcaccatcatcgccagcgcccagacccagacggacctgcaggcagtccagaaggacctcgccgccgtcggaatcaccatgaacgtaaagatggcctcctccactgacgaagccttcgccgccgtcgccacaacgccgctgggctatgcgccactgaactgggacaaccccgtgggcgtgatgtacggcgtggtcctcaacggcttcaccaacgtccagaaggccaccgacgagcagctcagcgccgccaccggcgagctggccaccgccaaggaggacgccgccgtcaaggccgcggccaccaagctgaacacccggctggtggaatccggctggatgatcccgctgtacgaggcgctcaccaaccagggctacaacaccaagaaggtggccccggtggagttcgccggcaccaacgcctacccgctcctctcgtcctacaagccggccagctgatacccgcccctgccgggcgggccctccccatcaaacggggggcctgcccggcagggcctgaccgatggaggtcaccatggaacttttcatcaccaaacgcctgctgatggcactcgccaccgtgctggtggtcgcggtgctggcattcatgctggtgcacgctatgcccggcagtcccggagccgtgtccctcggcgccggcgccacccaggaggccattgacgaggtcaaccagcgactcggctggaacgatcccctggtggtccagttcttcagctggctcggcgcggcggtccagggcgacttcggaatctccctcattgacggacggtcggtcagtgcggaccttgcgagcaggctccctgtcacagcatcgcttgctgccggagccacgctgctcagtgctgttcttgggattgggctgggcgtcaccgcggctgtccgcggcggcatggtggaccgcatcatcggcggcgtctgcgggatggccgtggcactcccggccttctggatcggcatcatcttcgtttacctcctggcagtccagtcctccgttttcccggccaccggctatgttccgttcgaggtctctccacaggactgggcgctgtccctggccctgccggtgataaccctggccgtgggtggcgccgccttcatcgcccggcagaccagggcttccatgctcgaggcgctccagcaggagcacatccggaccctccgggccacggccacgcccacctggaagatcctgtacgtccacgccctgcgctacgccagcctccccatcgtggccggcatcgcgctgcagttcatccagcttttcggcggctccgtcatcgccgagcagctgttcgccatgcccggcctgggccaggcggtccagaactccgtcagcacccatgacgccccgtccgtgcagggcgtggtggtgatcgctaccgtggtggtggtcgccgtcaacctggtgctggaactcgccaccaagttcctcgacccgaagttgcgtgcctcatgatccccaacgttgctcctgcctccgcagactcagcggagccgacgacggctgccgtccctccgagggcaccccgccaaagttcggcgaagaaattcgccggcaacaagctgttcgcctctccggcgagcgtcgccggggtggcctggttggccgcactggtggccgcctcgctgaccgcaccgctctggctgccctacaaaaccgaggaccaggacttcactgccgtcctgtccggccccaccgccgcccactggctcggtaccgacgaactcggccgggacctcctcagccgcatcttcgcttcggcggccggtacgctgggaacgtccatgatcacggtgattgtcgccgtcgggctcggcaccctcctggcgatgctggcggcagccgccggtgaccgcgtggagaccgtcatcagccgcgttaccgaagtcacgatgtccctgcccggcacggtgatcatccttgccgtcatcggcgccgtgggtaccaacatcccgctgatcatggccatcctcggtgtgctgatctccgcaggcatgtaccgggtgatactgggccaggccaagtccctgcagtcccagctctacgtggacgcagccaaagtggacggcgtcagcactatgggcatcagcctccggcatgtcctgcccggactgacgaacaccattgtggtgcagtcggccctgatcttcgccgtcggcatgctcatccaggccggactggcgttcatcggcttcggcccgcccattcccgaaccgagctggggcggcatgatccagggcgcctcccagaacgtctataacgccccgtggctcatggttcccaccggtgccgtgctggcgctgacggtcctctcggccaatgcgatcggcaacgccctcggcaaggcacccaacagcacggcgtcgcacctgccttccgccgcggcccggcgtcgacggaccatgtccgtaaaaacagcggttgcggccatcgccgcaaccgcgccaactccggcaggcagcacggccgcgaagaacacgcttagcgtgcgcaacctctccgtcggcgttgactccacaggtgcgggcaacggagtccgcctggtcaccgacgtctccttcgacgtcgaacccggcaccgtgctgggccttgttggggaatcgggctgcggaaagaccatgactgcgctgtccctgctggggctgctgccctccggagtttccgtgaccggcggacagatcctctggaacggcaggaacctggctgctgcaacggacaaggacatggaaagcgtccgtggacgtgaggtcgcgctgatctcgcaggaacccatgcgcgccctggacccgatgttcacggtgggctaccagctcaccgccgccatccggcgccttcggggaatgggcagggccgaggcgaaggccgaagcggtgggcctgctggagaaggtgggcatcgtggacgccgcccgcatcctgaagacctacccgcaccagatcagcggcggcatggcccagcgcgttgccatcgccctggccctctccggccggccccggctgcttgttgcggacgagccgaccaccgcgctggacgtcaccgtgcaggccgagatcctctccttgctgcgcggcctggtgaaggacaccggcatgtccgtggtgatggtcacccacgacctcggcgtcgtggccgacctctgcgaccaggtggctgtaatgtacgccggcgaggtggtggagaacggccggacggacagcatcctggaaaacccgcgccacccctacaccctggccctgctggccgcggacccgcacgccaaccacgccgctgacatgcccgagcgtctggccaccatcaacggccaggtgccccagcccaaggactggccaagcacttgccggttcgccgcccgctgccagttcgccggctccgcctgcgtggtccccatcccgctgctcccctccggaaccggggacggactggtgcgctgcgtcaaagcggacgaactcgccgtcgagggcctggactgggtggccaccgaggttgccagccaccatgtcctgaacctggtggaaaccccggctgttgcaacccggactgtagaaaaggatcatgcatgagcaccgcaacgtcagtccgtccggaagcgccgctgccggccgccgcccagcccctgctggaggtcagggacctggtggtccgctacggacgtggacgaaaggcaggcgccgctcccgccgccgtcgaccgtgtcagcttcagcatcgcccccggtgaaaccgtgggactggtgggggagtccggctccggcaagtccaccatcggcaaagcgatcctgggcctgcaaaaggtctcgggcgggtccatcacctaccagggcaaggacatcacgtccgccggcgcgtcccagcgcagggcactgggcggggaactgcgggccgtcttccaggaccccaattcctcgctgaacccccgcaacaccgtcggctcctcgctggctgagccgctccggctccgcggagtgggggcggccgatgcccggcagcgcgccgaggacatgctggaacgcgtgggactcccgcgcgaggccgtggaccggtaccccagccagttctccggcggccagcgccagcgtatctccgtggcacgcgccctgatctgcgatcccaagctggtggtctgcgacgaagctgtcagcgcactggacctctccacccaggcgcaggtgctgaacctcctggccgacctgcgcgatgagcgggggcttggctaccttttcattgcccacgacattgccgtggtccagttcctggcccagcgcgtggtggtcctctaccgggggcaggtcatggaaagcggacccgccgccgccgttacggaggaccccaagcaccccttcacgcaggcgctcgtggcagcatctccggtgccgcggcccgccgagcaggcggcacgccgggaagcccgggagtccctcggcgtccggaccggggcggctgccactcccggcccgggagggtgcccgttccggctgcggtgcccactggctacagacctctgcgccaccgagcggcccgcgctccggcaggtaggcggctccgccgtcgcctgccactacgcctagacaacttttcgccaccttcagaacggaccgctccttccatgacacccaccccctggcacgcagccatgatcacccctgccgaggacttcgacggcgccccgctcctgcggaaggcattccggcttgcggaggggcacggcgcggttgcccgggccaccctgcgggccacggcgtttggtgtgtatgaggcccttatcaacggcgttccggtgggcggggacgtcctgagccccggctggagctcgtacgaatggaggctccgctaccgcagctacgacgtgacgtccctgctggggcccaccactgtggtcggggtgtccctcgggaatggctggtaccgcgggcggctggcctggcacggcatgtccaacctctacggcagcgagctgggcttcttcggacagctggacatcgagttcgaggacggacacattcagactgtggcatccgattcctcctggcagtccggcccttcagcgaccaccttcaatgacctctacgacgggcagaccatcgacgcccgccggaaccagaacggctgggccgaaccgggctttgaccccggcactggtcccggcagctgggcgggcgtccgcgctctggagttcgacgtcggccggctggctgagccggtcagcccgcctgtggtgcgcagcgaggtcctcaagccggtggagatcttcacctcgcccagcggcaaaatactggtggacttcggacagaacatggtgggctggctccggttcaccgtccagggcgaggcagggcacaccatcaccgtccgccacgccgaagtgctcgaggacggcgagctgggtgtccggccgctccgctccgccaaggccgcggacacgttcatcctgtccggcggcgaggacttcttcgaacccaccaagacgttccacggcttccgctacgccgaaatcaccggctggaccggggagctcacggaaaactcgctggaggcggtggtggtccactcggaccttgagcgtacaggcaccttcgagtgctccaatgagctggtcaacaagctgcaccgcaatatcgtctggggcctgcgcggcaacttcctggacctgcccaccgattgcccccagcgggacgagcggctcggctggaccggcgatattgcggtcttcgcgcccaccgcggccttcctctacgatgtcaggggcttcctgcaggattggctcctggacctcgccgccgagcagaaagcggccgatggcctggtgcccatcaccgtgccggacgccctgaagtactgcccgcaaccgcccgaattcccggcgccggagtcttccgcgctgtggagcgaagcgtccgtctgggtgccgtgggcgctctgggaggcctacggcgatgacaccgtcctgaagaaccagtacgaatccatgaccacgcacacccgccgggtggagggcctgctctcacccaccggactctgggacacgggtttccagttcggcgactggctggacccggacgccgagccggacaagccgtgggacgcgaaggcggacaccggcgtcgtggccaccacgtgcatgttccgcaccgcttccatcactgcccaaacggcgcggctgctgggcctcgaggaggacgccaaaaacttcgaacagctggccgcgcgcgtccaggcctcgttccttgagcactacgttgccgccgacggcaccatccagagcgactgcactaccgtctacgcactcgcgattgccttcgggatccttcccacgagcgggctccgcgatttcgccggtgaacgcctcgccggtctggtccggaaaaatgattaccgcgtctccactggcttcgcgggcacgccgttcatcacccacgccctcaccgacaccggacacgtggacgaggcctaccgcctgctcctggaggagggctgcccatcctggctctaccccgtgaccatgggagctaccaccgtgtgggaacgctgggactcgatgcttcctgacgggagcatcaaccccggccagatgacgagcttcaaccactacgccctgggtgcggtggccgactggatgcacaaaacggtcggcggcatcagcccgctggcgccggggtacagcaaggttcggatcgcacccgtgccgggcaacggaatcgactgggcaaagacctcactgaagaccccgcacggaaccgtccgcgtggagtggaagctcgacgacggcgcgttcaccctcgaggcgactgtccccgagggggtggcggccgacgtcgtacttccggacggtgagccccgcaccgtccagggcggcacccaccgcttcacctccaccgcggcggccgtcgcgacgcgggggtaggcgctgccgccgcggacctccgcaccctctcgcagataatgtgcgtttttcggcgaccctctctcggatgatgcgctgttttcccgaaccctctcgcagccgatgcggtcttttcgccgacccctcgcacatccggttgggggtgcggtcgtccgaagacggcagatgatagagggttgcctgaaaaggcgcaggaagggatagagcgtcagccttgggagtgggtccgcgcgtcagggctggcctccgcgtggtggccgaggtttcgcgagaccgcacgtgccgcggcgcggacggccggggccaggacattggggggagtggaaccgtccgggaccacgatggacagtgcggccaccaccgagccctgggcgtcgaaaatgggcgaggcaaccgagacggtccgggagggcaggctgcggcggatcatggcaatgccggtgcgccggacgtcagacagggtccggcgcacctgcccctcgggcatatcgggaactcctggctcgttctcagggggcttccgcaggatggtttcctggaactgctggtcggcgccggcaagcaggaccagcccgacggcggtggaccgcagcggagcccggccgcccacccggtatgccacctcggttgcgtccttggaggacagccgttcgatcagcaccgcctgctcgttgtcgcggacagccagcaggacatggtggcgggtcacctcgaacaggtcctccaggtaggggagcgcgatttcccgcacgccgtgcccgcgaggcgacagggacgcgacctcccacagccgtacccccacgacgtaccggccgtcgtcgagcctttccagcgcgccccacgcgaccagccgggcaatcagccgcagcgcggtgggtgcgggcatcccggcgtagcgggccatctcggagagcgtcagggcccgacggcggtcggaaaagacggcgagcaggctcagcgcgcggtcgatcactggctcgccctgcttgggccgcttgccgcgggcgggggtggtttcggtgtccggctgggccgtcatggcttgcttccttgcaatgtccgtacgtgagctaccccacaatactattccaaccaatgaaagtagcgtgtggggcgcacgggccagcgcaggaagctgggatagtgaccgccactcgttcaggagcccgcccgcaatgacctccaccagcctcgacgcagacggcaaaacccggcccagggaacggccggagcccacccggctccgcgtggaacacctgcgggaggctttcgggataacggtagccaaaccccggatgagctgggcgccacctgccggcacggtccagcagaccgcctaccggatcacggcaagcaacggctgggacaccggccgggtggcgtccgcaaagcatctggcggtcccgtattccggcccggcgctgcaatcgcgcagccggttcgagtggcgggtgcggacgtggaacatcagtggtaacggcaccgaaaccgtaagcgcgtggtccgaaccgatgccggttgaactggggctcctgcatccctccgactgggcggcgcaatggatcggccccgaggaaccggacggcccggcccccggcgaacgccccggttatgccctccataagaccttcatcctggacggggcgccggagaccgcccgcgcctacgccaccgcccacgggatctacgagctgttcctgaacggtgagagggtgggcgaccagcagctcacccccggctccaccagctacaacaccaccctccaggtccaggcctacgacatcacggcgctgctgcggcccggcaccaacaccatcagggccgtcctcaccgacggctggcaccgcggaaccttcggatacacgcgcgacgccgacatgtacggcagcagcacggccctccttgcgcagctggatatacagtccggggaaagcaggaccgtcatcggcaccgacggatcgtggcaggtgtcccggacggagatcctgagcgcggacctgatggcagggcagcggacggacttccggttgctggacagcacggccgacgacggcgcaccttgcggaagtgccgcggaggccggtgccgccgtcgtccgccccgggagctacgaaaagctgaccggacccgtggcgccgcccacccggatcgtggacgagctcgtgccggtatccgtcacccggctggccagcggccaccaggtggtggacttcggccagaacatccacggctgggtgcggctcagcaggctgggcgggccgggcgagctggtaacccttgtctacggcgaggcgctggacgccgacggcgaggtgacccaggaccatctgcggccgcacgacttccgccacccggggcagttcctgcctgccgggcaggttgacatggtgacggcctcgggcgcgccaggggagatgtttgaaccgcggcacgccacccacggcttccagtatgtgtccgtgcagggccttgccccggacctcgcggcggaggacatcagcgcctgcctgatccacaccgatctggagccactgggcaccttcacctgcagcgacgagcggctgaacaggctgcacgggattgtggactggagcttccgggacaatgcctgcgaggtgcccaccgactgtccacagcgcgagaaagccggttggacgggggactggcagctgttcgtgcccaccgccgcgtacctctacgacgtcaccggcttctcgcggaaatggctgcgggacgtccgtgccgatcagtggcagaacggcgtcatcgccaacatctcgccgtcgcccggccccggggttacctccgctgagttcatggcgttcaccaacgggtcctgcggctggggcgacgcgatcgcgatggtgccctgggagatctacctggccaccggggacgccgggatcctggctgaaaactgggacgcgatgaaccagtggctcggcttcgtccgcagcactgcggagtcacagcggcacccgtcccgggccgctgccggcccggttccggcaccgcacgaaaagtacctgtgggacaccggcttccacttcggcgaatggatggagccggacggtccggaaccggacctgttcgccgcccgctccgcagaccacggcatcgtggccaccgcctattaccggaacaccactgcggtcatggcccaagctgctgcggtcctgggccgggcggaggaagggcgggcactggcggaactttcggacaacgtccggcaggcgtgggagaaggaatacctggacccggccggccaggtaacccagccaagccaggccaactgtgtccgcgccctcgcctttgacctggtcagcccccagcgccgctccagtgtcaccgcccagctggcctcgctcatccgaagcgccggcacccacgtgggcaccggcttcctggcgacgccctacctgcttcccgttttggcggacaacggcgagctgggcctggcctacgagctcctgatgcaggattccgaaccttcctggctgaccatggtggaccgcggcgccaccaccatgtgggagctctggaacggcatcgatgccgacggcgccgcgcaccagtctctcaaccactacagcaagggcgccgtggtctccttcctgcaccgctatgcggcaggcctcaggcaggcgcccggcagtgcgggatatcaacggatcatcatcgagccgcgccccggcgcaggcctgacctccgcggcaacgtcccacatcggtccgcagggacgcattgacgtggcctgggagatcgacgacggcgtgctggcacttcgggccacggtaccttccggaacaaccgccgaagtccggcttcccggtgaacctgtggccatcgtcggcccggggaccgattcctttgtggtcgccgcggacggctccacaccacacttccaccaagcaaggagcacaccatgacagtggacgcagccaacgacaccaccggcatcaccgggactggacagcggactgaacagccggagcctgcccgcccgggcggcgtggacgtcccgccttttcccgtcttcgacgcgccgggtgttcccgaacacgtctcggacgtgtccgcggtacaccgggaagtcacgtacgcccgggccatcggtttccggccgttgaagatggacatctggctgccccggcaggcagccgggcccgttccgctggtggtatgggtgcacggcggtgcgttccagctgggcgaccgccgcgaactgccgcccaccttcgcccccgactccgtgttccggctgctcaacgaggccggcatcgcctgcgccacggttgactaccggcactccctggaagcaccgttcccggcgcaactccacgacctcaaggccgccgtccgctacctccgggaatacgcggatcacctcaacatcgattccgatcgcttcggcgcctggggcgaatcagccggtgggcatctggcggcgctcctgggactgaccgggatccgggaggaccttgacggcggcctgggtgcgcagggccacgccagcggcgtcagcgccgtcgtcgacttttacggcgtatcctcgctggtggacataccgcccatggacatgccggagggcgtgttcccgccggcattgacggccgccgtcccggcagggatgtccctgcagcccgagcagatgctggtgggtggctccgatgaccgggacctgctcgcggccgccagccctgtcagttacgtggcccccggggcaccgccgttcctgctggtccatggcgacagcgacggcctggtcccgcactcgcaaaccgacctgctggcagccgcgctcgccgatgccggagtggaacacgacgtggtgaccattaggggcggcgaccactgcttcttcggtgccgaggaccagctggacgccatcctggccgccgccgtcggctacttctcctggaagctgggccggccatgactgccccggaatgggatatcacggctgccagccccgccggtgatctggcgccggacgcaggttttgcccagcacctcgctgcccccgaaggcccgcagaccctggacccttcgcaaccgccgccggtggggccggacgtccccatccgcatggccaccgccaacggccgccacggcccggtccggatccgcatctacggtgaagccacgtccccgcccggccccgccctgatgtggctgcacggcggagggtttgtcagcggcagccctgacatgccggagtcggattacctggcccgtgtgctggcccgggcggggacgcctgtattgtccgttgaataccggctggcccgcgacggggtctgcttcccggtcccgcacgacgacgccctggccgcctggttctgggcgcacgagaacgccgaatccctggggctgaatcctcgcttgctgtgcctgggcggtgccggtgccggcggcaaccttgccgtgggcgccgcgctctacctggtggacgccggaaaaccgctgccagcgaaacttgtcctggcataccccttcctccacgccgagcttccggcgcccgcgcagggtctggaccaggacgttatggcgggactgccgcgccaccttcgcttgacgccggaggactgcgtgcggcaggccgagaattacatcggcggtccgctgagcatggcgtcgtcctacgcgatgccgggctacgccgaccctgccggactgccgcccacagcgatcctggcctgcgagtacgacgacgtccgcggctcctcggagcgcttcgcctccgacctgcagcgggccggcgtcccggttgcctacttcctcgctgaaggggcagtccacgggcatctcaacctggccgcaggcaccccggaggcacaacctgccctggacttccttgcgaaggagctggcttcggcggcggcctgacggcccccttttattgccgggtgagcgcctggtccgctctggtgggcagcggagcgtctcccgcctcgtgcgtactcgaccagatctggcccatctcttccgtggactgttcaacgattctgctcatggccgcgtgggctgcccccgcctcgccgcgctggatcgcgctggcaacgtccacgtgcagctgcagggcttcgtggtccggcaggtgcggcatcaggccatgctccgtccggccggtgaggacttccgccacgaggttttgcagctgggaaaacatgggattgccggaggctttcagcaccgcggcatggaactcaacgtccagccggaggaactcctcctggtctccgcgttggccggcagcccataagcgcgctgcctgggagacgagttcgctgccggcatcccaggaggcacgttcggccgcgagtcgggcagcctgcggctcaacggctccgcggagttcattgagcgactgcaattgctccagccggtgggaggaggccagacgccagcggatcacctgtggatcgtagaggttccaggattcttccggctgcactaccgtgccgaaccggcgccgggattcaagcatgcctttggacgacaatacccgcgcggcctcccgcactaccgagcgggacacactgtgctgcgcctccagctcatccagccgcagaacggaattcggagcaaaacgcccgtccgcgatggcaagccccaagctctcaaccagcgcagcatgcaggtcgattggggactccgcctttggggttttcatggataaatcatacggctctcttacaaagggttgtctaagtctgccttatttctctatgatcgcttccatggcagatgtaaagatgcatttgcagggcggctggacagtgacgtcagccctcagaaaacaagggagtcgtaatgaagcgacgttcaattgtgaagtacgcggccgtcgccgcagcactttcaatgggcctgaccgcatgcagtggcagcggcagcgacgatgccaaggaagcgggcaccgttcgcgtgaccttggccaaccatgtatggaccgaaggcatcaaggcagccatccccgaatttgagcagtccagcgggcttaaggtcgaactgacccagctcggtgaagaccagctctccgaccagtacaacgtcaagctcaacgccggcagcgacgaaatcgacgtcatgatgtaccgtccgctgcaggaaggcaaggcgttcgcgaagaacggttacctcgcggacctgaccgaaagagtgtcctctgattccggttgggactggaaggactaccaggaaggcccggtcaaggccaccaccgtggacgataaagttgtgggcgtccccatcatcaccgaacgcgaagtgttgtactaccgcaaggacctgctgcaggcggccggcctggaagttcccaagacgatggaggagctcgaagctgctgcgaaggcaatcaaagagtcttcgccagacactgcgggcttcgttgcccgcaccggcaagtctgcggcagtcacccagttctccagcttcctgtatagcttcggcggcgactttaccgactcaagcggcaagtccgctgtcaactccgatgccgcgaaggaagcctacgcctactacggcggcctgatccgcaactacggccccgccaacgtcagcaccgacatgagctggcccgaggcgatggcaattttcacccagggcaaggccgccttctacaccgaggcggattcgctctacaagaacgccaccgacccggccaagtcaaaggttgccgacactgtaggtttcgctgccctgccggccggccccgctggttcgaagccgtacaacatcccgtcctggggcctggccgtgaacgaagcgtccggcaaccaggagaacgcctggaagttcatccagtgggcaaccagcaaggaacgcacccttgccgcccagaaggccggtgtccccggaccccgggcttccgtgtgggctgatgccgagggaacctccacgtacccgaaggacctcgccgaagccatcgccgtcagcgcaaagaacggggtgggccacgaccgtcccgaggttgtcaccgtaggcaaggcccgcgaaatcgtgggcgagccgatcgtcgccagcatcaccggcgcggatccggctgccgcagccgatgctgcccacgaagccttccagaagttcctggacagcgaaaagaagtaacgcctccggcctgtgcgcctgcgtctatcgcagcctgcatcacagccctgcgggacggcagccttgttgccgtcccgcagcggcccgcgaccccccccaaatccttaggtgaaccatgtctgtaacgaacgccgcccgcagtgctccggcccgcagcgccggccgccctcccagcttgggagggaatatctccgcctggtccaaccggcaccgcaaatggctttttgcggcccccgcgatgatcttcgtcggcgtgctgattgtgttcccgctggtgtggaccctgtacctcagcctgaccgattcgcagggctccgtccgcgccgctacagagttcatcggcctccagaactacctcaccgtcctcactgacactgaccggttctggccggcggtgggccgcacaatgacgttcaccggtgttgcgctggtctgcgaggtggtgctcggcatgggtatcgcactgctcctttggcgccccttccgcggggaaaagtgggtccgggtggccatcctgcttccgctggtggcaaccccggttgccgtcggcatgatgtggcggctgatcttcgaccccaacatcggcttcgccaaccagctgctcggcatgatcggcattccgccgcagccctggctttccgggcaggacaccgctcttgggaccaccatcttcatggacgtgtggcagtggacccccatggtggtgctgatccttcttgccggcctgacatcgctttccgatgaacccgacgaagcggcaagggtggacggcgccaacgccttccagcgcttcttctacatcacgctgcccctcatgatgcccaccgtcattgtggccatcctgctccgcggcatcgatgccctgaagaccttcgacatcctgtacgccaccaaaggcaaaggcggaggatccttcaacgaagtggaaaccctgaacgtctacgcctacggcctgagcttcgactacaaccagtacgggctctcctccgcggtgctgatcctgttcttcatgatcatcatcggctccatgtggctgctgaccatgcgcaagaaagcggtaagcaaatgaccgtcctgacccccaaccaaacgtcagcaggaaagccccaggtgcttcaccgccgtcgtaagccgctggcgacccgcgcctacaaagccttccgcgttgcagccctgatcgcagtggtgctgttcctgatcgcaccgttgttctggatgctgttggcatccttcaagaccaacgtggatatctacgacaccggcaaggccctcttcttctcacccaccggcgagaactacgccaacgtgctccagcggaacaattacttcgtcttcatcttcaacagcttctgggtggccttcgtttccaccgcactgtcgatcgtgctcggggttcccgccgcctacgcgatgagccgcttcaccatgcaccgttcggccctggtggtcctgatggcccgcgtcattccgggtgtttccctgctggtgccctggtactacgttttttccaacctgcgcatggtgggccggttcgaagtgctgatcctcagccacatgttcgtcgcgctgccgctgattgtctacatcatgatgagctacttcgattccctgccactggagctggaggagtccgcccaggtggacgggctcaccccgatcggcgccttccgccgcatcacgctgccgctttcagtcgccggaatcgccacggcggggattctctcgttcatcttttcctggaacaacttcatgtttgccctggtgctttccggggccagcaccaagacgctgcccgtcgccattttcgactttgtctcctatgccagcatcgactggggcgggctgatggccgcggccaccgtggtcaccatcccgatcatgatcattgcgctcttcacgcagaagtacatcgtgtccggcctcaccgccggtgcgaccaagggctaggaaacatatgaccctcatcagcaggatcgaaaccttcctcgtcgcgccgcgctggctcttcgtccggatcgagaccgcgagcgggatcgtcggctggggcgaagcaacctgcgaaggccgcagcgaaaccgtccgcaccgccgtcgagcagctcgccgaactcctgatcggcaacgacgcgctccggatcgaggaccactggcaggtgatgaccaaagggtccttttaccgcggcggccccatcttggccagcgcggtctcgggccttgaccaggccctctgggacattgccggcaagtacttcaacgcgcctgtccaccagctcctgggcggccacgtgcgcgaccggatccggatgtacgggtgggtgggcggtgacgagcccagcgaggtcgccgaacagatcagcgcccagctggaggtgggcctcaccgccgtcaagatgaacgcaagcggacgcatgagccccatcgcctccgtcgcagagatcgacggcgtcatccgccgtgtcgccgcagcacgcgaggtccttggcgagcaccgcgatgttgccgtcgacttccacggccgcctcagccttgccaatgcccggcgcgtggcgccgctgctggaaccgtaccggcccttcttcctggaagaacccgtcgtcccggaaaacacgcacctgctgcgcgagttcacctcgtccaccaccacgccggtttcgaccggtgaacggctctacagcaggcaggagttcctgcccgcccttcaggcaggtatcgccgtggcccagccggacctctcgcacgcaggcggcatcaccgaggtccgcaagatcgcctcgctggctgaaatctacgaagtccagctggcgccgcactgcccgctggggccgctggccctggccgcatgcctccaggtgggtttcgcgacgccgaacttcctgatccaggaacagagcatcggcatccactacaaccagggtgccgaggtccttgactatgtggtggataagtccccgctgaagttcgtggacgggcacatcgaacggttcaccggcccggggttgggaatcgagatcgacgaagccgtggtccgtgccgcagacaagcgcgggcatgcctggcgcggtcccatctggcgcaacaccgacggtgccttcgccgagtggtgacggccgggattgcgggcaggcagttggacacacctaagaaggagaatcccagtatggagaacaccctgacccctcaggcgctgctggccggggtaggtaggacccggctgcttgccatcgtgcggggcaccgacggcgcggcggcggcaaaggcagccctcgccgccatggaggagggcttccagtacgtcgagattgccctcaccactccgggcgcgctggcggccatcagcgaggtgcgggcggaagctcccgccgaatgctttgtgggtgccggaacagtgctgacgaagcaggacgtcgacgacgtcgccgtggccggcggccagttcatggtcactccgtcactcgcgccgtccatcgaagaagctgccagccgcggcctcgcggtcctggccggggccctgacgccgagcgaggccttcgaggctatgaaccgcggcgccaccgcggtcaagctcttccctgcctccattggcggacccggctacctcaaggcgctccgcgatcccttcccggacatcccgttcatcgcggtgggcggcgtagggctcgatgaggcggctggatattggagcgccggggccatcgccgtcgggctcggcggcccgctcttcggtgacgccggatccggtggcgaccttgctccgatgcgggagcgcgcccgccgcttcgttgccctcgcggctgaatacggcggccgggcagctgcggagcgcctgccgtgactgccggcgtcggtaccgctccggttgacctcctgaccctcggtgaatccatggtctcgctgcgctccgccggtccgctctcaaccggcggtgccctgaccatgcatgtggccggcgccgagtccaacgtggccgttggcgtcgccaggcttggccacagcgtcagctgggcaggtgtggtgggcgcggatccacacggagagttcatcctccgccagctccgcgccgaaggcgtcgtgctgcagcaccgcgaagaccccgcccgccggaccggagtcatgttccttgaacagcgcactgccgacatcacccgtgccttctattaccgctccgcttcagccggatcaatgctgggccgggaagacgtggaccgtgccctcgagccaggggcacgcatcctgcatctgaccggcattactgccgccctcagccccgaagcccgtaaagccgtggagtacgccgcggaacgcgctgccgccgatggcctggtggtgtccctcgacgtcaactaccgcagcaagctatggtcccgggaagaagcgcgggaagtgctgacaccactggtccgccatgccaccattctgattgcatccgacgacgaactgggcctggtggccactccgccggccggcggggaagacccgggcgcgcatgaagcggcgatggcggcggaactcctgggactcggagtgcgcgaagtggtggtcaagcgcggggcggccggcgccggtgtccacagcctggacgggcgttgggagaccccggcggtatccgtcaccagcgtcgataccgtgggcgccggcgacgccttcactgccggttacctctccgccctgctcgacggcgccgatatacccggacgcctcgagcgcggtgccctcaccggagccttcgctgtcagcactgcaggggactgggaaggcctgccttcccgcgaagaactgacactgctcgcaaccacgcccggcggaaccacccagcgctgacctttccgggctaaacccggcctcccatcccttccatcaagagagccccatcgctgtgaaaatcattgccgctgacgtcttcgtgaccagtccctcccgcaacttcgtgaccctccggatcaccaccgaggatggtgtgaccggtatcggtgacgccacgttgaacgggcgcgagctcgctgtggccgcctacctcaaggaacatgttgcgcagttgctgatcggtaaggatccgcaccggatcgaggacacctggcagttcctgtaccggtcctcctactggcgccggggcccggtgaccatggctgcgattgctgccgtggacatggcgctgtgggatatcaagggcaaattggctggcatgccggtctaccagctcctgggcggggcatcccggaacgggctgcgcgcctatggccacgcctcgggagctgacctgccgtccctgttcgattcggtccgggagcatctggagctcgggtacaagtccatccgcatccagaccgctgtccccggcatcaaggccgtctacggtgtggccgcgcaggcccaggcctcgggcgaacgctatgactacgagccggccggccgcggcgcgttcccggtggaggaggactgggacacccgggcctacctccgccacctgcccaccgtgttcgaggcggtccggaacgagttcggcccggagatcccgctgctgcacgacggccaccaccggatgacgccgatccaggccgcgaagctgggcaaggcgctggaaccgtatgacctgttctggctggaggactgcaccccggccgagaaccaggaaggcctgcgcctggtccgccagcacaccaccaccccgctggccatcggtgaaatcttcaacaccgtctacgattaccagaccctcatcaaggagcagctgatcgactacgtccgcgccgcgtccacccacttcggagggatcagcccgctgaagaaggtgatggacttcgccgcgcagtaccagatcaagtccggcttccacggccccaccgacatttcaccggtgggcttcgccgcgcagctgcacgtgggccttgcgatccacaactacggcatccaggaatacatgcagcactcggacaagaccaacgaggtcttcgagcagtccatgaccttcaaggacggctacctgcacccgggcgacaagcccggcatcggcgtcgaattcaacgaggaagccgcggctgcgttcccgtaccagcaggcctacctgccctacaaccgccttatcgacggaacggtccacgactggtaggggtgccgcccgccagttgccttcggtggatggcggcgggttggcgttactgcccggggagcccccttggaagacgcccagggggctttcgcctgccgtcctccaggtgtcggggcgggaaaggcgaaaagcctgaagccgtttcattcagtgaaaccgcccatgcggacaccgccggccgtcccccacagttgagtcagaacgcggtccacatcacaggcccgcaggcacaacaaaacgggacggaacggcgcggtgcacatggagtcgacgatgacggcagggcggatcctcaagggaattgagtttgcacacccggatggctttgccccgctgctgctggacctgtacctgcccgccggttccgattccgtttctgatgccgcttccggattccccgctgtcatccacttccacggcggcggatggcagacgggggagcggtcatcgctgggacccgccgtggacggtttcggactgagccccatcgagcagctggtggaggccggcttcgtggtggcgtcggccgactaccggctcagcgccgttgccacgttcccagcccaactgctggacgccaaggccgctgtccgctggctccgctcgcatgctgccgaatacagcgtggacccgggccggatctacgcctggggagactcggccggcggccacctggccagcctggtgggactcacggcgggtgccggcacggacggtgaaaccgacgacaacatcgcggccgtcgctgcctggtacccgcccacagacctgaaccgcatgggagagcaggcccggccggacgccgtcgcccgcgccgacgacccgggatcgcgggaggcgctgctcatcggcgcccagcccgccgatgcaccggacctggctgcagcggccagccccgttacctacgtgcgtgacggcgccccgccgttcctcctcatccatggcactgccgaccggttcgtccccgcagcccagtccactaccctcgccggcgcgctccaaaagacgggcgccgacgtcgaacttctcctgctggaggacgcggaccatatgtggtcccttccggacgggagccaggctgccgcacggcaggccaccgccgccaccatcgattttttccgccgccaggcgcggaaacactgatctcttcgcaatctgccggcgcgctcgcgcccggcaagacctgaaaggccctccatgcagttcatcggcatcacccaccacggcgaaccctgggcagccgccctggcggactcccgggttttcccactcgcccccgtcaacgacttctggtccgaccccagcggctggctggacaaagccgcctcactcccacctgccgtgtccgcttcccagggttccgcttccaacgcgtccgacgccggcagctggcaggcgcggagcagcgtcaccgaagtgcccctcgtccccgcctccgcacgggtaatctgcgtaggcctgaactacaaggcccacgctgccgagggaagctacaacgaccaggagctgccgccgtaccccaccctgttcggccgctggacggcgtccctctccgtaggcaacgtccccgtcccggtacccgccagtgaagccggcctggactgggagggcgaagttgccgcgtacatcggtcggcgggtggaatccgcggacgaggaatccgcggccgaggccgtcttcggctactccaccttcaacgacatcacctcccgcaccgcgcagaaactcacctcccagtggacactgggcaagaacggcgacttcagcggacccctcggaccgctggtcagccgcgacgaggtgggagacctccgcgacgggctccaggtccggacccgcgtcaacggcgtagaggcccagaacggcaacaccagggacatgatcttctccgttcccgaaatcattgcgttgatcagccagaccttcaccctgcatcccggtgacgtgatcgccaccggcaccccggaaggcgttggctacgcccgcaccccgcagtggctcctgcagcccggtgacaccgttgaggtggaaatcgacaggctcggcaccctggtcactcccgtgggagacctcacgctccggagccgtgcctgatgggcgccctggccgccgcttcccgggaacagctcccgggggaggcgcaggtcctgatttccggcgggggtcccagcggtctgttcctcgccctggacctcgcggcgcgcggcatccccagcaccgtgattgagccccgcagttccgtggaccacaccaggccgcgggccaaaaccaccaacgcgcgcaccatgacccacctccgccggctcggcctggcggacgcactgcgcgcagcggcgccgctcccggtggactatgcgcaggacgtcatcttctgcacccgcctcgccggacccgcagcccatgagctgcgccggttccggaactccttccagctggtccccggccgctacggcccgcagcccgaatgcgggcagcaggtcccgcagcccgtcctcgaggaggtgctccgcgccgccgcagcccgcaacccgctggtcaccttcatcaccgggtggagcgtcacggaagtacgggaagttcggggtgcggcaggccaaggcgccgcaagtccggacgttcaagccaccggaatccaggccaccgcaccgctgtacgccgccgtcgtcgcggacgtctccggcagcacggcgaccatccggagcagctatgtgatcggtgccgacggcggttcctccgcggtgcgccgcagcctgggcatccggctggaaggaagctccgctgcactgtccaacatcagcatcctgttccgctccaaggagcttggcgcggccatcaccctggattccgccgtccagtattgggtggttgggtcagaggccgccggcatggttggacgaatggacctggccgatacctggtgggccatcattcagggagtggaccccagcaagcatgtggcccctggcggcgccgccgccctggtccgctccctggtggggacggacgttgcggacattgacgtcgacgtggtggccacggatccctggacggcgcgcatgctccttgccccgcagtacagccgcgggaacatcttcctggtgggcgacgccgcgcatttgaacccgccctggggaggacacggctttaacacctgcgttggcgacgccgccaacctcgcctggaagcttgccgccgatattcagggctgggcaggcccaggcctcctggacagctacggcctggaacggcgcccggtggcggcgcggaccatccgcgatgccgccgcaaacggcaaggctctggcgtaccacttcgccgatccccggctggacgacgacggccccgagggcggtgcggcacggcgggcggcatatgaagcgctcgctgttaagcagagcgagtttgattccctgggcctggtgctgggttatacctacgctgattccccggcagtggcgccggacgggtctccggtccctgccgaggaccccatccgctatgttgcctctgctacccccggcgcactgcttccgcacgcctggctgcaggattccacgtccctgtacagccggctgggcggaggcttcacccttatggccgacgacggcgcgctgggcggggtgcacggaggccatgctttcgccgaggttctggaggccggtgcccggcagggcattccggtaacggtagctgtggtgggtccggccgacgacggcaccccgctgtccgaactgtggggcgcccccgcggtgctggtccgtcccgaccagcacgtggcgtggcgcgggagttcagccgaggccgcagcggcagccttgtccgttgcagccggcttcgcaccagccggggcatcaccgcagggcacatcattcagcagcagccaggacgaagccaggagcaactatgtcgacgccgtcattccgtgattacctctttgcccccgatcatccccgcgtcgcggagatcaggggcctggatgcccgcgggtacgccgaggcggcaaagctggactccttcgccggtcccatgatcgagggttggaagaagctgtacccgcaacccttcgtgggcatcaccagcgacggcgtgcggcgtgaggggttgtttccgctggcgccggccagggctggcgaggaggcgcccaccgcggagatggtggcggcagcccggaagctcctgggagtggcggcgcccgaacaggcgaagaagctcacctacgccgtggacgccccggaatggcagagctgggcgaacccggaattcatgcagcacgataccggcctgcggctggatgagctggagacgccggtccgcgacgccgccctggctgtggtggaggcatccctgagcgctgagggctttgaactggtccgcaacctgatgcgcatcaacgggttcctgggggacctggtggagctgccgctgctgatgaacgagttcagctacaacttcgcgttgtacggagagccgtcggaaactgagccctggggatggcagatctttggccaccatgccgcgctcaactgcctggtggcggggacccagctggtcatctccccggtgttcatgggcgccgaaccggacatgatcgacgacggcccgtacaagggcgtccgggtcttcaaggagcggatcgccctggcccgcgaactgatggcggcgctgccggcggacctgcgggcggaggccaccgtgtacgaagcaatggtggatccggcgatgccggaaggccgtatccatcccggcgacgaacgccaccttggagggtgtttccaggacaaccgggtaatcccctacgaaggcatccgggtcagcgacatgccggccgaagcccgcgccctcctggacgccgtagtggacgactttattgcctacctgccagcaggcccccgcgccgcccgccgccgggagatccgcgagcagtacggcgagagcttcttcagctggatcggcggctgggaaggccaggacgcgttctacttccggctgcagagtcccgtggtggtgctggaactcgaccaccacacgggggttttcctggacaatgaccagcctgccccgttccacatgcacaccgtggtccgcacacccaacgggaacgactacggccgcgaactcgtgaagcaatacccattgattgctccgtaactgccgttttcagggtccataccgacacctactcagcagtcgatggttcttaaaacccaaatggcccggacttcccttcggaggtccgggccttctggtgtgcctgtggttgctgggggtgtgtattcgcttcgggagcgctaggagatctccagtgcgacgcggcgctgcggcggcgggcccaccacggtgaggtccatttcggcctgggcgcgcccgaagccctccatgtccatgtaaggggtcccgccttcggtgtacatgtagtcctcggtgggcttgttgaagtactcaaagaacccgttgaagaccgacggcgtgaggaaccccagcatctgggtgttgtgcgagtccagggcgaaggagtggacggtgccggccggggcgtggacaaagtcgcccttggtcagcagcatttccctgccgttggcgtacagccacatccggccttccgtgcagatgaagttttcggtgtgttcggaatggaagtgcagcggaatgtagggcgtcttggctcccttggtgtgcacggcgaagtagttcgagccggtgttggccggccgggacaggtaggtgaacatcgtctggtagctggccagccgctcgccttcgtgggcgctgaggaagtaggggctctgcgtgggcggcaggccggcgtcgtgcttgaaggaaggttccacgcgctcaacgtcggggaaggtgatcccgaactccgcccccacctcagcctgttcctggaggccggccgtgcggcctgcacggaccggggggacgtgcgaatcgacaggggtgcccacccgctcgtagtaagcctcagccccgcccggcgtcatccagttcaggaagcgggtgtagtggctggccatccggtacgcgtgaggcgtgttcggcgggatgaccacggagtcgcccggggtgaggatgcggctttcgccgggcagccagacgtgaaggatcccgtcgaaaacgtagagcgtcttgtgctccaccttgtggctgacgaatggcgactctgcccccatgccgccggagatgtaggcggcgctgaagatcccgacggtgtctgctgcacgggcaatgaccgtcaccagctggccgttgatttcgtagcgtgcgccttcgcccgaggccatgtagtaggggacggcttcgccgggcagcgcgttggcaaccgggagctgcttgttcatttcctcaacgctgagggacatgggttccttctttccagtcagccggccatcgccggagcgtaacctccatcatgggtggctggcggcagtggccacgagccaggtttccaatgggtgaaagcccaacctggctcttagtgacggctgcggaagcggcgcagttccgcttccgcatggcccggcaaccctaggactcgcactccttgcagtacttcctgccgtccttttccctggcgagctggctccggtggtgcaccaggaagcaggacatacaggtgaattcatcggcctggaccgggatcacctggatcaagagctcctcgttggacagatccgctccgggcagctcgaagttgtccgcgagctcggtctcgtcaacgtcggcaatggcctcccgtcggcccgacttctcggttttcaactcctcgaagccgctgttcggctcgtcctcgggtgtcacccgcggagcgtcatagtcaactgacattggtgcgttctcctgtcggctggatgcagttcgtcctgaacagagcaacaacagaacgtgggccaaggatattccccgcccgacgtataggtagactgacctacctactgttgtccatcaaggagtttcctttgtccgctcgggatactgctgcgcacacgcccgtaccgtcgcttgccccgccgaagcgtccggcccgcgcgctactgcttgatgctgcagcgaggctcttctatgcccaaggcgtggccgccaccggtatcgacaccatcaccgccgaagccggggtggccaagaagagcctctacaacaactttgcttccaaggccgagctggtagcgacgtacctcgaggcccggcatgcggaatggctggggctgtacagccggcggctggaggatgccaggaatccccgcgagcgggtgctggccatcttcgatgcctacacggaccatgccaacgccgcctacctcaacgggtttcgcggatgcggactgctcaatgcggcagcggaactgcccgcaggggcgccgggccggctggcggtccggaagcacaaggaagaggttgaggagctgctcgtacttcacgtgaccgaggtgctgccggccggagacgggcgcgccgccggactggcccggcatctggccttcctcctggagggcgccatggcccgggccgggctcgagggcaatgacgcgtgcctgaaagagtgccggaccatcgctgcccggctgctggcggagctgtgaacacggcagccagttccgccaacgcgccgctctggggcgctttgtgcgtggtggcggcttccgtgctgtggggcaccacgggcacggctgcaacgtttgcgccgtccgtgagtccactggccgtcggtgcggtggccatgggagtcggcgggctgctgcaggcactgtacgcagccaacgcgataactgggcagtggccgggcctgctggaccgctggcgtttggtgaccctcggcgcggcggcggtggccgtgtatccgctggccttctacagttcgatgcggctttccggcgtggcggtgggaacggtggtgtccatcgggtccgcgccggtggcggccgcgctcatcgagcgcttcgccgacggtaaacagctcacccgccggtggatagcgggcgcgttgctgggcgtctcgggcgcagccttgctgtccttcgccgggcacgcgccggccggttccccaggcggttcctggacgtccctggccgggattgccttgggcctgctggccggcgccacctatgccttgtattcctgggcagcacaccgcctgatcggcggcgggctgtcgtcgcgggcggccatgggggccgtctttgggcttggcgggctgctgttgatgcccgtgctggcagtcacgggccggcccctggttgagtcgtgggtcaatttctcggtgggcgcctacatggccctggtcccgatgtttgccgggtacgtcctgtttggatggggcctggccaggatccgggccagcaccgccaccgggatttccctgcttgaaaccgtggtggccgctggactggcggtcctggtgttgggtgaacggctgcctccgcatggctggcttggcgccgccgtcgtcctcttcagcctctttatcctggcgccgcggcagtcagcccgcgtgacgcttcggccgccgtctccggccggggaaaggcttgctgagcagcaggccggtgcccagccccacgagtgaaagccccaggaccaccagcgcaacgatctggccgctgacgccggcgatcagcagcaccagcccggcaaggcctgcgagcgcgccgaaaaagaggtctgccctgaaccggggcgcggggtagccggagagcagctccatggccaggtgggggtcgtcggcgatcagccccagctccagctccttgagcagccgccgttcctcgtcggacattggcacgggatgcccccggtttcggctaaacgggatatcggtattgacgctaaaactcccatgccgctgcgtcaagaggcccggctgcatcgccgcaagcatcaatccaggacgtcgtaccgcagcacattccccaggaccctcacgccctgggtggggacgtgcggggtggacttggccggcggcatcaggtgtgcaacgggcagcccggcgagcaggaggcaatggtccgctatgagcctgcggtggcagcgccaccacacggtttcgctgcacatgatggcagtctgttctgactttgccgcagcaacgagctcttccgctgcagcggcgaagaccgcggtgcgcatgtaggcggcgtaggcccggaacgactcattgcgcagggcaacatcgggggaatcgggaggaagcttgcggaaaccaccaagccgccgttcccagcggtagcggattcccgcttccggcagccacgcctccatgctgtccttgccgaagtgggggtgcttcctgctgcccggcccgatccggacgtccaccagcgacgccacaccggcatcctgcaggcgcgaagcgaactccgcttgggaagcggtcccgtgaccgacagtgaacagggccctcacgcaagcaatgataggcacggctccgagccctctcccaacaggccgggctgaagggaccagccgccgggaagcagcggctccccgcatgtgaccaggccataatccacgccgggtttcgtctctgcgccgccctgcaataatctgaaccaatcggttgtgcgcgggggtgcaggcgcccggtgcaacaggcagcactgtaagttcgggcgacatcacaccagacgaggcggacacgcatgacggcttcagaccagcagcacccacagcgcacagggatcccaacagaccctcccgggcttgcgcccgcggcgggcggggctgctgccggcgtggccgtggacccccatttgctccagaaactggccgatgcgcatggcgtgggcacctcgttccagggctgggacggcctgccgcacactgtggctgaagagacgctggtcaaggtcctggctgccttgggggtacgcgcggacacgaaccaggccatcgaggccgcactggcggaagccgaactggcgccctggcggcggatgctgcctcccgccgtcgtcatccagcagggtgaacctgcgctggtcccggtccatgtgcgcgacggcgccgcagtgcagctgggcatctcccttgaaggcggatccggctctgttgccgcggtccaggaggacgtccgggaacagccgcgggatgtcgacggcgtggccacccgccgtcttaccttcgccctcccgcaggacctgcccctcggctggcacaccttgaccgcccgtgcgggcaacataagcgcggaggccaccctggtggtgacgccgcgccagctcaccaccgcgcaaccgctcgagcagcgccgcggctgggggctggctacacagctgtattccgtccggtccaggcgttcctgggggatcggtgacttcgccgacctcgccgaccttgccgccatcagcggcgaacgcggggccgactatgtgctggtcaaccctctgcatgcggccgaacccgtgccgccggtgcagccttcgccgtactcgccgtccacgcgccggttcttcaacccgctctacatccgcattgaagctgtgcccgagctggcgtacctgaagccgcgccggcgcgccgcggtggagaagctccgggaggaagtgtccgggctgaacaaggatggcgggcggctggaccggaacgccgtctacgcagccaagctccaggccctggaaatgctctaccatgcacgccgttccccggcccggcaggctgccttcgatgagttctgccgcatctccggccagggactggacgattttgcgctgtggtccgccatccgggaggatctcgcgccggatgacccgctgtggaccgatcccgcctgcgcgctgggcacccgggaggccgaggcgctgcgggaaaagctgggggaccggatcgggttccaccggtggctgcagtggatctgcgatgaacagctcgaagaagcccagagggctgcgctgcgttccggcatgaggcttggggtggtgcacgacctcgccgtaggcgtggaccacagcagcgccgacgcctggaccctgcgcggcgtgctggctcccgccaccagcgtgggcgccccgcctgacatgtacaaccagcagggccaggactggggacagcccccatggcatccggcgcgactggccgaggccggctacatcccgttccggaacatgctggccaccgttctgcggcatgcaggcgggatccgggtggaccacattcttggcctgttccggctctggtggatcccggtgggcaatgccccgggtgacggcgcgtacgtgcgctacgaccacgaggcgctgatcggcatcctcgccctggaggcgcagcgtgccggggccgtggtgatcggcgaggaccttggcaccttcgagccctgggtgcgcgactacctggctgcccgcggcatcctggggacgtccatcctttggtttgagtacgacggcgactccccccttgcgcccgaaaagtaccggacgcaggcgctcgccagcgtcaacacgcacgaccttccgcccactgccggctacctcgccggggaccatgtggcgctgcgcagcggtctgggtttgctggagcggtccgaggcggaggaacgtgccgagcacaacgcgtccctggagaagatgctcgccctggtccgggaacgtggctacctgcccgggacaaccgagggcgggcaagcggagacggaagagcagaccatcgaggcgctgcacctcctgctcacccagacgccgtcggtcctgctgggtgttgcccttgtggacgcggtgggggagcggcgggtccagaaccagcccggcaccaccgaagcgctgtatccaaactggcaggttccgctgggcgggccggacggcaagccggtgttcctcgacgatcttcccgcgaatgtccggttcaactcgctgctggccgcggtggaaggggccctgcgcagctgagtgcgacgcgggctcccctccggggcacaacactgcggggtcacttccagcccatccggaactccggaaagggcggaaagtgaccccgcgttgctttagctggccgtcatcacatgtgtgacgtggtcgtagcggaaggtgaccgggccgccgtcgtgctcgaagacgatgttggcacccggcgacgcaccgcccgcgccgtaactgtcattccaggaccggtccagggcggccttgaattcatacgtgccggcaggcagggccggcgcggacagcttccacacgaggtcggccggatcgagcacgagctgtgcctggtcgcaggcaggttcccagtccgtggcgcagccaagctcactgttcatgctccccgcagccgccacagccccgggctgctgcgaggcgtagacggcgctgagcaggtgcgtgctgttgtcgtagcggaacgtcactgggccgccgggatggtccagcgtgatgttcggcccgttgaatgcgccgccggccccatagttctcgtcccagccgccgttcagcgctgccttgtactcgtactggcccgcgtcaagattcaccgtgagccgccagatcttgtcggccgggtccagcgtcatcttggcctgtgaacaggtgggatcccacggcaacgtgcagcccatggcctcgttcaaggacccaaccacggtcaccgagccaggctgcggcgcatcgcccaccgtgacagtccggatttcactggccacgctgaaaccggggccggccattgtggcccggtacgcaaccttggtgccgtcagcgaggcccgagacgtcgtccgcggccgagtacacgggcgaggactcgtcggtggccaccgtggtccactcgccgccggccacgctgcgttcgaaggtcaccacgtggcttgccttctccgggtccacggtggcactgagttccacggagccctcggcgctgctgccctccaacggcttctgcagcgtcacgacgggagcgggcacgcttgccgtgcgtggctgcgagctggcggtgtgcccgccgttgtccagtacggtggcgcggtactcgacgggtgtgccggcgtccagcgcggccacgtcatggaacacctggtacggcgcggtgtcgtccgtgccaatgggcgtccacccgccgcctgccgtcctggcctcaaaggtgacctcgtagaacgaggaaccgccgacgtcggccgtcaccttgaggcgcccgttgtcgccgggagccgctgccgggtcctggaggacgacggcgggcgcggccttggagtgggggatccgcccggaggactggtacaccacggcggagagcggcgggaccgtgaccgtcagcgtgccggcctccgacgtcttggtttcggccgcagcgtcgccgtagatgcgggtgtagttgcgcttggcgatgtacgtggggacctctgcggtctgggcctgttcgctgttgttcagggccaccacgtactcgcgctggtccccggcatccgtgcgggagaaggcgtagatgcccgggccttcggaggcgtagcggtgctggtgggcgccgtcgcgcagggccgggtgctccctcgtgagggcggccagctcgctgatcttgctgtagagcgggtgcccggtgttgaagttgtcggtggcgtgcgtggcatcggtgcccagcaggtcgtcgtcgaggtattccggaacctggctggcgaacagcgtctggcgggcgtcctggtccccgccggggccggtgaagccctgctcgtcgccgtagtagaccaccgggttgccgcgggagaagtacatcagctcgtgggcgagctggtcgcgtgccacctgctcgacgtcggacgatccggggttgtccgcggcgatgaagctgccaatacggcccatgtcgtggttcccgaggaacgttggcaactggtagacgttcgagtccgcatccgtgtaccagtcatctccggagaagaaggtctccagcgtgcgggcgtcctggctcttagacgcgaagccgcgggctgcttcctggaaggggaagtccaggacggcctgcatctggttccgggttgtgtactgggaggtgaagctcttggtggtgtcgaagacctcgccgaacatgaagaactcgtccttgccctgggctttggcgtagctgaggacgtccgggccgaactcctgccagaactcgttgttgacgtgcttcatggtgtctatgcggaagccgtcaacgccgaactcgccgatccaggcctggtagatgtccttcatgccgtccactacggtggggtgctccgtgaacaggtcgtccaggccgaagaagtcgccgtagtaagcgtcctcgccgacgaaggttgtgtcgccccggttgtggtacagcgtggggtcgttcagccaatcggggactttcagctcttgctcgttggggtccaggaccgggatgtaggggaaggaggtttgcgggtcgagtttcgggaagctgtccgagccggcgtagtcgcggtcatcgaacacctcgccgcccgcggtcttgtacggcacttcgtccttggagacgtagcccttacgggcgccctcctcatagccgatgacgtccgctgtgtggttggtgatgatgtcgaaatagactttcatgccgcgggcatgggcctcgtcgatgagggccttcagctcatcgttggtgccgaggtgcggatcgatttgggtgaagtccgtaatccagtacccgtggtatccggcggacttgtcctcgggctggaccgccttgttcttgaagcttggggtgagccagatggaggtggtgcccaggccctggatgtagtcaatcttctcgagcaggccggccaggtctccgccgttgtagaacccctttttggtggggtcgaagccggacaccatgggatcgctgcccagtccgccgtcgtcgtttgcggcgctcccgttgttgaagcggtcggccatgacgaagtagaagttctcgtccgtgacaggagcgcggagtgagtggaaggccgacgccgggccggggtctttcgggccgggtgcggcctgggcggggaggactgccgctgaaacggcgacggcggccgccagcagccctgcagctgaacgaaaggcgatggctttggcggcggttttggccgtggtgcgggcggtggtgctgacccggtcggcccggtcggcccgctcggcccgttcggactgggagggaggggcgggtggtgaagcggcggatgtgcgggcgcgcgagggcacgctggaatgggtgcgggataacaaggggtgagaccttcctgggagcgtcgctgctgttcaggcttgccggggaaaaacaggcggcaatgatgggtgcggttcacaggaaagccagcctttccgtgagccacgtcacaactgtaagcgcttgcactgaataactccagtgattgtgcgaaggcgtccggggctggcccgcgcttctcccgcactgcctgcccgcctcagaggcgggcagtcagtgctcaaacgacagtgctgctccgggttgtcgccttttagtgctcacctgtgatcagcagcgggccttcctccagtggccgtcaggcagtgctcacgcggcagccctgcgccgcatactcgactggcagtgctcacgcggcagccctgcgccgcatactcgactggcagtgctcacgcggcagccctgcgccgcatactcgactggcagtgcatatgtagcggtcctgctcccgatgccgtccggcagtgcctatctggcagtccctcccagcctttcccagggctcagccgggggcagctagcttgcaggcaccagggcggtgggcgagggggtctggagattgtggactacctctcccgggcagcctgtgagggcgtccagggcaaaggtggccacgttgtcggaccgctcatgggccacgtggagccagttccccctcaccaagtggtgacgaggccagtttcccccgctgggcgtgtccttgacgggaatcagttccgtcccgccggcaccaacctcgagcacgctgatgatgttggagccgcgaacgcccacgaatgcataggagccttggaagccgaggcagatttccgcgccggagtcgtccgggaggctgccgcccgaggttgccggaccgcggaagaccagctcgaaggtccccgcttccggcctcacgatgaacacttcgacggagtactcggacaccacgaacacgtttccgttcggatgctgcaccaggtgccgggggccactgccgaaggggaggacaacttcgtggtcggccaccaggcccgtgcccggcacgtagttccacacccgaagcgtgtcgtggcccaaatccgttgtcatgatgcgtccgtccgccagcatcaggcttgcgtgggcgcggctctgccggagctcatttggattcaggcccgcgtggggatccacggagggcgcagcagggagacgccccgtcatcccgccgtcggcatccagttcgaagagcaggacctgcccgtcgccccagcaggttacggtgacgaagcggccctgccggtccacagcgacatggcacgttgcttctccggcggcttgcgggtcgccaaggggctccagcccgaagtcgcctgagcggcggaaagcccggaccattttgcgctgctcggccactgcgtacaccacaggcagggtgggatgaacggcgacgaacgacggcgagtccgtcttcgccgcagtccccctccattcgaggcttccgtcagggttcgcggccagggcgccgatgccgtcagcacggcctcctccgtcgggggtgtaggtaccggtccaaataacggggtgctgggcaggcagagtcatgggtccatcctgccaataaatggatgctttgcggtgcacgtgcccactaacatggcctgcagccacgccattggctgcaggccctcgggaagggatgatgatgcgaactttcgacgcgattgccgcgccccacgcccttgctcccatcgtgtccgccctgcgggcagcgggctgtgttttcgcggaagatgaggcgcagctgctggtagccgaggcgccggattccgaatcactcgtggaatgggtggacagccgcatttccggtatgccactcgaatacattcttgggtgggcggacttttgcggggaacgcatcgccgtggacccgggagtttttgtgccccggcgccggacagaactgctggttcaccaggccgtaagcctgctgcgggaccggccgtcttcaccgccgcctgttgttgtcgatctttgctgtgggtcgggcgctgtgggtacggccattgcccggctgtacccggaggcggaactgcactcagccgacatcgatcatgccgccgtgaactgtgcccgccgcaatgtggacgccgtgggcggtcgcgtataccagggtgaccttttcgcagcactgccgcccgggcttcacggacgggtgcggatacttgccgtcaacgcaccatatgtccccaccgaggcgataagaaccatgccgcccgaagcgcgcctttatgagtcgcgcgcagcgctcgacgggggcgatgacgggttggacttccaccaccgtgtggcagcggatgcccttgaatggcttttgcctgacgggcacctgctgatcgagaccagtaggcagcaggccgggcgaacagccgggattgtggctggggcagggttcaccgtctgtaccgtccattctgatgagctggaagggactgtagtggtcggttcgccgcaataatgcggctgcggagccggccaagttcaaggagcgcttgactggccgtttggtgaacgtcgtggtgccgatcgtcggtattgcgcagtcccgccgctcttgggtgcctcggaggtccctcactcccgttgtgttcgcggtggcgggggtggtctgaagtagtggttccgttgcggttttcgctgggggtcgatgtgtggcgggggtgtgaaccagggtgtgccgtggcgggacgtgatggtccattgttctttgtgtacgaggtggtggtgcgctgaacagagaagtgcgccgttgtcggtggttgtgggtccgccgtctgaccagtacgtgatgtggtgggcttcgcaccacggtgcgggaatggtgcagttggggaaggtgcagccttgatcgcgggcagtgagggccaggcgttgggccggggtaaagagtcgggtcttgcgtcctaggtccaggatctcgccgcgggtgcccaggacggcggggatgatgtccgcgtcgcaggcgattttgcgcagggtggcggcggccactggaccggtgaagacgaagttccccgccccggaacgcggtcctgttccggtcacggtgcttgtattcgcgcatgagcctgccccggtgcgtgccccagggtcagtgcctgtgccgtcgctggcgcttgtatcactgcgtgtgcttgcaccgcctgcgcctcggctccacgagcctgtttcctggcctccggagttggtggctcggtgggggaagaggtcctggtagttgatggtggcaatgatctggggccggttgccgccggtgatgggcagggcgttggtggtgagccctgctttgacggcgccgatgattccgtcgagttgtttttgagggcgggtgcgacgttccaggtccgggcccgggtcctggtgcgcgtcgttccaggcagtgtcctgcacggtcccacttccgtctccgcttgcggaggccaggaccgtgtccactgcggtgccgctgccggcgactgtccagatgcatggcccgatgtctgtcccgctgcctgcatcagtatcgatgtcgggtcctgtcccggcggggacggaggtgcgggggttggtggcggcgttcatggcggtgaggaggtgttcgtactggtctgtggtggcaaaaatctcgaggcggtgcaggccgtggcggggtttgcggatgaacgcgccctgggtgtggcggagggcttcttcgctgggttcggtgccgtcggcgtcgatggtctcggtccagcgctgggccaggcgggccaggaagtcggggtcggcggtggccgcggcggtggtgagggcgtgttcaatccggtccaggacatccggagtggtgtggtgccggatccggtccagtgcagcggtgatgatcgtcccggcgtaagaggacaccactggcgctgatgcccgcgacggcgagcccccatccgtaccctcgtccgtgctttcgccagtgtccgcggctgtttcctcaggagtcgctgtgccaacggctggcccggccatgaatggggtggctgccggggcaagggcgcttgcgaggtgtggccgggccggtgggaggggttcgccggtgaggctggcgccgggcagggcctggtcagcgagggcgaggcggcggcgggcctcgcgcagcgggattcggagcctgagacggaggaactccgcggtgttcctgcatccgtcatcggcaggcgaagtcatgaccggcactgcggcccttgtcccggttcctgcagcgggaggggccaccccagcagccgaagtggctgcgctgggtgtcgggtcgccgggtgtccggtcgcaggggttcggttcgctgggctccgcgttggccggtgtggcctggcccggccagccggcgtctgtctccttgagtgtttcgacgctgtcatcccatccggtgacccagccccgggaccgggcggaccgggcggcagttgccgcggtgatcgcctcgcttcgcgtccggtccacagcgcgtgcagcgagtagctgcaggcattcaacactccgggcgagttcctcaacctggccggcgaagtcggaagcctcaacatagtcggccaccgcaagggcatccggggcagccagcgccgcagcattgaggaggtccccgatgccagccagacctgctcgcggctgttctcctgcttcctcgacacgtccggaggcaccgtcaacagtcggtgcggggagcgaaaacggcccaacggcaagggccggagtacattccccagctactgcagagcggtggctggggacaacaggccgggtgcttgacgcaggcggagggcttgttgttctaggtatgccaggtggagcgagggaacctgcgttggagagcagggcggtgcacccgccgaactccgcaagctggttcctcatcaccttcatgggacaactttgccaaagaccactgacaaaaaggttggctaaagcggctatgtggataacgcgggatgctgggtgccagcctgggcgggttatccacataggcgtggagccgtcttggcaagtcgctgtcgaggtgacaaaccggttcagggttaagacgccgctggccgccgcgtcccccaaggatcgcgacggccagcaaagccattcagttgtagcacaggcaagcggttaatacgttgtcaaacgtaagccggtctgccgcgagccgtcagagctgcttcttaggactcggatcattctcgtccgaggtgccgaggttgtgcgtttcggggtgcgtactgtgcgcggggatgtggccctcgccaaggtcgtcgccgcccggggtaccggcaacaccagtgccagtagttccaggagtgccgaagccgcccgaagtacccggagcgctggtgccggaagcgccggccgttgtgccgtcgtcggacgttgaggacttcttctcaccggaggaaccctcgcgatgcattgcggaaccaatgactgtgcctgcccggcgggcggcctcgctcagctggtccgcaacttcaggagccttttccttgatggtctccgttgccacggcaaccttgtcctggacaggcttgctgtcccagatgccggcggccctggccttgagcttgtcgtacgctgcccggcccgaccgagatccgagcacgtatccggcggcaattcctacgcccaaaagaagtttgtttttcataatgaaatcctgctccctgaaaagattcagttccggccagagaggccggtagatagaaaaaccggcccggggatgttgtccccaggccggttttcctggctggcgcggcagttagctgcgtgcgccacgcttggtgaccatgccgtataccagcagcacgataagtgcgccgccgatggccagcagccacgtctgcagggagaagaactcctgcagtccggtgccaaagatcattccgccgatccagccgccgaggagtgctccaacgacgcccaggaccagggtgatgatccagccgccaccctgacggcccgggaggatcgccttggcgatcgcgccagcaataagtccgagaattagaaatgcaatgaatcccattttttgttcctcttcctaagtaaaggaggcctccggatcccggagacacttcatccttctgcctcaatagtaatcatgcttactatctatttgccaaccccggttggaagaaaaagcccatttcagggctgtttaatgccccgtgacgtctgaatcgttgccggcaccggggccctcatcgaggatagccaattccgctagatcctgcggatcgagggcgaaatcgaagatatccaggttttccctcatccgctccggactggcggtttttggaatcgttacaattccgtgctgaacgtgccaccgcaggaccagttggccggaagttttcccgtacttttcgccgagctgggagaggatgggagcgccgagcaggcccgcgccggagccacccagcgggctgtaggactccgtgacgatgccgtgcttttcatggaattcccgctcggcagcgcgcgttattgccggggacagctggatctggttgagggccggaacaacatccgtttcggccatcagccgctccaggtgggaaagcttgaagttggagaccccgatggagcgcacttttccctccgcctgcagccgttcgaaggtcctccaggtggagatgtactcgtcccgcgccggcaggggccagtggatcagcagcaggtccacataatccagtccaagccgctttaaggacccctccagtccttccaccgccctgtcgttgccctggaattggccgtccagcttggtggtaataaacagctcatcacggtccacgccgctggcgcggatgccattgcccacaccctgctcgttgccatacttcacggccgtatcgatgtgccggtacccggcttccagggcttgtacgacggcggtggccgcctggtcatcgtccagcggccaggtgccgagacccacctgcggaatggagtggccgtcattgagtgtgatcagcggtgcacctgtcattggaacagtctctcccctaaacggctgtgctagtccctgaatgccctaagaatattgtcggcgttgtactggagggacacgcgggcggtatcggatacagcatccgggcccttctgctgcgacaggaagttcacaaagcgctggatggcctgcgcggccctcgcggcgtcgccgtcttgaaccgccgtcgctgcctgcttggtgctggctgccagctggctggccacgggtccggacacgtccccggaatccaccaggtcttcaagggcgtgctgcagggctttcacgctcccgggcagccatgcggcgcgcaggggtacgccggcgaaatccatgtccgaggcaaggtagaagtccgtgtaggacggctggttgtaggtggtgttctgccgtgcaacctcggcgcggtactggggatcgtgcatgagggtgtagagcttgtggttggtcacctcggtgctgaggtacatgcgcagcgccgaactgtcagccgtccggaccagcatctcttcacgccagtcgcccaccacgtctgccaccaggctgggcgtacccttggtgccgttgttggtgcgggtgccttcagcggtcagcagccggccccgcttccagtcgtcaatggtgggggtctgctcgcctgagccgttgatgatctgcgtggtcatgtccgcggcccacttgatgctcatgttcgtgccggggacgtttttaggatcggtagtgagcttatcgccgtcggctgactgcatgccgatggcccagttctcgatgccgggaacggtagggtccacgtcgccgatcatgccgcgtccggtgtcctttccggagtaggcgccgaagagcacctcgccggtggcggcgtcgcgcatggcgtacccgtagggagcgtaggtgccgccctcgtggacagtaaagatctccttgcccggccgggcggggtcgatgtccgtcacgtgcatggcgtcgccgtggcccaggcgtgcttcctcgcccggtgtggcgctgccttcgggcatcgtgtcgaaagagctgtacagcagggagccgtcgtcgtcgatggtggcggagccgtacacgacttcctgcttgccgtcgccgtccacgtcggacgcactgagcgagtggaagccctgggttgtgagtttgccgaactccggatcggtgccgtcccggccatgcggcgagtcgttgaacgggttggtcatcggggtccagccggagtcgatgttccacacgggggagaggctggtcccgtcccaggtgtaggcggccatcgtgcttcgggtgtagtagccgcgggcgaacacggccgccggcttttggccgtcaaggtaggcgacgccggcaaggaaccggtccaccctgttgcccggctcgatgcgggccatagcgtaatcgccccacatgagtccgtcgtcgtgccttcccggctcataggcgacggtcttcagttccttgcccgtggcaccttcgaacaccgtcaggtattcggggccggacacaatgaagccctcgaaggcccgcaggttgttccgcgcgctgcgagagggggcataaacgtccatgaagtagtcggccagtgcttcggcgtcgggctgggacagggggtattggtacttcggcgcggtgccgaacgcttcctccagggtggcgggccagttgccggccttcacttccggatgttctgtccagccctggaacgtttccatcatgtgccggtagtagtccgccgcgctcatgcggtagtcgtccgagttggagtagccggcttcgatgtcctgctccagcagcgaaatgaacccctcggcagcgacgctgccgtcggccttgaagctagtgctcttggttcccggggctgtcttcatcatcatctcggcgcggccgtcgccgtcgaaatcgttgaccaggagttgggtgtagtgggcgcccgagcggatgttgacgcccagatcgatgcggtgcagcagcgtgccgtccgccttgtaggtgtccacgtaggtgttgccggtgtagcccacctgggagacgtctttggagttgttcgggtcccacttgacgatgaactcgtactgcccgtcgccgtcgacgtcccccacggacgcgtcattagcgttgtaggtgtaagccagcccggcgggggtgacgccgtctgccggcttcttcagcgggatgtccttgaagttgccgccccatggcgtggcggttgcgctactgtccacctccacgcctccgacgacggcccgcacctggtacccggaggcggtggtcccgccggcgtcctggaagttggtgctgtccgtgaccgtgcccagtttctcgccgtcccggtagacgttgaagtccgtcccggtgaggcctgtggcggaggaaccggaggcttcgtggcccaggagccgccagctcaggaagacaccttcggacgtcttcgcggccacaaggccgcggtcaaggtggtccagctggacgtccggcatgccgggcttgggggagcgttcgacggcggacgcgggagcggcgaggcagcctacggtaagggcaattccgacggcggcgacggacaggaggcgtgcgggagtacggtccggattcatcagtgaatcctttcaattcgagaacgggaaaacgcttccccgataacctagcgggggagtgccgcagaaaacaagccttgccgccgaggagtgaggaagatatttagaacgttgtagaagtagcgcgccgcgctggggacgccggaaaggtgcggggacgctgcacgcttccggcgtccccgcacccttccggcgaattcgacagcggcgccctgtcagttccggtgcggtggctggatctaggccccgctccgcacccaggcgataagccggtcgctgagggccatgtagtcctggtccacggtctgcagttcggggttcgcatcaaaccactgaacgatttgccgggcgccatcagcgaacgggatggtggcgcggtagccgggtaccagggacttgatcttggtgttgtcgaaaaccacggagtgtgagcggtctcccaggaggttggcccccagttcggcgctgtgtgcggcaatggtttcagaggccacgtggaccagttccggctccggaacgcccgcggcccgcgcgaacagctggtagatctggttccacggcaggtactcgtccgaagtgatggtgtagctttcgcccacggcttgcggccggcccagcaggcccacgaaggccttggcgaagtcctggctgtgggtcagggtccacagcgacgtcccgtcgccgtgcaccatgaccggcagtcccgagcgcatccggtggatgtcggtccagccgcccaccatggcgatcttggtgcggtcataggtgtgcgaagggcggaccacggtcagcgggaagtcctgctcgcggtatcccttgtagaacagttcctcgcaggcaatcttgtcccgggagtactgccagaacggattcttcagcggcgtggactcgaggatcggcagcctggtgggcggcttctggtaggcggacgcggagctgatgaacacgtactgcccggtgcggccggcgaacaggtcaatgccggcctgcgcctggtctgccgtgaaggtaataaagtccgcgacggcgtcgaactcgcgcccggcgagcgccgcacggaccgaggatgcgtcccgcacgtcggccgtgaggatttccgccccatccgggaccggccttgtggaccggccccggttgaggatggtgagctgatgccccagtgcgacggcgcgttctgccgccgccgcgctgatgactccggtgccgccgatgaaaaggatgcttctcggcgccaccgtgtcagcgtcaggggtgagtgggttcaccacgcgtagtcttccggcgcagtgcggtgccccgggaaaatgtcgtccagccgcttgagggcgtctgcgtccagggtgacatcgagggcgcgcacggcagcgtcgagctgttcctgggtccgcggtcccacaatgggtgccgtgacggcgggctggtgcaggagccaggcaagggcaacgtcgccgggttcgtggccgagctcatccgcgaagtcctcatactggcggatctggtcctcgtgcttcttgagggtctccgccgcacggccttcggtgcgccggacgccgtcgcgctccttcttcaggaccccgcccaggagcccgccctgcaaaggggaccaggggataaggcccagcccgtactgctgcgcggccggaatgacctccagctccacctggcgcatgaagaggttgtagatggactgctcgctgaccaggccggtgtagttgcggcggcgggccgcttcctgcgcctgggcaatgtgccagccggcgaagttgctgctgccggagtacaggatcttgccctgctggacggccacctcaatggcctgccagatttcgtcccacggggtgtcgcggtcgatatggtggaactggtagacgtcgatgtagtcggtctgcaggcgtttcaggctggcgtccagggcccggcggatgttcagggcggagagcttggactcgttgggccggtccgtcatggtgccgtacagcttggtggccagcaccgtgtgttcccggcgctcgccgcccttcgcgaaccagcggccaatgatttcttccgtccagccgcggtggccggcgccgccgtagacgttggcggtgtcgaagaagttgatgccctgctcgtgtgccgaatccatgatggagtgggcatccgcttcctccgtctgcggaccgaagttcatggtgccgaggcagaggcgggagactgtcaggccggagcggcccaggtgggtgtactgcatggggtgtcctttcggggacgggtccagggggctggcctacagctgggtgaaggcggcgacggcgggatctgacccgatccgggcgccggactccagggcggtgatggcggaaagttcgtcatccgtgagcttcagggaggatgcggcgaagttctcccgcatgcgtcccggatccaccgacttggggatcacgatgtttcctgaggccaggtgccaggcgagcaccacctgggccgtggtggcgttgtgggcgtcggcgatggcggtgacggcgtttccgttcaggtcgccgccctggccgagcgggctgtaggcctcgactccgatgcccaggtcccggcacttggccgcgagggcagcctgctggtagctggggtggagctcgatctggttgacggcggggacgatctccgcagactccagcaggttgtccaggtgctcggccaggaagttggagacgccgatggcgcggatctgcttgttctcgtacagccgctccagctctttccaggcctggacatagagcccctgggaggggaccggccagtggatcaggtagaggtccacaaactccagtcccagtgctttgcggctgttctggaatgcttcctgcgcccggccctgttctccgttccggagcttggtggtgacgaagatgtcctcccgcggaatgcctgtggccgcgatggccgcgcccactccggcctcgttgcggtacccggcagcggtgtcgatgtggcggtagccggcctcgaaggcgtcctccacaatccgctgggtgtcttcgggcgggacctggaaaacgccgaggccaagctgggggatagtgacgccgttgttcagtgtcagctctgacatgggggctccttgatgcgctggtgcggtagtggggtgccgtgggctcgacaggaagaaagcggtttccgctggctccctcctgagcctatgcacttttcgccggtaagtcagcaggactgcctgattctgtttttcctaggactgccagtcctaccttcgttgtagaacaggaccaccgtgccgggcacaatggtctgcatgggtcaaagcgccgagttcggaaaattcctcaaagccatgcggtcccgcctgagtcctgaggacgccggtgcggggcccgcgtcgggcacgcgcagggttcccggcttgcgacgggaggaagtcgcccgtctggcgggagtcagcactgactactacgtccgcctcgagcagggccgtaacatccacccttcacgcactgtcctggatgcagtgtcgcgcgccctcaggctggacagcggcgagcacgcgcacatgctggacctgctggagaactgcgccgggtccgcccggtccagcgtcccggccgcccagggtgtccgcccggcactccgccagctccttgaggcggtgggcgatgtgccggccatggtgctggggcggcgcagcgatgtccttgccggaaaccggatggccttcctgctgttcacggactttcccgcgctgccggccgccgaacggaacctgacccgatggatcgtccttgatcccggtgcccgggagctcttccgtgactggaaaactgttgcggcagaagcggcaggcgccttgcgggtggacgtcgggcggcatcccaacgacgcccaggccaatcagctggtgggcgaacttgcggtccatagcgagcacttccggcaatggtgggcagggcaccgggtggccacacggtcgtcgggcagcgtgcggctgcatcatcccgccgtcggggacctggaactgaactttgaaaacctggtcctcccggacgatcccgaccagacgctgcgggtgtattccgccaaggcgggctcgccgtcggccgatgcccttgcgctgctggggagcctgggggccgctggacccgccccggagccgcggagccgcgacgccgctccggccgttgcggagaacagggagtaagactgccgggaacattgtgcttttggccagttgaagcggctgattctggccacgagcccattggggaagaactgcgcgcttcctaggctggagtaacacgctttctccacccaaggatggtctcaacgatgaaacgcatcgctctgctcaaggaacgcaagggtgccacggccggcgctccttccaccaccacgggctcgcactgcccggtatccggcctctggagcccggaccgtgacccgcacaccgtgctgtccttcttcgaaggccacgtgttccccgcgttcgacggcgttccaacagtctggcggcggcgttcagcagctaccgtctcggcaaactagttaaacccaggctggcccgcacccaacgtccccgaaacgggttttcgacgttaagtgcgggccagtctggtttgcagccgctattcttcgaggcggaaaccgatcttcatggtgacctgccagtcagcgatcttgccctcttccagatggccccggatttccttcacctcgaaccagtccaggttgcggagagtctgtgaggccttcgcgatgccattgcggacggcctcgtccacaccctgatccgacgtgccgacaatttcagaaatgctgtacgtgtggttggacaacttcgctcctagtgatcgccttggggctcccggttgcgggccgttcttgaagactagtaggactccaagaacgttgaccagccttatccggatgttccctgaccgcgtgccggggaacatcccggggaagatccggcttacttcgcctcgagcaccaggttcttgaggtcgtccagcgtctgctgcatatggtcatccatggcctgccgggaccgcacggggtcgcgggattccagcgcctcggcgattttctggtggtgcccgattgcgtgctcctggatttcccggaccgcggacgtctgggtgcggcgcttctgcagcacctggtgcagcggttcgaacaggacggacacgaagacgttctcggaggcgtgaaggatcaggtcgtggaatgccaggtccgcttccacaaaggcggcaacgtcgttcacctcatgggcggcgcgcatgctgtccacatacctgtacagcgtccggatatcttcgtcgcgtatccgccctgccgcgagttcgcaggcaccagtttccagcattcgccggagctcgatgagctggaccgaagtttctgcctcgttcttcccctccgatgcagcacgcaacaccgcctcgagcgacgcccagcggttgagagggttcacgaatgtgccgcggccgcgctcaacactgaggatccgctgggcctgcagcgtcttcatggcctcacgcaccgtcatccggctgacctcatgccgggcgctcagttcgtgctcgcccgggaccgtggcgccgggcgggaactcaccggtgatgatgcggtccagcagctcatcggccacctggcccaccagtgattgcctcgccattgtgcccccgttgcttccttcactgcatatgtcggacaagtctacttgcgcgtctctatgtggtgtgccacactattcgaaatgcaagatgtctgacatcttacagttacgtttacatcaggatccgcagccccggattcatacacaactgattcatacacaatggagtgcactgtgacgcttgaagcagacgttctggccgcctacccggcagaagtccggattcccgccgaactggtggccagcacactggccgcctccaatgctgagacgccgcgggtcctggtagtcctcgacgacgatcccaccggaacgcagtcggtggcggatttgcccgtgctcacccagtgggaagtagcggactttatctgggccttcagccagtccaagcctgccgtctacgtcctcacgaacacccgcagcctggaccccgccgaggctgccgcccgcaacgaggaagtggtgcgcaacgccctggcagcagcagggtccccgcaggaactgcgcctcgggttcgtcagccgcagcgattccaccctccgcggccactaccccctggagccggacgttatcgccgcaacggtggctgacgtcagcggagaaaagaccgacggcgttgtcctggtccctgccttccccgacgccgggcgcatcaccatcggcggagtccactacatgcgcggcaccggcgcggagaccggcacgctcgcccccgtgtccgagaccgaattcgccaaggacgccaccttcggcttcagcacctccgtcatggccgactacgttgccgaaaagtcgcagggccgcttcgcagccggttcggtgatcgtcctggacctgaacatcatccgcgcctccacggatccgcaggccactgccgctgccatcgccgacgccatcgagcccgccacggactccacccccatcgtggcggacatcgtcaccgaaaacgacctccgcgcactctcgctcggcctcgaagaagccgaacggcgcggcaagaagctcctctaccgcgtgggccctccgttcggtcgcgcccggatcggccaggaaatccgcaccgaactcagcggcgccgaggcctacgcaggcaacacgccctccgaggcagggggcctcatcgttgtcgggtcccacgtgggagtcaccacccgccagctcaaggcactcaccgaccagcacagcgcggcgcggatcgtggagatcgacgtcgaaaagctcctcggtgcccccagcgtcgccgaggcgcacctggaccggaccgtggacgccgtcgtcgaagccctacgcggcggcgacgtcatcgtccacaccagccgcctgctgattaaggcagacgaccccgccgaaagcctgcgaatcgcccgcacggtgtccgccgccgtcgtcgccgtcgtcaaccggacactcaagaccttcccgccccggttcgtcatcgccaagggcggcatcacctcctcggacgtggccgcccacggccttgagatccgccacgccattgtccgcggccccatgctgccgggcatcgtctccctctgggagcccgtggatggccccgccaagggcatcccgtacatcgtcttcgccggcaacgtgggggatgaccagtccctcgccgacgtgacccgaaagctcagcaacactttttagtccccactggctccgcacacattcaatggagaacaccatgaccagcaactacaccgtcactgtcctgggcctcggcgccatgggcctgcccatggccacccgcctggcctcccagctcaccgtccacggcttcgacatcgccgaaccccgcctgaagctcgccgaagaagccggcatcgccacgttcgccaccgcccgcgaggccgccaagggcgccgacgccgtcctcctggccgtccgcaacggcgagcagctcaacgaagtccttttcggccagaatggcgtggcctcggtgctggagccgggcgccgtcgtcatcctcggcagcactgttggcaccgaagccatccccgaaacggtcgcaaagctggcccaatacggcgtcgagcttgttgacgccccgctgtccggcgggccgaagcgcgccggtgagggcgacctgctgatcgtcgtcggcgcttccccggaagcccgcgaaaaggcggcccccgcgctggaactgctcgcctccaccctgaccgtggtgggcgacaagcccggcgacggacaggccctcaaaaccgtcaaccagctgctctgcggcgtccacatcgcagccgccgcagaagccatggccctcgccgacgcccttggactggaccaggccaagaccctcgccgcgctcgaggccggcgccgcaggctcgttcatgctgtccaaccgcggtccccgcatcctcgaggcatacaacgaggaaggcgccgaggtcctgtcccgcctggacatcttcgtcaaggacatgggcatcgtgggcaaggccacccgcgccgcgggtttagcagccccggttgccgccgccgccgagcagctgtacctcctgggccaggcccagggcctcgccgctgccgacgattccgccgtcatcaaggtcgtcgcccccaccaagcgcaccacgtagcgagccccccatctctgagtttttgtccagataagccgacttaagggtcttttgggcctgcatatctggacaaaattccccaaacgtgcgacggcggcggtcccccctccgccgtcgtcgcaccctcccttccgttccccagcattcccctagaaaaaccagctcgctagtcttaactggcgatgtcaaaggagacacacgatgagcgcactagctctcctggccatagcagcagcgggcgtcgccctgttgctcgtggccgtcatcaagttcaagatccccgccttcctcgcccttctggtggtcagcgtcgccgttgccctggtggccggcatccccctgccggacgtcatcaagaccgtcaccgaaggcatgggtggaaccctcgggtccgtcgccatcctggtcggcctcggcgccatgctcggcaagatgatcgagatttccggcggtgcacagtcgctggccggaaagttcacgcagctgctcggcccgcgccgggtcatcgcagcgttgactgccgcagccttcctgctggccatccccgtgttcttcgacgtcggattcatcatcctgattcccatcatctacggcttcgccaaggccgccggcgtcaaccccgtcaagatcggccttccggtgggcgccatcatgctcgccatccacgttgttgtcccgccgcaccccggtgttgtgggcggcgcgggcatcctcggcgcggatatcggctggaccaccatcctgggcctcgtgctgtgcattcccgtcggcgtcctgggctacttcgtggcccgccggctgaaccgccgcgaattctccatgcttcccgccaccgctgagcagttccgcctctttggcaccggcacgtcccaggtggaacaggaagccgcgcaggggacctcctccgttgctgtcaggaaccaggtgaagacggcccccagcccggcgatgatcatcacgctcatcgtcctgcccatcctgatgatcatggttggcaccgtgggcgcggtcatcctgcccaaggattccttccccgcccagctcgccgcattcgttggcgcgccgctgatcgccctgctcaccgccctcggcctggcgtactacttcctgggaatccgccgcggctggtcctcccagcacaccggcgaagtgatggactcggccctggctcccacggccatcgtcatcctggtcaccggcgcgggcggcgtcttcggcaaggtcctcacggtctccggtatcggcaaagcactcgccgaagggctgcagaccgcaggccttccggtcatcgtgatggcattcatcctcgccgccatcctgcgcgcttcccagggctccgccaccgttgcgatcatcactacctccggcctgctggcagcatccgttgccgacggcgggttctcacccatccagacggccctcatcctgattgccatcgggttcggcgcgttcggtctcagccacgtcaacgactccggcttctggatcgtcacccggtacctggggctgtccgtggctgacggcctgaagacctggaccgtgctcactaccatcctgggcctggccggtttcgtgctgaccttcctggtgtggatcctcgtgggaggcctgggcgtctgatgcgcacccgactcgaccacctggtcacctccgccctccagcacggctccgctgtcccggccttcacctgctacgacttcaccacggccatggcagtggtggccgcagcggaggaggcgggccgcggcgccatcctgctggtggctcccaagactgccgccacgccgaacggcctgcgcctcatcggagcccttcgtggcctcgcggatgctgcatccgtgcccgtggctgtgcagcttgaccacgcaacggaccttcaggtgatggccgacgccgtcgcggcaggggcggattccgtcctcgccgacggctccgcgttgccttacgaggacaacatcgcgctggtccgtggtgcccgggcgttgctgggcccggacgtcgtgcttgaagccgaacttggcggcctcgccggtgacgaggaccgcgcctttggtgcggaacagtccggtgtggccgtggccggcctgacggattcggcgctggtggaggactttgtgtcccggaccggcgcggaactgctcgccgtggcggtggggaacgtgcacggcaagtacaaaggggagccgcagctgcgctgggacgtcctgcaggacattgcggtgcgtactcacattccgctggtgctgcatggtgcctcggggattcctgcggaggagctggtgaaggcagccgccatgaatgttggcaaggtcaacttcaacaccgagctccgcaccggggtgctggccacgctgcaggaccagctgccagggcaccggtccgacggcgaaaacctgcaggggctcctgggccactggaacagctcggcccgctcctttgctgccgccacgctggcgacgctcacgcgctgacgttcactcgagctttgtccagccgtgcttgaacccgcggggcctgcatccgcggacaaaaactccaggagggggaggctaggatcaacccatgatcctggcctccctcttttttgccctcctggccgcaatgctacacatctatatcttcaccatggagtccatcacctggaccaagccagctacctggaagcgcttcggggtggccagccaggctgacgcggagaccaccaggccgcttgcctataaccagggtttctacaacttgttcctggcggtgggagcctttgcgggggcagggttcgtggcgctggcacctgaggacccggtcctcgcagccgcaggctggaccctggtcttcagctgctgcggttccatgctgctggcctcgctcgtcctggcgctgtccggcaggaagtacctccgcgccgccgcaacccagggtgccacgccgctgctcgccgtcgtgctcggcgtcgccgccctcgctgcctagccgcggcgcaccgggggtgcggcgcccgttgcggcgcggacggctccacggccaggaaatggcagcgggggaagaggcattgccagcggagtgaagtagtgccactgtcgaaccatgaccgagaacatgacgtccaccgaagaccagttcagccctgacgtttcactggcacgcaacgatgcagaccaccggtatgagctgcgcgtggacggaaaactggctgtccagtccttcttcaaggacaagcccgggcacatcgacttcagccacacggaaaccacggagggcttcgaaggccagggcctggggaaggtgctggcacacttcgccctcgacgacgtggtggccaccggcaaacggatcattccccattgcccgttcatcgcagcctacctgcggaagcatgagggatacgaacagttcgttgactggccggagggctgactccaggaccgcacgggcctgctgatcagccgcccggacgggacgtgcctggaacaggtccttgccgcggcgtcctgcggcaggagtcagctggccagggcgtgcccgctgaggacgggcgcgtcgatggtgaaaccacaagcgcaccggtaggtctccacgtgctcggaaaaagggccggcacccatgggtactcccgtggttccgtccacgtggacgggcaaccggacaggtatttcttccggatccacccgctgcatcggagcgcggcaatgcatgcgggagttaagcgtgaggagcagccccatgtccgctggttcagtggagcccagcggagtaagtgcccgtgcgccggtttctccgggcgccgtaagctggtggtctgcaacggtggtcatgatgggtcatccttgggcttcttcacggaaccgccggcgttggcagccccgccgcgaactgcttgcggaggttcatttaccccaatacctaagcatgcttactaatgcacgggcaaatccgcgtgtggtccagtacgcacggttgccgctcgccgtccgctggccggcgggttccggcggttttgaatccaccccttagcgatgcctgtgctgccactgccgtgcatgccagaacagcaggcagatcagcgccgcaagtccggcgaaaatcgcgtaaggggcaaaggtgaaaacaaggaaagatgttggcattcccccggcggaggggcccaccatggagtttgcgttgaggaacacccaggcgccgccgccgatgagcccggcggtgaggagccataggccggcaatgtagggattgatggccagggtgccgcccctgccatagtcttcctccctctcatcggcgccttcgctgcggacggagttcccgtcgcggtccacttcccggaatccgattgcgcctggtggcccctgctccatgtttccccctgatcgccgtgcagccaggtccggctgcctctgggtcaaccctaggcccggcggctcatgccgtcttgtcacactcctggaccgaaggccggcaattgtgcagcaggtggacgcctcgccgccagtcaatgacggctctggggtacgaaaagcgacgcaatgagtaccgtttggggaaatacatcacagaagtttgattaaaagggtgacctaagtaaggctgtcctttgtaattttccgtgattcccgacagaaggaccaccagtgccgctgatgccccgccttgacgaaacagatgtggatgagccagccaatcccgcggcagggccgggcccactggcgccgggccaggactttggctcccgcgttgaactggccctgggcgccacaaaccacctcctcaacgcccgcaacgcgccgcgctatgtcgcccaggtcctgcaaggcgtcacggccgtggccaccaaactggagcggaccgcccggccgttctccggcgtcgagcccgctgacatggaggcccgggtgggcgccgtggacctcggcaccccgctcccggacacggccgcggcgctgcaggaactcgaggatgtgtacctgcgtgatgccgtctacttccacgactccaagtacgcggcccatttgaactgccccgtggtgattccggccctggtgggggaggctgtcctgtcggcggtgaattcctccctggacacgtgggaccaaagtgccggcgccaccatgatcgagcgccggctcgttgactgggcggccgagcggctgcaccttggcggcagcgcggacggcatcttcacctccggcggcagccagtccaacctccaggcactgctgatcgcgcgcaaccacgcagtggctggcctccggcaggacccggcacgggccggccaccgccttccggcgctgctggacacactgcggatcttcacctcggaagacagccacttcagcatccaaaagtcggcctccatgctgggcctggggttcgacgccgtcatctccgtgcggtgcacgcctgaccaccggatggatcccgcggccctcgccgaagcaatggcggatacacgcggtgccggcctggtccctatggcggtggtggccaccgccggaaccacggatttcggcgcggtggatcccctggcggaaactgccgcgctcgccagggcctacggtgcgtggttccacatcgatgccgcctacgggggcgggctcatggtgtccggccggtaccgccgcctccttgacggaacgcggctggcggactcggtcacggtggacttccacaaaactttcttccagccggtcagctccagcgcactgctggtccgggaccgttccatgctgcgccacatcacctactacgcggattacctgaacccggaaagcgcagccctggccgagatccccaaccaggtggacaaaagcatccagaccacccgccggttcgacgccctgaaactgtggctcaccctgcggatcatgggagcggacgccattggcgccctgttcgacgaggcaatcgacctggccgcccgcgtgggctcgctcctcgccgccgacgacgactttgacctggccgcaccgccgcagctcagcaccctcgtgttccgctaccggccgcgcctggaaaacggggacctgctgtccgagaatgcagccgacgcgctcaacccggccatccgcgccgccgttttcgcctccggcgaagcggttgtggcggggacaaaggtgggcggccgccactacctgaagttcaccctgctcaacgccgaagccacgctggaggacatcgccggaatcgttggcctcctgcgccgcaccggcgccggactcctgaaggaagggatgtccgcatgagcacccctatcaacggcaggatccatgacttcgctgcgatcggcgtcgggccctttaatctgggcctcgcggcactcgccgggccggtggaaggcctggacggcatcttcctggaacagcgtgactcctttgactggcaccccggcatgatgctggaaccggcccatctgcaggttcccttcatggcggacctcgtcaccctggcggaccccacctcgccctactccttcctgaacttccttaagcagaccggccggctgtaccgcttctacatccgcgaaaatttctacccgctgcggtccgaatacaaccagtactgccagtgggtggccgggcagctgcccgccgtccgttttggcacggttgtgctggatgtggcgtacgacgacggcgtgtaccggctggccgtatccggtccgggcgggcaggaggtgctgctggcgcggcggctggtgctgggcaccggcacctcaccgtacgtcccgtcgccagccgagggcattgttgcggaggctgccgctggcggtgggggagtggccttccacaatgccgactacctgtcccgaaaggccgagctgcagcagcagcgcagcatcaccatcctgggcagcggccagagcgcggcggagatctactttgacctgctgcaggaggcggacgcgcacggctaccggttggactgggtcacccgctccggccggttctttcccctggaatacaccaagctgaccctggagatgacgtccccggaatatgttgactacttccacggcctgccgcagcaccagcgcgaccacctgaacaagaaccagaagaacctctacaagggcatcaactcggagctgatcgatgccatctacgatctcctgtacaccaggagcatctccggcatggtggatacgcggctgctgacgcactcgtccctgactgccgcacaatggaacccctcggcaggaaaccacacgctgcacctgcggcacgaagaacagggcagctcctacaccttggacacagacgccgttgtgctcgccacgggctacagctaccgggagccgggatttctggcaggcgtgcgggaccgcatcgcccgggacagtgccggcaggttcgcggtgggccggaactacagcaccggcgtccagcccggggaaatctttgtccagaacgccgagctgcatacccacggcttcgccaccccggacctgggcatgggcgcgtaccggaactcctgcatcctgcgggaaattaccggccgggaggtgtacccggtggaggagagcatcgccttccagcacttcggggctccctcggacccgggggcagcggtggtgggacaggccgtccgtgaggctgggaacaccgcagcttccggcaccgcagcttccggcaccgcagccgccggcatcggggcgggggtgccggcatgaggttctcgttccgctgcctcgatgccgcagccgatgccgcgctcctgcacagctgggtgacccgcccctacgcctcgttttggggcatgctctccgccaccgtggaagacgttgcacgggagtacgcaaagatccagtccagcggccaccaccacgccctggtggggctcgacggcggcacgcccgccttcctgatggaggaataccagccggcagcctcaccgctggcagccgtctatcccgtcctgcccggtgacgtggggatgcacctgctggtggcaccgccgtcggacggtcctgaggccggctacaccgcaatggtgatggatgctgtcctggcacgcctgttcagcgtgcccggggtggaccgcattgtggtggaacccgatgcgcggaacacaaaaattcatgccctcaatgagcggctgggcttccagcccgctggcgtggtggccctcccggacaaggaagcactgctgagtttctgctgccggtccgactacctcgccgcacgttcagcagtgcatgccaccgccgccctgcccgcccgcgccgcccttcccaccatcccgtcccgtccgcttatttcccagggagcatctctgtgaccatccagctcgaaccagccagcaccgtccccgcgttcaccaagcccgcacccgctaaccccactcccgcacccggcaccgccgccgtctctggcaacgccgccgcgtccactacagcccagccggccggccccgtcccgcacctcaccgcggaggcgtggaccaaggccaaccggcacctgttgcgcaaggcgctcgccgagttctcgcacgagcggatccttgtccccgaacccgaacccgaacccgaccccctgaacggcaacggcagctaccgcatcagcagcggcgacggcacgcaccaataccacttcgacgcccggctcctggaactggaccactggtccatcgacgctgattccatcaggcatttccggaacggcgccgaagcgccgctggacgtgctggagttcatcacggcgttccatgaaacccttggcatcaacatccagatgctgcccgtctacctggaggagatcagcagcacgctggcaagccatgcgtacaagcaatgggccagccagccgtcgtcggcagagctggcggccggcatcaccggcgggcgcaacccggcggcggacttccaggccatcgaacgcagcatgaccgaaggccacccgtgcttcgttgccaacaacgggcgcctgggcttcggcatcagtgactaccacgcgttcgccccggaaaccggcgccccggtcctgctggaatggatcgcggtgcaccggagcaacgccgtcttcacctccgccgaagggctccactaccggtcccacctggacgccgaactgggccccctcctgggcaccttccaagcccggctccacgcgctgggcctggacccggacctgtacttcctgatgccggtccacccgtggcagtgggagaacaagctggcagtcaccttcgccgcggagattgccctgcagcgcatcgtgcctgtgggaaccgggacggacagttaccaggcacagcagtccatccgcacgttcttcaacgtcagttcgccggagcggacctacgtgaagacggccatgtccgtgctcaacatgggcttcatgcggggcctgtcgccgcagtacatgaaagccacgccggccatcaacgagtggctgcgggccctgatccggaaggaccccgccctgcaccagcgcggcttcaccatgatcggcgaggtggcagcaatcggctaccacaacgggcactacgaggccgggtccgcgcccgggtccccctaccgcaagatgctctccgcactctggcgcgaaagcccgatgccgttgctggcggacgggcagcaactggccaccatggcgtccctcctgcacaccgattccgccggcacgcccatggtggaagccctgatggagcgttccggcctcagccccgaggagtggctgcggcgctacttcgaggcctacctcgttccgctggtccactgcctctaccggtacgaactggccttcatgccgcacggcgagaacgtgatcctggtgcttgaggacggcgtccccgtcagggccgtcatgaaggacatcgccgaggagatcgtggtgatgggggacaggatggacctccccggggacgtgtcccggatcaaggcggacatcccggaaggcgagagggtcctggccattttcaccgatgtgttcgactgcatcttccgtttcctggccgccctcctggacgaggacggcaccctggcccaggaggaattctggcggacggccgcggaggccatcaaggactaccaggcccggcatcccgaactcgcagcccagttcgcccgccatgaccttttcgcggcggacttcgaactgtcctgcctcaaccggctccagctccgcaacaaccagcagatgctggacctcaccgacccctccggagggctccagatggccggccggctggccaaccccctggccaggttccgcgcaccgcaggccacggaggagggatctggctaggcttgccccatgaccccaaacacttccgatgcaaccgccaggaccaccgccctcatcaccggagccagcgccgggctcggcgccgaattcgcccggcagctcgccgcgcagggccacaacgtggtgctggtggcgcggaaccgggcccgcctcaaggaatccgcggcggagctggagcggcgttacggggtcacggctgaagtgctcccagcggacctgacgtccgacgacggcgtggcagccgtcgtcggacgcctgaccgatccggagcggccggtggaggtcctggtgaacaacgccggcatagggctgctgcacaacttcgaggacaaccccatctcggaggagaaaaagcacctgaagctgcacggggaaacggccatggagctgacccacgcagccttggaggggatgctggagcgccgttccggccggatcatcaacgtggcaagcatcgcggccttcctgcctcgggggacgtactccgctgccaaggcctggctggtgagtttcagccgctgggccaacctcgcgtacggcaggcagggcgtcaaagtcaccgcggtctgcccaggcttcacccatacggagttccacgaccggatggggatggacaagtccgtggcgccgtcgtgggcgtggctgcatgccgggcgggtggtgcgtgagggcctggcggacaacgcgcggggcaaagcagtttccatcccgtccaagcggtacaaggtggtggcggccgtggcgcggattgcgccggcaaggctagtggcggggcctgcgcggaaaccgaaagacgcccgcacgccccagtagggcagccggcgtgcgggtcgccgccgaccggacagccaccaccacggcgatccccaccagagcccccaccagggtctctgccccgcgctccaggatcaggaccgcgggatcgatggggtgggcaagctgtgtcatcagcaggatcacgggggtgaaggaaaccatggccaggccgtagtggcgggtcatgaacagctcggtggtgaactggaagaggaccaccagaagggccagcaccacggccttgccgcccggaaagaggcccgccagggaccagggaacgggaagaatcacgacggcggtcaccgccagtcccaggaacgttcccacaatgcggtggacgccccgccggacgctgctggggaggtccgctcccgccagcggcacggcggcggcggccatggcccagtgcggatggccgctgcccgtcaggacccccgcggtgccggcggcgcctacggccaggatgtagcgggcggcatgcaccagcagctcccggtgccccgcgggggtcaccccgggagcagcccggacggccccgcgctgccaggacctccggcggaaccagccgccgaaacccaccagcatggagaacgcggcggagcctgcggcgatgaaaatggccacctgccacggcaccaccgtgggtaccgaggcgcaggcacccagggccaggatcccaaaaaacggtccgttgggcttgagccgcacgcggtccgcaaagaccgatccgacgccggccagggcagcctccacgcccaccagccaccacgagtggagatggttcacggacaggaacacacccacggtcacgccggtgagcaggacgacggcggcctggccctggtgccggagccggagctggtgcgcttcggaccggccgtacatgccggtcagggcaccaaagacggcgtacatgatcaggtcggtgcggcccgccgccaggagcaggagcgaggggaccgccacgctgagggcaacccgcgccgcggcgagatggtcattggtggcgggctcgagccggtggagcgcgcgcatctgcaggaggacccgttccatgcccacctcctgctgctttcctgatgtggccctatggaagctatcaccggctggtgcggccggtcatgtttaggacggacaagaggacatggagcgtcattgtgactggcacgccaaaggcccgcccaccgtgcttcccccaaggaaacacgcgggacgggccttctgagcggggctgcatgacgtgccccggaagggttgcgccgcaggcggtgccgcggccggacaggctagacgccggcagcaaccttcccggactcgcgtgaatcggtgatgtcctgttcatcgaacgggagttcgtctaggttgatcagcgggttctcgtcctgcgtggcaacaagttcgcgggcctcagcctgggtatccacgctgggcatggaaccgggcagcggacgccgggcggattccttcaggaagtagatggccgcggcacctaccagcgaggttgccatcaggtagtacgcgggcatcatgtcgttgcccgtggcgccgatgagggccgcgacgatgaacggcgtggtgccgccaaagatggccaccgagaagttgtaggcgatgcccatggctccgtaccggctggaggtggggaactgcgccgggagggccgaggccaggttggcaacgtagaacgtcaccgggaaagcaatcagggccagtccggacagggtggaccagatctcaccgatgccaatcagcaggaatgccgggatggccaggaccaccgtgctgactgccccgatccacaggacgggcctgcggccgatccggtccgataactttccggtcagcggaatgcagaggctcatgaccaccagcacggggatggtcagcagggtgccgtgtaccggatcgtagcccttggactcggtgaggtaggtgggcatgtaggacgtgagggcgtagccggccgtgttggcagcggccaccaggaccatggcaacaatgatggagcgccaatacgccttgacgattccaaccggtcccttgacaacggccccgtcgctggcagcagcgtgtttggcgaggtcctcctgggcatccagggtggcctggaactgcggggattcctcgatcttgctccggaagtagacggcgatcaggcccaggggaccggcaatcaggaagggtatccgccagccccactcctccatggctgcctggccgagcgtcagctgcaggactgagaccagggcggcgccgatggcgaagcccatgtagctgcccaggtccaggaagctcgcgaagtagccgcggcgtttgtccggggagtattcgctgacaaacgttgtggcgccggcgtactcaccgccggtggagaagccctggatgatcttcaggagtaccagaagcccggcggcccacagcccgatctgcgcatatccgggcaggaggccgatggcgaatgtgctcgctgccatcagcatcagcgtggcggcgaggaccttctggcggcccatcttgtcgcccagccagccgaagatcacgccgcccagggggcgggcgatgaacgtggcggcgaaggtacccagcaggaacagggtctgggtggtgggatcggattccggcaggaagacgggacccatcgtggtgatgaggtagccgaacacacccacgtcgtaccactccatggtgttgcccacgatggttccgccgagggctttcttcagcatgggctggtcaaccacgttgacgtccgactccttgagccggcgccgtgcgagtattttcggtttccgggggttcctggcggccaccggagacgtcgctccggggggtccagctgggttggttccggaggcgggattaaggcctgcggaagagtcgttcacgcttcggtctgtgggcatttgggcaactcctgtggaggtcatttgcttgcgacttatagctgccccgctctgggcaggccttcaattttacgtgaatgccgtggcggacggtcctttgatgccgtaggatcggcccttttcggggtcttccggagagcctcagcggagtttccccgccccggcgattcccttgccagcattggggaatcccgccacaggtgtacccgctgccgaagtatttaagtggcatgcgtcacggtgccgcttttggcgccggtttcggggcccattgtgatggcgcccacggcgtttccggacgttgcgcgcagccggcgggccgtcgtcgtcagcccttttccggccgggcaaaaaggggggttcacaggcgcgctgcgcctccctaaggttgtgccatgggaacactctcttttgtttaggcggacgcctgcggcccgtgcccggcccgcctctccttcagtcgtacaaggccccgagcggccactgttggtagcactttcatttcaccgcggaaaggaagaacaaatggctgacgaaaacatggaaaagcacatccaaccggaggtggcgagccacctcgccgaggcaatgaacacccctgacatgccgggcgcggaagcaccgctcgccccgatggcgggaaccgggcagcgcacctggccggacggcaacggaaagcgccggcacccgaaggagcgggatgcgggccacggccgaatgggacagggagccgcagtgacggccgtccaccgcaccagccggccgcagatgcctcactcgtcctgaggaagaccaacctctgaggacgcccaaaggggctgggaacaccggaaaccaggtgttcccggccctttgtgctgttccggacgtttcacctgggtctggggtcaactccgccgcctcgggctcagctttcgcgcactacctctgacggctccttgtccagccgccagccccgccacacggggtgccggagccgccctgtcccggtccactcgctgtatgtcacttcgcccaccagctcaggggtaatccagtgtgcatcggcggcgtcctcgcgcgggacgtcctggaacggcgaggttttcctggccaggcgttcaacggtctgccggagctccgccagttcccgggagctgaacccgctgcccacacggcccgagtattgcagcttcctgccgtccgggatgcccaccagcagcgagcccacggtgtcctgccggccgcccttgccagggcgccagccgcccaccaccacctcctgcgtctgctccactttcagcttggtccaggtgcgggtccgctgcccgctcacgtagcggctgtccgtccgcttggccatcaccccttccaggcccagttcgcgcgcgctctccaggaggtgttccaccggttcctccagtaccggggagagcccaacggggcagtcggacggggtgaagaattcctccagccgctgccggcgtttggcgaggggcagcttccggaggtccgttccgccgtcgttcagcaggtcgaagagcatcaactggaccgggatggcagtccgggcccgtgccacgtctgccgggcgggtgagcttcatccgaccttggagcaggccgaagtcgggcctgccggacggcccgacggcgatgatctcaccgtccgcaacgaacggctgctccggccagcactgcctgtcggccagctcagggtaggtccgggtgacgtcgtttccgttgcggctgaagatctttaccgccttttcgtcggccacaaggatggcgcgcaccccgtcccacttgagttcgaactgccagttgctgccctgcaggccggctgcgtcaccggaggtggccatcatgggccggtaatccttggccccgggcgcggccgtgcccgccttgggcgacgtcccgccgtcgtccgttgcctggccggcgcccgcaggtccggcagttgtatccccggcgccttcctccggcgcctcctcctgctccgcgggcccggacgcgtgtctccgccgcccgccgtggcgctccgggtccatcaggtggatgagccactggccctcggaatcctttccctggccgcgtccggtgtggatgagcgcgaacttcctggttccgcccaaaccgcctccctccgaaccggtaagggtgacgatgacttccctgccgttgatccacttgtgcagctcataggtcccgtggtcccagatggtgacctcgccggcgccgtactcgcccttggggatggtcccttcgaagccggcgtaatccagggggtggtcctcggtctggaccgccaggtggttcttgccgcttgattccgggacacctttgggcagcgcccaggacaccagtacgccctcatgctccagccggaagtcatagtgcaggcggctggcgtggtgctcctggatcacaaaggtgttcccgctgccgggtgcacccgtgaagggctcgggggttttggcgggatcgcgcatggagcggtacttgcccagccgggggtcgccgccggcatggacgacggcggcgaacgggtccgtgccgtcctgcacccgccgcatgacctccttgtagtccaggtgcttgaggcccggggaaccgatctcctcccaggtccggggcgcggccaccgtcggtgtggggcggccgcggagggaatagggaacgatggtggttttggccgcattgttctggctccagtccaccagcaccttgcctttgcgcagagtcttcttcatgtcgctgacggccaggtccgggtggtcggcttcaagggcccgcgcgagctcgcgggcgaaggcggagatctgctccgaggtttgggacctgtccagggcggcgtacaggtggatgcccttgctgccgctcgtgacgggcaccgggtccatgcccacgtcctggaggatggtgcgggccaggagggccacttccacgcatgcctccaggcccgcgccttccccgggatccaggtccaggaccagcctgtcggggttcagttcgctgccgtgggagtccacctgccactggggcacgtggatttccagcgagttgatctgaccgaaccaggtgagcgtggcggggtcgttgaccatcggatagtggatggtgcggtccttgtgggtgatggcggcgcgggggagccagcccggggccgagtcctccaggttcttctggaagaacacctcgccgggcttgtccgcggtgccgacgccgttcacccaccgcttccgggtggccggcctgttgtacgccgcggggatcaggacgtgggccacggcggcgtagtaggccaggacgtccgccttggtggtgccggtctccggatagatgaccttgtccaggttggtgagggtcagttcccgcccggcaacccggacacggtccttagccgcaggcatggggcttcacctgcggcgttgcgtgatgttcacttgatgaatgagagccatttggaagggtgccatcgcgttcggcctggtcaacgtgcccgtgaaggtctacagcgccactgaggatcatgacatcagtctgcaccaggtccacaatgccgacggcggccggatccgctaccaacgccggtgcgaggtctgcagccaggtcatcgattactcggacatcgagaaggcctttgaggaggacggccgcacggtggtcctgtccaaagacgagctcaaggcgattccggccgagaacagccacgagatcgacgtggtgcagtttgttccgtcggagcagctcgagcccatgatgttcgagaagagctactacctggagccggactccaagtcgcccaaagcctacgtgctcctgcgcagggcgctggaggacacggacagggtggcgatcgtccagttcgcgctgcgggagaagacgcggctcggtgctttgcggatcaaggacgatgtcctggtgctccagtccctcctttggccggacgaggtgcgcgaggcgaacttcccgtccttggaggcggatgtccggatcagcgcgcaggaacgcgacatgtccgcagcgctggtggagtccatggcggcggatttcgatcccgcctcgttcactgacgagtatcaggtgcagctccgccagctcattgaggcgaagctggagcagggcgagtcgctggacacagaggaaacctttggggtggaagcgggcgagggcagcaagggcgaagtcatcgacttgatggaggcactgaagcggagcctggaccggaaacgagggtccggttccgcggcaggcagccctgatgaacaggcgggcggggactccggtgacgccgccggggacggtgaagaggaggcgaagccggcgcgcaagcggtccacggccgccaagcccgccgcagcaaagtccgccccagccaccaagtctgcggaaaaacctgctgccggcaaacccagtgccgcgaaatcggctggggacaaggcaggcgccgccaagtcctccgagggcaggggcgcggcaaacaagtccgcggggtccaagtccacggcagccaagtccaccgccgccgaaaaacctgccgcgaaaaccgccgccggcaaggctgccggcacgcgggcgcgcaagccggcgtgatggtccgcggactgcggagcctgctccgttgctcgatgccatgcctaagaaactactaagcttgcttgctttccggtagctaacacttaattgagcaggggggacctgtttcatcggggtcctttacagcggcgtccggtgcgtccacaatgagtcgcatcacagcctccgctgtggcctcacagcgtgctgtcactcactgtgacctgccacctgagaggggcgcggaaatgaacgatcagacggacacagccaaggcgaacggccagtcggacgcagctaaggcggaccgggagctcaaacagaagcaccgggccatgtgggcctccggcgactacccggccctcgcagacgagatgctcctggaactgggcgccatcctggtggaagcctgcggcatcacgtcccgccacaacgtgctggacgtcgccgccggatcgggcaacgcggccatccccgcagcaatgatgggagccaaggtggtggccagcgatctcacccctgagcttttcgaagccggccgccgtgaggcagccaaccgcggagtcagcctggactggaaggaggccgacgcggaggccctgccctttgctgacgccgagttcgacgtcgtgatgtcctgcctgggcgtcatgtttgctccccaccaccagcaggcggctgacgaactcctgagggtttgcaaaccgggcggcaccatcggactcctccactggaccccggaaggattcatcggcaagatgttcgccaccatgaagcccttcgccccgccgcctccgcctggcgcccaaccggcgccgcagtggggcaccgaggagcacgtccgggaactgctgggggacgggatcacggacaccgcagcccgcaagcagaccctggccgtgcggagcttccaccagcccggcgacttcgtccggtacttcaaatcccactacggccccaccatctccgtctacaaatacatcggggaggacggggacaaggtcaaggccctggaccaggcactgacggagctggctgattccttcggtgatgcccacggcgactctcccttccagatggagtgggagtacctgttgttcacggcgaagaaggccaagtagatccccccccaaccaggtagcagcaagtgtcgttatggacgtccataacgacacttgctgctacctacatgggcaaggggaagcttaaaagccagcggccgccgtcggacgtttcccggggagggaaggcccgacggcggccggtaaggcaggtgcgctgctaggcgtcgtgatccgtttccaggatctggaccaggtggttcagcgcatcgtcagcgccgttgccctctgcgcggaggactacaacgtcgccgtgcgaggcgcccaggctcatgagggacaggatgctggcagcgtccatggcctcgtcagccggctcgccttcacgggcgatggtgatgtccaggtcgtattctcctgcggcctcggcaaagatggcggcggggcgggcgtgcaggcctactcggctggcgacggttgcggtgcgttctggcattgttgctcctttgtcttgcggcttgctgtaggtccagtgccggctagctggtggttggggtcagaccgttgcgggaacggattccacggtatcagcggtcttgggggctgcccagcgcttcagtgccaccacggccagggcagtgacgatggtaccggcgatgatcgagagtacgaacatcagcacgttgccgatggcgaagaacacgaagatgccgccgtggggtgcctgcgacgtgactccgaaggccatggtcagcgctccggtgagggcgccgcccagcatgctggcaggaatgacgcgcagcggatcggcggcagcgaacgggatggcaccttcggagatgaaggaggcacccagcagccaggctgccttgccgttttcgcgttctgccaggctgaagagcttcttgtccaggaccgtggccagtgccatggccaagggcggaaccatgccggcagccatgacggttgccatgatctgccacggtgcctggttgtcggccgcgccggcgctcaggcctgcgacggcgaaggcgtaggccaccttgttgacggggccgccgaggtcgaagcacatcatgaggcccaggatgatgcccaggacgacggcggaggcgccggtcatgccggacagccagctgttcagtgctgccgtgaggccggcgatgggtccgccgaggaccaggaacatcaggccggaggcgaaaatggaggcgagcagcgggatgatgacaaccggcatcaggccgcgcagccagcgggggacggaccaggttccgatcaggtgtgccatgtagccggccagcaggccgcccacgatgccgcccaggaagcctgcacccatgaagccggagactgcaccggccacgaaaccgggggcgatgcccggacggtcggcaatggcgtaggcgatgtagccggccagcgccggaaccaggaagcccatggacagggcgccgatcttgaacagcacggcaccgaggtagatggcgaggccgccttcgggaaggttcccgaagttgttctccaccaccacggtgtccgctacgtcggtgatgtcgtagccgccgagcaggaagcccagggcgatcagcaggccgccgccggcgacgaacgggatcatgtagctgacgccggtcagaagggcccgcttcagcttctggccgatgtgctcgcccttttcctcggcgtcgtgctctgcctgttcctcggcaccgaagtgcggtacccggcgggcattcgggttgtccgcagcggccagtgcttcctggaccatcttggcgggctcgtcgatgccgcgcttcacgggggcgttgatcaccggtttgccggcgaagcgctccttgccgcgcacgtccacgtccacggcgaagatgacggcgtcggcagcggcgatgactgcggggtccaacggcttggcgccggaggaaccctgggtttccacctgcaggtcaacgccggcttcctgggccgcggctacgagggagtcggcagccatgtaggtgtgggcgatgccggtagggcacgccgtgactgccacgaggcgcctggggcctgggcgtgcgcctgcaccgtcacctgagccggctactgccgaggccccggcagcgccggtggcggcaccggcagaagcagctgcacctgccggtgctgcggcatgtgcggccggcttgtctgccagtgcgccgtccaccagctccacgatctcctcgcgggaggacgcgttgcgcagggctgcggtgaagtccttcttgatcagggaccgggcgagcttggacagcagcttgaggtgctcctggtccgcgccgtccggggctgcgatgaagaagatcaggtccgccgggccgtccttggcgccgaagtccaccttggggttcaggcgggccatggccagggtgggttccgtgacggcggccgagcggcagtgcgggatggcgatgccgccggggatgccggtggcggttttctgctcgcgggcgaaggcgtcagcgaagaggccttcaacttcggttgcgcgtccggcggcagcgaccttgcttgccaggtgccggatcaccgcctcgggcgtattgcccaggttctggtcgagctcgaccagttccgtggtgatgagctgagtcactgtcaatcctttcgaagggccgtgatggttacggcatccggggtggtttggtgtactgccggaactgtggaaccgggcagggaggcggctgcggcaccgtgggccacagcctggcgaaggcagtcggccggggcggcgccccggccgtgggcaagcaggtagccggcaagcgcggaatcgcccgcgcctaccgtgctgaccgcggcgaccggcggatgcgtggccagccacgcgccgtcggccgttaccaggacagctcccttggatccgagagttgccagcacagcacccacaccggaacgtacgacggcggcggcggctgccgcggcagccaccggatccgcttccagttcgtcagcggtggccgaggcaaagccggctgcagcagccagttccgccagttcttcggcgttgggtttgaggaggtccggtttcccggaaccagtggcggtcccgtcagcgccggcaccgtctccggacattgccgcggcgagcggggcgccggaggagtccacggcgatgtgcggggcgctgccgtttccggccgcgcggatccggcgggccaccgtggcgtagaagtctgccgggaaccccggcgggagggaaccggccaggacaacccagctggcgccgcgcgagctttccagcagcagcttgatcagggcttcctgctggtccgcatcgagcaccggaccgggttcgttgatcttggtggtcacgccgccgggctcggtgagggccacgttggtgcgcagcggctcatcgatgggaagggatacgaacggaaccccgctttcgcgtagtccggcgaggacgggatcactgtccgcgccggggagtaccgctacggattccaggccggaggcaaccagtgctcgggagacattgacgcccttgcctccagattcctggcggacggagacggcacgctgcacttcgccccgttccagggggccgggaagtgcaaccgtgcggtccaggcttgggttggcggtgaaggtgacaatcatgcgatcaccacgtcaacgccggcttcttccagggcggctgcgagttccgggcctggttcgctgtctgtaatcaaggtgtccagatctttcagggaggcgaactggaccagggtttccgtgtccagcttggaggaatcggccagcaccacgatgcggcgggccgaacggacgaaggctgccttgacggcggcttcttcaggatcgggtgtgctcaggccaaaacttgcgtggatcccgttggtgccgatgaaggcaatgtcgggacggagcctggccgccgcttccacggttgcctgccctacggccacctgggtgatgccgcggacccggccgcccaggatgtccagggcgattccgggaacgctggacagtttgccggcgatcggaaccgcatgcgtgatggcaaccagttccgcccgcggttccattgcatcggaaggttcgacggcggcgcggcgggagagcatgtcggccaggacttcggtggtggttccgccgtcgatcaggacgcttcccgcagagttgcgcggaatgagggccagggcagcctcggcgatgcggatcttctggtcaggccgctggatagcgcgctcgttgacactttcctcggtggtgctgaagcggtctgccgcaacggccccgccgtggacccggcgcacggtgccggcgctttcgagggtggcaaggtcgcggcgtacggtttcggtggtgatgcggaagcgctcggccaggagggtcacgctgacccggccgctgccggcaacaagctcggcaatcatttgctggcgctcctcggcgaacacgtaccctccgttgcgtaagttcagttggtgcggtggatcctgcagtgcccacataccgcggtgtccaagcctgcgtgactggcatcacatgatgttgagttacttgactttatctttgcttatgttggtttgtcaatggaaacccacacgaaacaaagtgcacgcggtgcgggctcgtgacttgcccacaaaggggaagcgaaaagccgggccggaccgcgatggtccggcccggctcgtcgggttcattccttgtccagccaggcagtaggccggggctttacctgttgttacagtccgccgtcgcggctttcgttccgggtgatgcgttcgccggtgttgggatcaaccaccgagcgggtctcgctgacacggcggctgcggccgggcgacgccaggatcagggaggcaatgagcccaataacgcccaccgcgataaggatgtagccgatgaggacctggtccacgaaggggataaggcccggagcgaccgcccaagcgaggatggcgccgagggcgataaggaaaatggaggatccgattctcatgaggtgctccttgtgtgggggccgggcgtggtcatcacccgttgacggttgctaagcatgctgtccgttaagcgtcacgctacagcgctgagtagtcctgttcaatgcttccgggcggtgcgtaacccatttgttgtgctgtgacccctgtgaatggtggggcggcagctgcctccgtccagcacgtcccgcccggccgtcccgcgaccgccgccggtccggcacggcgtcgggcttcttcccggcctgcctcgctaggctgatcggatggaaacagttgtttggtccaagcccgaagaccagcgggcggataccccgctgctggtcatgatgcatggctacggtacggacgagtcccgcatggtgcgcctgtttgaatacctgccggcagaattcacctgtgcggcgctgcgggcccccatggatatcggagaccactatggctggttcctgttggactacttcctggccaacgatttcgccgacgtcatcaaggccaccagcgccgtccaggcctggatcaagagcgtcaagggccagcacagcagcgtgagcctgctcgggtattcccaaggcatggcgatggccagcaccttgctgcgcctccatcccaaggactacgaggcggttgtggggttgtcaggcttcgtgctgcagaacgaactgctgtccctcaccgagtcctttgatacgcggccgccttttttctgggggcgggacaaggcggacctggtcatcaatgaagacgccatcgcctacacggacgaatggctccaggagaacaccctgcttaccgccaggacgtacccgggcatgggccacgccatgtccaagacggagatggtggacgtgagttcgttcctgcgccactacgtgctgcggccggagggatccacaaaccggcggtgacgctgcactggtcctgagaagtgcgtcacgtctgttcgtgaacaaaaaaacagttgcaggctaaatttgtaagcgcttacactcgtcttcggccgttatagcggcactgaactgggtgaacaggagatcagcgcggtgcggaggatgtactgcagcgggctgcggcccgatgatcggtgccggacctgcacgcctggcggctccgccggcttgtctccaggcccccgcttgcccatgatggtagaagtgcatgggccggcagggtcaaggccgccacgttcccccgtgagcgaagacctgccgcacttcctgagcagccgggcatcgtcgccgccacacttcagagcatccttccgtacaaggctgcccgtcgtcctgaaaggacaccccaccacccatgagctataacacggcaacaggccatccagccggcgaactctccgcctgggccggcgcgtcggcaatcctctttgacctggacggggtgctgacccccacggccactgtccacgagcgcgcttggcaggaactgttcgagggcttcctggcgtcgcagccacaggtggcgggctacagcgaaagtgactacttcgaccacatcgacggcaagccacgtttcgacggcgtacgggacttcctggcttcgcgcggaatcgtgcttcccgagggtcccacggacgatgaccccgccaacaccactgtgcagggcctggggaaccggaagaaccggatcttcaatgacatcgtgagcaccggcgtcgagcccttcgaaggttctgtacgcttcctcgaagccgcactgcagcgcggactgaaggtcgccgtcgtctcttcctcccgcaacgcacccgctgtcctggaggcggccgggctcagcgaccgcttccccgtagtggtggacggtgtggtggccgcaagcgaaggcctgcccggcaaaccgagcccggccacctacgagtacgcagcccgcctgctggacctgcccagcgaggaatgcgtggtggtggaggacgcagtctccggcgtccaggccggggaggccggatctttccactccgtcattggagtggaccgtggagccgggcggcagacccttctcgacgccggcgcaaccctggtggtcaatgacctcaaggaactgcttccctaaagaacatccgccgtcccccacagcggcgcccgctgctttccccggcagctcctgtcagtaccctcttcccccaatatccccgggccggcagcaaaccagctgcccggccacacgtcaaaggacccaacaccatggccctgatctccgcggaccgcgaaagattccccaacaccccctggcagctcgtggaaacacgccacgaacagggcaacgaggggaccctggaaaccctctttgccctgggaaacgggcacctgggcatccggggcgcccactgggcggcagccgattccgacctccccggcagcttcatcaacgggctgcacgaaatctgggacatcaagcacgccgaaaacgccttcgggttcgcccgcaccggccagcgcatcctctacatcccggacgccaacaacttcacggtcgtcctggacggtgagtccctcagcctggctgagtccgaggtgctggactaccggcgctccgtcgacttctccaccggcgtctacgaatgccgggtcacctggcagtgccggtccggcgccgtggtcaccaccaccgagcggcgcgccgtcggattcgcatcccggggaagccttggcatctcgctggaggtggccacggaccgcgaggtctccgtggacgtgacctcctccctggtcaaccggcaggaccagccggtggaggaccactcggcccatgatccgcgccgtgcgggccggcacgcaggccgtgtcctgctgcccttgcgcctcgacggcggtgacgggtcgctccggctggcctgggaagctgccgaatcgaagcagcgggtgggggtcgcggtggaccactggacctccgccggccatcagccgttcgagaccctcgtggaccaggacgacagcagcgtccgctacgtgctggcggtcagccccggcgagccgttccgcctggaaaaaagcgtcagctacgccgccggccggaccattcaggacccgtcagttgacccggccgctgttgccgaggagggcctgcgcccggtcgcggacatctttgccgagagcgaagcgcattaccgggattactgggctaccgcggacatcgtggtgaccagccagtccgagctgcagcaagccatccggtggaacctgttccagcttgcccaggcaacggcgcgcgcggacgttgccggcattcccgccaagggcgtgacgggctccggctacgagggccactatttctgggaccaggaggtctacctcctgccctacctgacctacaccaaccccgacggcgcccggcaggtcctcgagttccgccacggcatgcttcccgaagccaaggtccgggccaaggaactgagcgtggacggcgccctgtttccgtggcgcaccattaacgggctcgaggcgagtgcctactacgccgccgggacggcacagttccacattgcggctgccatcgcctttgccaccaaccggtacgtgtgggccacgaaggacgccgggttccgggacgggatgggcgcggaactgctgatcgaaacggcgcgcatgtgggtttccctgggcttcttcggcaaggacgggctcttccatatccatggcgtcaccggccccgacgagtacaccgccgtggtcaatgacaacctttacaccaacgtgatggcccgctttaacctccgggctgccgctgccctggagcatgcgggcgtcaccgacgaggagcggcagctgtgggaagcggctgcgaaccgcatgcagctgcccttcgatgagcggatgcaggtgcattcccaggacaacgacttcatgcaccttgagccgtgggactggaacacgccccgttccaagtaccccttgctgctgcacttccaccccctggtgatctaccgccaccaggtcctcaagcaggcggacaccgtcctggcgatgttcctgcagtggcaggatttcacggctgaggagaaacaccgggccttcgacttctacgatcccctgacaaccggcgattcgacgctgtccgcctgcgtccagggcatcatggcagccgaggtggggtactcccgcgaggcgctggaacactttaccaacgctgtattcatcgaccttgacgacacccacggcaacaccatcgacggcgttcacattgcctccaccggcggggtgtggagctccctggtctgcgggtttgccgggttgcgggaccagggcccggttccttacttcgacccgcgcctccctgctgggtgggacgggctggccttccacctcaagatccggggccgcctgctgctggtggaactcgagaccggctccatcacgctgaccgtccccggaggggagcccctggcggtggacgtccgcggccagcagttcaccgtcggcgccgaacccgtcagggtggcactggctcccgtgccgcagccggagcccacggttttccccagcgggcatccgacggcgagcatcccggtggtgcgtgccaacagctgagtgcggggcggcggcgggagcctagtctcccgccgtcgtcgtgcgttccagctcaggttcccggtccagggggtgggccagttcgtcggcgggcatccgtgcaacagccatggcgatgaccgccatcaccgggcataccccgccggccaccaggaagatcagccagaggggcagcacctcggcagccggcccggccagggccatggacaccggcatcagggccagcgagacaaagaaatccaggctggagacccggcccaggaggtgcggcggaacccgccgctggagcagcgtgccccagatgaccatgcccacgctgcctgtggcgccaaagatgaacagtgccgcggcgattgcccagaagctgtccatgacaccgacggcggccagcggcaggctgcccgcaccccaggacaccatcatcaccgtgaggtagcggcgcggcagccggaaggacgcggtcaacagcgagcccagcgcggcgccgacccccatcacggccagcaggaagccgaacatgcgggaatcgcccgccagctggtcgcggaccacgaacggcagcaggacttcgatggggccaatcaggaacaggaccgagatgcacgcccacaccagcgtccacagcagccacggggtgcgcagggtataaatgacaccctcccgcaggtcctggcggaaggatgacttgcctcgttcagctcccgcagccaaggaaccgtcttccgtcccattgacgggagcggccagtgcatgctggcccaggaagttcaggacaatgaatgccaggaggtggcacaccgcaaccgccgtgaccgcgtgcgacggcgagagtgcagccaccaccattcccgccacggccggaccggccgcctgctggaggacgggacgcatggacccttccattccgttcgctgccagcaggtcctgggcgggaaggatgcgcggcaggattgcggagtaggcaggaaagaagaacgccgcgccgacacccaggacaaaggaacccgcagcgacgtgccacagctggagcaggcccgtcatggcgagtccgctgacggccgctatcactgcgaggttggcgccctccacggcaatgatcagccggcgctgggggatcctgtccgcagcgatgccgccggccaggacgaacgccaccaggcccacgctgccggctgcggccaccagggacagttccagcggaccgccgcccaaatggatcacctggtagaccatggccacggcccacatgccggaaccaaagattgagatggcaagcgctgcgatcagtaccctgtactcgcggtgggcaaaaggccgcagggccttgggggtgggcataggctaagtctaggctttgggcgaactccggaggagccccgccggcctgccccgataagacgcagcctgtcccggattggacgcggcgggtgggtggctgctcccgcggtggcctaatgttaagcaaccttagtatgaggaattccggcacaggcgtgccggcgagacaagcagaggtgaccatggccaagcgcagcaatcccgcagtacggatagcacaggaaaccgcccacaacgcggtgttcgacgcagacgggaagcccaaacccggtgtccacaatatgctcctgaaggcggtggagatccagcgcccgctggtggtggcctacatccgccggctgcagaggaagcacccccgggccacggccgcccagctcgccgacatcctggaacgcgactacctccgcgcggtcaccggcggcggtgcgctggtaggtgctaccgccgtcgtgcccggcgtgggcaccgtggcatccctcggattgtccgccgccgcaacggtcgggttcctggaagcaactgccctttactccacctcccttgccgagttgcacgggatccggctcaccaacccggagaaggccagcaccatggtcatggccatcatgctgggcgaggaagggacagccctcattgggacgctcagcggccaggctgccggcagggaaatgaacgccaacaacgcctggggcaacgtcctgtccaagtcgatggtcgtgccgggcttcggcagcatccggaacaggatccagaaagccttcctcaagaacctcctcaagcggcagggatccgccctgttcggccgggcactgccgttcgggatcggggcggtggtgggcggagccggtaacctcgtgatgggccgtgcggtggtggccaacgccaaggaggcgtttggacccatgccggataccatccccggagagctcacggctgccgcggcggcccaggacaccccgacgctggaaggcaacactcttggatctcaacgctgaccttggcgaatcattcggctcctggcggatgggggacgaccccgccatgttccagctggtcaccagtgccaatgtggcgtgcggcttccacgccggggacccggtcaccatgctggacagctgccgggcagcctatgaactcgatgtgaccgtcggcgcccacgtggggtaccgggacctggccggcttcggccgccgctcgctggacatgagcttcgacgagctcttcggcgacgtgctgtaccagctgggagcgctcgacggcgttgcccacgcagttggtgcctccgtggactatgtgaagccgcacggtgccctgtacaaccggctggtccacgatgccgaacaggcttcggccgtggtggccgcggtgaacgcctacgatccgggcctgcccatcttggggctcccggactccgagctcctgaagcaggccaggcacgccgggcatccggtgttcatcgaggccttcgtggaccgcgcctatcggccggacggcacgctgcttccgcgctcggaggagggtgccgtgctgcacgacgtcgacgcgatcgttgagcgggccgtgcggctggctgccaagggcgaagtggtggccgtggacggaacagtggtgcaggtcaggccggattccctgtgcatccacggcgacaccccgggtgccgtggagatggctgccgccgtccgtgcgggactggaagctgccggcatcgagctggagtcgttcgcgtagcagtcgcctgccagccggggctcagccgaaaatcaggtgcgccaccgtgaagatcgcaagcccggccagtgcgcccaccacggtgccgttgatccggatgaactgcaggtccttgcccacctggagctcgatcttctgcgacgtttcctcggcatcccagcgggccacggtgtccgtgatgaccccggcaatgtccgaccggtacgtccgcaccaggtagccggctgcgtcgccgatccacgcgttgaccttgccggccagttcagggtcgctgaccagccgggagccgaagtcccgcacggccgccttgaacttcactgtcagttcgctgtcgggatcgtccacggcgcccagcagcgcgttcttgacggtgccccatgttcgggaggccagttcgcgcacctcggggtcgcccagcacctgggccttgatgtcctcggcgcgggcgatcatcacaggatcatgctggaggtcctgggcaaggtcgttcaggtacttgtcgatggactgccggacctggtggttggggtctgcctgcaccgcccggacgaacttaaggatctccacatacaccttgtcacccaccaggccgtcgacgaactgcggcacccacgtgggggaacggtcggacaccaggtgcgtgactgtgtcgtggttgtcgtccacccagtcggcggcgcggtccaccagcaggtccaccaggttgtggtggtgcccgtcgcggaaaatccgttcggccatcttgcccaccggcggcccccacggcggagtcagcaggtgcttacgcaccattccctcgatgaccgcctggacgtcgtcgtcattcaaaaccttgaacaggccgcggatgacggcggcgccttccttggccacccgctcggaaccggcgggcgtggcaagccactcgcccgcccggcgggcaatattcacgctggcgagcttgtcctggaccacctgttccgagaggaagttggtctcaacgaattcgcccagcgaggcgccgatctggtccttccggcgcggaatgatggccgtgtgcgggatcttgatgcccatggggtacttgaacagtgccgtgaccgcgaaccagtcagccagcgcgcccaccatgccgccctcggccgccgcgcgcacgtactggagccacggatattccttctgcagcgcgaacgcgaagacgaagatcactgccatcaccagcagcagtcccagggccaccagcttcattttccgcagcgctgccgccttttcggcgtcgccctcacttagctgatggccgacggcggcccccgcctccgcgcggtccctcgcaggaggcggtgtggaaggggcgggcccgccgggcgcgtcccgggtagttggctcagagttcacctgcatgtgccaagcctagtcccgcagcacggggccggtcggctaccgtgtctgcatgagtactgatgagtcagcgccgcagcggccgttggtctttgcccaccgcggctccagcgccgcgttcgccgaacacacccgggccgcctacctgcaggccctggccgacggcgctgacggcgtggagtgcgacgtccacctcacgcgtgaccagcacgttgtcctcctgcatgacgccaacctggaccggacctcggacggaacaggccccgttgcggagcgcaccctccgggagctgcggcacctggacgtctcatcgtggaagggcgtccgcatcccggaggcatacggggcacggtcagagcagctcctcaccctgccgggactcctggagatccttcggggtgcggggcgcccgatgaaactggccatcgagttcaagcaccccagcccgtaccagctcaagctggaggaccgggtccttgaggtgctgcggagcgaggggtgggaccccaaaagctcttccgtggacaacgtggcggtgaccttcatgagtttcagcccggactccgtccggcacctgctcacctcggttccgcccgagtacatctgtcagttggtggacgacgtggatatccgggcgatccgcggcgggctgggattcgggatgatcaccggcggcgcaattgccaacctgatgcgggccacccaggccgaaggcgagaggatccttgacaacggcgaggtgggcctggcggggcctggcatcgagtatgtccgccggcaccccgcggccgtccagcgctggctcgcctgcggcctgcgcttccgcgtgtggacggttgattcggagcaggacgtggccctgtgtgcggggctgggaatccaggagatcaccaccaatgtcccggcccgggtcctgggccagctgcaggttgcctcgccgcaaggtacgtaggggcgcagggacgggatcccggacggcgtgcccccgctgggcctgacggttacaggagcccgccgcgcctgtggttgagtggagccatgccttttccccgctccggccgggccgcccagaccctctccgctgcagccctgagcgcactgctcctggccagcgccatgaagcacttccgcgaccccaccttctaccgccaggtggtcccgggctacctctgccgtaatgacgacgctacccaaggtgccgcgccttcgcgtccgcttgccctcctctcccgggaggaatggatcgccctgagcgggctgctggaactggcagccgccgtcggaatccttgtcccggctacgcggaaggtggccgccacgggcaccgccgtgatgttcgccgcgttcctggccggacacgtggacgcgctccagcgggcgtacggaccgcagggaacgagcgcccagcggaaggtgcacaccgtccgccttcccctccaggcgccgctcattgcctgggcgtggagcctgcgccggccggccggcggagcacgtccgtgaccctgctggcatccccggcggtgcggatggggatctccatcagcatcgccaccggactgtacggcgtatccttcggggcgctctccgtaacgtccgggctcgacttctggcagacgatggcgctgagcctgctcctgttcagcggcggctcgcagttcgcgttcattggcgtggtggccggcggcgggtccggcattgcggccatgagcgccgccacactgctgggcatgcgcaacggcatttacggcatgcagctcaacgccctcctgcatcccaccggctggcggaagtacgtcgcagcccagctcaccattgacgagtccacggcaaccagctccggccagacggaccccgcagagcagcgccgcgggttctgggcggccggcatcggcatctacctgctgtggaacctgttcaccgccatcggcgcactcgccgggagcggcctgggcgaccccaagcagtggggactggacggtgccgccgtggccgcgttcctggggctgctctggccgcggctcaagggacgcgagccggtggccattgccgctgtatgtgccgtggccaccgtcgtcgccgtgccgttcgtccccgccggcgtgccaatcctggtggcggccgtcgtggcagcggtgatcggctggttcagccacggccggagcgacgaaggcctggagccggacgtggaccccttccgggaacgccaccacggggcgcagcgcgccggggaaaccggtccgggggccaccgaatgagtctctggatctggctgctgattgcctgtgcactggcctacgcgtggaagctggttggctatttcgttccggcccggctgcttgaagacccgcgcatgtcacgggtggcgggcaccatgaccatcggactgctcgcctccctgacagtggtgaacacctttgccacaggacagtcgctcgctgccgatgccagggtgggtgcgctggtggctgccgccatagccctggctcttcgcgcgccgttcctggtggtggtcctcgcaggcgcaggaaccgctgcgctgttgaggagccttggctggagctgagggcgcagggacagcaacacattcaatccatgtgatgccgctcacagctgctgggctttcccggttgtactataaaagcggctatgcagtcggccgtggaatttcgcatgaatggtgaccatggacaatcaactgcatgcagccggggaaagatccggacgtctgcaccacaagagttcgagacggcgggcgggactccctgccaagcgtttcttcacccggtttgcccgcctcgctgacgttccggaggaggacctggaattgctttcccggagcctgctgacgtcgctggacctggatccggcatcccacattccggcactgcaggccttggtgcaccaggaacttcgcagcaggggagaagctggcggcaagtagcaaaccgcatcccggaaccgatatgtggtggactggcaccagggccgcacatccactgcggcggccacaaaggaggaaccgagatgaacgatcagtcacgtccggagcagcaggggaagccgcggcaaggctatcttgacccgaggggttcggaatctacccgggagatgcgggataccgcccggcgccgccgggatgccgaggaaaagctgcagcagcacctcaacgaggccaaagaccacgtccccaatgagcgcgatgaccagccggggcagcacgaccataatgagcccgacggcgacggcgacggcgacggcgacagcgacagggacggcgacggcggacagggctcgtcgcgctaggctgggccggcagggcactgggtacatccccggtaaggctggcggacgtgtgtgcccgcatcaaccacgcacgaaaaagggtgggccgccggggaggttgccagcttctggaggagatattgcctgctggccaggagagctaaagccggctggctaggccacgccgtgggcttcgccagcgggcgccccggcccggcggcagctctcttcgacggccatctcgtaccaggcctccgccccgaattcgggttcaggagtatccaggttctggtataggctgtccagcaggtttgcgagctcttccgcgttcagcgagggaaggacttcctcggggcctcgggggtcgttaaggtatcggttcagttttgaactgttcattgtgccgctgccaggatgcgccggaactgaggggattgcttcatgggtcactccatcccaaagttgggaggctggctgcgtaacccctcctgaagtgtattgcacgtgcaggacgcccacaatggtgccatccgcgcgtcaaacacaaacgccggccccagcggtccggagccctggctgtgcctcgtacggcgcggccctactgcacgccttagcccaggttggggcccgttccgggtgtggacgggaccggcacatgggcaggcaaggggcgggtgggccgcacggtccggatggcgtcctcaaccagggccagcggacggcgccaggcgtcggaaccgggctccatggtgtccaccacgccgatgagcattgcgagcagccggaacatgtccgtcatggaaatgtccgcccgcaggcttccctgcccctgcccgcgcaccagcagcacgctgatggattccatgagtgagccggtaatgccggtcaggagttcgcgccgccctgcgacggcgcccagcaggttggcgtcagcgctggccgcgtccatgagtgcctccaggacccgcagcaatccggcggccccgtcgatgtccgcaagggcaccgtccaccacaggatccaccgtgaggcggagctgccggtttagggcggccagtaccagctcctccttgtccgcaaaattgcggaagagggtggccgggccaacccctgcggtagccgcgatggtctgcagcggtacttcaggtccaaaatcgcggaagcattgccgggccgccgtgatgatcttgtccacgttccgcgctgcgtcggcacggaggggcttacgggcgactgcgaggctcatgcgaaaaggttagcaacggagctttcagcgaacaccgttactgcacggtagggggttatgtgacgttcgcgggcgccttccggccctttcgacgcaggcaaggcgtggcacactggcttcatgttgcttgcgttttctgtcgccccgtcgggcgcccccagcgaaggttcccggcccactgacgcttcagtgcacgacgccgttgccgccgccgtcaaaatcgtccgggagtcgggcctgcccaacgcaacggactcgatgttcaccaccatcgaaggtgaatgggacgaggtcttcgacgtcgtcaagcgggcaacggaggcagtgggacggtatggcagccgcgtctccctggtgatcaaggctgatatccggccgggttactcaggagaactgaccgcaaaagtggaccgcctggaagaagcgctcgcagacggttcctgacccctcccgcagccccggcccgccgtcggccttctccaatcccgccgccggccttttcgccgtcccccaacttctatggaccccaaggctgccccgtgccaaactgtggcaatgttcgagcaccagccccggccggagtggattgcggctgaagagttcctgtcccgcgtcgtggtccatcccgatcctgcgctgcagcaggccatcagttccgccgcggaggcggggatgcctgccatcgaagtggcgcccaatgcgggcaagctcctcaagctcctggtgcagctgacgggagcccggcgcgtgctcgaaattggcacgctcgccggcttcagcaccatctggatgggccggggccttccctctgacggcacccttgtcacctgcgaattcctgcccaagcacgcggaagtcgcgtgggccaacatcgatgccgccggactgggggagaaggtggagatccggctggggccggcgctggataccctggcggcactggaggaggaaggccgggagcccttcgacttcatcttcatcgacgcggacaaggagaacaacagccgctacctggactgggctgtccggctgggaaggccgggggccacggtggtcctggataacgccgtctgggagggcgcaatcctggacccccgaatggacccggtcaacgcgccgggaatcataggggcacttaagctgttgggggaacacccgcggctcgacgccaccgtcatccagaccgttggctccaaaggctgggacggtttcgcgcttgcacgtatccggtagcacccgtgccgggggaccttcctgccccacaaactgctaagtgtgcttagaatcagaatccggctggcgatcagccggaccaacagcagcagtggaggaaactgatgaaagcgtcacccacccttgccggcaatcttcagacggtgcttacggacctcattgagctgcacctccagggaaagcaggcgcactggaaccttgtgggcacaaacttccgcgacctgcacctgcagctcgacgagatcattgccgccgcccggctctttgccgaccaggccgcagaaaggatgcgcgcgctgcatgcccttccggacggccgcagcagcaccgtctcagccggcacccggctggacgggtttccggaaggcctgacctccacgaagcagaccgtcaaactcatcacggcccggctggaacgaacagtccagactatgcgggatgtccacgatgaggtggatgaggaagaccccaccagcgcggacctgctccacgctgccatcgagcggctggaacagctggcctggatggtcaatgccgaaaccatggcacccacagcgtccgtcaccgagccggccggcacgtaggcgccgccgtcacgatgcaggaactctccgaagaacacagcgcacaatccgccggggacgcgttgcccggccccaacgcagcagtccggctgtccgctggcagggaaggcccggacggcctggatcccctgttccaggccgtctccgccagcgccggtgatgtgccggctttactcgagctggcccgggaggccggtaaacggtggccgaagcccggtgaaggcagtaccgggctgctttgggaactcctggccacagtggccgccattgacgttgcagctgcccggatcttcgagccgcatcttgatgccctggcgatcctggcccaggcagggcatgatcctgcccgtgccggcggggcctggggtgtttttgcggcggaaggtccaggcatgcggctcgctgcggaaggcaacggttccggggtgcttttgagcggtgccaagccgtggtgctccctcgcccaggtgcttgaccacgcggtggtcacggcccatacggacgacggcggccgtgcagctttcgcagttaacctgcgccacgccggcgtgacctgcgaggaaccggagtgggtggccaggggtctgcaggaaatccccagcgggaccgttcggttcgaccgggtccccgctgagctgttgcaggggaccaactggtacttcagccggcccggctttgcctggggcggcatgggggtggccgcgtgctggctcgggggagccgtgggcatcgcccgcgactaccgggattccctccgtgccggaggtctttccggccgggagccggaccaggttggactggcctcgctgggcgagctggaccgcaccctgacctccgcactgcagtatcttgcaggaacagcggacggcatagaccggcggggacaggggtccactgatcaggtgcccgctgaacagctgcccgctgaacaggtgtcctctcaacgggggaacgccgggcgggtttcgccgtggagcgatgcgctgcgcgtgcgcggaacctgtgccgccgccgtcgaacgcgttttgtctatagtgggcagcaaccgcgggccgggaccgctggcattcgaccggacgtatgccaaacggatggctgacctggcactgtacgtccgccagcaccacggcatgcgtgacgacgcccagctgggctccctgaccttgaaaggtgatgcgccgtggtgaccttcctgcacaccgacgaggggactgacgagtcggcctggtgcgtccggggcctcccggtcattcctgagctcccgctgggtccggaggagcttgccgcgatgcgcttcctggtccttgccgcacacccggacgacgagacgctcggagcgggtggcctgctggcgcggctgcacgccctcggcgcagaggtggaggtgctgttgtgcacggcaggggaggcctcgcaccccgggtcggaaacggtctcccgggaagaactgaccgccaggcgcctggcggaattcgccgcggccctggaccgtatggggctgaaagaccgctggcggtacctcggcctgccggacagcggcctggcggagcgcactgcggacataacccgtttggtcagggaagccgccgcagggctggccggtgctgcagtccggctcgccattgttgcgccttaccgcgccgacgggcatgccgaccatgatgccctcggaaccgtagccgctgctgttgccgccgacaatggttacgggctgctggagtaccccatctggtactggcactgggcaacccccgggcacctggaatggcagtcttgggtgaggttgccgctggagccgggggaacagtccgcaaaagaacgggccatgcaggagcatgccagccagaccaagccgctttccccgcatcccggtgacgaagtcctgctgagcgaatccttcctgcggcacttctcccgcccctttgaaaccttcgcctggactcctccgcaggagtttttgcccggaaaagcagatgcccccggaaccgtggcctacaccagcaaggaagcccaggacatcttcgacggtatccacaaccgggaaccggacccttggaagtacaccaccagctggtacgagcggcggaagcgcgcgctgactgtcgcagcattgccctccgaacacttttcctcggcgctcgagatcggttgttccatcggcacgctgacggccgaccttgccccgcggtgcaccaacctgctggccgtagacgccagcggtgcagcgttggggcaggcagcggaacgcctggcccctttcccgggcgtcaccgtcaggcagctgacgctgcccgccgagtggcctgccgggaacttcgacctggtggtggtgtccgaggtggggtactacctctccgccggtgagctcgatgccctggtcgaaaaagtcagggactcgatcctccctggcggcactctgctgctgtgccactggcgccaccccatttccggctgggagctggacggcgaagcagtgcacacccgggtgcgtgaccggttgaaatggcccacctccggcctctaccgggagcgcgacttcctgctcgagaccctggcagcgccagcggcggcggtgcctgcgccttgactcccgtcgacagggtggccgtggtgattccggtccacaatgaggaggaacacctgggtcgcgccctcgccggcgtggaggccgccgcatcgacactccggcaggtgcacccctgcatcgacgtcagggttctcgtggtcctcgactcctgcacggacggttctgcggccatagcttccgcatacaccgcccggaacacgtgcttctctgtccatgaggtcgcctttcgaagcgtgggaaggagcaggcgggcgggaaactggcaggctctgggcgctggggcagatgcaagccctggcgccggggccgggttgtggctggcgaacaccgacgccgactcggtggttccggacaactggctcgtggggcagctcgagttggcagcggcgggagccgatgcagtgcttgggtccgtggaagtggaccctgcggggatggcacccgaactgctcagccgttggcagtcgatgcactccttcggggaagaccacccgcatgtgttcggggccaatcttggcgtccgcggttcggcctaccttgtggcgggcgggttcccgcggcacctctcgcatgaggacagggtgctggcagggcggctccgggaccacgggtttgatgtgagggccaccgacaccatccgggtccggacgtccggccgcacgcaggcccgggcccccaagggctttggggcctatctgcggacgcttgggatggagatcgcattggcgccggaggcataaaggcagccccgtggcggcgtggctttgcggaacgtggcttaacgggaaaggggctgctgcggttgcgcagcagcccctttcagcaggactagtccttccggaaagcgtccttgaccttctcgcccgcctgcttcaagtcagccttggcctggtccatctggccttcagtccggaggctttcgtcatcagttgccttgccggttgcttctttggccttgccggccatcttctcggcggcgttgtcgatcttgtcgtccaaacccatggtatttctcccttcggctggtgacctgcggcgatacgcaggtcatgctcccatgctagccagccaggcgttgctacaacagatggctggccgcgccgggggagctgctggaagaggcaaaaccggcgggagagcgtcagaccaggtcgggagcgcttgcgacgatgtaatccgcggcggcaggaccggtcatggacaggttgttgctgtccgggtcaataccgtgcgttcccagcgccgcccacagcgcttccggcggctgaagccgggctttgtggagaaggcaccagctggtgtagaggccatacagctcatcgcgtccgaggcccagccccggctccctgtccgcgacaactgcttcggcaagaaaatcttcaaaatgtgtagcaggcatgttcgctcattcgggctcgaccttgatgccgccgtatctgcttcagcggccctgccggccccggagggctcaacagattaatcatgaaggtatggcagggcggctcgctttgtccagttaggctgcccagtctggacaggcaatgcaggctcgcgggaaacccggctggcccggggcttcatggcggcacgattgctccaagggtgcggccggatcgcatggatcgagggggccgacggcgactggggggactggcctcggtctcagaagaggccatctcaccgccggccccgcctgctcccgggtaccttgataaacccgggaaacttaaacaggacctccaagacaattttctcccatcttgaaggtcctgcctagtccccgcggaatgccctatcgggcgtcggtggcgccccggtcgtcgtccccgccaagggcacggtcgcgcaccttgtcccggacccggtcccggtgcggctccgtgggctgttcggagtcgcggcccccgtcctggtcccggccatcgtccgaggagtcatccccgccgttcccggcgctgtacttctcacggatttcgcgcccgtgctggatgtcctcttcctcctgcttctgcagcttttcgctcttcttggtgtccctggggggcagctggatggtttcctcagccttgatgcccgcctggagctgccggccgcgctccatctcggcgtcgaactctgcaccgaagagcagcgacatgttgaggatccagagccacagcagcatcacgatcacgccgcccagggcgccgtaggtcttgttgtagttgccgaagttgcctacgtagaagccgaaacccagcgatgcaagcaggaaaatgaatagggcaatgccggagcccatgctcatccacttgaatttgggctgcttgacgttgggggtggcgtagtagaggacggcgatgatcgcgatgatgagcacgatcatgaccggccatttggcgatgtcccagatggtcaggaatacgccgctgaggccgatcaggccgcccaccgcttccgctaccggcccgctgaggaccagcatgccggcgaggatggccacgatgacaacggccaggagcgtgaccaccagcattgttccgcggagcttgacgaacgcacggccttcatccacctcgtagacccggttcatggcacggccgaacgcaccaacgtagccggacgcggaccacagtgctgtggcaaggccaataaccagggtcaggcctgcggccggtgcacttgccaggtcttccaccactccgccgaccgtgtcaacagtctcggccgggacgaaaccgctgacgattttcaggagcgcgtcggtggtcttctgcgggtcaccaaagagtcctatcagggacacaagtgccaggatagccgggaacagcgacaggaccgcgtagtaggtcagggcggcagccaggtccggacattggtccttggtgaactcccggaaggttttcttggcgatgtacttccagttcggcttgaccagatctttcggactctccggcttccgggaatcatcgggcgccggagcctggtccgctttggcggtgctgctctcggatgcgtcatgagtggccatggggtgtcctctcgataaggggcgaaaaacggacaggccagctccgcggttggcggggccggcctgtcagggtagtgctggtgccttgcttgtgccgcggtgtgctggatgccgcttaggtgtttttgacgttgcctgcggcgtcggtggtgcggtctttgacgtcggtggcggcgtgttggccttcggctttgacgttttgggcggcgtcggtggcggtggccttgacgttttccatggcttcctgggcgggttccttgaggtcctggaccatgtccttggcggcgtcggtcacctgggtggccaggggctgggcggcggttttgagctggtccgcggcttcccgttccttttggctggccgggatcagggaggagatcagcattccggcgccgaacgcgatcaggcccgcggccagggggttgccctgggttttggctttgacctggtccggtgcgttggagatcgctgttccggcatcgccgagtttggccgcggcggtgtctttggccccgtgcagggtgtctccggtggagtgcagtgcgttgccggtgtgtccggcgccgctgtgcatggtgtcctgaacacgggtagtggtgtggtctgctgcgcccatgattttctccttgaccccgctgactgtgtctttaagcttgtcggtctggcggtggacgatgtttgagggggtgactttgtcggccacggcgtcaacgttggtgcccaggcgcgcgcgggtggcttctatgtctgaacggattgcgtccgggttatcgctcatcggtttacctcacctggttttagggttgggggtatttcggacagggtttcgctggtctggggcaggcccttgacctgtttgagttccttgcggccgatcgaggccaggaccgcggcgatgatgccccagatcacggcgacgatcagggcggcccagcccagtggcatcagggcgcccagggcgaacatcaggcccagggacaggaagatcaggacgaagtgtcctgccacgcctgccccggcgagcatgcccgcgcccttgcccgccttggtggcggactgtttggcctcggccttggccagctcgacttcctggcgcatgagcgtggacaggtcacgggtcacgtccccgagcagctcacccagcgaggcgttatcagccttctggtgcgcctcactcggagcgggttccggaatcgaactactcatcacagcccgccagactggccatccctggaacggtcccgggtgaggggatcgcctgccatgggatcgtcggcaaggtcgcggtcgcccagcggatcattggcaatccggtttccggaccacggttcttcgaccagctgcgggctgtccaaggggctggcgggacgcgtggggtcggaatagctgctgcctggcgcgccgccgtcgtatccagccgttgtggtggccgggccggggagctgcaccggagggggcggtacggtgccgcccgccgggacataggactcggtgtaccggtctccgtaaggggtgccggagtaaagcccggccgtgccggtggtgccgctggtggatgaagactccggtgccccggcggtgagaccgcgggtgagcctgccggcaaggacgcctgcacccgctgcaagcaggaggaaggttccgggtttgttgcgggcaaacctctggacctcgccgagaaggtcacccggctccctgttctctagccaggacgccattgaagaggtgcgctctgcagcctgccggaccaggtcgctggccataccctgctggtctggagcggtggccatgctatgcagctggctggagatattgcgcatgccttcggcggccttctgctgctgggttccagcctggcttgtcaggcccgactttgcctggtgcagcagatcctgcgcactggacttcgcctcggacgccacatgcgcggcttcttccttggcggtctgcgcaacgttctgggcagagcccttcgccgtgcgggcgacgtcagccgcttcttcctttgccgcatccttgcgggaagtccctgagctgtcgccggcctggcctgcaccataggggggagtggcggctgacgggaaggtagcggcggaccgctcacccggaattcctgtagaggccgggggagccgtggcagcggggtcctcgggccattggttctctgtcatcttcgctctctctttccaagaaggccggttgttgatcaagaaccagcagtactggccgtaaaataataagcatgattactaataaaaggtaagtgcccttgctaagcgagttctaaacagttccaacagagtcagccggaagggcgcaggccggtccggtcacatcaagtggaaagtggtgggtaacgtggaaacagctccatgggtatgggtggtaattgccgttgtggtggtggtgctggttgtgctgctgttgctgtctagcggacggcgccggaaggcgatccagcaaaagcgcgacgacgaacaccgggagaaggcagcagaaatccgccgtgaggcagaggttaaggaacttgacgcccgggagcgtgaagcgaaggcgacgcgcgccagggcggatgcagaacaggcccaggtggacgcagccaggttgcgccagcaggctgacaagcaggctatggaggccaaggcgctccgcgacgatgtaaatgaacgggcgcgtaaggcggatgagctcgaccctgacgtcaacggcgagctccgcggtgatgccaacccggaccgccgggaccgcagcaaccgcgaacgagtcagccacgatggcgcgggggacggcgcccctgacgcaggccgcggtactgatggccgtggtactgatggccgcggcgtccgaggggccggcgcccatgatggcgtacgtgacgacgctgcccatgatggcgtgcggggcgacgctgcccaccatggcgtacgtgacgacgctgcccacgatggcgtacgtgacgacggggcgcggaacggccgccccgacgagggtgccaatcctgcccccggcacgcgccgtgaccgggaggatccccactctggcatctagtccacgggcggtaccagtttccttggcttgagcacgggggagggagttactccttcccccgttcccatgccctggagaaccgccctgacggcatcagtggccggtatcgtcggctcccagcagaggatccggcgggcccggccagtgtccatgatgggagcgccggctgccatttccacccacccggagtcggtgggctgaagccgcagccgccacgtcaggccaacgatcctgtgaagcagccccatgggaatggggagtatcctgcgggcgcccaggatgcgggcgagttcctgcggcgtcagcaccggctccgccgcgatgttgaaagccccggaggcccgctggtcgataacacgccagtaggcgtccgccacatcatcagcgtgtaccgcctggaagaccaggctgtccggggcgggaagcagcggaatccgaagtttccccggcagcaggcgcggcaggagcctgccgaggaaatacctgccgatctcacttccggcatcggactggaaaatcaggcctggccggagccttgcaaccgagatgcctggctccgctgccatgaacgcgtccagggcttcctcctgctccgccttgtgccggctgtagtgcgagcctgccatgccgtggaccggccacgattcgtcgtgtcgctgatctttggatgccttgctgtaggcgccgaccgacgaggcacagaccacctgtttcaccccggccctggcggcagccgccagcacgttcctggtgcctgtcacgttggtgcggtacagctcttccaaatcccggttgggctggatctgccaggccaggtgaaccacggaatccacgccttccagggcggcatcaagccgggtgcggtcgctgtccaggccgacgtccagggggtgccattggatgccggagtagggttcccggctggtgtcggggaggcgcctgctgatccccgtcagtttcaggcttcccggcttttcggacagcttggcctgcagcttgcggaggagtgctgttccagcatttccgctggcacccgtgatggcgatgtgcatggcaaggactccttggcttggcctcccggtacggctgacaaaccgagcctatatccggggagcattgttttataagcaaccttatgatttcctacttctaagtcttgccgcaggctttcggacccctacccgagggaaccaacgacaatgcccgaaaactttcccgcacttgccgtggatacaatgcccgtccaccagacccagccacaactccagggaaacagcccttccggtactaaagcgggacggctgcgccagaccttcgaaaacgacctggtcctcggctacctggacctggcggaggccctggcggcccggtttgaagcccgtgggcgcgaacgcgccgacctgaaccaggttgcctaccttggactcgtgaaggccgcccgcggcttcgaccagtccaagggcgaaagcttccctgcctacgcagcccccaccatcacgggggagctgaagcggtacctgcgtgaccgcacgtgggttgtccgcccgccacggcacatccaggacttacgcacccggatgttccgcgccgagccggagctcacccagtcgctgggcaggaatcccagcgtggccgagctggcaggggccctggacgaagatcccgcggccgtgcaggaagcaatctcggcctcgagcagcatgcaccccgactcgctggacgccgtcaacccgcactccgacgcgccgtccatcggcgagatgctggcatgccccgagactccgctggaacgcctggaggagctcgcctgcctgcgtgatgccatccaggacctggaccccgcggaccgggaactcctgtaccgccgctacttctgcgaggaaacccaggtgcagctgggaaagcggctgggcatgtcccaaatgcaggtctcgcgccggcttgcccgggtgctggtggctctccagcgaaggctcgaagacagtgccatcgcaggaccgggagacgaaacacaagggaacactgcccggggaaatgcaggccacgggacccgtatggtcccggtggccggcgcgtccttgcggaccgcccacggagcgggcagtcctgccccgtccggcaggagtactgcccgccggggtgggggcgaggtagccgccaggctccccctggaagcgtgaatccgccgcgcgtgaatccgctgcgcctgagtccgtagcgcgggaattcccagctcctgaatccggcgttccgtactccgccaaaagacctcaagaaaaccgccaacagccaagggcgggcctatcttgcctgttcagcgccatggccgaacaacagaccgaaagccgggaaaaacatccggccccgtttaggagcagcagcagaggggaacagggaggacatgggaagcaccgaaacaaccaggctcagggctgtcctgttcgaccgggacggcacactggtggtcgatgtgccgtacaacggggacccggaccttgtccggccgatgcccggcgctaaagcggtactcgatgccctgcgctctgacggaatcgcaaccggcgtagtcagcaaccagtccggcatcgcccggggcatgatcactgccgacgacgtcgccagggtaaacgccagggtggaggaactgcttggcccctttgacgtgtgggaagtctgtccccacgcggagcaggatggctgcccgtgccggaagcccgcaccgggaatggtccatagcgcctgccggaagctcggtgtcacagagtccgaggcagcactgatcggcgatatcggcgccgacgtcagggccgcggaagcagccggcgccacgggcgtcctggttcccacacctgtcacgcttgccgcggaggtggctgacgcgccgctggtggcccaggacctggccggcgccgtgcgcctgctgcaggagcggcggtaatgggccgcgtcctggtggcgcgcctggacagcatgggcgatgtcctcctggcgggtcctgccgtcagggccgtggccaacggcaggatcccggacggcagcaggcccaaccacgtagtgatgctgtgcggcaggcagggtgaatctgccgccgccttgctgccgggtgcctccgaggtctacagctgggacagcccctggatcgtgaatcctgcaccgaaaatgaccggcccgcatgccgacaggctcatcgaatacgtccgcaattccaggatcaccgaagccgtcatcctcacgtccttccaccagtcaccgctgccgctggcgctgctgctgcggttggcgggtgttgagcgcatcaccggcgcgtctactgattacgccgggtccctccttgatgtccggctgaagccgggggaggactttcccgaggaccagcctgaggctgaacgggccctgggtatcgcggaggccgcggggttcaggctcccggcaggggacgacggcaagctgcgccttgcctctgtgccggacgtcgcggaccttgtggggcacgacccgtacgtggtggtgcaccccggcgcggccgtccccgcaagggcctggcccccgctgcaccacgcggccgccgtcgaacttctccagggcgcgggacaccgcgtggtggtcaccggtggtcccggcgaaacctccctgaccgccacggtggcaggaccctcggcgctggacctgggcggcaggacggacctgcattccctggcgggcgtcatggcaggcgccggtgcagtcatcaccggcaacactggtcccgcgcaccttgcggccgctgtcggcactcccgttgcctgcctgttttcccccgtggtcccggccatccgctgggcaccctacggggttccgctggaactcctgggggaccagaacgctgcctgccggatgacccgcgcccgcgtctgcccggttccgggacacccctgcctggactccgtttcgcccgaggaagtggtggcggcagtggaacgcctgatgggcggagtgagctctttcagtacccacgtcagcacccgtagaaaggcccgcaacagatgagaatcctgctctggcatgtccacggttcctggacggacgcgttcgtgcgcggccgtcatgattacctgctccctgtcctgcctgccggtgggccttggggactgggccgtgccggcagggactggcccgcatcggtgcatgaggtggacctggcggcgctggatgcggacgccgtggacgccgtcgtgctgcaacgcccggaagaaattgctgaagtagagcgcatgctgggccgccggcctggtattgacctgccggcggtgtacgtggagcacaacacccccaagggcgatttccccttctcacggcatccactcgcggaccagtccgccatccccctggttcacgtcacccacttcaaccggctcgcctgggacaacggatctgcggtgtcaacggtggtcgagcacggaataccggaccccgggcagctctacacgggtgagctggcggagctgggcgtggtggtcaatgaacctgtccgccgcggccgcgtcacgggaaccgacctgctgccggccttcgcgtctgtggcgccgctgcaggtcttcggcatgaagacggacggcctggctgccgccgccggcatggacgcatcccggttgacctcccgcggcgacctcaggacacaggaactgcaccgcgaactggcacgatgccgcgtctacgtgcacccgatgcgctggacctcactgggcctgtccctcctggaagccatgcacctggggatgccggtggttgccctggcatccaccgaagcgccgcgggccgtgccgccggaagcgggcgccgtgtccgccgacatcgatgagctgctccgctgtgctcggcggctcgtggccaatccggaggaagcacgacgacgcggcgtcgctgcacgtgaagcggcactggaacgttacgggctggggaagttccaggaccgttgggacgagctcttgggagacctggccagccggcccaggcgcccgctgaacgccagcaacaacggcctggacgagcggatccttgttccggcgcgagagaggaagaccccatgagaatctcgatgatttcagaacacgccagccctttggcggccttgggcggggtggatgccggcgggcaaaacgtgcacgttgcggcactgtcggaggcattggccagacgcggacaccacgtaaccgtgtacacccgcagggacgcaacggagcttcccgcccgggtccgggtggggcggcgcctggaagtggtccatgtggatgcagggccggcccgccatgttccgaaggacgagctccttcccttcatgggtgagctcgccgacggtgtggccagggactggagccagcggccgccggacgtggtgcacggccacttctggatgtcgggcctggctgccctggacgcagcgaggcgcccggactccgggtaccgggtccccgtgatccagaccttccacgcgctggggacagtcaagcgccggcaccagggagcagaggacaccagcccgggggaacgccgctggctggaacctggtgtgggcaggtccgcggacaggatcatcgccacctgctcggacgaggtttttgagctcaaggccatgggcatcgacaccggcaagatctctattgccccctgcggcgtggacctggacttcttctcggctgatggtcccgtggcggcaaggacggcgaaccaccggatcctctcggtgggccgcctggtgccgcgcaagggtgtggacctggtgatccgggcactgccttacctgcgcgaggcagggttcgacggcgtcgagctcctgatcgtgggcggcggcggagattccggcgtgcttgacgcggatccggaggtgcgccgcctgctgggccttgccgccgaactcggggtggcggaccaggtgcggctgcaaggacaggtgtcccgcagcgagatgcctggcatcttccgcagcgccgacgctgtggtgtgcgcaccctggtacgagcccttcggcattgtcccgctggaagccatggcctgcggtgtccccgtggtggctgccgcagtcgggggtctccgcgacacagtggtggaccacggaaccgggctgcacgtgccgccccgcgatccggaagccatcgcttccgcactggccatgctgctccgcaacccgtcgctgcgggcggagctgggaaacgcgggcaaggtgcgcgcccgcacccggtactcctgggaccgggttgccgccgaaaccgaaaaggcctaccagctggcggtggcaggcgctcctgccggtgttgcctcgatggaaggagcggcgctgtgactccggactggtcccttcgagacgccggcctgaggaccctggccgcccctccgccactgccgtccgtcctgcctggttccgggtttgtggacccggcaaccgcggacgttgtccaggcccacctggacaacgtggtgccggcgctggattcgctgcggcgccagtccggccgcctcgccgcctggggagtcgaactggcccagcgcctgctgcgcgggcagcggctgctggccgcggggaacggcggttcagccgcggaggcacagcacctcaccgccgagctggtgggcaggttcgacggcgagcgcgtcccgttctctgcgatctcgctgcacgccgagtcctcggccgtcacggcgatcgccaacgactatgggtacgacgacgtctttgcgcgccaggtgcgcgcacacggccgctccggtgacgtgctgatgctgctgtccaccagcggcaagagccccaacctgctccgggcagcggaggtcgctgcccggctcaacatcaccacctgggcgctcaccggcgccggccccaaccccttgtccgaggcctgtgacgaggctgtgatgatcgacgccctcaatgccaatgcgcaggaggggcacctgatcgccctgcatgccatgtgccgcgcctttgacctggaagtgggacggcgcagtgttcccgacgccggactgccgggcaggggaggccgggcatgaggatcgtcgtggttggcgacgtaatgctggacgtggacctgtccggggaggccacccggctcagccccgacgcaccggttccggttgtggacgtctccggggtcaggcggcgggccggcggtgccggcctggtggcgcggatgctggcggaggacggctggcccgtcaccctggtgacggtcctgggcgatgacgacgccgggcggcagcttgagtcgcacctcgccggggtgcggcttgtgtccggccccagcggccatgcctctccggtcaagacccgggtccgggcaggatcgcacccggtggtgcgcttcgaccagggctgcggcaaggcgcctgttccggatgccagcccggccatgctccgtgcggttgagcaggcaggcgtgatcatcgtggccgactacggcaggggcctggcggcgaatccccagctcagggacctcctggcccggctggccggcagcgtgcccatcatctgggacccgcatccttccggaccggaccctgtcccgggtgtggccgtggtgacgcccaaccttgccgaggccagcaaggcggcgggtgcctacacaaaccaccatgatgcagcgccgcaggacgcagggacacaggacccggcagtccaggctggccggatcctgatggaggagtggcagagccgcgccgtcctggtcaccaagggcgagcaaggagcagtcctgctgcaacagggcagcaactctcagcaggcggtgccggcgccacgggtggaagcgggcgatccctgcggtgcaggtgacaggctggcggccagcctggcagtccacctcctggcaggccgcgagctcggggaggcagccaggctggcagtccatgacgccgcggatttcctggccagcgggggagtgtccgcgttgccggaccaggccggcttcactgcagccgctccgaagccgcggaaccaggcagccggcaggctccgcaccagcgaaccgctgctgctggcccgcgcggttcgggagaacggcgggacggtggtggcgacaggcggctgcttcgacctgctgcacgccggccacgtccggtccctcgccgcggcccgcgaactgggcgactgcctgatcgtgtgcctcaactcagatgactctgtccgccggctcaaggggccggagcgacccatcatcagccaacaggacagggcagaactgcttctggctatggaatgcgtggacgcggtgatggtcttcgatgaggacaccccggaagccgccctggaacgccttcgcccggacatctgggtcaagggcggggactacaagggtgcccgcctgccggaggccgacctcgtggagaaatggggaggccgctgccttaccgtcccctaccatcccgcacgttccaccaccggcctggccgatgcccttgccaaggtgagctgaccgcggccctgccgcacgtttttgtattcccactgatttgtattcccactgaaaggaacaccatgactgcagaagtaaatgtgcctggaaccgccacccccggccgcgtgctcgtcacgggaggtgcctccggactgggggccgccgtcgtcgatgccgtccttagggcaggcggcaccccggtggtgctggaccgcgacatcagcaacgtctcggccgtcaaggccttcgaagtggacgttgcggaccgcgtcgcggtggaggccgccgtcaaggaagccgccgaatcactgggcggactggaagcggtggttaccgccgccggcattgaccgctgcgggaaactggcggacgtcgaagccactgagtgggaaaaggtgatcggggtgaaccttatgggcacggtctcggtggtccgggcggccctgccctacctcaaggccagccacggccgggtagtgacggtcgcttccaccctgggcaagcgggccgttgccgatgccaccgcctactgcgcgtccaagttcggcgtggtgggattcagccacgcgctcgcagcggaaaccggcggcgaaatcggagtgaccaccatgatccccggcggcatgaaaacccggttcttcgacgaccgcacggagcagtacaagccacaggacgattcccgcctgaacgatcccgccaacacggcccaggcaatcctctttgccctgtcacagcccaccggatgcgaggtccgggaaatgctgatctgccacgaagaagagggctcctggccctaaacgcaacaggccaccagaccggaaaaccgacgggaggaacaccatgcccaccactgccactgaaacacctgcagacaccggagcagcagaccgcgccgggatcaccatccgcaaccctcgtaccggtgaggtcctctggaccgtgcccgaggctcaaccccatgccgtgacccgcgccgtcgaggttgcccggagcgcagcggcggactgggcttccactgccccggcagagcggggcgctgcgctccgcaaggctgcgcgggcgctcgacgccgccgcccgggaactggccgggctcaacgccagcgaaacgggacggccggtagaggaatcgctggcggggatcgcggccggtgtgtccacgctggagcagtacgccgagcttggccctgtccaccgcggcctcagcctgcgcggaaaccagctcgcgtcggactacacggtggcggagccccggggagtggcagcgcttcttaccccatggaacgatcccgtggcggtggcctgcgggctgatcggcgctgcgctggctaccggcaacgcggtggtccacaagcccagcgagcgctgtccgcgcctcggcgaggcgttgggggaagtcctggccccggccttccctcccggcgtgttccagacggttaccggcggagcgggcgtgggcgcactccttgcccagtccggggtggacgtcattgcccacgtcggatccagtgctgccggtgcccatcttgcgcgggcgggtgctcagtccggagcacatgtcatccgggagaacgggggaaacgatccgctgttggtggaccgcgacgtcgatcccgtgtgggcggcagagcaggccgcaattggcgccttcagcaacagcggccagatctgtgttgcggttgaacggatctacgtccatgaagccatcgccgcggagttttgcgctgcgctggaggcggaggcagcactccgcaacggcaacggcacggtggccccgctggtggacggacgcatgcgcgacgccgtccacgcccacgtggctgacgcactgcagcagggagcacatgccgttgaaggcgggacgctcccggacgggccgggctccttctacccggcaacagtgctgaccggatgcacggaacggatggaggtcatgacggaagagacgttcggacccgttgcccccgtccaggtggtgaaaacgttcgacgacggacttcggctggcgtgcagcggcaagtacggcctcgccgccacggtgctgtccggcaacatcgcccacatccagcaggcagtggccgccctccccgtaggaaccgtgaaaatcaacgaggtcttcggcggggcccccggcggggctgcccagccacggggcatcagcggcgccggcttcgggtacggccccgaactccttgatgagttcagccgggtcaaagtggtgcacattgcggcgccgccggcggctgccctgaccagggaccagccatgagtacgtcggcggaagccgcggacctctcacaccagcgcgccctcgcggactggctgccggggcgtctcgccgccgaacagccggccatcctggtgcttggcgacgtcatgctggacggctggtggagcggcagcattgagcggctgtgccgggaagcccccgcaccggtggtggacgtgcagaaccgcgagtcggtgccgggcggggccgcgaacaccgccatgaacctggccgccctgggtgcccgcgtctccgttgcgggcatcattggaaccgacgatgccggcgtggacctccgcaaccagctggtggcagccggaatcgatgtcacctacctcctcgaccacccggacatggtcaccaccaccaagatccgcatcagcagcggcggccaggtgatgctccgcatcgatgactcagccaggtccgtgcccgccgaagcgctggccgagcttggggcgtcggtgcgctccgccgtcgaacaccagcaggcggtgatggtctgcgactacggcaccggcgtcctcgccgatcccgtccggcagggcctgatggacgccctcgcgggcagggaccgccgggagcccggcgcgcggcccctgctggtggtcgactcccacgacccccgcccgtgggcgccgctccgtccggacctggtaacccccaacgcgcaggaaacggcgcggatgctggacgtccggttcccggacggacaggagagggtagaggaggtaagcaggcacgccgatgcgctgctggaggcaaccggtgcgggggccgtggtggtcaccctggaccgtgacggaaccgtgctgctaaggcccgacggcgtgacgcaccggacgtgggcgcgaccggctgctgagaaacaggcatcgggagccggtgacaccttcgtggccgcgctgacgctggcccggtcggcaggactgcccctcacggccagcctggacctggcgcagtcagcagccgacgtcgtggtgcaccagccgggcacatcggtctgcagcacggcgcagctcagccgctacctgaaggcgttcgcggacaccgcgctggacgccgtcgagctcgaacggcagctggagctgcaccgcgcccaggaccagcgcatcgtcctgaccaacggctgcttcgacgtcctgcacagcggccacacccgctacctcaaccaggcaaaacagctgggggacatcctggtggtggcgctcaacagcgatgactccgtgcggcggctcaagggcgaaggccgtcccatcaatgcggtggcggaccgggcggccgtggtggcagcgctgagctgcgtggactacgtgacggtcttcgacacccccaccgcagctccgttgatccggcagctgcgtcctgaggtgtacgccaagggtggggactacaccccggagatgctggccgagacgccggccgtggaggaatacggcggccgcgttgccatcctggactacgtggccgatcgttccaccacggccgtggtgaacaagatccgggacggcgaaggggccgtgcagaccaactagggttgggagctggactggttgggctgaatgaagcggggcacgggtaatggcgaaacgcgggaagacggggagccgcggcagccgtcccgcagcgggtgtggtggaggttcccaggggaacccggccggatggcccggttgagggcgtctactacatcgataccggagactgcgagctgatcgcggaccaggacaattccaccggctggctcctgaaaatcaacggcgtcatgagctcccacatcgacctcgccgacccgctgttcctggacttcgaatatatgcggtggatggcagcgctcatcgagtcgcgctggccgccgtcgggagcatcctccgggctgaagcttcgcggcctgcacctgggcggtggagcctgctcgctggcgcggtacttccatgccgcttacccggacgcgcggcaggtggtggtggagctggacggcaagctggccgaatacgtccgcggctggttcgacctgcccaaggcgcccctgctgcggctccgcgtgggggaggcccgcgacgtgaccgagaccctgacggcggacacccgggacttcatcatccgggacgtgtttgccggggctgtcaccccccgtcccctgaccaccgccgaattcaccagccacgtcaagcgggtcctggcgcccggcggggtctacgtggtgaactccggtgacgcgccggacctgaagaacgcccgggaggatgccgccaccattgcggcatccttcaagcacaccgtgatcatcgcggaccccgccatgctgaagggccgccgctacggaaacatggtgatggcaggcagcgacaccccgttcggcgacgaccccaagctccaccggcggctcctgggcggcgcggtccctgcgcacctgtgggacgacgcccaggtccgggctttcgcggcagggtcacctgtgcggcacgatccgcctgcaaccccatcgattgctccgtaactgtcgttcccacccccgaaaacgacagttacggagcagccggcgaggtttttccacggcccagcagccattcccggtgttcggccatctgttcccggagcgcctggaccaccgccgccaccgccggacgccgcagcgaatccggccgcagcaccatccagtagggcagccgttcggcgatctcggctggcagcaggcggaccaggtcagggtggaggtcacccatgaaacagggcaggaaaccgatccccgctccggcgcgggttgcctccacgtggacaaagacgttggttgaggtgaggccgtcgcgcatggcgggcaccagccgccggggcgcgtccaggtcatccacctgcagcatcgaatccacgaaatagaccagcgggtggtcattgagctcggccaccgtggctggcgtgccatgctcggccaggtaggcgcgcgaggcatacatccccagcatgtattcgcccagccgcacggcctcggcccggtgcacctgcggttcgcccaccaccacttcgatgtccagtccggaccgctgctgcagcgcccgccgcgtcatggtcaccacctcaacgctcaggccgggatggtcccgccgcagccgcgccaccgcaggtgcggcgatataggcactgaagccatccgttgcagtcatgcgtacgacgccggtaattgggtcgggtgcccgtccggcgggtcccagggcgcccaccaccgcttcgacctgctcggctgcctggacggcctgcgctccgaggtcggtcagctcccagcctccgggggcgcgggccaggacccttccgccgagtgctttctcgagggaggcgatccggcgtgagacggtggtgtggttcaggcccaatgcctgcgcggcggccgtgaatctggcggtgcgggacaccgccaggagtaccagcaggtcatccggattgacgttcatatctgcaattctgcacacagtgcgtgctgcattggttattgaaggcgcatgtccgtgcagtaagactcagtgaagccattagtgctggagatcacagcacgtgtcgccgtggacacggaggagaacccccatgagcgctgaagagcgcccggcagatagtgctgccggacctgccccggtggacgctgcgctgcgtgagcgaccgaaaatctgttaaaaagcccgaggggactgctatggaaaacactttaaacggccgcaaggcactgatcaccggcggagccggcgggatcggcgccgcgagcgcgcgggccctcgcggcccggggcgccaaggtggtgatcgcggacgttgacgcggccgcggcggaagcacttgcggatgaagtgggaggcaccacttgggccgttgacctgctggacgtggactcactcgccaccctgagccttgactgcgacatcctggtgaacaacgcagggatccagcgaatcagtcccatcgaggacttcgaaccagccgatttccgcaggctggtcaccctcatgctggaggcgccgttcctgttgatccgggcggcgttgccgcacatgtatgcaaacaatttcggccggatcatcaatctctcctcagtgcacgggatccgggcctccccgttcaaaagcgcgtatgtatccgccaagcacggcctggaagggctgagcaaggtgacggcgcttgagggcggggagcgcggcgtcacctccaactgcatcaaccccggttacgtgcgcacgccgctggtggagtcgcagattgcggaccaggccagggtccatggaatcccggaatccgaggtcctggccaaaatcatgctgaccgagtccgcagtcaaaaggttggtggagccggaagaagtggcctcgctggttgcatggcttgcgtcggatgacgcgggcatggtgaccggcgccagctacacgatggatggcggctggtcggcccgctagccgcctggcccaggagttttcgtccagatatgcaggcttccgcagccttcagccctgcatatctggacaaaaactcaatccagctgtttgatttgccggtggtcgtagaagaacacgccctggacggtatccacacctactgatgtcccctgctggaaaaccaccaatccctcgcggcggcccttgaacggatcatccgccaccacggcgtcaccgattttgtagggtgaccgcggggcgaagggcttaagcaggcggttccatgtttgggctgcgaccttggtcaggctgatgggccggcccatgctcgacgggtcccggacaacggctttggccatatgtaccaactcctcggaagcggcgcaggccactcactcgcggtgcaggataaccggaatgttcccagcagagggcggccctcccattccggctggcaccttacgtcaaagctatgcgctattcacaccagtcacaccagtaacaggtactcacttttgccggacccggtacttgcctgatgcagcaacgattcagcgctggccgttgacgatgtcctctgcgttctcgaaggcccacgcaaccagcggaaccagcagcgcgctcagctcatagccgcgttcggtaaggctgtaatccacgcggggcggaataaccggctgcgcatcccgtcggaccagcccatcccgttccaaggtcttgagggtctgcgccagcatcttttcgctgatgccctcagcccggcgccgcaggtcgctccacctctgctcgccctcggaaagcgcaagcaggataaggaccccccatttgctggtgacgtggtccagcacagtccggctggggcaaccggccgggaagacgccgtcggcgaggtcaaccggaagcggcactgcctgggccgcgcggctgctgccactaactttcatgtgagtaccttacctgaaagtgcgtactctcttttaggaagtattcaggaatgcgtgtggttgtgcttcatgacagacacctacggaaggaatttcatgagcatcgtcatcaccggagcgaccggccagctgggccgccacgtcatcgaggccctgctggagcgcaacgtcccggcccgggagatcgtggccgcggggcgttccgtggaaaagctggcagaccttgccgggcgaggcgtgcaggtcagggcaatggactacgcggacgcgtcgtccgtggccggggcactgaagggcgcccggaaggtgctcctcatctcaggcagcgaggtgggccggcgggtggagcagcaccgcaccgtgatcgaggccgcgaaggctcaaggtgtggagctgttggcctacaccagcattgccaatgccgacagtacggggatgaagctggcagccgagcaccaggccacggaggccatcctgaaggaatcgggggtgcccttcgtcctcctgcgcaatggctggtacctcgagaactatacggaccagctgccgggaaccgtggctcagggtgccctggccgggagcgcaggcgacggcaaggtcagcggcgccgcgcgtgctgactatgcgcacgccgctgctgccgtgctcgtggcggaggggcatgcgggcaatgtgtacgaactggggggtgacgaggccttcagtatggcggacctcgcagccgaattcagtgcggccaccggcaagaccatcacttacaacgacttgcccgcacaggaatacaccggcctgctgaccggggtgggagtgccggagacgttcgcggagatcctggcagactccgatctgggcatcgcccgcggggacctcctggtaagcagcggggacctgcgcaggctgatcggacggcccgccacctcgctggctgaggctgtgcgggctgccgctgccgccgtatagcggccgtaccgactgcgtttgcactgattgtgtgcgtccggccggcagttgggaactgttgccggccgtcggcgcggaggaggggtagcctctactgcggaccgggatgaccatggacagcggcagggttccgtccacaaggtggtcccgccgtcggccgccccccttgactcggcgctggcttttccctaggttgggggcctgctgccagcgcgccggtcggtgcgggacaggccaccggggatgcgttccggtacctgcggcggcccaaaggagatcaagcatgaaagctatcgtgcaggacgtctatgggaccgcggccgtgcttgcgctgcgggatattgcccggcctgcagcgggcaagggggaggtcctggtcagcgtgcgggccgccggggtggagcagggcgtatggcacctgatgaccgggctgccctacttgatccggctttttggctttggcctgaagaagcccaaagtgcccgtgcggggccgggaagtggccggcgttgtggaggcggttggagccggcgtgacccgcctcaaggctggggacgaggtcttcggcacgtcggaggggtcctttgccgagtacgtgtgtgccaaggagggcaggctggccagaaaaccccggaacctctcattcgaagaagcggcagcggcacccatctccggcgtcacggccctgcaggcagtaagggacgccgggcaggttacggtaggccagaaagtgctggtcattggggccggcgggggagtggggtccttcgcggtgcaaatagccaaggcctttggtgcggacgtgacgggggtatgcagcaccggcaaagttgaactggtccggtccctcggcgctgacgcagtggtcgattacacgcgggaggactttgctgctggcggggtgcggtacgacgtcatcctggacaccggcggcaaccgtccgctctccgtcctcaagcgcgcgctcggcccgcggggcacgctggtgctcgtcggaggcgagcgcggtggaaagctgacaggtggcttcgaaaggtcactcgcggcacccttgtattcgcttttctcccggcagaaatccaggagcctggtatcgaaggagacgcaccttgaccttgaggccctggcatccctcattgaagccgggagcgttagaccagccgtggacaaggtcttcccgcttgcggaagcaccggctgccatcacctatctccgggagggccggagcctcgggaaagtagtggtcaggatctgatccggccgttttgtcgtggggtaaaaaagtcccgaagtattttgaggtcgacttgctgcaagcccatctccaggccccttaaatgtcagacagcgcttctcgggccatcacgggactaccccaacggcgacaaagggctgcgtcccgattcactttttctccggcggccttcgagattgcagagcttctgtatgccgggcccggtgcctaaagataccttttgcgcaccttgaaccaatcgtttggacccggcttcccggggtagggcagcggcgtcagcggctcccgggatgccggaatgacccccacctgccacggatcttggtaaacgatccgaccggggtcacttgcagacaatcgctcccaagcgacctcctttgcgtcgagaattgccagtagtggatccaaatgggtggtcatactgtccgcggactcccggaaccaggtgatcgcaccgatcgaatttccatcctcatagaacggtggattgggcaggttctcctggaaccaggcgtctgcaacggcgtagcaggtaatttcttcctcgctgagccgccctgtccggcgcagatggtctacagccacgaaaacgccaacgggtgctccagtccgcccgacatacttcgtttggaaccgcaggaagaccgtcattgcagcatgatctcacttatcggggaaggaccttgcccaaggagtcctctcacgctcactcgtcgtacttccggaccctgtggctgataaatgtcgaaggctgccgcaacgccatcattcgagcgggtttaactaggcggctcgagatgtctgcgatcccagacaccatgcatactttgacgacatcgaaacctatgcgcagggcgcaatgttaagtacgggataccggacagggccgggagtcccgtaaaaaacactggaggaaacatgctgttggacactgagaccggccctgggaccagcggcgcaccgcaggcggcaccgaaggtgacatccaaagttcctgctgccgaaaacacccttcgcatcctcaaactgctggcatcccggcgaggcccaatggcggcgtcgcaaattgcttccaccctgggcctgccgcgttccagcgtctaccacctgctgggggtgatggaagccaacgggtttgtcctccacctccacgaggagcagcggtacgggctcggcatcagcgcgttcgagctcagttcggcctactccaggcaggagccgctctcccggctgggccgccccctgctcgcctccctcgtggatgcgctgggcgagagtgcacacctggcggtactgcatgggcgcgacgtgctgtacatcgttgaggagcgcgccaaaaaccgcccgtccctggtgaccgacgtcggcgtccggctccccagccacctcaccgccagcgggcgtgccatcctggccgccctgcccaagtcccaggtccgtgcgctctatccgaacgctgctgccttcaccgcccggcacgaggtggaaggcgccatcatgaagtactcggcgctgtcctcccacctggaccaggtaaggcagcgcggctacgccaccgaacacggcgaggtcacgcctggctttggctccatcgccgccgccgtgacggaccacgtgggatggccgacggcggccgtcgccgtcactttcctcgaggacaaactgccggcagagcagtggccggcgctcgccgcgcgggtccggaaggtggccgatgagctctcggtgtggctccacggccgtcccgccaagtagtcccgtccccaccagaatcgccctgtcacccacacttacagaccgtcctggctgaggactgcacgtggcagggccgcgggggaggggaagggtccggtatcccggacagtacccttcggcaggccctgtttctgccgctgcggacgggctttagtagatacagaacttccagtacacccctacctgaaggagccatcatggcacccgccgatttcaccaccggtgcccgcccggtcaaagcagcccgaggcaccgagctcaccgccaagtcctggcagacggaagcgccgttgcgcatgctcatgaacaacctggatcccgaggtcgccgagcgccccgatgacctggtggtttacggcggcacgggccgggctgtccggtcctgggccgcttttgatgcgatcacccgaaccctggaaaccatggaaaaggacgagaccctcctggtgcagtccggcaagcccgtgggtgtgttccgcaccaatgaatgggccccgcgggtgttgctggccaactccaacctggtgggcgactgggccacctggcccgagttccgccggctcgaggccgagggcctgatgatgtacggccagatgaccgcggggtcctggatctatatcggcacgcagggcatcctgcagggcactttcgagacctttgccgcgattgcacgcaagctcaccggcgatgagaacggtaccctcgccggcacgctgaccctgactggcgggtgcggcgggatgggcggcgcgcagccgctggccgtgaccctgaacgatggcgcgtgcctgattgtcgacgtcgacgagacgcgcctgcgccgccgagccggcaagcgctacctcgatgaggtggaaaccgatcttgacgccgcgatcaccaaggtgctcaaggccaaggaagagcgccgcggctggtcggtaggctacgtgggcaacgccgccgaggtcttcccggagatcctgcgccgccacaacgccggtgagctcaccgtggacatcgtcaccgaccagacctccgcgcacgatccgttgtcctacctgcccgagggcatctcggtcaacgagtggcaccgggaagccgaggcggacccggagggctttaccaagaaggcccaggcgtcgatggcccggcacgtgcaggcgatggtggagttccaggacgcgggcgccgaggtgttcgattacggcaactccatccgtgatgaagcacgcaagggcggatacaaccgggccttcgaattccccggcttcgtcccggcctacatccgcccgctcttctgcgagggcctgggcccgttccgctgggtggccctctcgggtgaccccgaggacatccgcgtcaccgatgaggccatcaaggaactgttccccgagaacaagcacctgcaccggtggatcgatgccgcgcaggagcgcgtcgagttcgagggcctcccggcccggatctgctggctcggctacggcgagcgcgctaaagccgggctgctgttcaaccagctcgtcaaggacggcaaggtcaaggcccccatcgtcatcggccgcgaccacctggactccggctcagtcgcctccccgtaccgcgaaaccgaagcgatggccgacggctccgacgccatcgctgactggcccatgctcaacgccctgctgaacaccgcctccggtgctacctgggtgtccctgcaccacggcggcggtgtcggcatcggccgttccatccacgctggccaggtctccgtcgccgacggcaccgacctcgccgcccagaaactcgagcgcctcctcaccaacgaccccggcatgggcgtcatccgccatgccgacgccggctacgagcgcgccctcgacgtagccaaagaacgtggcgtccgcatcccaatgaacgagtcttcagggaccaactagtccatcgattgctccgtacctgtcgtttagagccccgaaaacgacagttacggagcaatcgatccccacacaccacaaaaagtaggaatcatgacattgacaacccacgaaccgctgaccgtcaccctcggcaccagcggtgtcacgccggaggacgtcgtcgccgtcgcgcgccacaacgcgaaggtcaccatttccccggaagccctcgaaaccgttgcaaaagtgcgtgcgcacatcgacgacctcgccgccagcgatatcccggcatacggaatctccaccggcttcggcgcccttgcgaaccgccacattcccaacgagctgcgcacccagctgcaaaaaagcctgatccgcagccacgccgccggcatgggtccggccgtggaacgtgaagtggtccgcggcatcatgttcctccgcgccaaaaccctggcctccggccgcaccggcgtccgtcccgtggtcctgcagaccatggtggacgtcctcaatgccggcatcacccctgtggtccgcgagttcgggtcgctgggctgctccggcgacctggcgcccctgtcccactgcgccctggtcctgatgggcgagggtgaggcggaagggcccgacggcgtcacgtacggcgggcggggagaacggcctgtcgctgagctccttgccgcgcacggcattgagccggtcaccctcgccgagaaggaaggccttgccctggtcaacggcaccgagggcatgctgggcatgctgcttatggccatcgccgaccttcggcagctgctgacgacggcggacatcaccgcggcgatgagcgtcgaggcgctgctcggcaccgaccaggtgttcctgccggagctgcacgccgcactgcgtccccatccggggcaggccgccagcgctgacaacatgctgcgcgtactctccggatcgccgatcgtagcctcccacaaagtaggcgattcccgcgtgcaggacgcctattcgctccgctgcgccccgcaggtcaccggtgcggtaagggacacgctggaccacgcggacctggtggcgtcccgcgaactggccgcggccatcgacaacccggtggtgctgccggacgggcgggtcagctccaacggcaacttccacggcgcccctgtggcgtacgtcctggacttcctggccatcgcggtggcggacctcagctccatcgcggagcggcggacggacaggatgctggaccccgcgcggtcccacggccttcctgcgttcctcgcggccgaccccggcgtcgattccgggctcatgatcgcccagtacacccaggccgggctggtctcggacaacaaacggctcgctgtacctgcatcggtggactccatccccagttcggccatgcaggaagaccacgtctccatgggctggcacgcggcccgcaaactccggaaggcagtggagaacctgcggcgcgtcctggcgatcgagctggtgacgtcagcccgggcactggacatccgcacccagctctccggtggtgtgctaacgcccggaccggcgggcgccgccgtcgtcaccgctctgcggaccgtggtggacgggccggggacggaccgtttcctttccccggagcttgaagccgcggacatgttggtggcagcaggcgaggtccgtcgggcagtcgaatccgccgtgggtccactggcctaaaaggcgaagaatcttcagcccatcggcacaaagcgtccgcctgatgaaatttccagcgacacggacatcgggcggacgcggagtgtagtagaactgaaggtgtagtaaaagtcacatcaaagaggctgtggcggaacatatacaaaggggtagaagttcaaatgaaagcacgtggggcagtcctgtcgaggcgcaatgcccattccgccgttatttccgactggaggggactccaggccggggaacgcgtcgagatcatcaagcaggcgcatgtggtggccgccggagaggtggaagaggtgtccaagagcggcaacgttctgtggcttgtgccggctggtccgtccgaaaagcagctctttttgaagtccgacggcgtacaggtccgccgggcctgacagccgggtaactgccgagacaaaagtccccgccgctgcgtatgcagcggcggggacttttgtctatgcgaggagaggcatccgtcgcaaactgtcaggcggcgatggcctcataggtttcaccgaagggaaccgattcgtccagggccacggtgtagcggccagcgtgcagcctggtcaccaggattccgcaggccgcgtcctgggccgcaacctcaatgagttcggcaactgcttcctccaggcccgtgtggacgtcgcccgcggtggcgaactccaggtcgatcgaccggaaggccgacgcatcggtgggggaggaaacggcggggacgcgttccatggttgctgtagtcatgtgtgaactttctgtgtttcatgcctgagggccctcttatcgtacccgctgatccccgcaaatgtcagatgactgctatttggagtgtcgggcgcgcatcctaaaaacgacaggaagggtgcgccggcagtcacaatagggcgcgttggcggcgggtcagcccatcagcaacgatgggagaaacgtggaaatcagctcgaaggagatctggatgaaaatcatgcgcctgggtgaaagcggcaaggagcagccggcagttatgatgccgtccggccggtactacagcctcctgccgctgacgcaggacgtggacggcgccttcctggcatccggaggagtggacaagatccgggaggcgctggaatccggttccctgccggaactggaaggagcggagaggctcagggttggcccgccgattgccaggcccggttcggtggtgggaatcgggatgaactacgccgcgcacgctgccgagtcaggctccgcgcccccggaagttccggtggtgttcctcaagccgggcaatactgttgcggggccgttcgatcccgcccccgttccgccgaactccagcagctacgactgggaagtggagctgggaatcgtcatcggcagggaggcaagttacctggagtccctcagccaggcggaggactgcatcgcaggatacgtgaccgccaacgacctctcggagcgcgagtaccagctccccggggcggccggccagtggaccaaggggaagtccctccccggctccacgccgctgggcccgtggctggttccggcaggggagatcgacggcgggagcctgccgctgcggagctgggtcaacggggagccgcgccaggattccgacacctctgagctcatcttcgatgccgccacccttgtccaccactgcagccagtacatgcgcctggaacccggggacgtggtcctgaccggaacgccggaaggcgtggcgctcagcggccgcttcccctacctccagccgggtgacgtggtggaggtagaggtcgtggggctggggcgccaacgccaggagctgttccgcgctggagaatccggctagcctgccttcactgccaggaccgggcagtccgcctccagcaggatccgctgggaaacgctgcccatgatgagcttgcccaccggtgtccgccggcgcaggccgatcacaatcagttcagcgttgtgctcctccgcggcatccagcacctccgcggcggcatcatggccacggaccggctgcttgatcacgtggtcgatgccctgggtggccaggcggtcctcaatgctctggatctccggctcctgggcgtagcggttgtccaccagcgcgtcccccttggacgagttgatgaccaacagtttggtgttgctcttccgggcttcgtggatggcctgggtcagggctgcttcgccctcgggggtcgggacgtatcccaccacgatggtcatggtgtctccttcttgtctgggtgagccgagctgtctgggtgggcgtggctgccttggcggacagtgctgtctgcgtggacagtgctgtccgaacgaacgttgctgccagggtgtgcggcaccctccgggtggacaggcaggtctgcatgggcagagctgccggacggagccgccggcgccgtgttcgtggccggcacaggtccggcagcagccggacggttgcgccggaccagcttgaagatcaacggccacgccaggatgagtcccacgatgatgtagatgacgacggcgatcggttcgctccagagccccgccgggtcaccggcgctgagctgcaggctcttgcgcagctggccttcgatccgcggccccaagatgacgccaaggatgaggggcagcacgggcagtccgaaccggcgcatcatgaatcccagtgcgcccagggcaagcaggaggaccagatcgaaggcctgcaggttcaccgagtaggcgcccagtgtggcgaagaacaggatgcccgcgtacaggtacggccgggggagctgcaggagcttggcccacaggggagccagcggcaggttgatcagcaggagcagcaggttgccgatgaagaggcttgcgatcagcgcccacaccagggggccctggctggaaaacagctgcggacccggctggatgccgtaggaggtaaacgctgccagcatgacggcggcagtggcgttggtgggcaggcccagtgccagcatgggggtcagggttccggcggcggctgcgttgttggcagcttccggaccggcgacgccctcgatggctcccttgccgaactcctcggggtgcttgctgaggcgcttctccgtcacataggagaggaacgtggggatttccgcaccgccggcgggaagggcgccgaatgggaatccaaaggctgtcccacggagccagggcttccaggaacggctccagtctttcttgcccatccagggccggcccacggggatgacatggaggggggtgcggcgcaggtgggcggcaacccacagggcctcgcccactgcgaagatggccacagccaccacaacgatgtccaggccgtccgcgagcagcggctggccgaaggtcagtcggcgctggccggtcacggagtcgatgcccaccaggccgatggccaagcccagggccagtgaagagaagccgcggagccgggatgaacccagcacggcagtgacggccagcagggccaggaccatgatggcgaagtagctgggagcgcccaggctgaccgcgaattgcaccacgatgggggcgcagacggccaggagcgcggtgccgatggtgccggcgatgaacgagccaatggccgccgtcgcaagcgcctgtgaggcccgccccgctttggccattttgttgccttcgatcgccgtcaccaccgaggatgattcaccgggtgtgttcagcaggatcgaggtggtggagccgccgtacatgccgccgtagtagatgccggcgaacatgatgaaggcgctggtgggttccagggcgtaggtgaccggaaggagcagggccacggtcatggccgggccgaggccgggcaggacgccgacggcggtgcccaggatgacgccgatgacggcgtagaggaagttcatgggggtgagggcggtggcgaaaccgtccatcagtgaggaccagacgtccatcagaggattccttccaggagtccggcgggcagtgcgatgcccagcccgaggtagaagccgtagaaggtcagcagggacagggccacggagatgagcccgtcacggatgtagcggcggctgcccagtgccaggacgctgccccagaacaggacggtgccggagatgacccagccggcccagtcgatgagcaggatgttcaggataaaagcgcccgcaaggggcaggatggtcttccagtcggcagggtgggtgaggtcgatgtcctcgccgccttccgcttcgccctggccgccccggatgacgttgacggccagcagcactgcgcaggccaccagcaaaccggccacgatgaacggaaccgttttgggaccaaccgggtccgactgggaatacggggttaccaggccgttggcgtccaggaagacaaggacgccaaccgcgccgagcaggagtgcaactcccagctcggcgcggcctttaaggcctgtggtcagcgagctcacgccaacccaagcttggtgaggacgtccgccacccgcttgtcctgctcggtgaggaaggtctcgaactcgtcgccggtgatgaaggcgtcagtccagctgtgggtcttcagcgcttccttccagccttcggttgcgtgcatcttctcgagggccgcgatcagggaagccttgtcctcgtcgctgatgcccggaggggccacgatgccgcgccagttggtgaacaccaggtcgatgttggattccttcagcgtgggggcgtccacaccctccaggcgctcctcgccgctggttgccagcacgcggacttcgccggattcgatctgctgcaggtactcgccggcgccggaagcggcaaagccaagcttgttgccgaggatcgcgggcaggaggtctccgccgccgtcgtaggacacgaagttcaccttggtggcgtcaatgcccaccgcgccggccagctgcatgggcagcaggtggtccggtccgccgggggaggagccgccgcctacggaaatggacgccgggtcagccttccaggccgcaaccaggtcgtcgatggtcttgtagggggagtccttgctgaccatgatcgcgccgggttcctcgatgagccgggccaggggggtggtctcggtcagcttggactcggacttgttggtgtagctggcgcccacgacgcccagccccatgagcatggtgaggtcgccgttgcccttttcgttgaccacgcgggccaggcccacggtgccgccggcgccggcgaggttgaagacctcggtgttggtggagatcttctcgtcgtcgaggacctttgctgcggcgcgtgcggtggtgtcgtagccgccgcccggggtgttggggaccatgatctgaagtccggtgacgggtccggcggcggcgccggagctttccggaccggtggagctcttgccggtggcaccgcaaccggtggccatcagggcgatgccggcggcgacggcggcgactcgcaatgcgcggatctggcgcatggtgttcctcttctcagtaacgcaattctttacaggatgatcagcggacctgatctgtgcttcgatgctaggccccgcagtgacggcgatcactcttgtgtacgcagagaaagttaagttcattgcgttcacgtttccggcatcccaccacgcccgggttggcgccgaccttcgccccggtgtgcgctgccctttaggctggaagccggctacggaacgggggatagatatggcggagcacggcgggcgttacggcgccaaaccggcggcgtgggccggcatcgtggtggtccttctggcgctggtgccggcagccttgcgggttgcagatggacgggcgggctggctggaggcactgttcatcctggccggggccgggttcatcaccttccacgcaacccggctggtgctgctgcaccgcaccggccggaacccgggcgtcggcgtgagcagtgcccggagggccggcggggaagagcgcgacggcggtccccgctgactgtcccgccggctgcggtatagttccggtacgccgggagggggcgcgctcccgtgtgcctgtgcccaggcacctgaaccaccactaaaggaatccacgcagtgacgcgacgaagaggaatgtccctcgccgggcagtaccttgtgctccagttgctgatcgtcctggcagtactcgtggccgtggtggccatctccctggcccaatctgctgccgtctttgagcgcaccgagggcaggagggcactctccgccgctgaagcgctcggcaacaaccctgcggtccgcgctttgctgcccgaggcagaaccccgggttggttcagcgcttcccgcggtggccgagtcggtccggaccgtctcgggatcatcgcacgttaccctggcaaagctggaccggacggtggttgccgcctccgatccgggactgctgggcaagcccctggaacttggagccagcagggtgatggagggcagggcatggaccggagtgctggacaaaagcgggaccgccgtgctgtccgcccatgttccggtccttgacgattcgggaaagatgatcggcatcgcctcgatcagccgcaactacccgtccaccctggaacggctgggagatgccgttcccaacctcctgacctacctcggcgtggccagcgtcctgggcgtggcggggtccctgctgttgtcccggcgggtcaagcgccagaccctggggatggaacccagcgagatcaccgggctggtggaaaaccgcgaggcgatgctgcacggcctgaaggaaggcgtggtggcgctggacccccatgagcgcgtcacggtcgcgaacgacagtgcccgggaactgctggggctgccgccggattgcgtgggcaggaagctcgcgtcccttcccgtggacccggcgctcaaggtggtcctgacccgcgaccagccggacccggaccagctggtgctcgtgggggagcggctggtggtgctgaaccgtgttcccatccgctcccgcggccgcaacatcggctcagtgacaacgctgagggacaggacagagctgtcctccctggagcgtgagctgggcgccacccggaccgccacggacacgctgcgagcgcaggcccacgagttcgccaaccagctgcacgtcatttccggcctgatccagatcggcgagtacgattccgtggtgcagttcgtcaacggcgccacggtggaccggaccaggctgaacgatgaagtgaccagccggatccaggatcccgcgctcgccgccctgttgattgctaagtccagcctcgccaccgagcgtggcgtggcactgcagcttgacccgcagtccgccctgcgcccggtcaacgatgagttgtcccgggacctcaccaccgttgtggggaacctggtggacaatgcgttcgacgccgtcacggggcttcccggggcggccgtccgggtgcttgtggaggacagcacggaccatgtcaccgtcacggtccgggacaccggccacggcgtcccgagcgacgccgtggaggacatcttccgccaggggttctccaccaaggaagcaggcccggcggacggccgcggcttcggcctggccctctccagggtggtctgccggcggtccggcggggacctcaccgtggccaatgacaacggagcagtcttcaccgcacgattcaaaagaggtgcaacgcagccatgatcaaggtgctgatcgtcgacgacgacttcatggtggccaaggtccacgccgggttcatccagcgcacgcctggcttcgctgtggtgggcgtggcccacaccggcgcgcaggccgtgatcgagacggaacggctgcggcctgacctggtgctgctggacatccaccttccggacatcaacgggctggacctcatgcaccggctgcgggacgtcgccccggagctggacgtgctggtgatcagtgccgcgcgtgaggtggagaccgtgcgcaaggccctccgtggcgggattgtgcactacctgatcaagccgttttcccagtcggacctgcaggagcgcctggagcattaccggagtgcgtaccagggactggattcagccaagaacgtggccgagcagtcggacgtcaaccgggtattcggcctggaccggaccgagcggccgcttcccaaaggctgcagcatcgagaccctgaagctcgtggaggccaccctgaatgccgccgacggcgatctttccgcggccgaggtagccgagcagctcggaacgtcccgggtcagcgcgcggcggtacctggagtacctgcacgacgaagggaccctggacgtgaggctcaagtatggggtggggcgtccggagcggcgctacgtcctcaagggccggtaactcaccggcgttcggggactcctggcattcgccggatgtcgccgcgcgtcagtgctcgccaccggaggtgggtccggggaggaactccgagggcagttccgccaccggaatgatcaccatgtcctgcaccttccagtccatggccacgcaggccttgcgtgctgactcgagcttttcgagtgttggcatggcaccaccggctggaaccacgaaggactcaatgtggaagacatgtccttcgtcgcggatccgcgacttcgcgtcggccgcccagtccaggctgcggaggtaggtgtccacttgccggcccagcggatgcggttcgccgtcgtcgtaggtcatggcccgcttgtccatgagagcggagacggcggcgcgggtgttcttgaatccgtcatggaggatgctggcagaaatcagcagtgccgcggcgtagtcagcccaccacagcccaagcccgattccgcccacgccggccaccgccgcaacggcggtcatccagtcagccttgttcatgtccgcgtccgcgtacaggactttgtcgtgcagtgtggcggcgagcttcatcttggcccggcccaggaagaccggcggtgccgcggtgaggagcataacgcccatcatcagccagcccagccagatggtgctgccgaaaagttcgatgccgccgatggtggggtgctccgccttcagcaggcccagtccggactccaccaggaggtagccgcccatgacggtaagtgtcaccgctgccaccaggtgtgctactcccgtggaccggtggtagccgtaggggtggtctacggatggaggcttccggatgacacgggatgccagcaggaaggaaatgggtggcaggaatgagagcaggtcctcgatccatgcagccttcatggcctgcgagttgccaagcaccaggaacaccagcgtggtggtcaccgcgaggaaacccatggtggcccattcgagtttggcggccttgcgcagcgcttcccgctgctccgcgggcagttccgtatgcccgaaccggacggcgccgccgctcctgacgtccgtcattgctgtgccttcacttccatcaggtacttgtccagttcaagcaggaaggcgttctccccaagcggtaccagcatgacgtgcttgtggatgtttccacgcccgtcccgtgattccgtgtagggccgggtcaggccggcatgggtcacccagggcgtcttgtcgtccacgccgccgatcacgagatccagcccgccatgtttgagttcatcggcaaggacatgttcggttcccgccacccactcaatccttgccccgagccgggtagcgaactcctttgccaattccgcttccgtgccttggacgtcattgctgctgagctcaccgctgcctggagcggagatccgcacccagtctccgttcatgctggctcccacgcggagggttccgccccgcaccctctccagggtcccctcaggatcagccgggaagctggatccgcagccggagaggaccagtaaggcggccagcagcaggccggccatcgatcccaggcgccgcatcgggccagctcccttccgtcggtagtagtccaataatagacagcctgcttactttattgggaagtgatgcgcagcgtgaagcccgccaagagcctgccggatcagcgcagcagcgtggccagcagccgcgcggcaacccgtgcggtccggccgtcgacgtccagcgccggattgagctcggcaatgtccaggtgcagcagttttccgctcccggccacctgcctgcacaccgcggcgatgaccgggaggggcacgccgtacgccgccggggcactcacccccggcgccaccgcggctggcagcacgtcaaggtcgatggtcaggtagagcacgtcaatcccgtcaaggaacccggccacgaaggtgcggacacggtcggcctcgcagtcctcgtccaacaggtagcgcacgcccagcccctttgccgtgtcgaacagggcgcgtgtgttgttgggttcggaaattccgacgacggcgtagcggaagtcgcgccccgcggccgcttccgcgcgggccatctgcaggaacggcgtcccggacgttgccaacggctcgtcccgcaggtcgaaatgggcgtcaaggttcaggatgcccagccgcttcccgtcccggaccgccgcagaggcggacacccccaggtagctcgcgaaggcggtttcgtggccgccccccagcactgcggtcacctgcccggcgtcgagcagcgccgtgacggcccggccggcgcgttcctggccggcctcaaggtcaccgcctggcaccacaacgtccccggcgtcgtacacggcccggtccagatggaacgccagggggcccaggaccttgcggatggccgccggcgcggctgccgcgcccgtgcggcccttgtttcggcgcacgccctcgtcgctggcgaagcccaacagggtggcgggcctggcatcctccccacccgcagcacccgcggcacccgcagttcgcgcagtacccggagcgctttccgcgcgggtgcctgctgtcccgccgtcgtacgcagtaactgcctgccaccagcggcggtgggcggcgtcatcgccgtcgaacctcccttcccagggctcgggtgggaggtcaacgtcaggtatcaggggggccatgctccaagctcaccgcatgcggacagcgaaaaccagcagcgctgccgtcgctatgtctggaatccaagatcgtcggcgcccgcgggcagcaggggctattgtggagcaatccctccccggggaccccatcaccttttgcgccggaccggcgcaccatagccaggccggagaacagccccgtgtttgaagcccccagcatcctctttgctgccgcaggcgcggccgtgtttaccgcagctgtcctccccaaactcctgcgcaacatgcccttctccatgcccatggtcttcctgggcgccggcatggcggctttcgccctgattcccacgcttccggacccggaccccatggtgcacagcgactttgttgtgcacctgacggagatctgcgtcatcatctcgctgatgggtgccgggcttgccctggaccgccccgtgggccgcaagcgctgggccaccacctggcggctcctgggaatcgccatgccgttgtgcatcatcacgctgaccctgctgggcctgtggttcctgggccttggcctcggcgctgccctgctggtggcctccagcctggcgcccacggacccggtcctggcctccgaagtgcaggtgggtgaacccgcggacgaggaggagggcgcggacaaagaagacgaggtccgcttcggcctcacctccgaagccggccttaacgacgggctggcgtttccctttgtgtacctggccatcgccatcagcatcgtggggtcatccccgctggcctggttcccggaatggtttggggtggacgtcctgtggcggctggccatcggactgctgctggggttcctcaccggcaagctcctggcacggctgtttttctctgccggcgctgaaagcctccggctgtccaaccactcggagggcttcgtagccctggccgcaaccttcctcgcctacggtgtcaccgagatgatcgagggctacggcttcattgccgtgtttgtctgcgcggtgactatccgttccgctgaacacacgcacggctaccaccgggtgctgcattcctatgtggagcaactggagcggctcatgaccgtggtgatcctggtcctgttgggcggcgcgattgcccgcgggctccttgcggggatcggctgggccgaggtgctggtggcgctggccttcctgctgctggtcaggccactggcaggctggatcgggctgctcggcggcaagaccggaccgcgcgaacggatcgccctctcgttcttcgggatccggggaatcggctccctgtactacctctcctatgcgctgggcaagggcgagttcgccggccaggcggagtggctgtggtctttcgtggggctggtggtggcgctgtccatcgtgattcatggcgccaccacctcaccgctgatgaaccggctggacaagctccgcgaaaagaaggcccgggcgttgaccggtgacgaaggcctggcgcccaacactcccgtatagggcaccaggccttgcttccgcgccgggcgccgggctcggcttccgtgcagggcgcgccgcgcccgggggctacatgcccagtgccgcctcgatgggtccaaccgcgaagaacagcaggaacgcaccggccacggcccacatgagcgggtggatctccttgaccctgccctggacggtgcggatcaggacgaacgcgatgaagccggcgcccaggccgttggcgatggaatacgtgaacggcatcaaggtgaaggtcaggaacgcggggatcgcaatgccccagtcctgccagtcgatcctgcccacctgggacaccatcatgaagcccaccaccaccagggcgggggcaactgcttcaaagggcaccaggttgatgagcggggtgaagaacatggccaccaggaagaggagcccggtgacgatcgaggccacgcctgtgcgcgcaccttcgccgattccggcgccggcttcaacgtagatctggttggaggaaaccgatgccccgccgcccacgatcgcgcccagggcgtccacctggagcacgcggtcaacgtccgggatgttgccgtgttcgtcaactgtcccggcctcgttggccaggcccaccatggtccccatggcgtcgaagaagatgctgaggaggatgacgaaagcgagcagggttgcggcaacgaagcccaggtgctcgaaggcgccgaacgggtttgccttgccaatcagggacaggtccggggcggcccatccggtgaaggtgggcgccaccagggaccagccctgcgggttggaggtcttgccgtcgaagctcggtccgatgtgcagggtcatctccaggagcaccgaaatgatggtggaggtgatgatgccgatcaggatggcgcccttcaccttgcgcaccaccagcgcgatggtcaggatcaggccaaagatgaacacggcggtgggccagccgaggagcttgccgtcatagccaaggccaacgggcacggtggtgccggcgacgtcggggatgcggcggacgaagccggcgttgaccaggccgatcagcgcgatgaacaggccgatgcccaccacgatggcagtcttgagcccgtccggtacggctttgaagacggcggtgcggaatccggtgaggaccaggatcagcatggtgacgccggagagcaccaccaggcccatcatgtccggccacgtcagccccggattggtggccacggtgacggccacgaacgcgttgacgcccaggccggtggcaagcgcgaaggggtgctttgcccaggcgcccatcaggatggtcaggattccggccacgaaggccgtcacggcggcaacggcggtgaaccccaacgtggtgccgctggagtccgggcccgagaggatcagcgggttcagcaccacgatgtagctcatggcaaagaacgtggcgaagccgcctcggatctcgcgggaaaggttggaaccgcgctcggtgatcttgaagtaccggtccagggcagagccttgcttaagcattagtcctccggggaagtctgtgggatacctgcatcctatggtggcggcggcagggcggcaggcattttcgcctagtctgtaaggaagccaacacaaggagccgccgcagcatgcgtcccatccgccagatcctgaccctggggctcgtgctcctcgttttcgccgccggtgttctgggcctcgccgggcccgcagcggcccatgatgccgccgaatccagcacgccggctgccggcgcgtcgctgccggcgccgcccgaacaggtctcggtggccttcaacaacacgccgctgggcatcggcgcggcgttctccgtcaaggacgcctccggcaccgagtgggcggagggacccgtggacatcgtggacaacgtggcatcccagaagctgaaggccggaggcccggcgggggagtacacggtggcctggcgcgtggtcagcgcagactcgcatcccatcgaggggacgttcgcctttaccgccgccgccgccgggcagggtgccgcgccggcggcaactccaacggcggcaggaagtccgacggcggcgggtacagtcccagccaccggcaccggtgcaggcaccgcccctgccatggggacggcccagccggggactacgggcgagcctgaacaggagggctcaggggagccgttccagtggagcatcgtcatctttgcgctcgtcgcggtggggctgctggccacccttgccatcctggcccggcgccggctcacagcaggcactgacgacgacgaataatggcgggcgccggtcccgccgcgggcaggggcgctgggcacccttaacaggtcacggccgcaaagctcccggtggccgggtaggccacagcgtccgggtgcactctggcggagatcgcctggcccaccgtcttggcctgccgcaggacttccttgggcgagggcgtgatgagttcccccacacccaccaggtagatgccgatggcccgcatggccgcggtgaggttacggcccaccgccattccaaagtcattgatcatgcgccggagctggctgtgggcgcaacgggtcaggacaatgtggtccgccaccaggattcccgtgggtgtatgcacctcccactgcggggctgaagcaagcggggacccgccgttcaccatggtcagctggacggcgcgggtggtgttgcgcacgtcgacgtggtggctggcggcgtagttccgcaggtgccgcaggatctcgttgcgttcgcgaaggctcacggagtccgccgcgtcgcaccgctgaagggaagctgtgttggccggctgtgcggcgccaaggaggtccagtccgtccaccactatcgagtccacgccgcggcggcacagctcggcagccacggcgaggccggacaggcccgtgccaatgatcacagcggtggtctgttcggtcccggcattcccaggcatgcttgacactacagtttccctccttcgaaagtttcggcaggtgcgggcgtcctcgcccgctcgcgtcccgttacccccaaagtccggccgcagtgcattgcccgggcagctctaacggaaagaggcagtaggcgtcccggaccaacaatgtcctgaagactacagaagattcgcggccagggatagcccaatcccgaaacaattccgtccgggtgaaggcgctttcccggaactgcccgccacctgtggataaccgccgtttcctggcccgaagaggcttgctatggcagggcctacggagaatagtgagaagcggaagcgagcctttcttcccagctcaggcgggggtaagggtgcacggggaacggcccgcttctggcagaatagccgcaacatcaggcagtatcgcgaggaggcggccccatgggcgcacaagagttgcatccggacccgcaggacggcggcagtcctgccgctcccgaggggatcgtagtcggcgtggacggttcggaccacggccagtgcgcactggtgtgggcggcacgcgaggcccagcgccggcgtcgtccgctgcatatcgtcaccgcctactccgtcccgatcttcgcggcttccggcctcgacggcggatacgccaccgtggacgactctgtaattcgcgaaggagcggaggcgatcgtcaaacaggccctggagaaggtggccgcctacgacgtcgataccaccgcgtcagtggagaacggcgatgcctccggcgtcctgctggagatgtcggaaaccgctgaactcctggtcttcggtacccgcggccgcggaggctttgtgggcaggctcctcggctcggtgagcagtgcactcccggcccacgcgaaatgccccactgtgacagtgcccctgatctgttccgaccggctcggcgaaacaaccgaggaccggcacatcaaggcggagcaggccaaggccggccaccagcgcgtggagaacgtggtggtggtgggcgtggacggttcggagcaggcacgggtggccgtgctggaggcggctgcccaggctgagcggctcggcgccaccctgcgcgtgatctgcgcggttccgcagtacagcggttccctggcgtgggttcctgcccccatggaccgcaaggcgctgttcgcggacatccaggtgaccctggacgccggaatggcgtggctgcggagccacttcccgaatctgcccaccgaatccgagctgcgggacggctctccggtggacgtcctggtggacgccagccgccacgtggaacttgtggtggtggggacccgcggccgtggcgggttcaccgggatgctcctgggctcaacttcggacggggtgctccaccacgccaagggccccgtcatggtggttccggaccgggaggacccgcgcctggcggaccgtgcccggtttgggccggtactcggggcagcctgaccggtccccgccgcaggggagcgccacgatggcagctgaccgcccacgaagccgtggacgggactcccgcccacaggacgggaactccgccctcgccctggtcctacgcctcagccaggtcgatggcagcatgcttccgctcgtgggaggcaaggccgccaacctcggcgagctgatggcggcgggactgcccgtgcccgacgggttctgcctgacaacggtggcctaccgggaggctgccaggactgtccaggacggtgtgcttgcggagctcggtcgtctccaggccgcactgcagccttccgatccaggcaggaccgcccagctcgccatggtggcggggagggcacgggaggccattcgcgccctcccggttccaccgcagacggcagccgccgtggagcaggcgtatgcggctttgggcgggaagacccgcgtggccgtgagatcctccgccaccgccgaagaccttccgtccgcgagcttcgcgggccagcaggacacgtacctgaacgtggtaggcagcggagccgtcctggacgccgtccgcaactgctgggcatccctttggacagaccgggcagtggcttaccgggcagcgctggggatcgcgccggaccaggtcgccctcgccgtcgtggtccagcggatggtggacgccgaggcggccggggtgatgttcacggcaaatcccctgaccggcaggcgccgtgaggcagtcatagatgcagccccggggctcggtgaggctgtggtttccggcgccgtcaatccggaccacttcgttgtggacacgggagaagcccgggtcattgagcgcaagcttggagacaagcgcgtcatggtgcggccccttccgggtggtggaacggaggccctggacattcccggccgggcggactccgccagcctcacggacgaacaggcagtagggcttgcggtcctgggcctgcaggcccagcggcacttcggctcgccgcaggataccgaatgggccatcgacgccggcggtgccctctggctgacgcagtccaggcccatcaccacgctctaccccataccgcagagccggtctgcgggggccgggacccggctgtacatgtgcttcagcctggcccagggcctcacccgcccgctcacacccatggggctggcatcactgcggctcattgcttcctcggtggcgttggccgcggggttcgccgttcccgatccccggcaggggccgcagccctacgcggaggcggcccagcgcatctacgtcgacctcaccaccccggtccggagcagcgtcggccgcagcatcctcccccgggtcttcgacttcatggagtccaggtccgccctggtggttcggcaggttttcgacgatccggagttttcggtgacctgcaggacgccgttcggattcctgcgccatgtcctgccggcagcagcgcgggcccgcgtgccggagacggcgctccggggactgttccggcccaaggcggcgctccgccggctggactccttcacccggcactatgccgaggacctggagctgggggcaggagcaggtccccttgaacggcttgaccacgcggagcggctcctgggaggcaggctctttgcgattgtgcccgcggttttgccccttcccgctatgggattcgcgatgctgtggctggcgggaaggctgctcggaggacaggaccgccggaaggacctggaaaaagtgctccgcggcctgccgcgcaacgtgacaacggagatggacctcgagctgtggcgccttgcctcggcggcaaaggacgacagggactcacgggtggttctggagtcgcaggagccgtccgcgctcgcagcggaattcaaggccggcaccctgccccctgtcctgcacgcaggcctggtgcggttcctggaacgctacgggcagcgggccgtggccgaaatcgatgtgggcatgccccggtgggctgacgatcctacgcacatcctaggcgtcctggttaactatctgcgcctcacggatcccgccatggcaccggacgtccagttcagccgggccgaggccgaggcggaggcggccgtgcagcagctggttgccgaggcgcgcggccgtggccgggcccgtgcattgctggttggtgcggccctccgccgggccaggctgttcgccgggctgcgggaaacgccaaaataccagttggtcctgggtttggcggaagtgcggaagcaggtggccctggtgggagccgggcttgcggccgatggcagcctggacagtccggaggacatcttcttcctcgatttccgggaggccaggcaggcgctccagggcccggacgcacaagggcgccggaaactgcgtgaactcgtggtggaccggcgggccgcctacgccaccgagctgggcaggcgccatatccccagggccctgctctcggacggcaccgaacccgaggtgctgtacgccgccgcaggtgttgcggcgggcagcgccacattgtccggcagcccggcctcagcgggatcggccaccgcccgggcccgcgtcatcctggaccccgtgggtgcccacctcgaacccggggagatcctggtggctccgtccaccgatccggggtggaccccattgttcctgaccgccggcggcctggtgatggagatgggcgggcccaactcgcacggcgccgtggttgcccgggagtacggcattccggccgtggtgggggttccggaggccaccgtccggcttgccacgggacaaagaataacggtcgacggcggcgctggaaccatcgtgcccgaataggcccgggtgccccgcaggcaggtgtggggagccgtgccgaggcgtacccttgagctatggactcccatcaaggagagggccggacaatgaaccagcaggatatgggcgacccacgtacaaccgggggcgtgcatcagcgccggaaccgcgcgtggttgcggtgggttccggcggtggccgccccggcagtgatcgccgccggggtactggtgggatccattccggcacgcgccggcgacgccttggcggacaagaccccggccgacgtccttgccctgctcgccggccacaaaacccataccttctcgggcacgattgaacaggcctccgagctcgggttgccggaactgcctgcaacgggccctagttcgggtcctgcgtcggatgaccccgccgcgtccgcgatcgagatgctcaccggtgagcatacggcgagggtattcatggacggcaaggccaaggcccgcatccaggtcgtggaccggttcgccgagcggaacatcatccggcgcgacaacgatgtgtggttctactcgtccaaggacaactcaacagcccacctgacgctgccggaccatgcccgcgacctcccgctggagggcccggcactgcctggcaccagcccggaaagcgccactcctgaaggcagcatggtcccgccgactccccaggatctcgcggcgaaattcctcgccgcggcagacagcacaactgccgtgtctgttggcccggacgtccaggttgccgggcgcgccgcctataacctggtccttgagccgcgcaccggcaacacgttggtgggcatgatctccatcgccgtcgatggtgaaaccggcatgcccctctccgtggaggtgacggcacgcggggcaggagagcctgccttcaggacgggcttcaccagcctctcgctcgatgcgccggatgccgcactgttcaacttcgtgccaccgccgggcagcccggttgaagagctgcagttccagcatccaacgcaccaggccgccggcccagggtcttccggctacccggaagcgcacaccgatcctgaccagcttgcggccggtatcaaggacaaggccggctcctacctggccgggaccggctgggaaaccgttgtggaactgccgacggaaaccggagccggggcaaagctcagcaccgcactggcgcagaatccgctgctgggccaggccgccgtcgtcgtacctggcggacggctgctctccagcgcactcttcaacgtcctgctgaccgacgacggccgtgtctttgcgggcatggtccccgcggacaggctgcaagccgcatcctccgccccgtgacggaacccgcgggggttccgggacaacggacgtacggcctgaccatcgagacgcagggcctgaccaagcgtttcgggcagcaggtggccgtggacagcctggacctcgcggtgccgtcaggggcagtcttcggcttcctgggccccaatggatcggggaagaccaccaccatccggatgctgctgggcctcgcggccgcctcagccgggaccgtcaggctgctgggccgggagatgcccggcagcttccaggatgtcctgccacgggtgggggcgctcgtggaggggccggctttttatccattcctttcggggaccgcgaaccttcaccggctggacgccgccggccggcacgcggatcctgccacgcgccgggaacgggtgggcctggcactggaacgggtagggcttggccacgccgccggcaagcgcgtccacgcgtattcgctcggcatgaagcagcggctgggcatcgccaacgccctcctgtccccccgcgaactgctggtgctggatgaaccaacgaacggcctggacccgcagggcacccgtgaagtgcggaacctggtccggtccctggcggcagacgggaccaccgtttttgtctccagccacctgctcgccgaggtcgaacagatctgcacgcacgcggccgtcatgagcgccggccggctggtggcgcagggaccgctggccgaactgcggcggtccgggagttcgcgcctgcgcctcgtgaccccggacgcgggcgcggcgtcgtcggtccttgcagcgctggggctgtccccggaatcaggtgcgggccagccggatggggaagtggtggtggccgtcctggcacggccgggattgccgccggaggccggggcggggcatcccgccccggaggacattgttgtggagctcgtcaaggcaggcgtccgcgtccgcggtttcgcggtggaacgggagagccttgaagaccggtttgttgaactgacgggggaggggttcgacgttgcccagtagtgcgaacgcgaaggagaagtcgaacgcggcgggcatggcggccgtcgcggggccgcggggagcgggcatgtcccttctgctgtccgaaatcgcggtcctgttccgccggcgccgtacctgggccctgctgctcgcgctggccgccattccggtgctgattgcggtggctgtgagggtctcctcggcggttcctcccgggcgcggcccggccttccttgaccggatcacgcagaacggcctgttcgtggcgttcactgccatgctggtgtccgtcccgctgttcctgccgctcacggtgggtgtggtggcgggggataccatcgcgggcgaagccaacctgggaacgctgcggtacctgctggttgcgccggccggccgggtccggctgctgctggtgaaatatgccggtgccctggcgttctgcctcgctgcacccctcacagttgccctcgccggtgccgccatcggtgccgcccttttccccgtgggcccggtgacactgctgtcaggggatgtcatccagccgccggaggccgtgcttcggctcctcctgatctcggcgtacctggctgtttccctggccgggctgtccgccataggactgttcctgtccacgctgaccgtggttccggtgggtgccatggccgccactgtggtgctctcggtggtctcccaggtcctcgaccagctgccgcagctcgagtggctgcacccgtggctgttcagccactactggctgggcttcggcgacctgctccgccagcccgtgctgtgggactcgtttgccagcaatgcgccgctgcaggctggatacgtggccgtgttcggagcactcgcctacggccggttcgtcaccaaggacgtcctgagctgaacgggaggcagaatccccccgggcaacgcatcctcaggcgtgctggtgcgcctcgtgttcagaatggctggcgggctccagctggaacgtgcagtggtcggtatcgaagtgcgagcccaggcaggtgatcagtttgtccagcagctggtcggcgccgcgggcgttgagcaccccgtcctccaccaccacgtgcgcggagaagacggggacgccggaggtgatggtccagatgtggatgtcatgcacgtccgtgactccctccacggacaggatgtgctcccggatcatctgcacctccacgcccttggggctggcctccagcagtacatccaccacgtcgcggagcaggctccaggcccggggcaggatcatcagggcgatcaccacggacgcgatggtgtccgcagcctggaagccggtcaccatgatcaccacggccgcggcaatgacggcgaaggaacccaggagatcgcccaggacctccaagtaggcgccccgcacgttaaggctctcctggtgtgctccgcgcaggatcaccagggacgccacatttgcggccgcgccaaggatggcggccaacagcatgatgtccgtctgcacttccggcgccgcaccgatccggcggatcgcctcgctgaagatgaccacggagatcacgatcaggatcagggcatttgccagcgcagccagtacctcggcccgctggtacccgtaggtcctttggtcgctggcgggccgcccagcaatccacgcagccagcagggcgatcgttacccccgctgcatccgagagcatgtggccggcgtcggcaagcagggacagcgacccggagaggaccgcgccggcaacctggaccaggaccacggccagagtgatggcaaggacggcaacaagccgcttccggtgccggcctgttgcggtgatgccgtgggtgtggctgtggtcgtgtcccatgcctacaaggctagccccagccgagctcgtgcagccggtcgtcatcaatgccgaagtggtgggcaacctcgtgtaccaccgtcacggctacttcgtggatgacgtcctcccgcgacgcgcaaatgtccaggatggcctcccggaagatcgtgatcctgtcgggcagggacccggcatcccaccaggagtcccgctcggtcaggggcacgccctcatagagtcccagcaggacggtgtccggatcctcgccgggcttcggggcatagtcgtcctcaatgaacaccgccacgttgtccatggcgcgggccagcttgtcggggatgctgtccagggcatcctggacggcagtctcgaattcgtcctcggacatggtgaagcgaaggggttcgctggggccttcgggggcggtgggcaggcccggcggcaggctggctggcatactccgactctagcgggaaccggccgccccggctcctctcggattccggctcctgcgccgggtcagcgccacgcccaccaggcagaccaggccgccgatcaggcccaggaatgccgggacctcacccagcagcagccaggagatcaggatggtagtcccgggcaccaagtaggtggtggcggccagctttccggcgtccaccaacgaaagcgcgtatgcccaggtggtgaaggcaatggccgtggggaaaatccccagatagacgagcccccacgttgcctgcggcggggccgcctgcacttcgctgatcagctggcctgtgaagggcaggcagcagagcgcgcctaccaggatcccgaaccaggtagcctgcgcggccggaaatttccgcagcacaggcttctggatgatgacgctcacggcggcgagcacggcggcaaggaggcacagcagcacgcctgccacgtccgtcgtcggccgttccccgggcgcagaggcctgggctgatccgaaggcgatcagcgccacgccggcaaaggcaaccaggctcccgataatgagccagcgcgggaagccctccttgaggaagatgccggccatgattgccaccaggatggggttcacattgatgagcagggcgctggtgccagcatcaagcacgtgctcggcggcgttcagcgccacgttgtacccgccaaaccacatcaccccgtaggccaggatcggccaccactcccggcccctcgggaggagccgggttttcaccagttgtggcaggaccagcagggagaggacgacggcggcaatcgccagccggccgagcgtcagggagccgggggagaagtgggggccgatcgcccggatccccacgaaggccgacgcccagaggaccacggtgaccaccatggcagccaccccaagtgccttgaccggggttgcggcggtgtggggaggtgcaggggcagtccggttggcggggctgattgaaggcatgcagcaaatctatccgggcgcaagggcagctgactggcggaaatcggccatgtctgcgcaacttcctgccaaaggacatccgcctgggggttattgcggcgccgcccattccagcaggcgttccacgggccacgtggtgacgatccggtccgcggggacgccgttcttctccgcgcgctcggcaccgtactgcaggaagtcgagttggccgggtgcatgggcatcactgtcgatcgagaacaggcagccggcgtcgagggcgagctggatgagggcgtccggcgggtcctggcgttccggccgcgagttgatctccaccgccacgttgtgttcggcgcaggcggcgaacacctccttggcatcgaagtccgacggcggacgcgtgccgcgagagccctccaccaggcgcccggtgcagtggccaaggacgttggtatgcgggtcctggatgccgccgagcatgcggcgggtcatggtcctgctgtccgcgcgcaactttgaatggacgcttgcaaccacaatgtccaggcggtcaagcagttccgggtcctggtccagttccccggattccaggatgtccacctcgattccggcgagcagccgcaccggcttgcccggctggccgccgtcgcctgcatgggtgccggcgttgatcgcctccaccacgtccagctgctggagcaggcgttcggcggagagtccgttcgcaatggtgaggttgggggagtggtccgtcagtgcgaggtactcccttcccagtaccctggcggcagccaccatcagttcgatgggggagccgccgtcggaccattcgctgtggctgtgcaggtctccccgcagcatctccccgagttccgtccctccggacgccagaggcttggcccccttctcccggagatctgccaggtactccggaacctggccctccactgcctggcggattacctggtaggtccggtcgccgatgcccttcatggatttcagccggccgttttcggcgcgcgcggccagttcctccggcggcagcgggctgatggccgccgctgccttgcggaatgcctggaccttgaaggtggcagcgcgtccgcgctccagccagaaggcgatctcattgagtgctgctacggcatccatccgtccatcttcacccgtcccgcccgcttcgtggcggtgtttttggccgattttggataattcctgcctaggccctatagttttagagtccagttcggagaaacgcaaaggacaaagacggaaagccccgcttgacgccttttattttgttccgaacgggttctggcccccatcgtctagcggcctaggacaccgccctttcacggcggcggcacgggttcgaatcccgttgggggtacgcaaggaactggtcaaacagactgaaattgtctggtaggctggaagccttgaaaaaagcggtagagatactgcggaagcaagaaacgcaaggccctgtagcgcagttggttagcgcgccgccctgtcacggcggaggtcgcgggttcaagtcccgtcagggtcgctctgattgttggaagagattccggctgtcatggtgactagtcacctaggctctgtagctcagttggtagagcgttcgactgaaaatcgaaaggtcaccggatcgacgccggtcggagccaccactgggaagcatcagttcttcggaactggtgcttttcttatttcccgggcctacagttaatgggcccgcatggagcacgtctcgatccggcatcaatacccccggggccggccaattttccgccccgcggcttttcagggtccgtaaacttgctggctgcacagccgtggacacacggcaacggcacaagagaacacacagaacagacgaacgtacacgagacgaacctgcacaacgcagtctgagcgcacacagcgcataaggagaaactgggaatgtccgccacatctggcaccaggaccatcagccaaccacccggcgaaacacctcccgccgtcaggaaggaggagaaacggccgccccaaaccggcggccctgagctcgcgcggtgggttttctggccggcagccgccgtcatcatcgtatttgtcctctttgccacgatctttccggcggccgccaccgatctgttcacggccatccagggcaacgtcatcaggtggtttggctggtactacgtggcagccgttgcgctcttcgtggtgttttcgctctggatcggcctgagccgttacggcgacatcaaactgggccacgacgatgacgagcccgagttttccgtggtgtcctggtttgccctgctcttcgcggcaggtatgggcatcggcctggtcttcttcggcgtggcagagccgctgaaccactttgccgcaccccggcccggtgttgaaggatcccccctggagctcgcccaacaggcgatgacgcagacctacctccactggggcctccacgcctgggccatctacgttgtggtgggcgtatccattgcctacgcagtccaccgcaggaaccgccccatctccatccgctggacgcttgagccgctccttggccgcaagcgcgtttccggcgggtggggcaacctgatcgacgtcgtggccctggtaggcacgctgttcggtgttgccacctccctgggccttggcgtcctgcagatctccgccggacttgaacaggccaacattgtccaggccaccaccatgacgcagatcgggttgatcctctgcatcatcacgctgaccatcatttcggtggtgtccggtgtgggcaagggcatgaagtggctctccaacaccaacctggtcctggccgcgctgctgatgctggtggtgctgtttaccggccccacgctgttcctgctgcgcgagttcgtgcagtcgatcgggcactacctccagaacgttgtaggccttactttcaacacgctggcattttccggcgcagagggcgaggcgtggcaggccgcctggaccaccttctactggggctggtggatctcctgggcgccgttcgtcggtatcttcatcgcccgtatttccaagggccgcaccgtccggcagttcgtcgccggcgtcctcctggtacccaccgccatgggcttcctgtggttctccgtcctgggcggcgccgccatccaccgcgaactgttcgacagcggcgggcttatcggcgaagacggcaccgtggataccgaggatgctttgttcaacctgctgggcagcctgcccggcggggttgtcctcaccgtaggcgcgattctcctgatcgccatcttcttcatcacgtcggcagactccggtgccctggtcatgggcatgatctccaccggcggagacgtggaacccaggaactggctgcgcatcttctgggcgctggccgccgccgctgttgccatcgccctgctcctggccaatggactgcaggcgatccaaaccgcggccatcctcaccgccgtgcccttcagcgtggtgatcatcctgatgtgcatttcaacggccaaggccttccatcgggagcatgagaccctgatgcgcgcacaacgtaagctggcccgcgaccagatggccgcccatgtcacggagcaggtccaggactccatgcatgactcggtccaggagcactaccaggagcacgtcgcggaacagatccacgactccgtccaggagcactaccaggagcacctggcggaccaagtccaggaccaggtcagcgaggccgtggaggcccatctgaccgaacgcctggctgcaggcgaggctgcggacgcaacgccggcgcgaacacccaaggcgtaggcccgcggccctgcgccagccgctcacgggcattgagggaggcacctgtccagctggacaggtgcctccccttttcgtgcccggaccaaacattggtccctgttgcagggtggcatttctcacctttgaacggcctaaaaggcaatatttgatcttggctgaaggttgtggcacgcgcgcgttaggggatatgtgtaagcgcttgcgcaaaaccggccccgcaccggaaaagggcgatgaaacctggtttgatctctcccttggaggctgtctacggtggaaacacggccaggaaagcaccacagtccgggcctcttctacggggactacccaaccccgttccccccttgatacaacggcgtccccgatgacgcctgccgtgtcgccgggggtcgccggagttcgaaggccatgggcatccgcccgtcttccacgaacagttataactccgcgagaagagcaacaatgcacaagcacccccaatcaccccggatgctgcggtggcgccccgccgccgcagcactggccaccgccgtggctgcctcggccttcctggccgttccctcggcgcaggccaacgagccggcagatccgccggccgccgagcagatgccggcgcccactcccggattccccctccccacggaacacacgcaggaagccttcgacccggcgtcggacttcacctccaagtggacccgcgccgacgccaagcagatcatggcgcagagcgaccccaccgtggcacccggtgagaactccatgagcccggatgtcaccatgccggaaatccccgaggatttccccgccatgaacgaggacgtgtgggtctgggacacctggtccctcaccgacgaaaacgcgaaccagatcagctacaagggctgggacgtagtcttctcgctcgtggcagaccggcacgccggctacggcttcgaccagcgccactggaacgcgcgcatcggctacttcttccgcaagaccaacgcagacccggccaaggacaagtggaactacggcggccatgtcttcgccgacggcgcgtccatcggcaacaccgaatggtccggctccacccgcctgatgcagggcaaccaggtgaacgttttctacacggccaccacgttctacgacgtagccgaacggaacgcaggcggcggcggaattgctccggacgcagcaattgccaaggccctgggcaagatccacgccgaccagaacggcgtgacgtttgacggcttccagcacaccaagctgctggaaccggacggcgagatgtaccagaccaaggaacagaacccgggcttcgccttccgggatccctacacctttgccgacccggcccacccgggcaagaccttcatggtcttcgaaggcaacaccggcggtacccgcggcgagtacgagtgcaagcccgaggacctcggataccgccccggcgacgccaatgccgagtccgttgacgaggtcaacagcagcggagcctactaccagacagcgaacgtgggcctggccgtggcagagaacaaggacctgaccaagtggtccttcctgccgccgatcctctccgccaactgcgtgaacgaccagaccgagcgtccgcaggtcttcatccagaatgagggcggcaagaacaagtactacctgttcaccatcagccaccagttcacctatgccgccggcatgcgcggcccggacggcgtctacggcttcgtcggcgacggcgtccgctcggactaccagccgatgaacaacagcggcctggccctgggctcgcccacggacctgaacctgccgtccgagtccccggaggcacccactccgaaccagaacggccgccagttccaggcgtactcccactacgtgcagcccggcgggctggtccagtcgttcattgacaacgtcaacggcgtacgcggcggatcgctgtcacccaccgtgaagatcaacttccgggacggcatctcgcaggtggaccggagcttcggccaggacggccttggcccgttcggctacctgcccaccaacctccgcgttggcggcgagggccactacaagtaaaaccgactgcccgtaaatgcagttcaggtacaggcagggacgtccggagcacgggcgcccctgcctgctgccgttaaggcacggccggggatagggtggggatcaacagaagggggagtgcctgatggaataccagaacccacaacccaaccagggcatgcagcaccgtgccgcgccggctcctgtacccggccccggccgaacagttatttccgagacagccgtcgccaaggtggcgggcatagcagcccgatccgtgcccggcgtctactccttgggctcggtcccgtcacgcgcactcggcgccatccgcgacgccgtcggcagttccgaccacgccgccggtgtgcgggccgaagtcggtgaaacgcaggttgccgtggacatcagcctcgtggcgagctatggaacaccgctccactcgctggccaaccaggtccgcgccgccgtctaccgggcggtcgaggaactcgtagggctgcaggtgatcgaggtcaatgtggaagtcaccgacgtctacattccgccaccggtcaaacccgccgttgccggttctactgacatgtccggccctgcggaaagggaggcgctgctgtgaacctcaccgtggccggcgcagcaatgggcgcgttcgtcgccttcatgtccctgcagttcgggttatggggcttcctggtttccctcctctttatggccatcggggcactcctgggccgggccgccgaagggaagctggaccttcgcggggtcctggacgccatcatcggccggcgctcgtcctcatgagctccacagccccggccgtccggggccaagagctgagcggccacaaccgcatcagtacccaggccctgacaagcctcgccaaggccgcagcagcccaattcctcggtgtggaagccgaagacgtccgcgctgactggacggacgacgacggcctgctggcgttgtccgtcgtcgcacccatcagcatgcccccgttgagcgcagtggtgatggatccctcgcgcgtcgatggaaccgggggttccatgtgggaccggaccgtcagggcaaaggccggcatcctggccacggtggctgagctcagcggttccgggctgagccgggtggacatccggattaccggggcaaagatcagtgaaggggggcgcgtgcggtgagccgccacgttgaaggccacggcccggatatggaccggatactgcgccgtgaaacccggtcatcgcgtgctgcggtggccaccgcagccgccgtcctggtcatcgtgctggcggcctacgggctcctcgaagcagccgtccacgccatagggcaaccggcctggctgatcgagccgcaggtggccgcggaacgccttgttgcgctgccggcgggaatccctccactgttgctgggcgtcatcggagcggtactggcaatggcaggcgtgctcttcctcctcaacggggtgctgcctggacgccgcgcccggcaccttatgggtgttggccgggacgctgctggcccggccgttgtggtggacgatgaagtcattgcttcctcgctggcgcggcgtgcacggcttgctgcgaacgtcacgccggagcaggtcatggtggtggtcgcccggcggcaggtagtggtgaatgtccggcccacctccggtgtgcctgtgaaccaggacgctgtcctcgcggcagtccggagcgaagtggacgccatggcactggatccctcgcccgaggtgcgcgtgaatgtggcaacatccggagtgatcggcgcatgaacagtacccccacccttctcaaccgcatcctggtcgcggccctgggcctgctgctgcttggggttggctgcctgctgatgttgctggccgccgtcccggcggtagcctcctggtggcgagcctggtcagcggaagcatggagcggaatcaacacggcgttcaacgccacccggtttccggggcggcccgagagttggctgtggatcctggtggcgctggccctgctggtgcttattggcctcatggtggcctgggttgcccagcagggcaaagggcgggccgatgtgcttgccgtcgagtacgatcccggtgaggtcccgggcgatgtgcggatcggcggcggagtggctgagcaggcgctgaagcacgcgctcgcgcaccgtccagacctcgccggcgccacggtgaccacctatgacgtcaaaggcacgcccgcgctaaaggtccggctccttccgcggcagggcgtggccccgcacctgctcgcagatgaagtgtcggtgctggtgtcagccttggaacaggcggtggggaaagacattcccgtattgatccatataggagccggagcgcggacgcgcttccgcagggcagagcgcgtccgctgactgtctttagttcctcaccaggtacacggcgcagtccacgggaacctcatgcatcagctcccactccgcgacaggctccggtccgctggagagcgccacggaatagccttcgggtatgggcgcggacgcgaagcccatattggcgaggaccaggacatcccggttgtggaaggccagcaggccgctgtccggtgcattgacctccgcccacgccagggagccggtgccgaggtgccgggcagaccggaaggtgagtgcggcgcggtaaagctccagggtggagccttcctcgccatcctgctggtcggcggcaagcggcccaaattctgcgggctggggaagccagggggccgccggttcgccctggaatgaatccgcgaagccgtaaccgggcttatccgcagcccacggaagcggtacccggcagccgtcccgtccggtttctgccccctgggtgcggaagaacgtggggtcctgccgcgccccggccggtagcgtggtgtgctcggggagtcccagttcttcgccctggtacaggtaggcggagcctggcagcgccagctcaaccatggttgcggcgcgggcgcgggccagccccagggccgtgtccggctgctcgtcgtccccggcaatgcccttcgggaacgtggtgggatccgtgagtccgaagcgggtggaatggcggacggtgtcgtggttgctcagcacccaggtgcacggggcacccacgccttcggccgccttcagcgacgcgtcgacggcctcggccatgcgctcggcgtcccagccggccatcaggaagtcgaagttgaaggcctgctgcatctcatcctgccggacgtagagcgccagccgttccgccggttccacccaggcctcggccaccatcatccggtcgctgccgtactcggacaggacgcggtgccagtcccggtagatctcgtgcacgccgtcctggtcgaagaagggggagggcggatacaccggtgataccgcgcggtggggctcctctgcatcagtgtgggcgcctggtgcatcgccgggaggtgccggttcccgtggaacctcagaggtgccctccaccatggcggcaaccccgtcccagtcgggaaggccctgttccttgaccatcccgtgggctacgtccacacggaatccgtcaacgccgcggtccagccagaagcggaggacagagcgcatttcgtcccgtacttcctggttttcccagttcaggtccggctgcttggtgtcgaaaaggtgcaggtaccattccccggctgagccgtcggcttcggtgacgcgggtccatgcggctccgccgaaaattgacttccagttattgggtgcccggttgccgtcaccggaccccggcacctcgtcctggccagggcggaagatgtaacggtcccgttccggggacccaggcggggcgctgagcgcagcccggaaccagtcgtgctcgtccgaggtgtggttggggacaaggtcaacgatgaccttaagtccgcgccggtgagcttcctgcaacatggcgtcgaagtcctcaagggcgccgaagaggggatccacctgccggtaatctgccacgtcatagccgccgtcggcctggggcgacttgtagaacggggaaagccagatggcgtccacgcccagccgctccaggtagggcaagcggtccaggaccccgcgcaggtcacccatgccgtcgccattgccgtcggcaaaggaccgggggtagatctggtagacgacggcgtcggcccaccattccctggttggggcagaggcaggaacgctcggcttggacattaggttcctctcagataactttttgatgtaaacgcttgcattgccgacagcaaccttactagtgtgatggtcaccacaacaacctcaccaaacaaccgcactgtcgactacatacttgtcactcagcgaggagcttcaagccaatgaaaacccctagattcctacttccggctgccaccgccggcgtcctggcccttaccctcaccgcctgcggcgggggaggtggcggcggaaccgcgggaggcggcagcgacgccgaagctaatttggaaggccggggtcccatcacgtacgtgcagggcaaggacaacaacaacgtggtccgtcccctcattgagaagtggaacgccgagcaccctgatgagcaggtcaccttcaaggaacagacggaccaggccgaccagcagcacgatgacctggtgcagaacttccaggctaaaaccgatgactacgacgtggtgagtgtcgacgtcgtctggactgccgaattcgccgccaaggggtggctgcagccgctcaaggacaagatggccattgacacgaatggcatgcttgaagctcccgttgagtcggcctcttataagggcacgttgtacgccgctccgaaggactccgacggcggcatcctctactaccgcaaggacctggttcccgaagcgcccaagacctgggacgagatgatggggatgtgttccatcgccaaggaaaacaacatcggctgctatgcgggccagtacaagcagtacgagggcctgacggtcaacgcttccgaggccatcaactccgccggcggttctgtcctcaacgacgacggcaagcccaacctgaccacccctgaagccgaggaaggcctgaacaacctggttgatgctttcaagaacggcaacatcccggccgaggccatcacctaccaggaagaggaaagccgccgcgcattccaggagggcaagctgctgttccaccgcaactggccctatatctacagccttatcaccactgagggatcttctgccgtgaaggataagttcggcatggcgcccctgcccggcaaggacggcccgggtgcttcctcccttggcggtcacagtgcggctatcagcgtctactccaagaacaaggccacggcactggacttcatcaagtttctcaccaatgaagaacagcagaagttcttcgcgaaccaggcttctctcgccccggtgctgagttccctgtacgaggaccaggaacttgtttccaagctgccgtacctgacggtccttcaggagtcgatcgctaacgcagtgccgcgtcctgtcacaccgttctacccggcggtcacccaggccatccaggagaactcctacgctgcactgaagggcgagaagtctgctgagcaggcgctggccgacatgcaaaagtcgatcgaatccgccagcgcaggatcgtagcaaccaatggcaaccgaattgggcccgacgccggcaactaagccggcgtcgggcgggaccccggtccaccacggacccaagggcgtaggcgaagacaacaagatcctcagccagggcaagtgggcatcatggcttcttgccccgaccatcattgcgctgggcatcgtgatcgtttacccgatcatcagcgcgatcatcatgtccttccagaaggacgccggactcgatccagtcacaggcctctttactgaaggtggcccggcaggcatccagaactacgtgaactggctaggccagcagtgcgctgctccgggcggcggcaccgtcgcttgccctcccggtacgctgggtggccagttctggtctgccaccggaacaaccttccttttcacggtcattaccgtcacctttgaaacaatccttggtttctggatggccatgatcatggcgcggaccttcaagggccgcggacttgtccgtgcggctgtgctcgttccgtgggccatccccaccgccgttaccgcccagctgtggctcttcatgttcgacttcaacggcatcatcaacaagctgtttaatgtctccatcctgtggaccggcagcgagtggcctgcaaagtgggccgtgatcattgctgatacgtggaaaaccactcccttcatggcattgctgatccttgcgggcctgcagatgattccggcggaggtctacgaggccgccaaggtggatggtgctactgcctggcagcgcttccggctcatcacgcttccgctggtgaagccggcgctgatggtagccatcctgttccgtaccctggacgccctgcgtatgttcgaccttccgtacatcctcaccggcggtgccaacaacaccaccacgctgtccatcctggtgatcaaccagatcaggcaagggttcaactcggcggccgccttgtccaccattacgttcatcatcatcttcctggtcgcattcatcttcgtccggttccttggtgcgaacgtcgtggagcaaagcggagccaccggtaaggggaagaaatgacaaccacaactgcttccacagagctgcgggcacggcaggacaagggccgcaaggccgcccagaaccgtgaaaagtgggcgagtgcccgcacgtatatcagtgccgtcgtcatcctgatctggtgccttgcgccggcctactggatggtggtgacggcgttccgcgaggtggacttcacctacgatacgacgccctggcccacgcacgtgacgatggacaatttcatcacggccttcgatacgtcgttcggcaacaggttcggccaggccctgttgaacagtattttcatcggggtcactgtcacggtgatctccctggtgatcggcgtttttgccgcatatgcgcttgcacgcctgaacttccgattcaagtacttggtgctcggcttcatccttggcgcctccatgttccccggcgttgccctgatcaccccgctgttccagctcttcaccaacattggctggatgggcacgtaccaggcactgattattccgaacatttctttcgtcctgccgctcaccgtctacaccctgacgtccttcttccgcgaaatgccgtgggagctggaggaatcagcccgtgttgatggctgcacgcagggccaggcattccggaaagtgatcatgcccctggcagctccggcgatcttcaccacggcgatcctggcgttcatctcctcctggaacgagttcctgatcgccagccagctgtcgaatgaggccacaaaaccggtcacggttgctatcgccagctttgccggtgcccagccgaaccagatcccctacacggccatcatggccgcgggcactattgtcaccattccgctggtgatcctggtgctcgtcttccagcgcaagatcgtagccggccttacggcaggtgcggtcaagtgacgggtgacgcttcccgctcccgccccacgggggcgggaagcgcccgccgtagggccaggtccggcgaggatttcgacatcatcattgggttcctcggcttctgggccctggtcctcttcgtggtcactgtctggatggaagtgactgcgcaaccggcactcggttgggcgctgggactgctggcaacgctcctggcactgtacggcatggtgcggctgcggcggcgcctgccggaccgtcggtagcactcccggcagtacggccgccagtgctacctccggtcgggaaggtaacactgcaatgcaagccggtgcccgaataccattgcaggggcatcgcacagtagcagggcgcatgcctgcagggagtacatgaggggacaccgtggcacgcacaaatgaaaggtctcaacggggcggccacagcggggtcagcattgaagacgtagcggccgccgcgggagtgtccaccgccaccgtgtcccgggcggtccggggactgccccgggtatcacccgcaacacggcaaaagatcctcgacgtcgcaggagacctgggttatgtggcctccagctcggcctcgggccttgccacaggccgcaccaagaccatcggggtgctggcaccttttgtgagccgatggttcttttccaaggccatcgaaggcgcggaccgggagcttcacgcccgcaactacaacctgtccctgttcaacctgggcgggcacggcagcaatcgggaacggctcttcagcaagaccatggtctacaaacagatcgatgcgctgctggtcctctgtatggccctgacccacgaggagctcgagcacctgcagaaaatcgatatacccctggtggtggtgggcggccacgtcgaggaatgcgcctacatcgggatagacgactatgctgcagcctccacggccgtccgccacctgatcgacctgggccaccgggacattgcgctgctgcacggcgacgacgagacagaccttaacttcgacgttccccgcgtccgcatcctggcgttcaaggacgtgatgatggcggccgcgctgcccacccggcccgaatgggacgagtggggcgacttcacggtccccagcggacaggccgccttccgccggctctggtccaagcccggggccaagcccaccgccatcttctgtgcctcggacgagatggccatgggcgtgatcttcgaagcttcccgcctcggggtccgggtgccggaggacctgtccgtcgtgggcatcgacaaccacgatttcgctgaggccgtgggcctgaccacggtgggccagcggcccgacgagcaggccgagctcgccaccaagatgctccttgatgaactggacgggcagattggatcggtccagtccgccgtcgcgccccacgaactgattgtcagaaggacgacggcgccgccccagtcctaggggcgtccagccacggttgcagcttcaggaggcgcgcgccagctgccggatgggaatccagcgggacgccaggcggcggtaggccgcagcagcgccggtcatgtcgccctccgcgaggcattcaatgcccagccggatgtccatgggggattcgtccgggtagaccttgtccgcaacagcaccgtaatcaagctccaccatcgagtccacatggaacatctcaagccactcggtgagctgggcaagatcgtccagcatgtccaggtccggcgccgccagggccaggttggccaccgcgtagcgggcgcgctccaaggcctcggtgatgggcgcccacacccgcactgtgacgatccgccccccgccttccacaacgtccttgcggtccgattccatgaacagcgagaaccagctgaacgggattccccacgtggaggcccgggtgtgaacgcgggttgagccgtcgcgggccttcacctggtcaatccgttcctggtgcttgtcccgctgctcctcggggatcagcagttccgccagggggccgtggatgccctccatcagggcgttggctgccaggccggcgcgaagtaccagctggctgggacagtacagcagcacagcctcagcgccggcgccgtcggcggatggttcgttgtcactcccgccggcaggtgccggggcggtagtgacgcgcaccaggtctgtgcgtccggtggggaaggggtcgccgcctgagcgggtgatgcgtcccagcgaggccagcagctcggcgttttcgacggcggcgcgggaggcagcgcgcgcccctgcctcctggatcgcctggcgctgctcttcggggaaggcgtccagcggttcgtagacgcgcagggttgacgagaacggcaggccggcctggccccggtagaggtttccggtcatcacggcctccttgtgtgggtccaggacacagtcatcagtccgccagttccaccagcacgggggcgtggtccgaggcgcccttgcccttgcgctcctcgcggtcaatggaagcgccggtgacgcgcgctgccaatgccggggaggccagcacgaagtcgatccgcatgccttccttcttggggaagcgcagctgggtgtaatcccagtatgtgtagacgcccggtcccggcgtgaaggggcgcaccacatcggtaaaaccggccgactcgaaggcatggaacgcggcgcgttccggcgggctgacgtgggtgtagcggttgttgacgaagaggtcgatgtcccacacgtcctcgtcgaagggggcgatgttccagtcgcccatcagggccacctgggcacccgggtcctgtgtgacgagctcctgggcgtgggtcttcaggctctccagccacttgagcttgtagggcatgtgttcgtcgtccagggaacggccgttggggacgtagaggctccagatgcggactccgccgcaggttgcagccatggcgcgggcctcctggaccgggtccttgcctgctttgccgaaggagggctggtccaggaaggtccgctcaacgtcctccagccccacgcgggaggcgatggcaaccccgttccattggttcacaccgaagtgggccacctcgtagcccatccgctcaaagagttcccacgggaagttatcgtccttgcatttggtctcctggatggccaggacgtcgcagtcgctgcgctgaagccaggcttcaacgcggtcggcgcgggcacggagcgagttcacattccaggtagctatcttcacagttcctaacctaccttgagcgccggaaatgcggacccggaagtgccgccgaaacggggtgcaacggcgcggacacgcccacccatgcggccccattcggcaggaccaggcaccaatgtgccccagcacggcagtgcccggcgggcgccggggccaagggagcaggaacgggatccggcgtggtggaagttagtaggaagtccgagtatattcgcaaccagaaatgacctggatcacatgcgaaggagcgtgcagtcatggtccgcgagctgtcccattacatcggcggccaccacgcagcaggcctgtcgggccgctttggcgatgtctttgacccctgcagcggccaggtccaggcccgcgtgccgcttgccggccgggatgaggtgcagaacgcagttgccgtagcggagaaggcgcaggtggagtgggcggccatgaacccccagcgccgggggaggattatgctgcgcttcgtggacctggtcaaccgggacctggacgcgctcgcccggctgctttcctccgagcacgggaagaccctcgctgactcgaaaggcgacatccagcgcggcctggaggtggtggagttcgccgccggggcgccccacctgctcaagggtgagttctccagcgacgccggtccggggatagacatccactcgctgcgccagcccctgggcgtggtggccggcatcacgccgttcaactttccggccatgatcccgttgtggaaatccggacctgccctggccgccggcaacgcgttcatcctgaaaccctccgaacgggacccctcggtgccgctccggctggcagagctctacacggaagccggcgtcccggacggggtgttcaacgtggtcaatgggggcaaggaagccgtggacgcgctgctggaggatccgcgggtcaaggcggtgggctttgtgggttccaccccgatcgcccagtacatctatgccaccgccgcggcccacggaaagcgggcccagtgcttcggcggggccaagaaccatatggtgatcatgcccgacgccgacctggaccaggcagcggacgccctcatcggtgccgggtacggctccgccggggagcgctgcatggccatttccgtggctgtaccggtaggggaggaaacagcggaccggctggtggccaagctccaggaccgcgtcgctgccctcaaggtgggccacagccttgagcaggagtcagactttggcccggtggtgtcggccgacgccagggaacgcatcgagggctacatccaggcgggtgtggacgccggcgccacgctgctcgcggacggccgggggctcagtgtgccgggccacgaggacggattctgggtagggcccacccttttcgaccacgtcaccacggacatggcgatctatcgcaacgagatcttcggccctgtcctgtgcgtggtccgggcggcagactacgacgaagcgctcgagctctgcaccaggaacgagttcggcaacggcgtagctatcttcacccgggacggtgatgccgcccgagacttcgccacccgggtggacgtgggcatggtgggcatcaacgtccccatccccgtgccgatcgcctactacacgttcggcggttggaaggcctcgggctttggcgatttgaaccagcacggcgcggacgccttccgcttctataccaagaccaaaacggtgaccacgcggtggccctcgggaatacggcacggagccagcttcgtgatgccggaaggaagttgatgacggacagcgcaccacagggcacagctgaagcaggggtttcagtggacagcagggaggtgctgttcgagcgccgcggccggctgggcgtcattaccctcaacaggcccaaggcggtcaacgcgctcactgccgggatggttgggcagcttctggagcagctcaccgcatgggcggacgacgacggcgttgccacggtcatggtggagggcgccggagaccggggcctctgcgccggcggcgacattgtggccatctaccgcgacatgctggagggcggcgaagcgaccgcgcatttctggtcaaccgagtaccgggtcaactccctgatcgcccgctatcccaagccgtacgtggcactgatggacgggctggtgctgggcggcggcgtcggaatttccgcccacgggtccgtccgggtggttaccgaacgcacccgcacagggatgccggaaaccaccatcggctttgctcccgacgtgggagggacgttcctgctgtcacgcgcccctggcgaaacgggcacccacgcagccctgaccggggcccacctaagcggagcggacgccatgttcctcggcctggccagccacttcgtcccgtcggaaaggctgcccgccctggtggcggcgctggaacacgaaacagcggaagccgccgtcggccgttacagcgcggcagctccgccctcggcgctgcagggacagcagggctggattgacgcctgctactccgcggaagatgccggggaaatcatccgccgcctgcggggccgcgagggagagggcagcgccgcggcctcgcaggcggcagacgccatcgaggcgaaatcgccaacgtcggtgaaggtcacgctggccgcccttcgccgcgtgaaaggccgcatcctggatgaggccctggcgcaggagtaccgggtgggcctgcggttcctggaagggccggatttccgggagggcatccgggcgcaggtggtggacaaggaccggaacccccgctggaacccggccaccttggcggacgtgacgccggagcaggtggagaacttttttgcgcccctggggagccgggaactggaccttcagggcgtggaaccgcagcaaaaaggagcctgaccatgaccgaaaagtattctgtcgccttcctgggcctcggccacatgggcggtccgatggccgtaaacctggtcaaggccggccatgcagtggccggcttcgatgtggtcccggcagcccttgaagccgccaaagccagcggtgtcccggttgcgccgggtgccgtggaggctgtcgccggggctgacgtggtcctcaccatgttccccagcggccggcatgtcctggatgcctatcgtggccgggaagggcagcccggactgctcgcggcggcgaaacccgggaccatgttcctagactgctccaccatcaatgtggacgaggccagggaagcggcatccctcgccgttgacgccggccaccgctccgtggatgccccggtctccggcggggtggtgggggccgaagcaggcaccctgaccttcatggtgggcggggatgccgcggactttgaggcggtgcggccgctgctggacgtgatgggcaaacgcgttgtccactgcggcgcccacggtgcaggccaggctgcgaagatctgcaacaacctgatcctgggcgtctccatgatcgccgtcagcgaggcgtttgtcctgggggagaagctgggcctgagccaccaggcgctgttcgatgtggcctccgcggcatctggacaatgctgggccctcaccaccaactgcccggtgcccggtcccgtccccaccagcccggccaaccgtgactaccagccaggttttgccggggccctgatggccaaggacctctcattggccgtcaacgccctcaacagcaccggggtggctgcccggatgggcccgctcgccgcggaaatctacggtacgtttgcggcaggtgagggcgcgggaagggacttttccggcatcatcaccgacatccgtgatatgtccggccaccgggcgggcggcggaccagagaatgcagaaggcagtgcgccacagagcgcagcgcaggacgacgggagcccggagtgacggaatacgcgaacatccttgtggagcagcggggcagggtgggcctggtgacactgaaccgcccgcaggcactgaacgccctgaacaaagccaccatggaggaactggtggccgcggtcaaggccatggatgccgatcccggggtgggggcggttgtcattaccggctccggcaaggccttcgcagccggcgccgacatcaaggagatggccgcgcagggctacatggacatgtacgccgccgactggttccgcggctgggaagacttcacccggctgcgcctacccaccattgcggccgtctcgggattcgccctgggcgggggctgtgaactggccatgatgtgcgatctgatcatcgccggagacaacgcgaagttcgggcagccggagatcaaccttggcgtcctgcccggcatgggcggctcacagcggctcacccgcgccgtgggcaaagccaaggccatggacctgatccttacagggcggttcatcggggcggaggaggccgaccgctgcggcctggtgtccagggtggtccccgccgaggatgtggtggacgaggccctgaaggccgcagaggtgattgcctccaagtccaggcccgtggccatggttgccaaagaggccgtgaacgccgccttcgagacagggctggcccagggggtcctgttcgagcgccggctgttccactccctcttcgccaccgaggaccagaaggaaggcatggcggcgttcacggagaagcgccagccggaattcaggcaccggtaacggccagcgacctccggtaggcgtcgacgtccgctgccagctcctccgccatgaggtggttgttgatgacgacggcgatccaggcggcagtggccgcagaggccagcacctgcgccttcaggtccgtgacgttgccggcggcccagacgccggggactttcgtgccgccgtcggcatccgtttcaaggtaggttcccgctcctgacggatgttcggacggagccaggccaaggccggcaaaggcgtccagccgggcatggacccggggccccaccaccagcgcatccacggcaatctccggaccgccggccagggcgacgccccgcagccggtcctgttcaacccggacggcctccacaaccccggccaccacccggatcccgcgcgccgccagctgttcggtttccgcgccggacggggcaaccctgttgttcaggaagagcgtgatgttgctgctccactggcggaagagcagggcctggtgcactgaccacgggccgttccccaggatgccgatggcctggtcccgcacctcccagccgtggcagaacgggcagtgcagcacgtccctgccccagcgctcacggagcccatcgacggcgggcagctcgtccgtgagcccggtggcaaccagcaggcgccggccgcgcagctgcgtgccgtcgtcgagcgttacttcgaagccctccgccaggccgccgccggcagccacggccctgccgtggatcacgtcggcgccgtagctctcagcctccgtccgggcgaccgcaaggagtccgccggggctgatcccgtcccgtgacaggaaaccgtggacccctgcggcaggggcgttccgcggttccccgctgtccaccacggccacggaacggcggctgcggcccagcatctgggcggcgctcaacccggcggcgccgccgccaactatcaggacgtcatggagtgtttctatgttttcagtcatgcctccaatgctgttgcgtttgcttcctagctggcaaacttatttgctgtaatggcaaactggctacatggatatcggagccgaaggcgccatggatacgggaacagacgcggtgctcgcatcagttgggccgcgcctcagggcgctccgcctggcccgggacatcaccctgtccgcgctggctgacgccacgggcatctcagtgagcaccctgtccaggctggagtccggccggcgccggccaaaccttgagctgctgctgcccctggcgaaggcctatcacgtcccgcttgatgagctggtgggtgcaccggaaacgggagatccccgggtgcacctgcggcccatcacggcgcggggaatgaccatcattccactcacccggaagccgggcggcatccaggcctacaaacacatcttgcccgcagggccgctgcaacagcccaacccgcaggtgcacgaaggctatgagtggctgtatgtcctgaacgggaagctccggatggtgctgggcagccaggacctggtcctcggggcgggggaagccgccgagttcgatacccgcgtgccgcactggtttggccgcgcggatggaaagcccgttgaattcctcagcctttttgggacccagggcgagcggatgcacatccgttccacgccatcctgacctgcaggtccagccttttcccagctgcataaggtagacagggctggacagccggaagcggatgggggagcactatgttgggaatggcgtcagacgctggcggctcgactgataatttaaccggcctggtgggcgtggctgcacggaccatcgagcacatgggtgagtggggcgtgggtgcttttaccctcgccgaaactgtggtgccgcccatccccagcgaagtgatcctgcccttggccggctaccttgccaagcaggggtccctgcagctgggcctcgtctttgtcaccagcaccctcggggcctacctgggtgcgctgttcctctactggctgggcgcgaagctgggccttcaacgttccatccgcggactgtccaggctccccctggtggaccaggaagactttgagaaggcggcgggatggttccgccgccacggcaggtcctccatctttttcggccggcttctccccggtgtccgcagcctgatttccctcccggccggagcgtccggaatgcccctgggcaccttcagcgtgtacaccctggctggcagcgggctgtggaacggggccttgatcggcctggggtacctgctgggcacccaataccagatgatcgagcagtactccaggttcctgaactacgcggtctacgctgcgctgggcgtgacggtagcactgctcgtggctcggcggctcaagcgggaaaaagtccggcgctgacgggcctatcccgaaagccgtgcttcacagcataggccgcgcttcacgcctcgaagtcgccggcgttgcggcggaaggcgccgaggatccggatcaggtggtccacgtcgccgggatcgaaccccggggcgctgaacacctcggcgttgagcgccgccgtcgcacgcttggcgagggtgcgccccgcggtggtgagctcaatcagcgtggtcctgccgtcggtggggtgcggagaacggtccaccaggcccgcgcgctcaagccggtccaccgcattggtgatggacgtggggtggacctggagcaacgcgctcgccttgttcatggggagggagcccttcctggcgaaactcagcagtgccaggagttcatagcgggcaaacgtcagcccgaacggtttgagcgtggactcgatcctggccagcaggatctgctgcgtccgcatgatggcggtgatggccgccatgggagcggcgacgtccgcccagccgtgttcctcccagttccgccgggcttcggcaatgggatcgcgggacaatggggtacccatcgaacacctttcgtccgagtgacgcgcatcactcttttatcagcgatgtgaatatactaggacatccaatggttgggctaagcggaggtggatgccggtgggtcccgaaggacgcggcgaagcgctcccctttcccgacgccgacctcatgtacgtcgcggacctcctagcagcgcctgagcgggaacggtacctccgcgtccgtaaattcctgcaggaccacgtgcgcgggccctccattccgtactggaaccgcgaagagttccctttcggcctcctggcggagatgggcgggtacgggctgggcgccctccaggtggatggcagttccatcctgctcaagggcctgttgtacgtggagctggccagggcggatgtgtccctttccgccctcaccggcatccacaatgagctgatcgtgggaaccatcaaggaactgggatccgaggaacaaaagctccgctggctgccgggcctggaagccttcaccagcttgggggccttcgcgctgacggaaccggaccatggttccgatatctccggcgggctcgagacctcagccaggctggacggcgccgaatgggtgctgaacggcgccaagcgctggattggggccggcaccatcgccgacttcgccctggtctgggcacgcgacgtggaggaccggcaggtcaaggccttccttgtggagacggaccggccccgctacaaggccgccaaaatctgcaacaagatcggcctgcggatcatgcagaacgcggacatcacgctgcaggacgtgcggattccagcggccaacctgctgcccggggccacttccttcaccaaggccaacgacttactgcgggactcccgggcctgggtgggctggcaggctgccggaatccagctcgccgcgttcgatatagcccgcgcctactcgctggcacgccggcagttcggcaaagagctggcacagttccagctggtccagcagcagcttgcggacatcctgggaaacgccacggcctccctggcgctgatggtgcagctggcgcggatccaggaggaggggaagctggagatggcacaggcagccctggccaaagccaccaccaccaggctggcccgcgcgtcggtggccatggggcggtccctgctgggcggcaacggcatcagtgctgacttcgaaatgggcaagctgttcggagacgctgaaatcctgtacacctacgaaggcagctacgagatcaactccctcatcgtgggtcgggccgtgaccggaaagtccgcgttcgcctagagatgctcttccgcgtaggccagcagcgcgtcccgcacaaagcgtgcgcctggctcaccgccgtaattggccgcgaaccgggcatcggcgacgtacatctccgccaggcccagaacataccctttgatgtcgccgccgtcctccgcggcgggggtgccggggatggacgtcagccactcaacgtgccgccgcgccaggtcctgcgcttcgggaccggcgggggaaagtcctgaacctgcagcggcgatccagtcgctgcccagcttcgcagcgcgtaacttccactcccgctgttcaatcgcacccattcctcgccaccacgcatcgcttttcgcataggagtccttgccccagcgctcttccacctcgtctttgtactgcgtgtggtcgaacccgtcgaacatcttttccgccaccatgtcgcctccgcctttcactgtttcgattgtttgccggacggatgccatctgccgcgtgagccgctcctgctcctgcgccagccattccagatgccggccgagggcctggactgcatctgtctgctggcggaagaccccggcaatggccggcaggcccaggccaagctcccgcagcaggaggatcctttgcagctgcaggagggcggcgccgtcgtaatagcggtagccgttgctgcccacccggctgggtttcagcagcccaatctcgtcgtaatgccgcagcgtgcggctcgtggtgccggcgagccgcgccacgtcctggatggaccagtcgggcccggcctttccatccgttgcttccatggttttagcgtaggggttgacgctgcgtcaaggtcaagcaggtttttccgggaatccgtgaccgcgtggacggcggcttccggaccggttccgggcctgcgcaacgaggcggctgaaggcgaagataaagactgcctcgatggccagcatcagacccacgagcagccactgcccccgggcagcgaagacaatgcatccggttaccgccaggacagttcccaacgcaagggtgtaaacggcaaatccgacggcgacgcgcgcgctgcggacgccggtccggaacccgaagcccatgggttcaccgccggggtgcccgggaacccagtcgggcgcggccggtcccagtttgtcgaactcttcccaagggtcctggtcctgtcccgtcaccctccaattgtcccaaatccggaaccggaagggttgttggtcgggggaggcgggcaacaaaaacagcggcccctccagcaaaatgctggagaagccgctgcaggatacggggttccgccggcacggggccggcggtcacctaagccttagagcgggcggatgttctccgcctgcgggcccttggggccctgggtcacatcgaattcaaccttctggttctcatcgagtgagcggtatccgctgctggcgattgcggagtagtgggcgaaaacgtcagcggacccgtcatcgggggcaatgaagccaaaacccttttcggcgttgaaccatttaactgtgcctgttgccatggctgcattccttcgtgtgactctgattctctccccgtgccatcggcccggagtgcgaggagaacgtcccccgcagtccccaacgtacggggcgcaggccgtgcttgcaagggttaggcaacatttggcgaggtcagcgcatcccttcacggcggattgcggtggctattgcggccgctctggtctcaaccccgagcttggcgtagatgtgagcaagatgcgtttttacggtggcttcggagatgaaaaggcgccggcccagttcgcggttgctaagcccttcggtgaggaggctcagcagttctgcctcacgcggggtgaggatttcttcgggattgcgcagttgctggaacaaccgcgatgccaccggcgggctcatgacgctcttgccttgtacggcaccgcggatggcggaaaaaatttcctcgggcgcggcatcctgcaagaggtatcccatggcgccggcatccaccgcccgtacgatgtccgcgtccgagtcgtacgttgtgaagaccaggatcgcctggcttcggttgcgctcgcggattcttcggattgcctcaattccgtccatcccggcacccatggcgaggtccatgaccaccacgtcgggggaacgctcctggacccggtccatggcttcttccccggacgcggcctcggcaatgacgtggaggtccggctgcgttcccagcagggcccgcagcccgcttctcaccaccaggtggtcgtccaccagcaacaccgtgatcgggctcatacgggtgttccctgtgcgcggtgcccgtcggagggcaccggcagctgtgctgcaacgatagtcccttccccgggtgcgctttgcacggagaaggtgccgcccagctgctccacgcgctgccgcatggcgcgtaacccatagccgccaacgttcgacggcgctgctgccgccgccggatcaaagcccccgccgtcgtcgtaaatatccagggtgaccgcctccggaaggaatccgattgtcacggtgacggcggcggcagaggcgtgcagccggatgttggaggcagcgctctgcaccacccgcagcagggcgtgccggagttcggcggggacggggcgaggctccccggtcaccaggagccgggcttcggggacgtactgccgggccgcgaggagcagcgcgtcaggaagcggggagccctccagcccgggagaggcaagctcgtgcaccagggcgcgggtttcggccaagttgttccgcagtagcgcagtggcttcaaggaggccagccggcgctgaatcgtgcggccacgaccgccctgatgcttcgagcagcagcaggctgctggccagtccctgggtcacggtgtcgtggatttcccgggaaacccgttcccgctcggcaatagtgccggcgcggcgttcactggctgccagctgtccctgcgccagggagacctcggcgtgcaggcggcgctgctcctcggcgtcgtgctggatccggtcataaatcagcgtcagcatgacgcccactgccaggggcccgaggagcatcgccaggtccgtgccattgctcatccggaacagcccggcagcagtggctgcggccgtgacccctgctgcggtgtaggccgcggcgcctgccagggcgctccggctgaggaagaagagcgcaaacgagcaccaggcaaagctcggtgcagcgaccaccaggacagcccagactgccaccagggcaaccatccacggcaccccgggccgcgcccgccgggccagcactgcaacgacggcgtacagcaggcaggcggctgcggccaggccgaggaccatgaggttgtcagcggggctgtgccgcatgacgtaacggaccagcgaggccaccaggagcacggcgaacccaagatgtacggctatatcgatgcctgccaaggggggacggcccggacccgtaggggcggagtccgtgccggcgggcggggccgggccctccacgacggcgtcgtcaggggttcgggcggaggctcgggtaggcatgggatttccggttcgggtgggggaaggctatccacaatgctattgcgcccgcctccctgagtctctcagccttttggctgatacggctggccttgtggcgcaggacctaacagccaaacgcccgatggcagggcaggccggcgccggaaggatggaaccgtacccgaaccgaacattgcccatgaaggaaacaccatgaagaagtccacaaaagcccttgccgccgcagctgccgttgcgcttgccctcaccgccggcgtgacggccgccgcgaatgccgggcccggttcagctccggcagtcgtccctgcggcagacatccagcccgtgccggaaaacgtcgtgcagcaaaaccgcatatcggcaggcgcttctgcccgggccgtgcaggcggcacttgccaaatgccaggcggacaggctgccgttcgtcacggttgcgctggtggaccgtttcgggacagtgcaggcgctgctgcgcggagacaacgccgccgaacacactatcgaggccgcccggcagaaggcctacactgctgcggccttcggaacccccaccagtgagctcgccaaacggatcaacggaaccggccccagcattgccgaccttcccggcacgctcttccttgcgggcggcgtccccctcaaggtcaacggggcttcggtggccggcatcggcgtcggcggcgctcccgatggtgccttggatgaggcctgtgctgcggccggcgcggatgccatcgcggtgcccggcgcagcccagtaggctgggcgcatgcggtggttcggggccctgtgtgcggtccttgtccttgccatgtcggtgacatcgtgccaggcggggagcggggaaccgcagcctccggcggctgctccgccgtcggccactccaccgcaggcctccccgccgaggctttccgctgaagcccaggcgcagctggaccaggagctgatcgccgccgccaaggccaacaacgcacttctggttggtgagctgatagaccgcggcggcgacgtgaatgccaaggacgcaatccaggactcggcgttcctctacgctggcgccgaagggttcaacggggtgctccggctgacgttggctgcgggggcggacgtcgccagcaccaaccggtacggcggcaccgcgctgatacctgccagtgaacacggccacgtagagacggtgcggatcctgatcgacgccggagtgccggtcaaccacgtcaacaacctgggctggacggccatgcaggaagccgttgtgctcaataacggcggcccacggcagcaggaagtggtccggctgctcctcgacgccggtgccgatccaaacatcccggaccgggtgggcaggacggccttggagaacgccgaacggctgggtttcgctgggatcgctgccctgatccggtcccgcggctagattttttgtccagatatgcagggttgcgggccggcaaagtctacatatctggacaaaaactcttcgggttagagggtctcgaggatgctcacgtagttggcgatgcccacgccgcccatgttctgcacggcggcgcggcgggggttggcaagctgcatttcaccggcggttccggtgagttgcatagcggagatgacgtgctgcgatactcccgtggcgccaaccgggtgtcccttggccttcaacccgcctgagacgttcacgggcagtttgccgtccttgaagacccagccttcttcgatggcccgggcaccctggcctgcctcggtaaggcccatggcctcgtacatgagcagttcggcgatggtgaagcagtcatggacttcggcgaagtccaggtcggccagtccgacgccggccatcgccatggcgcgctgccaggagacgcgggtcgcggcgaaggcagtggggtcccggcgggccgccgggaagaagtcgtttgcctggccgaacccggcgaggcggaccggcgcagtgacacctcccgtaggggacgtggacagcacgacggcggccgccccgtccgagacgggggaacagtccgtgcggcgcaggggatcggccaccatggggttcttgtccgagacggtgcggcagaactcctcgccgaggtccttgcggagctgggcgtacgggttttccacgccgttgcggtggttcttggcggcgatggagcccaggacatcacccaggttcgcgtcgccgtaccgctttccgtagtgcctggccacctcggcgaagagcccggtgaagccggtggtggatgctttgccggccatgtcgtagtccgcacccagcagtccggcccccacgacgtcggccccggcatgcgtcatcttctcggcaccgatcaccagcaccgtcttcgccgtgcccgcgagcagggatttcgtgccctgctggaacgcggcggagcctgaggcgcaggcattctccacccgcgtggctggaacgttggccaggtccggggacacctgaagcgccagcgatgatgggaaggccagcggcatcatgccggaattgaactggcccaggtagatttcgtcgatccggcccggttcgatcccggcattcgcaatcgcctcggtggcaacctggacaatcagggactccagggtctcgtccgccagcttgccaaaccggctgtgcccccagccggtcagcaggacatccttgccgaactgttcctgcaggctcatgccggggctccttccagtgctgattccgccagcgcgatggtgaattccgcctccgtcttctcccggatctcatcaacggtgactccgggcgcaaggcgggtgagcgtgagctgccgccctcctgtttcctcgccggtgtccgcctcgcccttgacgaggtcaaacactgcgaggtcgctgatgatccggtctacgcaggccagcccggtaagcggcagggtgcattccgtcacgatcttggccgtgccgtccttggcattgtgctcggtgaggaccaccacgcgcggggttccggccacgaggtccatggccccgcccatgcccttgaccatcttgccggggatggtccagttggcgaggtcgccgctgcccgagacctgcattgcgccgaggatggcaactttgacgtgcccgccccgaatcatgccgaacgaggtggcggagtcgaagatgctgccgcccggcaacacggtgacggtctgcttgcctgcgttgatcaggtcggcgtcctcctcgccctcgtaggggaaggggcccatgcccagcaggccgttctcgctctgcagcaccacccgcacgccatccggcaggttgttggccaccagcgtgggaatgccgatgcccaggttcacgtagtcgccgtcgttcagttcttcggccgcaatcgcagccatctcatccctggtccaggccatggggttctccttttcggtaagtgggggaggatcaggccggtacggcttcggacgcgggacggcttgaagccggacgcaccgtgcgctgctcaatgtccttgacccggtccctggcctgcaccagtcgctgcacgtacacgccgggggtgacgatgtggttgggatccaggtggcccggatccacaatcacttcggcttcggcgatggtcaggtgtccggcggtggcaacaacgggattgaagttccgggcggtgtagcggtacatgaggtttccgtccgtgtctgcggtgtgcgcatggacaagtgcgacgtcggcgcggatggcgcgctcgcggacgtacgtttcgccgtcgaacacctcgtgcggcttgccttcggcaaccagggtgcccacaccggtcctggtgtagaaggccgggatgccggctccgccggcgcggagccgttcggccaaggttccctgcggcgtgaactccacctccagcttgccggccaggtactgctctgcaaacagcttgttctcgccaacatagctggcgatgaccttgtggacctggcccgcatcgatcaggatgcccaggcctttgccgtccacgcccatgttgttcgagaccaccgtcaggtccgtcaccccggagtcccggacggcctctatcaggtccgcggggatcccgctgaggccgaacccgcccacagcgagtgtcatgccgtcccgcaggacgtcccccaaggcagcggaggcagttggctgaagctttgtcatgattctcctcatcgagcatccgggtaatccactttgtggacaggaggtctggaagtggacactatgagggatccaggggcctgtcaaggagtcggtttcatcgctaaaaccgtgcatttcacagtgtggacggtaggatacggactatccataatgtggacataagggagagatgtgaacactttgccggtgcagggagcccaagtggtgagccggattgcaggtttgttacggctcgtaggccggaacgcggagggcatggcgctcgccggcctcgtcaaggaatccggtcttacccggcccaccgtgcaccgcctcctgtcgtccctggcgtccgaggggctgctggaccacgatcccgtttccggcaactgggtgctgggtccggagatcctcctgatggggtcggtcgcatcggcgcggtttccacttgaggagatcgcccggcccagcctccgccggcttgccgaagccaccggcgagagtgccttcttttccatccgtcgtggttccgaaaccgtgtgcctgctgcgggaggagggcagcttcccggtgcggtccttcgtcctgcacgagggggtgcggttcccgctgggtgtcgcctcggcgggcaccgcgatcctggccttcctgccggaagccgagcaggaggagctgcttgggagctgggcagggcacgcgggtactttcgcggcgtcacacaccagggagctggtccgggccaacctcgcccaaacccggatgtccggctactccgtgaatccgggccttgtcctggaagggagctgggggatgggtgcggcggtcttcgatgcctcgggcaggcccgcctgggcgctttccctgaccggcatcgagccgcgcttcaagcccgaacggcaggaggaactgggcggcctcctgatggccgaggcccaccgcatcacccagcagctgggcggggaaggaaagggggcgcggcctcgctgagcctccccgcctgtgccgggaaagcacgacggcacgcccaccttcccggtgcggcgcgccgtcgtacctccctggacgtggggtcagcggtgcatcaactggttcctacagcccggcgcggggctcctcgggcccctggtgcttccaccaggtatcaaagacggtgaccggaacggtgcgcttgtggcgcgtccgcaggtatttctcctcgatcgatgcagccacggattcaggcacatcccggccttcgaggtagtcgtcgatctggtcgtagctcaggcccagctcgtcctcgtcggttcggccaggcctgtcgtccagcagatccgccgtgggcaccttttcccagacccgggcgggggcgccgagctcggccagcagggccctgttctgccgcttgttcaggccgaacagcggaaggatgtccgcgccgccgtcgccgtattttgtgaagaagcccgtcacggactctgcgccgtggtccgtgccgatgaccaggtagttgtgctctcccgcgagcgcatactgggcgatcatgcgggtgcgtgccttggtgttgcccttgtggaagtcggagatttccgagcccacggtcttctcgaactcatcctcgaacccgtccacggcggccgagatgttgaacgtccactgggtcttgggctggatgaagtccagggcagcctgggcgtcttcctcgtcgtgctggacgccataaggcagccgtaccgccacgaagtttgcgtccactccttcggcttcgagctcttccaccgccagctgggccagcttcccggccagggacgagtcgaggccccccgaaatgcccaggacgaagcccttggtgtgggtggccttgaggtagtccttcaggaatgtgacgcgcttgcgcacctccccggcggggtcgatccggggctgaacgcccatttcctcaatgatctttgcctggagttcgcgcatgaggtccagactagccagctgcggcaacaggcctcaagcatccacaccggcccgcccgcactaaactggagaccatgacttcccccagtgacactgcagtggatactgcagccgcccgcgcccgactgctggaactgatcaaggaactcgccgttgtccgcggcaaggtaatcctctccagcggagccgaggctgactactacatcgacctccgccggatcacgctgcaccatgaggcctccaagctggtgggccaggtgatgctggcactggcggacgacgccggcatcgactttgactgtgccggcgggctcaccatgggtgcggacccggtaggcaccgcagtgatgcacgccgctgtggacgccgggcggactgtcgacgcgtttgtggtccgcaaggcccagaagtcctacggcatgggccgccaggtagagggaccgtccgtggagggccgcaatgtcctggtgctggaggacacgtccaccacgggcggctccgcgctgacggcagtggaaggcgtccggaaggccggaggcaacgtggtggccgtggctgtcatcgtggaccgcgacaccggagccaaggaaaagatcgaagccgaaaccggtgtgccctacctgttcgcgttcggcaaggacgagctcggcctgtcctgaggcgctttcgtcaccacgtgctgaggtccagcgggcaggctgcggcggcagccgccccgttggaccgcaacgcggggctgttctatcatgtgcggtaacccctcttcccgtatggagaacgtgcaccatgctcccccctgaacagcccttgagttccaccgaccaggtccagaacctcattctggaaagtgccgacttcgagggcttcctcaacgaactggctcgtttttccgcgcaccagatggccggcgacggcgacgacgccctgtgcggcatcacgctgctccgcgaccggaaggccgccaccattggctggagcagcgattcagccagggaagtggatgagatccagtactccctctcgcagggaccctgcctcacagcggccaaggaggaacgcgaagtcaacgttccggacctgtttgaggagaaccgctggggccccgactacgctgcagccgtggcctcccatgggctgcgttcagtgctgtccctacccttcaatctccagggcgaggcgaaggcggcactcaacctgtactcggacgctccgcggaaatttgatgagcgtgccgttgcccgggcccgtgaattcacccgcgagatctcccaggcgctccggctggcggtgcggttctcgctccacaccgacagtgccgccaacctccgcgccaccctggagtcccggaccatcatcgacctcgccattggcatcgtgatggcccagaacaggtgcagccaggaggcagcagttgccatcctcaccgaggcctcaagcaacaccaacaccaagctcagggacatcgccaagtccttggtggactcggtgggaggcgttggcacccgcacgcacttccaggagccgggaaagcggcaggctgaccaaagcgcctagccggcgaccagcccacctcgttgttactggcgggttgtgcccggcttccgtggggggttacgcttaccgaggttgagccgtcggccatagacaccctcttttggagtacctatggaccgcgcattaaacgcattcgttaaccttgatgtccccgccgacgtcgtccgcattgatatcaggggcagcctgaaccaaagctcccgccccgaactcgtgcacatcgtccggcgcgtccgccggatgggcatccgctcccacgtccgcgttgaactctccggggctgagaaggtggagtcctctgcccttgccagcctccggagcgaccttaacgccatcgatagcgatacgctctccggaatttacggcagcggggtttcattggctttttccccaagcgccgatggatgggccgcccaatcggacccgacccggcagccgctggcactcatcgacgtcctcaccgacatgacggaggacggagaggactttgctgatggctacccgctggtgccgaccggacgcctggaagacttgtgcggccgtcccttggaggagtactcggacgccgaactgctgactgcaagcgactggattttcggccttctggacactccgggagccttcgccggcccggacctgctgggccggtacaacgacattggcctggagttccggcggcgccagcaggaggaagcggtaccccttaccgcctcggagggccaggcggccagctgagaggtgcctgctgaccgggcgtcactcaatggttacaccgggattcttgcggcagcgtcttggggtgtgcctacggtagaggcgtgccgtatgagggggaggtaagtccgcagggccggcccggggtcccgggggcccggctgctggcagaaggtgctgccctcgaacagttctcacggcgtggattcctggcgggcaccggcgctgccgggctgctcgcggcagacatgctgctgacccggcaggtgcaggcccagcgccgcacggaccggatcctcaccgttgctgacgacttcgccgacgcctactacccggacgccagctggttcctgttccccggatacaagaccagttgggaggagtcgcagtggatcctcaactcgctccggggggccctgaacaagcgggcacggctcgccgccgtgggctactccaaccagggcctggacattgacgacatcgtcattgccgtcatcgagtatgtccgggcccagaaactcaccaagctgtttttctacggccacagtttcggcggaatggtggccacccaggttgctgcacggctccttgaaatccacggggtggaggtccagttcatcgtgctggactcaagcccctacagcaagcacgatgtcctggaccagagctggttcgacggcgtggtgttcctgtacgagcggggcttccggttcccgtccgcccttcgcggtgggtacgagcttggggagcgggtcatccacaaggacgagcggagctggcggcagatccttgaccagaccctcgagcagctttccccgattgccccctcaagcctgctgatccaatccgaatcggcctacatctactacttcgacgccagcaggttcgccggcaagctgggggacgccaagatggcctacattggcaacccccgggaccgcactgtccgctaccagacagcggtggaggcctgggccgtggcgttcaaggcgaacatggtctcgagcagcctccataccgaaggcgccaggccggcccacgcaagcccgggatggaacccaaacgtgtaccggccggtccttgaacagctgttggacgagcacttcccgctgccccgcggcggatcccgggtaacagtcttctagggctcctgctagatctggttcttcaggtcggccacggagttcaggacctggttgggccggaacgggtatgaaccgatctggtcccgctgggtgatgccggtcaggaccaggacggtgtgcaggccggcttccatgccagcgatgatgtctgtgtccatccggtccccgatcatcgccgtggtctcagagtgggcatcgatctggttcatggccgagcggaacatcatcgggttgggtttgcccacaatgtagggctcgcgtccggttgccttggtaatgagcgcagcaatggccccggtggccggcatggggccgtccttggacggcccggtggcgtccgggttggtggcgatgaaccgggcgcctgccaggatgaggcggatggccatggtgatcgcttcgaaggaatacgtgcgggtttcgccgagcaccacgaagtccgggtcctggtcggtgaggatgaagcctgcctcgtgcagcgccgtcgtcagtcctgcctcaccgatggtgtaggcgcggttccctgatccggaaccttccacctggttcttcaggaactgggcggtggccagggcagaggtccagatgttctcctccgggacttccagcccggaagcgcgcagcctggcggcaaggtcgcgcggggtgaagatggagttgttggtgagtaccaggaagcgcttggacgtgtccacccagcgctggatgagctccgctgcgccgggtactgcctggttttcgtggaccaggacaccgtccatgtccgtgagccagcactcgatctcctggccgctgcggtataccgccgggtttcctgctacctggtctgcttctgccacgtctacctccacgggtgatgaatgctccagtggtccagtctagtgttgaggggtgaaccagacgcccggcatgacatccgaaccgcagtcagaacccggggagacgccgggggaaccggaatccggggcggcgcacgccgaaaaggcggaggtcggcgtcggaccctgggagggtgaactgccggaaggggaccactgggatcccgatctcctcgccgacggcgaccgccgcaacgtgctggacaaataccggtactggaagcacgaggcgatcgtggcggaactcgactcgcggcgccacaacttccacgtcgccatcgagaactggcagcatgacctgaacatcggaacggtggtgcggaccgccaacgcgttcctggccaaggaagtgcacattatcggacgacgccggtggaaccggcggggtgccatggtcaccgaccgctaccagcacgtccgccaccaccccacggttgaggacttcgtggcctgggcggagggggaggggctggcgatcgtcgggatcgatatcttccccgattcggttccgctggaaacgtacgaactgcccagggactgcgtcctggtgttcggccaggaagggcccgggctgacgccggaagtccatgaggccgctgtggccactctgtccatcgaacagttcggctccacccggtccatcaacgcggcctccgccgccgccatcgccatgcacgcctgggtgcgccggcacgtgttcaaccagcacgtgtagcaggcggtgggcccacgcccgcagggttccctggccgtggagccgctccggcgagggtcccggcccgagcctgcgagggtagggagccggcgcggacttgcgaggctagggtgcgggtggggcgtaacccagaacacgcccagcccggaaatgactaggatggtgctagccgtaagcggtactccagggttaccagcccacagacgaacctcagcataggagtcagcatgcccattgcaaccccagagatctactccgagatgatcgaccgcgcaaaggcgggcggcttcgcattcccggccgtgaacgtgacgtcctcgcagacgctgaacgcggccctgcgcggcttcgccgaagccgagtccgacggcatcgtccaggtctccaccggcggtgcggcctactggtcaggcgcctccacgaaggacatggttgccggttccctgggcttcgcggcgttcgcccgcgaagtcgccaagaactacggcgtcaacatcgccctgcacacggaccactgccccaaggacaagctggacggctttgtcctgcccctgctcgcggcctccgaggctgaggtcaaggccggacgcaacccgattttcaactcgcacatgtgggacggctccgccgagaccctgcaggaaaacctgcgcatcgcccgcgaactgctggagcgcaccgctgccgccaagatgatcctcgaggtcgaaatcggcaccgtgggcggcgaggaagacggcgttgagaacgagatcaacgagaagctctacaccacggtggaagacgccctggccaccatcgacgccctgggcgccggcgagaacggccgctacatcacggccctcaccttcggcaacgtgcacggtgtctacaagcccggcggcgtcaagctccgtccggagatcctcaaggacatccaggcccaggtgggcgcgaagatcggcaaggacagcccgttcgatctcgtgttccacggcggctccggctcctcggaccaggaaatcgcggacgccgtctcctacggcaccatcaagatgaacatcgataccgacacccagtacgcctacacgcgcccggttgcggaccacatgttcaagaactacgacggcgtcctgaaggtcgacggcgaggttggcaacaagaagacctacgatccgcgcgtctggggcgcctccgccgaagccggcctggcagcccgcgtggtggaagccaccaagcagctcggttcggccggaaagaccttctaaatgtcggatgagttccgccggaacctgatgggccccgagcccacgctcctgcctgccgagaccgaggtctacgagcagctggacgcgggccaggaagccctggacctcgtggagaagcaccccacgtcctcactgttgtgggccgtgctggccgaggaggcctgggcggaggggcgcaccatcgattcctacgcctactcccgggtgggctaccaccggggactggactcgctgcgccgcaacggctggcgcggcgtggggcccatcccgtgggagcataagcccaaccgggggttcctgcgggccctctactcgctgggccgggcttccgccgccatcggcgaggccgaggagccggagcggatcgagaagttcctcaacgattccgacccctcggcgaaggctgccatcgaggcgaagtagcaagcgctgattaaagtgcgacggcgggtggtcaccttatgaaaaggtggccacccgccgtcgcacttccaggagttcttatccagatatgcaggtcaaaaggccctttaaggctgcatatttggaaaaaagtcaaggctttgggggagctagctggctttctgcaggcccgtacgggccatggcgtcggcgtaggcgacccgcatgtcctcgaggtactcctcctggcgggccggcgaaccggcgaacgcgcggccgctgagggaacgcaccttgtaagtcttcaggccgcggcgccacagcagcggaacttctgtcttcagcagcaggttggcgaggcggttggcctcggtgccatgcgccacgatcaccgacgcgcggggaacaagcgcaaggaacttcaggagcggtttgaggcccgcggagatctggtccggggtgaactttccgttgggctcgccgggcaggtgccacgggtggacgttccacggcatcacgaactccgggcgcaggcccagcttccactggatgccgagcatccgggtcacggcatcgtggtccccgggggtgatgaacccggacttgtccgcctcgccgatgttcgagtacaggctgatgatgcggcactcgtccacgtcatgcatggggtcgacgtaaggcactacggtgccgggcttggcgtcctgcagggaatcgcacagttcattgacggccgcgacgttgggttcgtagcggcggctcaggagttgctcatggaaagattcgggtgccagggctgtcatgtagtgcttgatctcctgcggggattgttgttgcttccgccggtgaaaatgggcgcacgacggcccagctcatcaacggcggttaattggggtgggccgattcctggtcggcctttcccagtttagcaagccccgccaaacgaaacgccgggcggggccacccaataagagcacgggcgcatagtttcgcaacgtaataactgactgcagatttctgtcacgtccattgacagcttttctttaggttggttggcttttgtcacagcccgcatatgggggatcaccgctggctggacacacccaatgcactcgaaagaggtaccgcaccgtgagaaaaaccctggcaaccttcaggaccctggcactaacgggagccctggctctggcagcagtgaccgtcccggcaccggccctcgccgtcggcgaaggccccaactatgacggcaacggccagatcaccacgtcgaagcttgccacctacgaccagatggttgcgttcctcaaagaccaggacgcccgccagcccgccatggagctcgaagtcatcggccaaacggtcaagggccgggacatccacctggtcaagtacatttcggaccccgccaaacccaccatcctctacctgacgcagcagcacggcaacgaacagctcaccaccgagggcgccctggaattcgtcaagcacctgggcaccggcaagtcaggggacatccttgacggcgttaacatcctggttgtccccatgcttaatgctgacggtgccatgggggacgtgaacttttccttggaggactacatcgccaagggcgaccgaaacatgacccgctacaacgcgaatgaagtggacctcaaccgggaccacgtggccaaagtccagcctgaaacgcaggcgctgcacaacaacgtgatgcgcaagtaccaggtggactacatgatcgatctccaccaccagggcacccgcagtgaacgcgacggaaagctggtctccggctcgatcctgtaccccaccacacccaacgccgatccggcagtggtggagaagtccaagcagctgggcgcggtggtctttgacaatgtcgactccaccggttggggccacctcggcaagtacgtgggcggcagtgccgaaaccatcagccgcaacggcatcgccgtggagtacggcattgcgacgctgctcttcgagatgcgcggcatgtccgaccactacctggatggctacgcactggggctgcggagcaacggctacctgatcaagcagacagtcaccacgctgaccgccaccgccgccgccatcgctgacggttcaatcgccgacgccgacacctccttctgggacagcctggccacgcagacctcccggcccggcgaggaggccgacgacgagtagcagcacccgctgacgctccgccgcggtcccttcctgcagcagcccctgcgctgcggaaagggccgcggcggactaacgagtggacaaagtcgcccatcggctaaacttgggtggtaagggccccggaactcttgcgtcgctgtgccgccatcggaccagtgacagccggtacattcggggcattctcatgaacggcgctgcgcaggaccgccacagtgtggccgaaaccgggcagcccgaacgaatgggggaggatcccatgccagcaattgtgatcgtaggagcccagtggggcgacgaaggaaaaggcaaggctaccgacctgctcggcggccgtgttgactacgtcgtcaagccgaacggcggcaacaacgccgggcacaccgtcgtcgtaggcggtgaaaagtacgaactcaagctgctgccggcaggtattctcagccccaacgcggtgcccatcatcggcaacggctgcgtggtcaaccttgaggccctcttccaggaaattgacggcctgcaggcccgcggcgccgacacttcaaagctccgagtctccgccaacgcccacctggtggccccgtaccaccaggtgctggacaaggtgaccgagcgcttcctcggcagccgcgccatcggcaccaccggccgcggtatcggtccggcctacatggacaaagtggccaggctgggcatccgcgtgcaggacgtctttgacgaatccatcctccggcagaaggtggaaggttccctccgccagaagaacgaactcctggtcaaggtctacaaccgccgcagcgtcgtggtggatgagattgtggactacttcctgtccttcgccgaacggctccgcccgctggtcatcgacagcacgctggtcctgaacaccgccctggacgagggcaaggtggtcctgatggagggcggccaggcaacgttcctggacgtggaccacggcacctacccgttcgtgacctcctccaaccccaccgccggcggcgcgtccgtgggttcgggcatcgggcccacccgcatttctcgctccatcggcatcatcaaggcctacaccacccgcgttggcgccgggccgttccccacggaactctttgacgagatgggcatgtacctgcagaagacgggtggcgagttcggcgtcaacaccggccgtccccgccgctgcggctggtacgacgccgtcctggcccgccacgcgtcgagggtcaacggcttcacggactacttcgtcaccaagctggacgtcctcaccggcatcgagcagatccccgtgtgcgtggcctacgacgtcgacggcgtccggcacgacgaaatgcccatgacgcagacgcaattccaccatgccgtaccgattttcgagtacttcgaaggctggaccgaggacatcacgggcgcacgcaccctcgcagacctcccggagaacgcacgcaactacgtcctggcgctcgagaagctgtccgggacgcgcttctccgccatcggcgtgggtccggaccgggaccagaccatcgtggtgaacgacctcatcaacgactgaccggtccgtaaccgggtaaaagcagggaattacgacggcggcggggcactcttgcaagggtgtcccgccgcttgtttctgtccggggcgggaggggcctgcggcaatttacacagggttaacgtggttggtcttgtgaggctgccgggaagcccgcgagactcgtctgtacaccctgtgactgcgaggaaggacttgccatggccgggaaattcgaggcatttgtggactctgattcgtctttcaggttccggctcctggcccctgacggcgcagtgatggctgtctccggcccgtaccgggacaaggccgcccttgctgccggcatagccgccgtccgggagtgcgccggtaccggtctggtcaccgatctttgttccgccggggccgcaacccgccaggcccacgtccctgccccggcggaggaaccggccacggctgcaccccggacggagtgcgaggaccagcgcgtccccgccggagggcacgccttcgttttcgcccaaggcctgcggcgccagggcccccggccccgctggactgccgccgcccgctgacccgtccaaaaagttttcaaagttttcccgtccaggcgtaaccctttgcgtgcccccagcgattacccctatgtagcgccggcctggaacttgtcccccatcacgttccaggccggctctttcactttccgacggcaggggcagctgcctagtcggaccggcagcgaacgcgtggcggtcccgggcggtggttactgggcggtaaagtgaggcggggaaaaggcgttccgcactcggacggcttctccgcgcaaacaaccccctctttgaccgaaagctccacgtccgtgactgatgccctgacagacgaggccctggacggccccgccgggccaacagtattcagcgttgtctaccggacgtatgcatcacaggtcctgggctatttgacggcccggggagtcgaggatccggaggcggccatgcaggaagtgttcctctccgtcctgccgcgtcttggctcagtgcacgggggagccgccgggctgcgcacgttcatcttttcggtggcccacgcccgcatggtggacgatcaccgccgccagagccgcactcccgccaagctcccttttgaaccggagctggaccagcgcgaagattcgtcggcggaaacggaagcgctggaacggatagtgccgcaggaggtccttggcctgctggatgcgctgccgcaggaccagcgcgaggtactggccctccgcctcgtggccgggtttaccgtggagcagtccgcggaagccatgggcaagagcgagggcgccgtaaagcagctacagcgccgggcgctcctcaagctccgggaacttgcggacgtgaaggaatacctgaagccatgacaccacaagcgcaccacacagcggacgcggtggaggagatgctcctcgacgccggccttgggcaggacgccgacctgcgccggaccctcctggccgtaggttcgttagcgcaacttcccgtgccggctcccacgggacagctggctgccctgctggccgccggtacctgcgatgcacccgggaaagacgcgcagggcagctacacgacggaggccaccccgggcgatgaactcgggcggcgccgccggctgcgcgcacaccggcccaccgtcgtcgggctggccctggtggcgggcatgggaatgggagttggcaccgtggcggccagctccgcaggtcctgcccataccggcagcccctccgtgcagcaactgctcgaagactggtcaccatcctggaccatccgtacaccccaggccgctgcgcccccaccactccaggagggcagcgatgacgctgccagcgggcaggatgacggcgggctggctggcagtgggaccacccctggcggggaaccgccggcaacggcgcagcccgcggaggagtccgggcagggcacaacgttcctgctgcccggccagggctgggacgaacccggagacgttcctgcggcagacggacaggacggcaggaaggaaccggaaaagaacggccacgcagcagaagaggacacggcagcaggacccgaacagaccggtccgactgatccccggaccaacaacgggaacaccccggacaagacagggcaacggccagtagaggctcccggcgtgccgggaaacgccggacagggaccagcagggcagggagccgacgccgccgccggaggaaaacccgtgcccgggaccaagtggctggaaaagttcgtccgctagccgtagtgacctgagaggttgaagacgcctcgtagcgggctgcacgctgacggcgttccctccgcgtaggctgaacccatgggccacacgaacgatcctgcagtcatagaacgcctgatgcgcaccaagggacgctgggccatcgtcggcctgagcaccaatgaatggcgtgcagcctacgacacctcgctgttcatccgggaccggatgggcatggaaatcatccccgtcaacctgcccggtgaccccgtccacggcgaacccggttaccgcagcctcctggacatcccggccgccaagcagcccatcgacgtcgtggactgctttgtgaattcccacaaagtgggggacgtcgtggaccaggcgatcgccgtaggcgcgaaagccgtgtggatgcagctgggagtcgttgatgaggctgcggccaagcgggccaaagaagcggggctggacgtggtgatggacagctgtcctgcgcagcaggcctggaagttcaacctctgacaggctttcagcctcagcgcttcagcagctccggatagtgccgttcggtgacgtccgggtgcgcccgcatcctgcctttgagcatgttcatcccaaaccaggccagcagcgggttcgccgggtcatccgtgattcccctcgccgctgccttcagctccggcggcagcggcaccgggtggatcaccgcgtcaagccttggggaccagaagaacggaacggagtaccggtccacgcccggcagcggtgcctgcacccggtggatggtggccgccaggtagccttccgtggccacctcaagcatttcaccgaggttcaccaccagcgccccggggagcggttccaccggaacccacgctgccgccccgggcggaagcacttcaagcccgcccacgtcgtcctggagcagcagcgtgacgaatccgtagtccgcgtgcgatcccacgccctggtctccagcggcctccaccacgccgcccacatagtgcaccagcttgcccatccatgccggtgacccctggaacggctcgtcgaagtagtcctccggaagctgcaaggaaacggccatccccctgagcagctccatccccaccgcggacatcagttcagcccacgccatggccacggggcgaagttcggggaacgatttatcgggccagaggttggggccctgcaacagccagaacggctggtcctccggatagtccgtaacgggcggccgctccggtgagtagtcgatctgctcccgcgcgtctgcccttccctgggtgacctcggtgcccatccgggtgtagccgcggaaatgcggcgacagccggttatccagcttcagccggtcctcgagcggaaggctgaagaagcgcctgatggtgtccaaaagctgttccggctggccgggggccgcaccgtatccggtcacttggaagaagcccacgttgtgcgtggcgtaccgcagctgcccgatgaaatccgggctgaaggacccgccggcctgccgggccgtgcccaggtccagaacaggtatggacccctgatcgcgtgccatcctcgcagactagcaccggaggcgatggctttataggctttccggatggaccccgacgcactgcggaaagtttgcctctccttccccggcgcgtacgaggattatcccttcgggcctgagaccgccgtcttcaaggtaagcgccggcggttcccagaaccagggcaaggtctttgccttgtcatcgatgagcccggacggctacgtgaacctcaagtgcgagccgggcctggcggtgcagctccgcgccgcacaccctgaaatcacgggggcgtggcacatgaacaagacccactggaacggtgtccggctggacggggcgcttcctgacgacatggtcagggacatggtggaggactcctacgacctcgtggtggcaggcctgggcaggaaacagcaggaacagctgggatgggcgcggctgaccggatcggccggtggagcacgtggctgaggaaaggctggccgggggccggctcaactaccccgggatcggcagcaccgaacggggcgccgcccccgcgggctacccgcgggtccttgaggaagcgttcctgggcaccggcatggaggtgtaccggcgggtggctgcaggcatcctgggctgggaactgcagcggcgggcagggctccgcgtccgtgccgattcacccgtggcggtgccgggggcgcgggtggtcagcggcttcggtgccgggccgttccggctgaacgccccgtgccaggtggtgtggacccgggaacctgagcaggagcgcattccgcagtcagcgggatttggctacggaaccttgcccgggcatccggcccggggcgaggaatccttcgaggtggagatcaacgggcgcggagaggtgttcctgcggatccgggccttcagcaaaccagccaactggttctacgctgccggcggactggtcacccgtgctgcacagcgccacgtgacgtcccggtacattgaaggggcacgcactctcgcctcggaaggaatgcccccgtgatcttcattgtcgtcaagttcaaggtcaagcccgactggtcggagcgctggctcgacctggtggccgactttacccaggccactcggcaggaaccgggaaacctgtggttcgactggtcccgcagcgtggacgaccccagcgagttcgtcctggtggaagctttcaaggacgacgccgccggcgaccacgtcaacagcgcccacttcaagcaggccatggcggacatgccccaggccctggccgagacgcccaggatcatcagccgccagctcgacggcgaaggctgggaccggatgggcgaactcaccatctgagcccggcagcacatcggtaggctggacccatgtggatcggctggatcgaattcgatatcctcctgggcgacgtccagagcctcaaggaaaagcgctcggtcatcaggccgctgctcgccgaggtcaggcggcgtttcgacgtctccgtcgccgaggtgggtgaccacgaccagtaccggcgctcacaggtgggcgccgggctggtggcggccgaccgcgcccacctcattgaggtgctggacgccgtcgaacgctttgtggcagcccggcccgagttcgaactgctcagcgcccggcagcgtgaccaccacagcgaggactaaccgcgcgcccctacccatcgattgctgagtagctgtcgttttcacccgcgaaaacgacacttgctcagcaatcgatggggaatgtggataacttctgcgtgtcccggcccattctggtgtcatgtaccgatgaagaccccacgccccctgccggaggagctccgcggccgcccattcaccctcgtcgatgccgcgctggccggagtgtcctcgcgccgctggcggcacggttccttggagcgcttcggccggggcattcggatggaaagcgcgacggcggcactccccttaagcgttcgggtccggcctttcatcgaagtcaacgagcgatgcgccgcatcgcatttcaccgccgtggagctcaatggcctgccgcagcgccggcagaacgaaggccttgaggtctatcacctcatccggcccgaaggcgcggcgcatcttgcgcgcccgtacgtcattgtccaccggatgaagctcttcgaggacgaggtgatgatggtggacggactccccgtcaccacgcctgcgcgcacctggctggacatggcggagatactgtctgtggatgaaatcgtggccatgggggacagctgtgtccgcgcacccaggctggagctcgagggccgggacatgccgttgtgttccatcggcgatcttcagcggatgatcaaccggcacaaaggcaaacggggactccggaacgccaaagaggccatagagctcatccgggtgggctcggactcgccccaggaaaccctgctgcggctggccttggtccgggcaggcatgcctgaacctgaactgaacgtcgccatcaccgacggtgctggcatcccacaccatcagcccgatttgagctaccgccaataccggatcgggatcgaatacgagggcgaacaccacggcgaggacggacagatcgtgcgggatatttcacgctcggagcgctacaccgccctgggatggactgaagtccggatctcaaagcgccacatgcccaacgatgcgaaacctgcggttgccaaaatccggacggcgctgatccaagccggctggcggcggggcggttagaaaaatcgattgctccgcacctgtcgttctgagaggtcaaaacgacaagtacggagcaatcgatgggggactagccgaagtacttcggcagggtcccttcgtgtgccgcgcggagggcgtccagggacaggctctccacgccattgatctccagcttgccgctggcggcatccaccacgccaatgcggatgtgggcgaagccgcgggcggtgcacatgtccgtgaagcggatttcctcggagcggggaacgccaacaatggcacggccctgggactcggagaagagcgccgtgaacaggtccacgccgtcccggtccaggacatcctgcagggcaatccgggcacccacaccgtagcgcagcgaggactccaccagggctgccgcgaggccgccttcggacaggtcgtgcgcggagtcgatcatgccgtcgcgggacgcgttgatcaggatctcgcccagcgcgcgctcggcctcaaggtcaaccttgggcggctgcccgcccaggtggcctcgcatgttcgcccactcggagccgtccagctcggcgcccgtggtgcccagcaggtagatcgtctggccgtcctcacgccagcccgacggcgtacggcgggcaacgtcgtcgagcttgcccagcaccgccaccacaggggaggggtggatgggggtggtgcccgtctggttgtacagggagacgttgccgccggtgaccgggatgcccagcaccatgcatgcgtcggacaggccgcggatggcctcggcgagctgccacatgacgtccgggtcctcgggggagccgaagttcaggcagtcgctgacggccatggggacggcacccgcggtggccacgttgcggtacgcctcggccagggccagctgcgcgccgtggtacggatcgaggtaggtgtagcggccgttggcgtcggtggccagggccacgcccaggccggtttcctcgtcgacgcggaccacgccggcgtcatcggggaaggccatggcggtgttgccgcccacgtagcggtcgtactggttggtaatccagtccttggagcacatgttcggcgatgccaccagttccgtgacggccttggccagttccccgggcgcggccgggcggcccgcgtcctgcacggagcctgtgaaggtgtcagcctgcacgcggtcctgccactcgggccgggcatacgggcggtcgtagaccggtccgtcgtgtgccacggtgcggggatcgacgtcgacaatcacgtcgccttcccaagtgatgatcaggcggccggtgtccgtaacctcgccaagccatgagtactccacggcccatttgtccatgacagcctcgaacgccttgacgttctccggcgtcactacggccatcatgcgttcctgcgactcggacatcaggatctcgcccggggtcagggtggggtcgcggagcaggacggaggtcagctcaacctgcatgccgccgtcgccgttggacgccagttcggatgtggcgcaggagatccctgcggcgcccaggtcctggatgccttcaacgagggaacccttgaacagttcaaggcagcactcgatgaggaccttctcggcgaaggggtcgcccacctgcaccgcggggcgcttggacggcttggtgtcgtcgaaggactcggaggccagcacagaggcgccgccgatgccgtcaccgccggtgcgggcaccgaacaggaccaccttgttgcccttgccggacgcgttggccaggcggatgtcctcgtgccgcatgacgccgacagccagggcgtttaccagcgggttgccctggtacacggagtcgaacaccatttcgccgccgatgttgggcaagcccagggagttgccgtacccgccgatgcctgcgacggcgccgtgcatgacgcgtgcggtgtccgggtggtcgatggcgccgaagcgcagcggatccatcacggcaacggggcgggcgcccatggagatgatgtcgcggacaatgccgccgatgccggtagcggcaccctggtagggctcaacgaacgacggcgagttgtgcgactcgatcttgaaggtcacggcccagccgtccccaaggttggtcacgccggcgttttcgccgatgcccaccagcatgtccttcttcatttcctcggtgactttctggccgaactggcgcaggtggttcttggaggacttgtaggagcagtgctcgctccacatcacggagtacatggccagttcggcgccggtggggcggcggcccaggaccttgacgacctcgtcgaactcgttctgcttcaggcccagctctgcccaggggagttcgacgtccggggtcttggccgcgttctcgacggtgtcgatgttgaacttcttggtggtttccgtggtcacttggcgcctcccacaatcttgttcaggacggaggtgaagaatccgagtccgtcggtgtcggacccgccgatcccgtcgagggattctgggccgaacccaacttccacggcgtgctcggggtgcggcatgagtcctaccacgttgcccgctgcgttcgaaatgcccgcaatgtcccggcgggagccgttcgggttgaagccaacgtagcggaacaccacgcggccctcggcctcaagggcgtccagggtcttgtcgtcggcgatgtactggccgtcctggttcttgagcggaatcgtgatttcctgcccggcctcgtaatccaaggtccaggcggtgttgctgttctcgacgcgcaggacctggtcgcggcacatgaacttcaggtggtcgttcttgatcatggacccgggcagcaggtgcgactcggtgaggatctggaagccgttgcagataccgagcaccggcagcttggcgtccgagttggcggcatcgatgattttggtcatcagcggggcgaagcgtgcgatggcgccggcgcggaggtagtctccgtaggagaacccgccgggaatcacgacggcgtccacgtcacctagttcggtgtcggcgtgccagagttcgacggcggtgccgccggcgaggcggacggcgcgggcggcgtcgcggtcatcaagggtgccggggaacgtgacgacgccgatccgggcgccggcgagcctgcgggcgcccgaggcgtcggcgggtgcttcgccgatcagggggagttcagtcatgtcaggcctcgacgacctcgacgttgacgacgtcctcaattacggggttggacaggagggtttccgcggcgtcgcgggcctgcgccaggatttcctcggtcacctcgccgtcgaccgtcagttcgaagcgcttgccctggcggacagagctgaagctggtgaagcccaggcgggggagagcgccgacgatcgccttcccctgcgggtccagaatctcgggcttgggcatgacgtcaacaacgatccggggcatccggtaactcctgtgcgtgagcttgggtaagggcgcagcggagtggtgccgtctcacgccgttccgggcctgggacacgttgacttaaacagttcaggccgtgagttcagacaatgcgttcagacatgaggacgggcgctccgcgagcttgctcgtccattctaccggccgaagggccacagcctgtattcggccggttcgggcaggacgaccgcgggtagcctgcttgccggacgggtggcggcggcggtttccggcctggtgctgtggagttggacgggtggcatcactaggattgttgaatggctgaaaattcgaaatccgtgctgttgcccgtggtcgccgcagcagtgttcgcaggactgggccggatggtgttccagaagattaaggccgaccgtttcgcccgggagaacagggtagcggggccggtggatgagaagacccgagagtggatcagcgacgtggtccgtacgccgcgccagtagcggcggagcgcatccccttggtttcaagggcgtctttcagggcgcccttttttcgtgcccttccctgctgcggcaggcccccggcttgccggaatatgactggcggaaatttcggttttgtgtcctatgtcatattcagctatcagtctgtactctgtgatcggctggtctcacgaaatgacaagatctgtaagttcgcgtgccatgccatgtcgtttcgggcccccaaccgtggatgggccggtacatcgcgaaaggtttgcacgtgagatctactggaaagagccccatgcggggcgggggattccggaaggcagcggcgctcgccgtgggcttgccgctactcctcacctcgatggccatcactcccgccaccgcggcgccggccgggcaggacaaggcagtaacagccaaggagaatgcacccgccgacttcaaggatggacgctacatcgttgtcctggcgggcgcagcagcggccgcctacgagggcgggacacccggacttggtgcaaccaaacccggaaacgggcggaagctggacacaggcagccccaactacaaggcctacgacgcacacctccgcaagcagcagcgggaggtcgctgccagccagggggtgaccccgggaaagcagtacaccgctgcccttaatggcttcacagcagaacttaccgccgctcaggccatggagctgtccaaagacgatcgcgtgctggctgtagccccggacgtggagaatgccccggactacaccaccaccgacttcctcaagctgaccggccccgacggtgtctgggccacgcagttcggcggtgaatcgaacgccggcaagggcgtggttgtgggtgtcatcgactccggctacgccccggacaaccccttcctgcagggcgaaccggtccagccgctgaccggacctgcccaggtgggcattccctaccgcaccgcggagggccggatcgccatgctcaaggctgacggcaccaccttcgaaggtgaatgccaggaaggccagggaacgggggcctccttcgacggttcccagtgcaactccaaggtcatcggggccaggtacttcgccgataccttcatgcagtacgtggccccggagaaccgggcgcccgaggaactcatctcgcctgtcgacgtcggaagccacggaacacacaccgccaccacggccgccggcaacgccaacgtggagcaagtgatcgacggctcaagcttcggcaagagctccggcgttgcgcccgcagccaaggtctcggtgtacaaagtctgctgggaagacaccaacccggacaccggagggtgctactcctcggcgtccgttgaggcagtggaagccgccatcaaagacggcgtggacgtcctgaactactccatctcgggcaataacaacaacaccaccgaccctgtggccctggcgttcctcaacgccgcagccgcaggcgtgttcgtctccgcatcagccggcaactccgggcccaccgcgtccactgtcaaccacgcctcgccgtggctgaccacggttgccgcatcgacgttccccagtgacctgctgggcaccgtcaaggtctcggacggatcgctgtaccgcggagcctccatcatgaagtcggaagttgctgacaagcccgtagtggttgccgctgcggccgcagcggcgggagtaaccaatgccaacctgtgcggccccggcagcctggatgcggccaaggtggcaggcaaggttgtggtctgcgaccgcggcgtggtggacaggacggccaagagccaggaagtccaggacaagggcggcgtcggcatggtcctggtgaacctcaccagcagctccgaagatgccgacaaccacgtgctgcccaccgtgcacgtcaatgcgcccaagagcctcgaactgaagtcaaagctggaagcgaacccggccctgacagtcagcctggtcaagggcgacctgaccggtgaaccgccggccccggcgccgcagatcgccggcttctcttcccgcggtcccaccctcgccgccggcggagacctgctgaaaccggacatcgccgcaccaggcgtaaacgtcctggcgggtgtatccaccatcggcaacgacggcgaccagttcggcttcatgtcaggcacctccatggctgccccgcatattgccggattcggcgccctggtcctgagcaagcagccaacctggtctcccgccacggtcaagtcggccatgatgaccaccgcctacccgctggtcaacgccgatggttcgcccaacgccgatcccttccagggcggcgccggccacatcgactcaacccgcgtcctggatccgggcctggtctacaactcgggcatcaaggactggctcggcttcctcaacggccagggcgtggacaccggcgccccgcaggccggcaccatcgtcgcccgcgacttgaacctgccgtccgtcgcgcttggcagcctggtgggagaagtccaggtcaagcgccagctgaccgccctggttccgggcatgtaccggccggaggtcaacatgcccggcttcaacatccaggtggagccgaaatcactgaacttcgccaaggcaggacagacccgcgaggtcacgctgaccatcaggaactccagcgctccggtgggcaagttcagcacgggcaccctcacctggaagggcccccgcacggtcagcacgcccatcgccatccggcccgttgatgcacagatcgctccgtccttctccttcagctcggccacgggcagcgggagcggcacgatggaactggtgtcaggctcggacaaccccatcaacgtgggcgtggagggcctggcgccgctgagccagaccgccatcaccaagactcccggtgaatacgctccccggaatgacgaccacaacgcgctcctcaaagtgacggttccgcaaggagcatcatttgcccgcctgggtgtccaggcgcaatcggacgacgtcgactgggacatggtggtctacgcaccgaatggctcgggtggactgacagccacccaggtggcgacggcttccgccagtgagttcctgaacctggagtctccgcgtgcaggaacgtactacctcgcagtcaatctgtactccactccggacaacggacctgccagcgcctccgtccaggccgtgacgttcgcgggtgacgcaggcaacctcactgtggaaccgaacccgatcgtggctcctaacggaactgccacctcggccacggtgtcctgggcgggcctctccgagggtgcctacctgtcccggctcagcctgggcggcaacggcatcaggacctgggtcaacgtccaggtgggcgctgcgcctgttgcccctgccggggctccgcaggtggcgttcgcagacgccgtaccagcggcgtagcagcctgacgttatataagaacaggatcccgggcgtttcaaccgcccgggatcctgtcttttgcttaaccggccttacgtggtcccggaaactccgcccgcgctcccaagcaaagctgccatggcattccagcgcgagatttcgcagccatccgtgcgcgtgaacacggaatcaacggtgcgcccatgaaagatgcccgtgaccacggctacctggggcccgccgtactgctgggtgcacaaccggggtggtcccggcttgggaaagaagatgccctcgccgtacttttccaccgctgccagggccgcatcagggtccggcagggtggtggccggctgggcgcggccgccatcagccaccagccgaaagacatgttcgacggcggcgggatcttcccggagcctgacagtcaggtcgatcacgccggaaccattctggacagtgcgtccagttccacggccagcttctgccggagtgctgccgattcggcggcaaaggagcgctggtactccacatactcggccttgccctgcggcgtctcaatgggaattgcggggtagccccactcggcaagatcgtagggggaagcctgcatgtccatggcgcggatccgccaggacaactcgaagcagtccatcaccagttcgctgggcagggcagggagcagcttgtacgcccatttgtacagatccatgttggcgtggaggcagccgggctgttcgaggtggcgctggctctcgcggctcggcgctgactcattcagcgggacggcgtccggcgtatagaaacggaacgcgtcgaagtgggtgcaccggatcctgttgtcctccaccaccttgtccgtgccggctgatcccaaccgcagctgcagatactcgtggcgcaggtcgaacctgtcctggtggtacaccatggcccattcgtgcagcccgaagcagccaaattgggcagggcgtgctgcggttccgcgcaggatgatgcccgcaaaggcgactgcctccctgcggtcggcgagaaaggcgtcccggtcaaaggtgaccgccgtgctgccttccggcagtcccaggagggcaagctcgccgtcgtcgagctgccggtagtgcttccagccaaggcgcccggccgcttccccacccagcaggacgtgccccgcgccggggtgccaccggcgcagctggccaggtttctgggtgtagtaggtgaagaggaagtcctccaccggatgctttttgcctgccgacctgcgggccaggtaggggtccgcgtagcggctgacgcgcagttggtgtgccttctccagctcctgccattcgtccgccgcgaggagcctaggctccaccggcaacaccaagaacattccttgcagcatcccagctactgatttcacagccattggttcgcgagaaggcggcgtctacggggacgccgtccacaactcctgtcacggtggctttctgggggccgccccactgctgcgtgcaggcctgtgcggatcccgggttggcggggctgaggagcccagcgttttccttcaaggcggcgcaggccgcatcagcggagggatgcacgctctcggcggcggggacgccgtccgtgcagaccagggtgtagctggtctcgggttctccctcggaggtggtcacgatgatggacagttcggcattgccctggcctggtccggaaggtgccgccgaaggttccggggcgggggccgggacggaggtctcggcgtcggcggacgggctggcggatggactgtccgacgcggtggcggaggccgtgggagtcgcggaaggggtccctccgccctggtccggggagcatgccgggagcagcgttgccgccagcagcagggcgagcgccgtcttcctcatggactgtggcctgtccgtcatcccattattctactgccggttctggttctgtctcctgcccggaggtggccgcaatcagccccatcatggaggtgtgcaattcggcgacctgggcgcgggtcaatcccaggcgctccatcatggttcccgggactttgagggcctcctggcgaagcgcggcgccttctgcggtcaactcgacggcgagggcgcgctcgttcccgtccacccgccgtcgcgtaataagtccggcggcctcaagccggcggagcagcggcgaaatggtggccggttcctgggcaagggcatcgctgatgttccggacagtgcgcggactcgcttcccagaggcacagcatcaccaggtactgggggtgggtcaggttcagtctttcgaggacgggcttgtacgcacccacaacactgcgcgcagccaccgtcagggcgaagcacaattggtgctccaggagcaggtcctcgtcctgccccggctcggtgccggttgccgtctccatagctcctccaattgttagtgcactaactattagctacacttacagtagtaatcatgtcaggtaaggagccgggttcatgggcaagggcaactctgaaggcaaggaaaacgcctcgcagcgattcatgcgggcaaccggcaggctgcgggccatctttggtccggccaaccgctcgtccttggtccacgacatgacggaggaaaaccgcaggctgctggcgcagcgtgaggcggagacccagcagtgggagaccgttacccggcccgatggcagcacctacgtcgtacccaggaatccggaagacaagtcgctccgctgagcctgccaaagtgggcacgggcgggagccttttcctgtccgcgggcataaaataagggcactggctccagcgggaggcaggaactctttcccccggatagtcgggaagggggtggaaacagtgccgcatgtagtcaacaggttcatgggcctgaccgacaggctccggttcttctttgggccagccacgcggctggaccccgatacgccggtggtgcacaggcacgacgcttacgaacaggcctcggaagaggacctttcgcacttcgttgtggaaacagatgccgccggccatcactacgccgtacgccgcgaagacctcgaaaagcagggctgaacgggacccggccgctccggcaatcccgtcagcagaacgtaaaaagccgggcccctttccgaatggttcagaaaggggcccggcttttcgtgactggctagcggccggtgccgccgtacacggtggcttcgctttcgctgtccaggtcgaaggccttgtggatgacgcggacagcctcgtccagcaggtccgcgtgggtcaccacagagatgcggatctccgaggtggagatcatgttgatgttgattccggcgtcggacaacgctttgaagaacgttgctgacacacccgggtgggagcgcatgcccgcaccgatcagggacagcttgccgatctgctcgttgtactcgatgctctcgaacccgatctggtcctgtgccgcatgaagggccgccagcgcgtcggcgccctccacgatggggagcgtgaacgaaatgtcagtccgccccgtgccgtgggtggagacgttctgcacgatcatgtcgatgttcgagtgggcgtcggcgatgacctggaagatcgcggcggccttgccggggatgtccgggacgccaacaacggtgaccttggcttcggaacggtcgtgtgcaacgccggagatgattggctgctccaaggcaactccctcttgtgtggtgatcttgtcttcggcgctggggatgacccacgtgccttcgtgctggctgaacgaggaacggacgtgcagggggacgccgaacctgcgggcgtactccacgcagcgcaggtgcaggatcttggcccccgacgccgcgagctcaagcatttcctcgctggagatccgctcgatcttttgggcggagggaacaacgcggggatcggccgtgtaaatgccgtccacgtccgtgtagatctcgcagacgtccgcttccagcgcagcggccagggccacggcagtagtgtctgaaccgccccggcccagggtggtgatctcgttggtggcccggctcattccctggaagccggccacgattgcaatgttgcccttgtccagggcggtacggatccggtgggggtcgacgtcgatgatccgggccttgccgtggatgccgtcggtgatcatgccggcctgggaaccggtgaaggactgggcggaggcacccagcttgttgatggccatggccaggagtgccatggagatgcgttcacccgcggacagcaacatgtccatctcgcgggccggggcggagtccgtcacctgcccggcgaggtccaggagctcgtcagtggtatcacccatggccgagacgaccaccacaacttcgttgcccgcaatctgtgcgtccaccacgcgtttggctacccgcttgatgccgtccgcgtccgctacggaggatccgccgaacttctgcacgatgagctgctttgtcaccgcacggccggcgggcggctcttgctgctgcgttgcgttgtgcacttcggtagtgggcgtactcatgcgcgtaccttcacgaatcaattggagtccggccagacagccgtaacgctgtgctggccctgacgctgggaactaacgccatcgatggcgcgacttctcttcccagtttatcgccgcccgcagcccggggttgaattgtgaccattttcagccccggaatgcgccgctggtgggcgcgggtgcttgtaagtggccgagtctggagtcctggcagcgtggggcagaacttgtcgtggtgtggtgcgtcgacgttgcgcagtgcaaggtggtgcccggtcaggtcagggcgttgcggcggccctcgaatgcgcgtcccagggtgacctcgtccgcgtattccaggtctccgcccacggggagcccggaggcgaggcgggtcaccgtgatcccgatcgtcttcagcatgcgtgccaggtaggtggcggtggcctcgccctcaagattggggtccgtggcgatgatgacttcctggatggcgccgtcgttaagccgggtcagcagctcgcggatccggagctgttctggtccaacgcccgcgatgggattaatggcgccgcccagcacgtggtagcggccccggaacgaccgtgtccgctccacggccagcacatcctttgattcctccaccacgcagatcacggccggatcccggcgcggatcccggcaaatattgcagagttcctgctcggtgacgttgccgcagaccgagcagaacttgacccgttccttgacggtggtgatcgcctcaaccagccgtttcatgtcctgcgggtccgcctcaagaatgtggaacgcgagccgttgggcggacttgggacccacccccggaaggcgtccgagctcgtcaatcagctcctggacagcaccttcgtacacgtttccctctttagcttggtgtggtttgcgggtaaagcaatgacttgcaggggcgcaccccggctaaccggggccgcggtcagtaccgcggtgcgatggggcttccgtccggggaacgctcctcaatcagcttcccgcccagaatacgctccacggcggcacgcccgaacactccagactcttcgatcgtctcgtcgtcggcgctcgggatgtcatggacataggtggcagcagcggccactgccctggccggagccttggcgcgcccggcctcggcttctgggctgttggacaggcgctggtacagactctgccgtgcttctgctgcggcagcagaagacgactgcggagagtttgccggggccgtcttcgccggagcagccggagccgccgcagtggtcaccgaagccggcgaggctgctgctggagcctgccctatcggcgacgatgctgctggcgacgacgctgttggggcataggcagcgtgcgccggcgtggctgcagcagcggaggaggccgatgccatggcgtactcgggcgcgcgcacgtgctccggtgaaggcgactgtccgtcatcctgtccgctgccgggagccggggcagtaggcgccaggccccactccggtccagggctggagccggccttggtgaccgggatggagggcggcacctgggctgcagcaggttcgtagtgcggcgtcggagcaggcgggcttggtgcctcttcgggtccttccgcggaggcactcctgcccacgttgctttcctcgccgaccacccagaccccgggtgcctgttcgactgcacgggtccaaggatcgtggggacttccggcggtcgatgctggatcagcgtcagtctgggcgatgctgtgggcgcccgaaatggcgccgggaccggcgtctgagccggccggagcagaaccgaccagtgaggatccggccctgcctgaaacgccacccgtacctgcactgcttgaacctgcactgcttgaacctgcactgcttgaacccgcactgcctgaaaccgcgctgcttgaattggtgctgcttgaaccggtgccggccgatggtgccggcggccgggactgggcagaagggtcccagtccatgggaggttcttcttccagcgggggagcgtcctcgtccctggctggtccccagtcgtcgtcagaatatgagtagtcgcccgccggggcagcaggaaccggagcaggagaggcttttacaggggcaggggcgtgtccaggcgcctgcccgggggcggactgcccggctccgttctccgcaaactggctgacagggtgcgccgggacggccacctgatccgcagcgggctccggtgtggcggcgccggtactgccggcgttgtcccttgcagtcgcgccgcccgtgcgctgttgtgcgtcccgcgcagggggctgcggggccgcactgttcgcgctacccggacctggcaaaacaccctgctggttcacagcgctggcgcggcctgacgtctccggctgctggactgagtcgtcgggtgacggtgcaggggccaggccccaggcgacgtcagccgacgttgccggggccgcccgggtggcgggcacttttgggtttgggtcagagctcgcctgcgtgccgccgccggccgacgcagtgatctggcagtcgatgcccacggttttgtggatggcctgccgcaaattctctgaatggtctgcccggccgaaggcgccggcaagcccggttgtggtgaaggcaagggtcaggaggtggccgtcgaacgcggcaacctgggcgttgggttcgacgagggcccacgtgctgcgcttgattttggacagcgtttgcaggacatccggccaggcgcggcgcaagacctcaacatcgcccatggatcctgccgctgcggaggccgccggggcaggatccggagagggggaaggctgcggcccggaaaccggcaccggccggtcagccggctcgtgcatggcaccctggacagggccggaagccgccccggaattgccgccctgcgcctggccgggctcagcggacgcctgttgtgccgtggcggcgcggtgcacatcgccgccccgggcagtgggaggggtggatgatgacctgttccccgccgcatcttctacgggccagtcatcggtgctgacgcgcggcgcggtcagcgggccgcggggtgcaccagcgggggaggaggcatcctctgcccggccggcagcatgcgttaccggagcggctggtgctgccgaagctggccgggtggccgacgccgaagcaggaacgggcgtcgaaggcgaagccgccgccgcacccgcaggcgtgctcgaaccagcggacactgcaggcgatcgcggagcggcaggagcagcttggccgccgccagaagccgctgacgctgccggggccgcagaagatgcaggcagcgcttcctgggcgggggctggaagtgcccccgtttgaggcgccggggaaacatccgccgcagtgcggggcgcaccaggggtggcgggagcgccgacgtcgttcccggcgtaattcagccggcgttccacacggtctatacgtgcggccatgccgcgctcgttttgctcagaactgggcagcaggatcctggcgcacagcagctcaaggtgcagccgcggggaggtggcgccggtcatctcggtcagtgccgtgttggtgacgtctgctgcccgcgacagctcagccgcgcccaggttgtgggcctggttcttcagccgggcaatctggtccgcgggcatgccgcgaaggatggtctgggcgctttccggcatggcctggacaatgatgaggtcccggaagcgctccagcaggtcctcgacgaaccggcggggatcgtggccggtttggatgacccggtccacggcccggaagacggtggcggcatcggatgcggccacggcttcaaccacgtcatcgagcagcgaagcgtgggtgtagccgaggagggcgacggcaagttcgtagtccaggccgttcgggcctgcaccggccatcagttggtccaggacggagagcgagtcgcggacggatccgccgccggcgcggattaccagcgacaggacgcctggggccaccggaacgttctcctggttgcacagcagctccaggtaggccatcagcggctccggcggcaccagccggaaagggtagtggtgggtgcgggagcggatggtcccgatgaccttgtccggttccgtggtggcaaagatgaacttgatgtgttccggtggttcttcaacgatcttcagcagggcgttgaagccggctgacgtgaccatgtgggcctcgtcaatgatgaagatcttgtagcggtcacgcaccggggcgtaggtggcgcgctcgcggaggtccctggcatcgtccacaccaccgtggctcgcggcgtcgatctcgatgacatccagtgagcctgagccgccgcgggcaagctcaacgcagctggggcacgtgccgcaaggggtgtcagtggggccctgggcgcagttgaggcagcgcgccaggatccttgcggaggtggttttgccgcagccccttggccccgagaaaaggtaggcatggttgacccggtttttccgcaaagcggtcatcaacggctcggtgacatgttcctgcccgataacgtctgcgaaggagtccggacggtacctgcggtagagggcggtagtaactgtcacagagaaaaccctaccaatccgggccgacatcctgccgccctgtgggggaatagtaaagaccccccatgcacccgccagagcccatttacccttgctaccttccggtcctgggggagttcaacaggatgacgccacatgaggggccgtcagacactttacccgaacttgctgcccgactcgaatcggccgtccgtcaggcgccagccttccaccggccagctcatgaaggccggctcctcgtacggatgcgttgcccgcacggcggcgatgaccccacccagcagaggctcttcaaccacgcactcgatcctgtcctcggcggcttcttccggtatgccgactcgtccaaggtacggttctgagccgtcccgggaagtgaagcggcctgtccccggcgtgacgaaggaacagtgggagtacttgccgatcctgcctgctccggcgtcgccgatggctctgagtagtgcctcagtgtgagtacacgggacgtagatcaccagtgcgtgcagcccgttcatggctccatcctgccggaaccagatgggggaggtggacgaaagtcgttgcttatcccgccggtgcccctgatcatgggtatatacaccgattggggcaatctcaaggttgtgagctgtgtggcctggctgaacggggccggacccggcagctcaacggtgtccggggaatggacgcgttgggggcgtccatttcgtggttaaggagcatccacgcaggcgcgaagccgcccggccgggagcatctatggctgtacctccagccatgcagccggggccaattgggcgatgcggaaaagatcaggtaatctagtatctgcttttgattcagaagcagctggagaattcgcctagcggcctatggcgcacgcctggaacgcgtgttgggttaacgccctcgggggttcaaatcccccattctccgccggttagaacccggctccggcagacgccggggccgggttttttcgtttgtccgagttgcgtacgccggtcacgcgcctgcgcccggcaggcccagccggcgaagtcgttccctggcggccagttcgctgggacccctgcgccccaacgccaggcgaacgacgccgagaaccaacttggttgcgagcctcaccggcagcgtcacaggacccacccgtggcacagccagtcctagcatccggcggtaccttggctccaggctgtacaccgcacctgcaaacaggatccggtaacccggccggagcacccggttcaacggcgggttccggatgaactccaccgtctccgccacccgggcatcgacgcgaagctcaccgctctggtaccagcggtccagttgccggtgcatgtccgcctcgctcagcggtgggtcctccactcccatcagccggccggcctgggaccactcgcgaacataggcgtcggtgccgccgggtatggcgccgccccagatcttgtgggcggtcaggaacgcgtccgtgaacgcaaggtggatccagctggccagttccggatcattggcactgtagtcgcgctgcgttccgagattgtcgctgtaactgccctggactgcctcgtgcagccggcgcacccggcgtgaggcgttctccgcggcttcagtggaaccgtatgtcaccgtgaagatccagcggatggtgttcgccagcctgcccagcggatcctcgcggaagtttgaatgatcgtggacgccggcaagcgcgccggggtgaagggactgcatcaacagtgtgcggatcccggccacgatgggcgacatggaaccatgcaccgcccacaccgcggaaccgggcaggtggtagccagaatcgtcccccttagcgagatcgagctgccactgcggaacgccctcagagccgttactgaacgtgtggacaaggcgtttcttgatgggactcaggatgtttttcattgcacacgccctcctgcggcataccccgctcttgggctaatcgtaagcacaacccgggctctcgacgcgcgtgcacggacacctggtggcagcaaccgcacagcgggcatccacaaaaaaaccgcagtgtcccgcggcagggttcccagggtcccggcccgtatgttcccatgggagataccgtcatgacaggggcggccagtcacgtcctggagtcagtctcatgggcaatcacgcggtatccgggaaggacgccacaagccccaaagggtggtgcctgcccgctgtgcgtgctgtggcggccagcggggtgctggccatggccgtttgggctgtgaacccttccgccagcgcacctgaagcggggaccgttgcggcctccgttatccgttccggcgcaggcatgggtgccgtggggattccggttggttccagtaccggcaccagttcagaccggcacggcagcacggagtcgggcgccccgacgttggacggccttgttgccggcccactgaccgcggccatcctgagcgacccccaggttgagatcgccttcccgcgtccgttggtaagtggccacggagaggagaccccgtctgcccttcccgtggagctgacaggggtgggcaggccgccggcggggtaccttatggctcccctcaagcagttggctccctcgtcgcccttcggactgcgggtaagtccgctgtccggaacagcaggcgatttccacctcggccaggactatgcggctccctgcggcacccaggtcttcgcggctgactcgggagtggtccgcgccgcgggctggcatccctggggcggcggcaaccgggttgagattgatcacggtaacgggctcatcaccacgtacaaccacctggagtccatcgccgtccgcagtggggattccgtcaacgccgggcaagccgttgcgggggtgggctccaccggatggtcgacgggatgccacctgcacttcgagacaatcctcgacgggcaccacgtgagcccacagaagtggcgcctgatcccgctccggcccttcggcggcggaccggctgacctgcggtcatacctgccgggcactgacgccccgtccaccgggcccatacgctggaccatcccggtgggccagggcagcgagcctcctccggctccccgctgggtaaaagcgccttcgacggcggctgggtctccttctggggcagcatcatggctgtcgactctgaggcccgcggactccggaacgccgtcgccgactgcgtgggccgggtatggcacgccgacgcagaccgcgacggagaccgggactggtacgccgacgccgtcgccgtcgccaacggagactgagtcgggtacgccgacgccgtcgccaacggagactgagtcgggcacgccgtcgccgtccccgacggagactgagtcgggcacgcctacgccgtccccgacggagacggagacgggcacgcctacgccgtccccgacggagacgggcacgccgacgccgtcggagacaggcacaccgacgccgacggacactgtgcctccaccgactgagcccgtaccgactgagcccgagcccacgccggttgagcccgtaccgattgaacccgaacccacgccggttgaacctgcgccgatcgagcctgcacccacaccggttgagcctgcgccaattgaacctgcacccacaccggttgagcctgcaccggtcgtacctgcgccgatcgaacctgctcccacgccggtcgtacctgcgccggtcctacctgcacccccacccgttgagcctgcaccgattgagcccgcaccggcgcccactgcgacctactcaatagagccgagcccggcaccgattgagaccaccgaaccagagccactgccgaccggcacgtacgcgaccccggaaccctaagatccagccgtaagttcacccaggaaaatccaagcccggaccagtacagtggtccgccggtaacgaattccagacatgaacaaccttcggaggacgcagcctgtgacacccctgtacccgatcccactgaccatgaacgacggcaccgccactgatttcggcatgttcaagggaaaagtggtcatggtggtgaacgtagcctccaactgcgggttcacgccccagtacgcggggctggagacgctctacgaaaagttcagggaccgcgggttcgagatcctcggcgtcccgtgcaaccagttcgccgggcaggaacctggcagtgacagcgagatcgccgagttctgccagcggaacttcggggtgaccttcccgctgaccgtcaaggcggacgtccgcgggcggggccagcacccgctgtacgcggagctcaccaagttcaagacaggactgctgcccggattggtgaagtggaacttcgagaagttcctcatcagcagggaaggggaagtggtggggcgctttgcgccaacggtggaaccagactcggcggaggtgattgacgccatcgagaacgcccttggttaaaaaaccgctgctgcgccgaacgcagccacgcaaaagcgcagttctttcatctttttccacatcagccacggcgatttacccaaagtttgccaaatgtctgattggataaaccttactgaagggtacaagggaagcgccgtttcccaccgaccacagaggcagcaatggagcacatcgaggccgaacatccccggccacgccacttccttctccacctgagcgatccccacttgacgggaggcccggaccccctttacggcgtcgttgacagcgaagcccggctcactcagctctttgaagaggtcaaggcctccggagcgcggcccgaggccgtcatcttcacgggagaccttgccgacaagggcgatcctgaggcctacgtcaaactccgggccatcgttgaccccgcctgtgaagagcttggggccaaagttatttgggcgatgggcaaccacgacaaccgtgccaacttccggacgggcctgctggacgagcccgccgatgacgggcccgtggacaagagctacttcatcaacgggctccgcgtcatcaccatggacacgaccgtgccgggataccaccacggtgaactgagcacctcccagcttgagtggctcacacggcaactggacacgcccgcccctgacggcaccatcctggcgctgcaccacccgcccgttccgtcagtcctggatctctccgtcctggtggagctgcgggaccaggtttcgctggaggccgtggtccggaactcggatgtccgcaccatccttgccggccacctgcattattcgaccacggcgagctttgccggcatccccgtgtccgtggcctcagccagctgctacacccaggacctgaacgttccctttgggggcaccagggggcaggacagcggccagtcattcaacctggtccatgtctacgagcacacgatcgttcactctgtggttcccatgggacgttcgacgacagtgggcgagtacgtctccccggaagagacaaagcggcgcctggacgccgccggggtccggattccggaaagcgccaagcagcggggcagcgcgaagctcggactgcccaccagccgctagaagagtaggcaaaggtccgtgccgccagcggcacggacctttgtgttctggaccttgtttacggccaggtgtcttccgtcaggcctatttttcccagggcgccttgatggggaagtacttgtccaggaagtccgtgaccagtgcggcgcgctcgtcggccggcacttccgggaaactgccgtcgttcaggcagaagaagtccatgttccgcttggccagaagcttgggcaggtacttcagccccgtcttcatggtggtgtcaacgtagcggaccttcgctgccgtctgggttacggcgcgtccggtgagcagtgcgtagtagtggtagaacgagttggtgacggagatgttgtccgccgcccggaagcggctggcagccgtcttccggaattcttccgggaactcgcgctccatttttgccaccacgctgcggcgcagaggtgcagcacagtgctccaggtggcgggtggtgatccgcccgaaccggttccacagcagcttccggttaacgcgggctgcgttctcgaacccgctccgttcaaccgcgttctcacccaggccgatccgggtttccgcctcgacaaacttggtgatgccgccgggcgtgaaaaacaggtccgggctgatcggccggccgaagaacatgtcatcgttcgaatacaggaagtgctccgagaggccttcgatgttgtggagctggcactccacggcctgtgaattatgcgtgggaagcaccgaggggtccgagaagaactcttcactgcggacaacggtcacggagggatgatccgccagccactcaggagcgggtgaatccgtggcgatgaagatgcggcggatccagggggcgaacatgtacacggaccggagtgcatatttgagttcgttgatctgccggaaacgggcctcgtggtcgtcgccttcgccgaggacaacgtccttctgctgggcacgccgggcggcaatgtattcgggggagcttccgtccacccaggagaacaccaggtcgatgtcgaagctgatgtcgctggcgtggtcggcgaacatgttctcgatggtgggccaggtgtggccgtaccgctccacggttccgcggacggcatcctggcggagcagggtcctgcgcgtgagggagttctcgatcggcaggatgatttcattggccttgaaggaccacagctcaatctgcacaccggctgaagagccgaactcgaagccgccgttgggttccacgcggggccggtacaggcggaagatgcgcgcctgccggttggtggaaagctcgccgtccgcaaccagcagcgaggtcttcttcttggcatccaccgtcatggaatagaagggctcatcccggcaggcttccaccagggccgcccgcagtttcttccggtctttccagtccagggcaatgacgggccggtcattgttgccccggaccagcaggtacgccaggtccgcgttggccagcacgttgcgcacgaacaggaggtcctccaccatggcctggtaaggggtcctggtctggttgatcagcgcgatgcggcccttatgcgtgatgacatcagggcgggggttaagccgctgttcagcttcgggggaagtgatctccgcgtgaaattgttcctctacggatgcctggcctccgtagtagacctcgtcttgaaccggtgcttctgtaatggtcgtctccgtgctcgtcaaagtaagcgttcctacctgcatgatagccgggcggcttaaacagcaggtttcgggcagggtgcccggggccggggaaccggcttaggcgcccagcgcctcacgccagctgcgcaggaaagccccgccggcgtcgtcgtggataacggaagcctcaagccccaggtcctcggccgtcaggaccgggtacggtttctccgggatgccgtcggccgggcggacgtccacgtgtttcactgcgtggtcgttgtggtggagccagtcggccatggcgtagtcggtgcgcgaatcgcccactgtccgccaggctgccggggtgatgccctgcgcggccagcagttccactgcccggctggcgcccaggtccttcccaagccgtaccgactcgatgtccgtggagatgatggtgggatccacccggtagtccacttcgtcgtcggaattgggggcgtggtggtccagccggaccacgcccagcccgtggcgggccatcagttccatggcgtcggcgtcaaagagtttctgctctgcgaggtagtcggcactgggtacctcgatgtgctgctccacggacaccatggcgcgcttggtttcatcaaagaacatgtgctcggcatagtcctccgccaccatgcgccggatgtcgtccccgtaggctgccggcacggcgagctcccggtccacgtggacagggccgggtccggctgcggtgtagctgaaccagacggcgcccttttcgcagatggcgtggatgatggttcccgccgggattccggcggcgatcatgggctccatcacctgttcccggatgaaggcgtcggagcgcccggtgttgaaaacaacgggaatcccggcagcggcgagggccaccaggtcatcgatgatctcccgcttcacgtcgcgcgtcaccgggctcgccaccggcccgtccacatcgagcaggagtgccagcagcggcatggcaggtgcgtggattccgggtgcgggcacggcaggggactcggaggctgtcatgcctctattctgtcagttgaaccttcggcagagcccacggcggcctgtgccggcaaccggcggtggctgcaggcggcccatggtcactgtttggccacaacctgcgggaggaaccgccgggtactttcgctgggcccgcaggatgcctagtgtggcaaggtgatatttaaagctgtgggcgagggccgcccttaccccgaccatggttataccacgcccaaggaatgggcttcgctcccgccgcgtccggtccggctggacgagctggtgaccaccaagcgcacccttgacctggaagcgctgctggctgaagattccaccttcttcggtgaccttttcccgcacgtggtgcagtaccggggaaccctctacctggaggacgggctgcaccgcgccgtccgcaccgccctgcaccagcgcaccgcaatccacgcccgtgtcctggtgatagatggctaggaagcagcagaaggacgtgagcgtcctccacggccaccacgtagtcaccggtccggagctgcgtgccacttttggggccgcccaggccgacgaaacagcccgcgtgcgccggcgcgtgctgcacggggttgtcctggtcctacttgtgggcctcatcgcggcggccatcatcacggcgttggcgatcatcaacggccagctgaagatccccgcagcggatcccgcggaagaatccgtctccacctgccctgccgcaacgttcgactacaccccgaacgaccagatcaacctgaacgtctacaactccaccagcaggcccgggctggcacgttcagtggcggacgagttcctggcccggaagttcgtggtgggcgccgtgtccaacgtggacgccggctaccgcggcgccgctgccgtgatttcgggagcggccgggcagtctgccgcgttcagcgtccagcggaacctgccgggctcggactatttccaggacagccggacagacgggagcgtggacgtgatccttgcccaggactacaaggcgctgactacaccggagctggttgaccagacgccgggaaccctgagctgtccgcgggagagccgccgcatcgcggacgacgacaaatggcccgtccttccgtcggcggcgcccaccccgtgaacttccccgggtaaatcagccggccacagccggaaggggacttacccggacggggcggccgtcgtcgtcgaacctggcgccggcacccagctggatgaagcgcacggtcctggccacgcgtgcttccagctcggcgggctcgtcgctgcccctggccgcgctggaagacaacgtgcccaggatgagctgtgcctgctggttgatgtcagcggacggaaggtagccctgctccattccgtcccgcaggatgccctgcagcaggatgctaagctcgccaacatggtcggcgagtttggcaaaggacgacggcgacagcacggctcccatggcgggtcccgggggcagatggcggcggctgaggtcaactacctgggcgcggacgtacagggcgagccggtccacggggttgtccagccggcccagggagtcccgcagttcggagaggaacttttcggtctcatccagggcataggagattagcagctcctcgatgtccgcgtagtagttgtacacggccgtccggcccacgcctgcgtgccgggcaacgtccgtcatggtcaggccgggcaggccgtgggaaaagaggagttcgccgaaggcggtgaggatgcggcgctgggtgtccgctcgctgctcggcgttgctggccgctgaaatcctgggcatacagacactttaccgcgatgtgtcagtaaacaccctgaccacttcttgaggcgctctcctaggccgggcagccgtccggcccgcacgccccgccctccgcggagttgaccagcaccagcgggttggcttcctgccatgcctggtccagtgcagccgagaacgtctccgtgggctgggctcctgagaggccgaacttccggtcgatgacaaagaacgggacgccgctgatgcccagggaccgcccctcctggacgtcgaagcggacgttttccgcgtacttgtcggtagtgaacagctcgtccgcctcggcctggccgatgcccaggtccaccgccagggaggtcaggtactcgcggctgccgatgtccttgccatgctcgaagtgatcactgagcaggcgctctttggcggcgtcctgcctgccgtgcgctgcagcgaggtggatcaggcggtgcgccgtaaagctgttggccacaaccacggaatcgaagcggtagttcaggccttcacccctggcctcccgggctacatgatcgaacatctgtgaaacctgctgcgctggcatgcccttgcgggtgctgaggtagtccagttcggttccgtcgtagtgctcaggaagggcggggtcgagctgatagctccgccaggccacctccaccgcatcccggtgcggaaacgccgccagggcggcttcaaagcgtcgcttgccgatgtagcaccacgggcacgcgacgtcggaccagatctcaatcttcataccaccgacaacccggaggcgcgcggcggcattccggggggctctgttaggtacctcacggtagggcttgtgttgcggcccccgatagggcgatagtcggatcaaaggttaagcaaacgccctcggagatcttgttccgaatcgccatgcggactaaagaatgggtccgctggaagtgccaggacaactggggatcccggcctgtcgtcctcatggaggccaggaatgcgtataggacttgttgctggaccctggatcccgattccacctgtgacctacggggggatcgaacgggtcgtggacagcctggcccggggtttggcggccgcaggccatgaagtgctgctggcagcaccctcggagagtacgtgccctgtgccgatcgtgccgggaatgcgggcggcagccccgcacgacatgggttccacgacgtccgaactcagccacgtggtcagggcctacgaaggcctgggggacgttgacatcatccacgatcacacgatggcagggcccctgtacgtgcattcgccccggggaacgccggtggttaccaccatccatggcccgctgaacgcgaacgccgtggacatttaccgggccatcgcacggcgggcagccattattgcgatttcccgggaccaggcctcgcatgctcccgacgtgccggtcacccgggttatccatcacggcatggatgtctcccaggtgccggtgggcagcggcaccggcgggtacttgtgctttgtggggcggtcctgccctgacaaggggctgctggaggccatcatgattgcccgcgaggccggcctgcccttgcggatcgccgtgaagatgcgcgaacacgacgaggtccggtacttccacgaggtcattgagcctttgcttggacccaacgaggatttcgtgggggaagtggatgacgcgacgaagtaccggttgatgggcggagccctggccttcctgaaccccatccagtggtccgagccgttcgggctggtgatgatcgaggcgctggccaccggcactccggtcatcgggacaaggattggctccgccccggaaataatcgagcacggacgcacgggtttcctaggtaagaccggggacctggccggttttgtcggggccgccgccgggctgagcagggcagcctgccgcaaggctgtggtggaccgcttcagcgtcgagcgcatggtggaccagcacatccgcctttttatggaactgattgaaagcggaccggccggaggggttccgcatactgcgcacgtgcaccagaatctataagggccggcggtcctccagtccccggcagtatccctgaaggaaggagtccttccatgaccgcgtggaacgaagacaccgaggcaggcgctgccgagtccggttcggtgacggtactggagggatcctcgttctgcatttcagcagggaccggggacatcagttccgacggcggcacgaatggcgcgttcttccaggacacacgcatcatttcccactgggtgctgcgggttaacggctcgttgcgggagccgctctcggcccagcggcccaaacccttcgaggccacctttgttggcagggcgaagtggccggacgggcggttcgacagtcccctggtggtacggcaggtccgccatatcgggccgggcctacaggacgacatcacgctggaaaactactcggcggagcctgtggagtgcgaggtagagcttcttgtagccgccgaccaggccgacctgttcgacgtcaagggcgggcggattcccgctacccacgagaccacccggtctgtccgggacggccagctcgtcatcgaaaacgtccgtgacgggcagcagcggggaacagcggtccgcgcccgcggagcagatgtcagcctggacgggctgcgcttccgggcaagcatcccggcccgcggcaaatggaccacgagcgtcatcgtggtacccctgataaacggtcaggcgcccgccgaagctttcaccgagaccgggattccgcatcatcgggaaggcgtccgccggcaccgccactgggaacagaacgttccgctgattaccgttgcggacgccaacctgcaggtcacccttaaccgcagccaaagcgacctgggatcgctgcggatctttgatccccatcatcccgaacgggcggccgtggcagcaggtgcgccatggttcatggctctgttcggacgggactccatcctgtcctcctacatgagcctcatggttgatccgaaactggccgccggcaccctgcagaccctggcaggcctccaggggacaaaagtggaccttgactcggaggaggagcccggccggatcccgcacgaggtgcggcttggcgtgaccgcgggcctggcggtgggcggaaccgcctactacgggaccgcggacgcaaccccgctgttcgccgccctcgtgggcgagctcagccggtggggcctgtccaaggacgttgtccagccgttgctgccgcacgtggaccgcgcactggagtggatcgaccagtacggggaccgcgacggcgacggttttgtggagtatcttcggcccaacacccatggcctggtcaaccaggggtggaaggattcctgggacggcatcaacttcgcggacggaacaatggccgaggcgccgattgccctgtgcgaggtgcaggcttacgtctacggcgcctacgtgggcaggtccctgctggcccactgggatggcgaccgggacctggaaagccactgggccaaacgcgccgaggacttgaaagcggcgttcaacgagaagttctggctcccggagaagggctacttcgcggtggcgctggacaaggacaagcggccggtggacgcctgtacctcgaacatggggcactgcttgtggatgggcatcgtggacgaggacaaggcaccgtccgtcgtggagcacctgatgtcaccgcagatgttcacgggctgggggatccgcacgctgggctccgacatgggcgcctacaaccccgtcagttatcacaacggttccgtctggccccacgattcggccctggttgccaccgggctgatgcgctacgggttcgtggaggaggcccggctgcttgccaccggcatcctggacgccgccgaacacttcgacggccggctgccggagctcttctgcggctttgaccggggcgagtttgaggggcccgtgccttaccccacggcgtgctcgccccaggcttgggctgcggcagcgccgattcagctgatccgcgccctgctccggttcgaccctgtttatacccgcggagtagtccacctggcgcccatcctgcccgaggatatgggcgacttccaggccgcgaacgtactgctggacacctcccggatcaccatcagggcccacggaaccggcggcagcatcgacggactgccgccgggcctcaagatgctcgccgaaccccgtccgcacctggcctacccaccccaggcttatccggcctgaggcaccccgtaggggaggaccagggcgggggaggaccagtcagggaacggcgcgctccaacacgaagtcgtgttcaaccgcgctgcccagccggaacgacttggttcccaccttccggaacccggatttttcatagaaccggagggcccgggcgttctggctgttgactcccagccagacgccccgggcgccggcttccgccgctgcctggaggctggcgtgcatcagctcggcagccgcgcccagtccatggtgttccgggtgcacgtagcacttgctcagctccactgacggcacgattcccagcgccgaaacgacatccgggtcttctgccggccggttcaccagcaggctgtagccacgcagcccgccgttgccgtcgatcaccaggatggtggtgtccggatcggccaggtatgcccgaaagtgccgttcgctgagggtgttcgccaggtgcgcggcaatgtcatcaggtgacgccgacggcgggcacgccagcggaaaggtgacggccgccagcgcagccagcgcgccggcgtcgtccgctgctgccttgcggatggaagaggtcatgcagggattttacgtccctggcttccgggttactgctggaaggcggcgtcgaaggaggtgttcgacggcgggaagtcgaacttcttaagggcggcgagggcttcgggggcgccgtgcaggcggtccatgccggcgtcctcccactccacagagatggggccgtcgtagccgatcgcggacagcgcgcggaaggacgcttcccaggggacgtcgccgcgtccggcggagacgaagtcccagccgcggcgcggatcgccccagggcaggtgcgagcccatgacggtgttccggccggtctggcggatcttggtgtccttgcagtccacgtggtagatccggtccttgaagtcccaaatgaaggagacgggatcgatgccctgccacatcatgtgcgaggggtcccagttcaggccgaatgcttcgcggtggccgatcgcttcgagggtgcggacggtggtccagtagtcgtaggcgatttctgaggggtggacctcgtgggcgaagcggacgccgcattcgtcgaagacgtccaggatggggttccatcggtcggcgaagtcctggtagccggcgtcgatgaccttttccgggacgggcgggaacatggccacgtactgccagattgaggatccggtgaagccgacgacggtgtccacgccgagtgccttggcgagccgggcggtgtgctgcatttcctcggcggcgcggcggcggacgccttcggggtcgccgtcgccccagaccttggcccccacgatggcctggtggcggaagtcgatggggtcatcgcagacggcctggcctttgaggtggttggagatggcccagaccttgaggttgtacttctccagcagggcgagcttggactcgacgtagccgggctcgtcccagcgccaggcgtccaggtggtctccggagacagcgatttccaggccgtcgtagccccagccggaggcgagcctggcaacttcctcgaggggcaggtcggcccactggccggtgaacagggtaaacgggcggggcatgtcaggctcctttggtggcgggggctagctggatgaggctgctcttggaggcggcggactgttccacggcgtccaggatgcgctggacttccagcccgtcttcgaacgacggcgacggcgcggttcctgagctgaccgccagcaggaagtcgcggacctcatgcgtgaaggtgtgctcccagccgatgatgtggccctgcggccaccacgcatccaggtaggggtgctccggctcgctgaccaggatcctgcggaagccctgctcccgtgcgggggcggtggcgtccaggaactggagttcgttgaggttttccaagtcgaaccggagggctcccttgtcgccgaaaacctcgagctggagggagttcttccggccggtggccacccgggatgcctccactgaggcgatggccccggaggcgagggacagcgtagcccaggcggcgtcgtcgaccgttacgtcctccagcccgcttgcgggaccacccgtgccggggcggcggttcacgaaggtgtgcgtacggcccgagacttccgtgacgtggtccccaagcaggaacaggacctggtcgatggcgtgggaggcgatgtcgccgagcgcgccggagcccgcggtttccttcctcagccgccaggtcatgggcgcctggtcatccgcgagccagtcctgcaggtaggcggcgcggacgtgcctgactgttccgatcctgccctcggcgatgagctctttggccagggcgagggccgggacccggcggtagttgaagccgaccatcgactgcacgccccgggccctggcggcgccggcggcagcggtcatggcttcagcctctgccagggtgttggccagcggcttttccagcaggacgtgcttgccggcagccagggcggcgatggcgatttccgcgtgcatccagccgggtgcgcacacatcgatgatgtggatgtcgtcccggtccaggacagtccgccagtccgtggcggtctctgcccacccgtacttcgcggcggcctccgcaactgctgcggcatcccggcccaccaggaccttctgctcgaacgcggggacgtcgaagtagctggcgacgttccgccaggcattggagtgcgccttgcccataaaggcgtagccgatcatggccacgcctagcggcgcggcggtgcctgtgtccgggctcatgccgagtctccgagggtcagggtttccggtgcccagtcttcggggagggctgccgacgccggcgcggagcttaccacatccacgaacgttcccgaatccatggactccgagatggagaccatcgaatccagcacgtggtaggccaggtcaccggtggcacggtgcgggacaccggcgcggagcgaacgcgccatgtccaggacgcccatgccgcggccgttcgcgggacccgtggccgggatggtggtccagtcctcgtcgcctgcccgccagagcttgacgtcgccgtcgaagttgttggggtcgggcagggaaagagtggcctcggtgccggtgatctccacgaagcccatccgggtacgcggggactcgaaggagaagacgctgtgggaggatgctccgctttcgaactgggccatcgctgagacgtgggtggggacctccaccgtgaattcctcgccggccttggggccggaaccgatgacgcggacgtccttggccttggacccgacggcggccaccttccggatggagccgaatgcctggaccagggtggtgaggtagtaggggcccatgtcgaacagcgggcccgccccgtactggaacaggaacgcggggttggggtgccaggactccggtccgggcgtctggaatgtggtcatggccgccagcggggtgccgatgtcgccgcgctggatcaggcgcagagcggtctgcaggccggcgccgaggaaggtatcgggggcgcagcccaggcggatgcctgcggagtcagccgtcttgaggagccccaggcctgagtcgcggtcaagggagaacggcttctcggtccagacgtgcttgccggcgttgacggctgcggtggccacctccacgtgggctgccgggatggtcaggttgacgatgatttcgacgtcggggtggtgcagtgccttctccaccccgccccactcggcgattccgtattccttggcccgtgcctcggcggcctcctcgaagaggtccgcgatcacgtggaccttgaggtcagggaaagtggtgaggttgtccaggtactgcttgctgatgttgcccgcgccgatgacgccgacgccaaccgggcccttggccatggagggggtgctcatgcctgggctccttcggtgttggcggcggcgttgtttgcggtgctcccggcggcgttaaggaatgcgaggctctctgcgatgccctcgaagatgtccccggcgtagtcgtcgaattccaccacgcccacctccagggaggtggcggcggcgatcacgtcaaggaccggaacctggcccttgcctgcaggctgctgtgccttggtgtctgtgctgaggggcccgtccttgatgtggatcagcttcacccggtctccaagcttggtgaggatgtccacggggtcctgcccgccgacagccacccagtaggtgtccacttcaaggaccagctccggattgagcaggccggcgaagtattccagggcagtccggccgtcgatggtggactccagctcccattggtggttgtggtagccaacccggatgccgtactcggcgcccttcttagcggcctcattcaatgccgctgccgtggcctggatgtcctctgccgtctgccagcggtcggcggggatgaacgggtcgatcaccgtggtgatgccaaggtccctggccgccgcaaagatctggtcctggtcctggctgagcagcggcgcgtggcctgagggggcggtcagcccgttttccttcagggctgcaccgagttccttcgccgtggccacgaaattgtaaggctccacctgggtgaagccgatgtccgcgacccggcggatggtgcctggcagatcctcctggatggcgtcccgcagggtgtagagctgaagtgagtaggacaaagtgtctcccggttgcttggccacaatggcaagtgctgtgatgcaggtctacctgcaaagctaggatcacttttgccgaacgtcaagcaaaagttgctgccgtgacataaataagtagatctgctatccatgtcctatgaacaagaccaccgcccggcaggctcccgctgagccccaggcgttgccgggccgcgccggcgacatcttccagctgctgcgggacggcaaggcccgcacccgcgccgagctggccggaaccacgggcctggccaggtcaaccgttgcggcccggattgacgccctcatctcttccggactggtcggtccggccggtgaggcaacctccagcggcggcaggccgccgtcgcgctttgccttcaacccggccgcgcgggtggtactggcggtggacatcggagccacgcacgtggcgctggcagtcacggacctgggcggatccgtgcttgctgaacggcggatggaccagcaggtggcggacgggccggagaaggtgctgggactggtggtccgcgaggcagcgaaactgctggcgccggcatcccggggagtgccggaccttgcaggtgtggggatcgggcttccgggacccgtggagcatgacacggggcgcccggtaaaaccgcccatcatgcccggctgggacgggttcgatgtggtccggtttgtccagcgctcgctgccggtccccgtgctggtggacaatgacgtcaacatcatggccctgggtgaacgaaccgcccattggccggaccacgacaacttcatcttcgtaaaagtggccaccggcatcggtgcgggcatcatcagcagcggcgacctgcagcgcggcgccaacggcacagccggcgacctgggccatgtccgcgtcccccgcggggacgacgtcctgtgccgctgcggaaaccacggctgcctcgaagcactcgcctcaggacccgctatagccgcagccctgcgcagtgaggggctggaagcggcgaagggggcggacgtggtcagcctggtggcgcagggaaaccagcaggcaatccaggccttgcgccaggcaggccgggacgtgggcgatgtgctcgccaccgtggtgaacctcctgaacccgtcggtcatcgtgctcggaggaagcatcggagactcgggcgagcacctcgtggccggcgtccgggaggttgtctaccggcgctcgctgcccctggccacctcgcagctccggatcgggctgtcccatgcgggggacaaggccgccatcctcggcgccagccagctggtgacccagcatgtcctttccccggcggttatcgaggcaacccttgccggcaacgctatggcgggctgagagtcggctacggtgcgatggtccggatgggggcgccggccagccaggcggtgacgtcctcgaatgccccgccgtagaactggcggtagctttcccgcgtcacgtaaccaaggtgcggcgagagcacggtattgggagcggtgaggagcgggtgcccggcctgcagcggttcctggtcgaacacgtccagcgccgccccccggatccagccctcgctgagggccttgagcagtgcgtcctggttgaccagcgggccccgggcggtgttgaccaggatgccctcggggcccagcaggcgcagctcctgttcgcccacgatattttccgagcgtgcggagagcctcaggtggagtgtggcgacgtcggcctggcggaaaagttcgtccttggataccaggcgcgcaccagcctcctccgccgccccggccgtcaggttttggctccacgcgagcacctccatcccgaaggcctgcccgtaggcggcgatccggcgcccaatcttgccaagccccacaacaccgagggtttttcctgccagctcgaagcccaccgaggtctgccaggtgccggcccgcagggagttctcctcggccggcaggctcctggcgatggccagcaggagtgcccacgtcagctcgggggccgcgttgggagaacccggggtgccgcacacggtgatgccttgttcgacggcggcagcaacgtcgatggaagcattcgccatcccggtggtcaccagcagctggaggccggggagtttttcaagcacttcgcgcggaaaagcagtccgttcgcgcatggcaaccaccatcgtggcatccgccagcgcggccaccagggactcgggtgaggcgaaaggttcacggtaggtgacaacacttaccccttccgcctccagggctgcccagtccgcaaaaccatgggccacattctggtagtcatcaaggatggcgaggcggtgctgcatggcgttgtccttcgtcccggatctctctggcgtgaagttcatcgtaagccagcgggtcctgcggggacgcctggaaccgctgaaccgccggccgtgatagcaatgggagtgatgaaaccacccccagaccggtccccggccctgtgaacggccggatcctcgcccggattccctacagctggatcctgctggcctgcatcggcctgcttgcacttaaccttcggggcccgtttatagccgttgccccggtggtggacctgatgcaggccgagcttaacttctcgccggtgctgttggggctgctgacgagcataccggtcctctgcttctcccttgcggcgcccctggcatcactggcagccaggaagttcggcgccgagttcgcagtgacgctgaccatccttggagtgctggccggcgtcctggtccgttcctcgggagggcccgtcctggtgatggccggcacggtggcgatcggcctggccatcacggtgggcaacatcgcggtgcccctgatcatccgccgcgactttgcgcccgcccggcaggggaccgcgatgggcatctacacggctgccctcaacatcggttcgttcctgacgtcggtggtcaccgcaccgctggccagtgtggcggggtggaggttcgcgctgggctccgtggcggtcctggcggtggcggcggtagcgttctggatcctggcggtgggtccgcgaagcgcattcctcgtctcgcctgaaagcacagcggacagcagcctggcgccggtccggggctcgcgctggatcactgccgggctgacagcgggcttcgccgggcaggcgttttcctattacggggtgacggcgtggctgcccagctacctcaatgacgagctgggaatgtccgcctccgaggccggtgcggcttcctccatcttccagatcctcgccatcgtgggcggtctcggagtgccgtttgccgccaaatacatgagcatggcgtccctggcagtcaccctgggcgcgctgtggattaccgtgcccgccgggctgctgctggcccccggggcctggtggctgtggtccatagccggcggcatcgcccagggcggcggcatcaccgtcatcttcatcgccatcatccggctggcaagggaccaggcgtcggcaggacgcatgtccgccgttgtgcagggcgccggctatgccatcggagctgccgccccgccgctggtgggcttcatccacgacgtctcgggttcctggacccccgcactgctggtgatcctggcgtccgtgctgacgttctttaccagcactgccttctccgtgcggcaggtgccaaagggccgctgagccaggcgccgccgtcgtacgtcgttcccgccttccgacgctctctcacttgcggcaatttcctgcagcaagtgagagagcgtccgggggtgggatgttccgtcgccgggccggccctccggatttcggaggtgcctgttgcgaaagggcgtgcctgcccggcgaacggaattctggttacgcggcggcgagttcctcgaccgtggccttctcacgggcctcggtcaggtaccgcgcataggcgggcagggtgaggaaggacgggaagtcctgggccatggtgacctcttcgaagatgtcgcgggcgtcttcgaatcggtcgccgtcgaagcgttccagccgcgcgaattcctcgtccaggagctcctcgatccagtggtgggtgacgatttctccccggtccgtgatggcgctggcgaacatccactgccagagctgcgatcgggagatttccgcggtggcggcgtcctccatgaggttgtggatggccaccgcaccgttgccgcggagccaggactcgatgtagcggatgcccacttcgatgttgttccggatgccctgttcggtgatggtgcctgtcgtggcggcgacgttgatgagggcggcgtcgtcagggatcacgtcctcgcgggtgcggtccagctggttgggcttgctgcccaggatgctgtcgaacacttcgcggcacaccggcaccaggtccgggtgggcaacccaggagccgtcaaagccgtcgttggcctcgcgggtcttgtccgcacggaccttctccaaggcgttggtgttggcggcttcgtccttgcggttggggacagccgccgccatgccgccgatggccatggcgccgcgcttgtggcaggcgcggaccagctgttcggtgtaagcccgcatgaagggctgggtcatggtcacctggctgcggtccggcaggacgaagcggggtccgcgggtgcggaagttcttgatcagggagaagatgtagtcccagcggccggcgttgaggcccgcggcgtggtcccgcagttcgtagaggatctcctccatttcgaaagctgcggtgatggtttcgatcagcacggtggcgcggatggtgccttgcgggatgcccagcaggtcctgggccaggatgaagatgtcgttccacaggcgggcttcgaggtggttctcgatctttggcaggtagaagtacgggcctttgccctgggccaggaggcggcgggcgttgtggaagaagaacaggccgaagtccacgatgccgccggcgatgggttcgccgtcgatcagcatgtgcttctcgggcaggtgccagccgcgggggcggaccacgatggtgggcaggtcaccggccgggcgaagcttgtattccttgccctcgggggaggtgaagtcgatgcgccgctccagggcatcggtgaggttcagctggcccttgatgacattccgccacgtgggggtggaggagtcctccatgtccgcgagccacaccttggcccccgagttcagggcgttgatagtcatcttcttgtccaccgggccggtgatttccacgcggcggtcctccagccccggggccgggggagcgacacgccaggacggatcgttgcggatgtgttcggtttcccggaggaaccggggatcctgtccggcagcgatctcagcccgccgcgtccgccgtgcctgcagcagctcctgccgccgcgccgccgtcgtcctgtgcagcttggcaatgaaggccaaggcatccggggtgagcacttcgtcctgccggcaaatcggctgggcagtcatggtgattccattgatcgtgaagctgtcagtaaagctgttcatttcagtctcctggtgcagggcccaactgggtagcagtaagtgccgttttgagccttcaaaacgacacctactgctacttacttggggggaagaagttagtggaactggccctcttcggtggatcccacgagggcgagggtggatgcgttcgggttgagcgcagtggcgatgtcgtcgaagtagccggtgccgacttcgcgctggtgcttggttgcggtgtagccgcgggactcggaggcgaattccttctcctggagctcgacgtaggcgctcatgccttcccgggcgtagccgtgggcgaggtcgaacatcgagtagttcagggcgtggaagccggccagggtgatgaactggaacgtgaagcccatggcgccgagttcacgctggaacttggcgatggtggcgtcgtccaggtgcttgcgccagttgaacgacggcgagcagttgtaggagagcatctggtccgggaactcggccttgacggcttcggcgaacttgcgggccagctcgaggtccggggtgcctgtttccatccagatgaggtcggagtacggggcgtaggccttggcgcgggcgatgcagggttcgatgccgttgcggaccttgtagaagccttccgcggtacgttcaccggtgatgaattcctggtcgcgctcgtcgacgtcggaagtgatcagggtggctgcctcggcgtcggtacgggcgatgaccaccgacggggtgccggcgacatcggcggccaggcgcgcggcgttcagggtgcggacgtgctgctgggtgggaatgagcaccttgccgccgaggtggccgcacttcttctccgaagcgagctggtcctcccagtggacgcctgaggcgccggcctggatcatggacttcatcagctcatacgcgttcaggggtccgccgaagcctgcctcagcgtcggcgacaatcgggaccatccagtcctcgacggtctggatgccttcggagaattcgatctggtcggcgcggaggagggcgttgttgatgcggcggaccaccgtgggaacggagttggccgggtagagcgactggtccgggtaggtgtggccggaattgttggcgtcagcggcgacctgccagccggaaaggtagatggcgcggaggccggccttgacctgctgcacggcctggttgccggtgagggcgccgagggcgttggtgtagccgccggtcttgtgctcttcggtgagctgcttccacagcttctccgagccgcggcgggccagggtgtgctcttcggagacgcggccgcggaggcggacgacgtcggaagccttgtagtcccgggtcacaccttcccagcgggggttggcggcccactcgagctccagtgcggcggcctgctgttcgggcgtctggttgggctcaaatgctgcagtcatcgttgatctccttgattgagctccggaatcgataggcgggaaccgcgccgttgcggttcccgccggtctcccggtgcggtgtttctttccgtgatcactacttttccgcacttccaaagaggtttctaggtaaaaaaactggaaagaaatgcacttcttcacgtattctgcataaatgtcgccttcaagctggaaccgcaaagccgccgtcccgccgtcgtccgctgccgcccctgaactggacgtcatcagcttgggccgccgcgtgcgccacctgaggaaggcggcaggcctgacgctcgatgacctgagtgccgccgtcggcacggcgcccagccagctgagcctgatcgagaacggcaagcgtgaaccgaaactggggctgctgcagcagctggctgcggctctgaatgtgggcatcgaccagctcctcggggcggagccgcccagccgccgcgcagccctggaaatcgagctggaacggtaccagcggagtccgctctacgagtccctgaacctgcccaaaatccgcatcagctcgcggcttcccatggacgtgctggagtcgatggtggggttgcagcacgagcttgagcggaagctgaatgaacaggtggcaaccccggaggaagcccgccgtgccaatggcgagctgcgtgccatgatgcgggaacggaacaactattttccggagtacgaggcggaagcgcagaaggtcctggccagcgtgggccacaccaccgggccgctgtcccagcacgtcatcgcggatatcgccgcacatctcgggttcagcctccaccacgtgggcgacttgccgcattcaacgaggtccgtgaccgacctgaagaaccgcagaatttacctgacccagaaccagcggacggaccatgacccccgatcggtgctgctgcaggcgctgggccactacgtcttggggcaccagaccccgaaaaattatggcgacttcctgatgcagcgggtggccaccaactactttgccgcggcgctgatgctccccgagcaggccactgtggacttcctgcagagggcaaagcaggccaaggagattgctgtcgaggacatccgggacgcctttgccgtttcctacgaaaccgcggcgcaccggttcaccaacctggccacgcagcacctggacatccgcacgcacttccagaagacccaccagagcgggatcatctacaaggcttacgagaacgacggcgtgacgttcccgcaggaccataccggcgccatcgagggccagccgtcgtgcaagcagtggacgtcccgggtggtgttcgatgtggccgacaagttccgcgcgtacaaccagtacacggacaccccggccgggacgtactggtgcactgcccggacggagcgctcggccaacggcgaattctccctttccgtcggtgtcccctacgcgcacgtgaaatggttccgtggacgcgacaccaccgaacggtccaagtccacctgcccggatgagaactgctgcaagcggccgccggctgaactggccacggagtgggccggcaatgcgtggccgtccgcccgtgcccattcgcacctgctggccgcgatgccgcccggggcattccctggtgtggacgagaccgaggtgtacagcttcctgcaggcgcactcggggagctaatcccggttgcccaaacgtatggaaaaccggccggaatccgcatgctgaccgccgttgggcttttcctctggtcccaactgccggccaggcgtagagtccctccatggcactggatcctgttgaaacaaaccccggaaattatcggattgctttcgagaatgagcgcgtccgcgtgttggagtacacggacgaaccagggcatgcgacctccgagcacagccaccctgacagcgtgatgatcacgctgagctcgttccgccgccgtatctccaccaacgggagatccatggatgtggaacttccggccggagtggcccggtggctgcccgcgcagcaccattcgggcgaaaacacgggtgacacaggtacccacacgttcttcatcgagctgaaagaatcagcggaggttcgggcgggagcaacggatgaaccgctgggaccggccgactcctgaccaggcagccactacggcggttgcagcgcctttcgcgccgtccgaaactagcgggcgccgccctgccacagcgcatcaaacggggcgccggacgctacgcggttccggatccccgcggtgacaaaatccttggcagtgcgggctgcttcgagaggcgacgcgcccttggcgagttcggcggtcacggcggccgccagcgagcagccggcaccggaaacggccacctcgcccaccttgggcgcgctcaggacttccagggtttcgccgtcgtagaacacgtcgacggcgtccgggccttccagccgcaccccgcccttggcgagcacggctgcgccgctgagttcatggatgcggacggcggcggccttgagggactcgacgtcggtgatttccaggccggacagcgactcggcctcgaagtggttgggcgtgacgaaggtggccaggggcaggatctgtgccttgagtgcctggtccgtgtccagtgcgtgccccggctcctgccccttgcagatgaggaccggatccagaaccacattctggaatgagttttcaccaagcgcaccagccaccgtggcgatcgtggcggggctgcccagcattccgatcttgacggtatccagcaccggccggccgggcacggactccccgtccaaggccggaccgtacgccgccgtggtcgcctccaactggtccgagatgacctgctggtccaccgggacaaagcggtggttccagttgtcgttcgggttgaacgagacgatgcaggtcaggttggcgatgccaaagacgccgagctcctggaacgtcttcaggtcggcctgggcgccggcgccgccggtggcttcggaaccggcgatcgtcaggacgacggcgggggtgtcagcgggggactggacatcaatggaagcggaagtcatggcaccatcctgccatccggcgtcgaacacccgctttgtggtgctgtacagcatgtagccgtggtgctggtcagggttccaaggccgcggctagcggcggcgcggccggttcacgccctgcccctggcaatctgctgaagcgcacggcccagttccggctggctgtagacgaagcccgcgtccagcagcttctccggctggacccagcggctcttcaggaccagttccgtctctgtccggatcaatacggcaccgagccgcagcagccaagccggagtggcgatgccgaacctggccccgtatgcccggcggaccatgcgcatcagctcgcggttgtccaccacatccggcgacgcaacattcaccgggccggtgatgtccttccgggcatgcaggaaacggacacaccggtacagatcctccacatggatccagctgaacttctgtgtgcccggtcccatccagccgcccaaacccatccgggcaaggatggcgaagggccgcagtgctcctcctcccgggcccaggacgatggagatccgcaacgggaccttgcgtgtccccggggtaacagcggctgcaagttcggcttcccacgcgcgggcaacatccaccgaaaatcccgtgcccagttcgccgtcgcgttcggtttgcgggccatccatggcatggcggtagatggtgccggtgctcgcattgagccaggtcgacggcggctcccggcacagtgcgacggcacggccaagtgccgctgtagtggaaacgcgggactcccgtatggctgccttgttccgggcgctgtagcggcaggagacggagcgtccggcgaggttcacgagaagctccgcgccgtccagcacctgggccaggcgggcgtcgtcgtcatcccacgtggccgacggcgaacccttggcgcctctgcggccaatcgtgcgcacggtccagccgtccttctcgaaccggacccggaaatatctgccgatgaatccggaagctccggccagtaccaccgttctggtgccgctcattgtccccccaatgtgttgtttcggtatttagccgcggatgctgcggctcaggctcaggaagtcatccaggatcttgccgacccccgggatccgtgccagtgagagtcccctggtgaccagcgggacggcgccgtccaccagccgcctggtccgctgctgcccttcggagttgtcgtagacccagaagagggtgacagccatgtaacaaagccacagcagttccggaagatcggacctgagctttttcggtgccggcggtttcgcggccccaaccgccgtgcggaagatgtccagcgacgcttcgcgggccgccgtcgaccctgctgcgaagggatttaccggggacgtcgggcggatggcggtggctatgaagtcgccgccaaaccggtggtagggggccatggcatccaatcccgtgtggagggtggcccggagccgactggtgaggtcggtggcatccttgagtgcttcggcggccctggcagcgtgctccgcctgtacctgcagatacagctcctggaccaggtcatccttggacgcgaagtagtagtaggcattgcccaccgagatcccggcctcggccgcgatagcccgcatggtggtcttggcgaagccgatctcccggaacatgcgcagtgcgacgccagccaccagctggcgcgtctgctcgctctttacggtcatggacttacctcaaatttgaacgtgttcaagaaaagtaccacagatttgaacacgttcagattgggctcatcaggctaccgcacggcagccgctcccgcagtgggagaattgggggacagtgctaatacagccggccccgctctccgggtaccgagcgaaccactacgaacggacctccgcaatgacctcagcttcaggccaccacgccctgccccacacccctccggctccggaccgctcgcggttcgcctcgatcggatccccgtacttcggcatcatgctttcgatcatggcggttgtgctgatcctgtccaacatcggggcgtccaagggagtggccatcgggccgatcatcaccgacggcggcttcttcctcttcccgctggcgtacatcctgggcgacgtcatcagcgaggtctacggcttcaaagtggctcgcaaagccatcctcaccaccttcgggctgtccgtcttcgcatcgctctgctactgggcgatcattgcccttcccgggttcgatgacgagttcggaatctccaagcaggcggccctggagggcgcgctcggcccggttccgcagattgtgctggcgtcgctgctggccttcctggccgggcagaccatcaactcctggatcatggtgcggatgaaggcgcgctccggcgagaagtccctgtgggcccgcatcatgggttcctcagtggccggcgagttcgtggacacactgatcttctgcagcatcgccgcctcggtgatcggaataaccgatgccgcgacatttgtgaactacgtggtggtgggctttgtgtacaagaccctggtggagttcatcctggtcccggtgacgtcgctggtgatccggtgggtgaagaagcgcgaaccgagctacggggtcccgacggcagcggtgacgagcgccgcgtagccgccgcccggcgtcgtactttccacctgcagcgagatcgccggaaagttgcgggctcgccggaacgcaccggcgaactcgccccgttccggcgatttcggcgacttggttacgccgggacggctgccgggatgccccgggggtcagcccttgagcgtcccgtcgagcagggcccgcagttcccggaagtgccgttccgtcgcctcctcgtggaaggctgaggtgtcggccatggagtagccatgggatgcgccgctgtagacctggttggatgacgcaaggcccgccgcgtcgagggccttgcccagtcgggccacggcgtcgggcgccatgctctggtcatggtcggcgtggccgaacacgaaccgtgcctttgccctgcccagccccagatccgggctgtcgggctcgtctgttgcaagcccgccgccatggaatccgccacaggctgccaccgcttccgggtgtgccgtggcggtgcgcaccgccagcctggctcccatgcagtagccgaacgtgccgatgggacccggcgcaacgccgtcgagcgttccaagggccgcaacccacgcatctatgtccggcagcgccttgtctgtggtgaggcggcccacccggggaaaggccgccttgccggccgcctgcctgccctccggggtggtcatgtccccgcgcggtgccagctccgcggccgtcccttcgcggtagaagacgttcggtgccaggaccacatagccccagtcggcaacgcgctgggccatgtccccgatgcgcgggcgcaggccgaaggcgtccatgtacaggatgacgccggggaaggggccgccgccggtggacgggcgggccaccagggcctcggcagtgccttcagcagcagggatctggatcagcatcgggtcaggataccggaacagctgacgacggcggtcctccagcggcgtgcgccgcttggctgcgcgtgcggccgcttgcgtgcggccggctaagggccgccgggcaggctaggagtagtactgccccagggtctccgccttgaaatcgaagaaggtcccgtcctcgatggccaggcgggcgtcgtccaccatcttcaccacaaaccgttcgttgtggatggagatcagcgtggcggagagcatctcctttgacttgaagaggtggtggatgtaggcccgcgagtagttggtgcaggcgtagcagtcgcagccgtcctggagcgggccgaaatcgcgcttgtacttggcaccggagaggttgaagcgtccccgcggcgtgtagaaggcggagttgcgggccacccgggtgggggagacgcagtcgaaggtgtccgcgccgttctcgatggccgtgaagatatcgtccggttccgagatgcccagcaggtggcgcggcttgtcctcgggcagttcctcgttgcaccagcggacaatggtgcccaggttttccttctcaagtgccccgccgatgccgaacccgtcgaacggcatggcacccagatcccggcacgccttgcggcgcaggtcctcgtactgcgcgccctggatcacgccgaacagggcctggtacggcttgcccacccgggacgacgtcagccggaagtgctcctcgatgcaacgcaacgcccacaggcgggtgcgctcaagggattcctcctggtacctgcgcgagttctgcagggtggtcagctcatcgaaggcgaacatgatgtccgcgccgatctggtgctgcacctgcatggaaatttcgggggagaaccggtgccggtcaccattgaggtggctcttgaaccacacgccgtcgtcgtcaatgtgggccaggcgttcctttccgggggcgacggcgtcatccggcccggacgcatccacggctttcatgtcgatgaccttcttgaatcccgagcccaggctcatcacctggaatccgcccgagtccgtgaacgtgggcccggaccagttcatgaacgcgccaaggccgcctgcctcgtccaggatgtccgcgcccggctgcaggtacaggtggtacgcgttggccagcaccgcctgcgcgccgaggtccgccacggcctcgggcagcactgccttgacggtggctttggtcccgacggcgatgaacgctggggtctggatctcaccgtgcggcgtggagatggtgccggtccgtcccaggaactggccgccgttggaagccacctgggcagcggacggcggacagttctcactgagccgggtgcccacccggaaggagaattccgactgccggtccgcggcggcgccggccgcagtccacggggccgttccagtgagggccgtttcagccgtggcggcggcagggaagggagcaggggcagggttggctggcaccgtacaagtgtgccagcattctgccccgtcccggcaaccgcccggcaaccgggcctgcaaccgaggcggtcagctgaccggttcggttgaggggtagttctcagcccgccaggcatcccaggaggagcgtaccgattcgagcctggcggcgcccaggtcgtaggtggaggcgatgaccagggagccttcgccttcctcgcgcacgtccttgatggcgggatggtcggccaccaccaggagtccctccccatgctcggcatagttgtggacagtgaggcccacctggtggctggtccggtaccagaccttgccgctgatctcctcaccggtccccagcctcacctggtagttctggcccggcgccgggacgtcggtaagcccgagtttctcgatcgcggagccctccccttccgtgagatgcaggaagagggtgtggcgtttgccgtggggatggcgttccagggcgaaacggagctgctgcaggaacgtaagccagccctgggtgatgtcctcgtcccaggcagcccattcggaatcgtggtccagcgccccgcgggtcacgctgacctgcgttccgttaggcacgggcttcaactcaaagacgtccccgccatggacggtcaggctggtgtggtcaggcgactcctcaacatcgccggagaagtagatctccttgatctcggagtccaggtcctctgcctgccagccatgccattgggctactttggacggttcacgcagcatggtccagacctgcggcgcgtcggcgttgatcactacgctgagattgttcgtcatagccccgaatgtacaactccggcacggcgccgggtaggggcaattttcccaaccgggcgccgtgcccaaaagtcaggcaccctcaggcgcggacggcctcaagctcgttgctgatgcgccgctccagctcgaccatcccgatggtttcggagccgccgtgggcacgcaggaacagcagggactccagccgcagcagccgccattcacgctcggcgtcatggttggagttgtcgatggagcggaaaatttccttgtcgtacaggttgggctcattgagcgagcgctgccgtaccttggcagccatcctggccttgaatgggtccgtttcctggttttccggggtccggatcagcttctcgtatacctcggcccgttccggctggccgttctggcggcagatgtagctggagagcgccagggatgcttccacggatgcccaccggccggggttcccgtcgaaggggaggacgttgaggaggtcggccacggccagcgagccctcggcgtccttgagcgtgatgaagagctcgtgggcgaggtcgctcaggtccttcaggcagctgccggacttgaagttgacacccttggccagccggtcggacagcaacaggacgcccatcgcatcgggatgtgcctccgccgcaccttccacaacggactccggggtaccctgcggcgctggaatcagggccaggtcctcttcgctgggtccgctgagggccggcggtaccggaggaaggggaggcacgacgacggctggagcgggggcagcgggcgccggctcttcgcggagctgcctgggctgctcctgccctgcgttttgccctgcctcaggcgctgggcgggccgcccgcggaagctgggtgacggcgtcggggtttccgtccaccacggtcacggtggtgcccaccgcgatgcgcagggttccgccgccggtaaggctggcgagcaccagcgcgggtgctccaaagtcgtcccgctccagctccacctgatggacttctgccgtccgctcgccgtcgggcaggacaatgtgggtgccggtggtcagagatccagcctgctgttcaagatggtgcctggcggctggtgtttcggtcatgggagtccttaggttctcttgcggtccgccctacagtctacaaagacgcgcacctaaaatcggggacccccaggttccggcgtgatgtcagaagccaacaccggcgaaggccagcgcctggcggatgaggctgccgcggccgccgacgaactccatttggacgccggggctgaggacttcctcaggggtcatccaggtcaattcgagggcgtcctggcggggctcgcattcacccgtaaccgggatgacgtaagccagggccacggcgtgttgccgctcgtccgtgaagccggtctgggacggcgcagggaagtattccgccacggtgaaggggacagggctgatgggaagttgcgggaacgccagcggtcccaggtccttttccatatgccgcagcagggcagcgcggatggtttcgcggtaaatgacgcggcccgagaccagggaccggaccatggtcccgtcctcgtcagcctggagcagggttcccacctcgttgacgaagcccagcgggtccagcctgaccggcacagcctccacgtagaccatgggcagccgcccgcgtgcctcaaagaggtcttcttcggagagccagccgggattcgggtcaggggtgcgcacgttcatggttaagttctaccccatgggacgctgcgtgacgggtgggactcagctgccggcggaatgcgtcggttcttcctctcacgcgtggcgctgggagatccagagcgtcgccggcacatgcgcagctgctccagccccggcatcggggttggcaacgtggagggtgcgcgcgaaggcttcctccgtgatgctggcctggatacccgctgaggcgaggcgttcccgcaaaggctccagcccgccgtcgtactcaaaacccaggccggaacgcggtgctcccgaggccggccggaccatcaggaccccgccgttctttgcggtgaagtcggcggtgtcgtcctggtccggtaccgggcgcggccgcgcgcccacctgctgcagggtgcgggaggcggacgcgggatcctccgtgaaccagaccccgacgacggccagggcaggatcggcgtcggcgcaccgggcgttgtgggcggctttgtccgcaaggaagctgaaaccgtcgggcgccgtgatccggcaggcgtcgccatggtccgcggcgacgagctctgcgggtgtggttccgtcttccccagcagccaggttggtgcggcgggcgaactccgacaggtctcccacctccactgccagcgcggtgctgccgtcctctgcggccccctcggggacggcgtggagggccaggcgtcccagcccggcgtcgaaaacctgccagccggcgtcgttctcggtccggaccatgcccagggcggtgaggagcctgtcccaggaatccagcctggacgtgaagtgaagggggcgcacacggagcattttggtttccttaatcctcggtatccagggacctctaggcccatgatgccacggcgccggcgcttgtggagaggggctgccgtggtgccgtgatgcgggggcagaatagggccatgaccgttgaacttgaggagctgctgctgccggacgcggcggcgtggcgcagctggctggaggcacaccacagcaccagcccgggggtgtggctggtcctgcacaagaagggcggaaacgtcacggaactggattacgccgcggcgctggacgaggccctgtgctttggctggatcgatggccaggcgcgccgccgcgatgaacagacgtccttccagcggatgacgccccgccgaccccggagcccatggtctgccaggaacgtcggccatgtggcgcggctggacgcggcaggccggatgaccgatgccggacgggccgcggtgaatgcggcgaaggccgacggccgctgggacaacgcttacggcggccaggcggtggctgaggttccacctgatctggcggcggccatcgccgcgcttcccgccgcccaggcgatgttcgatgtcctcacggggacaaaccggttcgcgatgatctaccgggtcaactccgccgtccggcctgccacccgcgaaaagaggatcgccgaattcgtggagatgctggcgcgcggagaatccctgtatccgcagaagaagcgccccggcggcgtgacctgaccgcacgggcagtggatccgggaatccgcgcccggttgggttcctgccggcatacctgtaaaattgacggttcacttgcgctggtgccgttcccctcctggggagcggcacttgtgcgttcagcgacggatcgaaaacatgccccgaaaaatcctcggacccgtaccccctgccctcaaacaccggcccctgacctgggtggttgccgccctggccgctgccctggtcctggtagtttccctggtgctcgccggcaacgtccggacggggccagccgccgttgccggccgtgttttggacggtgttgcgtcggcgcaggcaacggccagggatgccacgggcagctacgcgacgctgtggctggagggcggcgacaccacgctcgtggaccgtgggggcgcgctcgatgctgagggtgcggaggatgtgcggagcattgaatgcggcgcgggctggctggccggagcccgcgtggacggcaaggttttcctgcgaagcagcgcctccctggacacggttgaggatgctgcggcggcgcgtcttccggagtgcatcagcgccgaggcgcgcgatgccctgctggctgacctcggcgtggacaggacgtggccggagccagtcggggaccgcttcgaaccgccggcgggggagtaccgcccggcctaccacctcaccccggaccagcgctggatgaacgatccccagaagcccttcttcctggacggccagtggcactactactatctgtacaacgccgactacccggaagggaacggcaccgagtggttccacgccaccagcaccgacctggtcaactggaaaaacgagggcgtggccattgagaagttccgcaacgggctcggcgacatcgagaccggcacagcggtggtggatacggagggcaccgcaggattcggcaagggagccgtgatcgcggtgctcacccagcagcatgacggtgtccagcggcagtcgctgttctactccacggacaacggctacagcttccagaactacaatcagaatccggtgatggacaacccgggcgaagaacactggcgtgatccccgaattgtccgcgacgacgccaacaaccagtggctgatgctgctggccgaaggccacaagatcggcttctacacgtccccggacctcaaggactggacctatgtttccgcttttgagcgcgacgggctgggaatccttgagtgcccggactttttccagctggacgtcgacggcgacccgtccaagcgcacgtgggtgctggccgccagtgccaacgggtccggggaagggcgcgccacggggctggcgtactggaccggaagctgggacggaaaaacgttcgcgccggacgccggagaccaccagtggctggacggcggaacggacttctacgccgccgtcacttgggatgacccgcgcctcacggacggccagcggaaggcttcgcggcacgccattggctggatgaacaactgggcgtacgcccgggaattgcccaccggggagtggtttggagcggcctccgtggtgcgtgacatccggctggtgtccgacggcggacgtccggttttggtctcggcgcccacccctgcgctggagtccctggagggcgatccggtccagatccccgcgggcaccgtccaggaaggcgcggggcaggagttgccggttccggacagcggcgcgtacaaggtggacctggaaattgaaaagcccgcatccggcagcggtgaagcgcgcgtcctcctgcaaagcggcggcaaggcctacgccacggtgggttacgactttgggaccgggcaggcctttgtggtccgggacggggattcggtggcacaagctgccggaggcccggcggaggggtaccggacggtgagctcggcgagaggcaacaccgatggggacacggttcagctgaccgcctatattgaccgctcttccgtggaagtcttcgtggacggcggccgcgggaccctgacctcgctggtcttcccgccgcagggaactaaggacgtccggcttgcggcctcgggtggtgccgtcagcattaggagcggcaccgtcacgccgcttgccgccatccgctgagccggacgtcccgtggcgaacgtgcgcctgtgcgcgggcccgccgtgcaggaaacgaggctgttcaggactcgagcctctttaggactcgagcgggaacgccacgccttcgcccaccacacgaaggcacagctccatgcccggccgggcgatggaggcgttccagtggcggatggtgataatttcgccgccgccggggtagcggtggtcggggctggcggctagctgcggcgggaccgagagcttcagccggacggtggtttccgggccaaagtagtccgtgtccaccaccaccccgcggatggctgcatcctcggcgatccggatctgctccggcctcagcatcagctgcacgcggccctgcgccggcggcctgcggacggggatggcccccagagagcaggtggccagcgacccctcaagccaggcatccaggatgacggcgtctccgaggaactccgccgtggcacggtctgcggggcgggtgtacaccacgaacgggttgccgatctgggcgagcttgccaccgcgcataacggccacctggtccgcgaaggacagtgcctcggcctggtcgtgggtgaccaggatggtggtgacccctgcctcgttcaggaccttggctacggcacggcgggtagccaccctgagccccgcatccagtgcggagaaaggttcatcaaggagcatcagttccggctcgcgcgccagggcccgcgccagggcaacccgctgctgctggccgccggagagctggtgcgggcggcgcttggccatggccgggtccagggacaccatctccagcagttcgctgatccggccggccactgcccgccggccgcccggcaggcggtcctggtccagcccgaacgcgatgttctgccccacgctcaggtgcgggaacagggctccgtcctgtgccacgtacccaatgtgccgtttgtgcgccggcacccacacgccgtcgcccgccaccttggcgccgttcagcgcaatgctgcccgtgtccggatgctcaaacccggcaatcagccgcagcagggtggtcttgcccgacccagagggtcccacaatggctgtggttccgccccgggccacggaaaggttgacgcccttcaggacggcctggttgccaaagttcttggtgacgtcggtgatctccaggtggctgttcgtggtgggtgccacggacggggccacccgcggctccggcaacctggaaggggcttgttctgtcactgtccggctactttcttggactgctggaagaggaggtacgtcatgggcgcggagagcaggatcatcaacagcgcatacggcgcggcgccggcgtagtcgatttcgctgctcttgctccagaattcggtggcaagggtgcgcgttccgttgggggacagcagcagggtggcggtgagttcgttggcgatggccaggaacaccagcgccgcgccgcccgccgctgccggcgccgtaagccgcagggtgaccctgatgaaggacaccagcggcggcttgcccagtgcctgcgccgcttcgtccagttccttgggtgcctgtgccaggccggcccggaggttgaccagggcgcggggcaggaacagcagcacgtaggccgccaccagcactcctgcggtctggtagatcccggggaccacccggatgctcaccgtgacgaaagccaggcccaccacgattccgggcagcgagctggtgatgtaattggagagttccagcgacttgctgaaccagccgggatggcggacagcaagataggccatggggaacgccaccacggtggtggcaagggcgcccaaaaggccgtagccgagcgttgtgagcagcgccggaaggaactcgtccgcagcccaggctgccgttccgccggaagccacccagcgcagcacaaagaacaggggcaggccgaaagccagtgccgtgagcgccagcaggaacagctgggccggaagctggtacacgtgcagcggcaggcgcagcgccttggcctgcgccccggggccgatgcgtgcataccgtgcagtaccgcggctccggacctcggccagcagcaggaggaggcagaaaaacaccagcacgctggcgagcatattccctgccgccccgttgaatgtcgactggtactggaccatgatcgccgtggtgaaggtatcgaaacggatcatggcgaacgccccgtactcggccagcaggtgcagtgccaccaggagcgcgccgccggtcatggcaatgcggagctgggggaggaccacgcggaagaaagtacgccaggcgccgaggcccagtgcagccgcggactgctcaatggccgggtccagccggctgagggcggcggcggcgggaatgtagaccagcgggaagtaggagagggtggcaatcaggactccggagcccagaccgcccagggaaggaatggcggaaacccaggcgtaactgttgacgaacgccgggatggccagcggcgcagccagcagcacggcccagacccgcgcgccccgcaatgttgtgcgttccacgagccaggcgccggcaactcccaggaccaggcacagcgggacggtgaagaccatgagcaggacggtgttcagcagcagttcggccacgcgcggccggaagatgagttcggcggcggtgtcccagcccgttgccacggtcatgtagaccacgtagccaagcgggacgaccgaaaacagggcaatcagcaccgccagggcggacaccgcagaaacgccgaaaggcgggcgggggctgttgccccggcccgccgtcgtcgtgctcccccgtgggggagccgatagatcaggagtcacgaaatcagaggagtcctgccgaggtcatcagttcggtgaccttctccgagttcagcttggcgggatccacggtgggggcctgcagatctgcgatgggaacgagcttctcgttcgcggggacgtcggaggcgatggcgtactcgaaggaggtgccgtccttcaggatttcctggcccttggtgccggtgacgtacttcaggaactcctgggcagcttcctggttcttggaggtcttcagcacaccgccgccggatacggacacgaacgcgcccggatcctggttcttgaagtagtacggggtgacgttattggagttctcgccggtcttggcctggtcgccgtagtagtagtagtggtagatcagcgcggcatcgacttcgccggcgttgactgccttcatggcggtactgttgcccttgtaggccttgaagttgtccttcatgcccttgagccattcctccgtggcggcctcgcccttgagttccaggagcgccgagacaatggcctggaagtcggcgccggacggggaagcagcccacttgcccttccactccgggttggccaggtccagcatggacgtgggcagctggtcttcggtcagcttgttcttgtcgtacaccaggacggtggagcgggcagcaatgccggtccacttgccggtggacggacggaactcttcaggcacctgcgcgatggtggcttcgtccacgtccgcaaacaggccggcgttctccacctgggtcatggccggggagttctccgtcaggaacacatcagccggggatgctgagccttcctggatgatctggttggaaagctcggtgtccgagccctggcgcatggtcaccttgatgccggtctcggcggtgaagccgtcgatccattccttggtcaggctctcgtgctgggcgttgtacacggtgatttcgccgttgccggcaccagcggaggcgtcggacgaacctgtggctgcgggggtggtgctgccgccgcaggcggtcagtccaagtgctgcggtggcggcgagtgcgatgcctgccagggcgctgttgcggatcttcatggagggactgctttctggggaaacgtcgggcggacggggtcctgttgggcgtcggggaaggatgcccacgcttggaactgtagggtaggcaaacctaagcaacaaaccagaaagcgctttaagtgacgagggtcacaacaattacaaaactattgcgtgccctaattgcctgcgttgccggggagggttgccgcggcctccaggaccatccacgcctgcagctgggtggaaagttcgacggcggctcccggcgggtatgtttcgcccgccggtttcacggcatgctgggagaagacgacggcgccgcggtacgtctccgcagcctcgccggcctgcatggtgcgcttcccggaccagaaggcctcagccgttgctgccaccagccgggcggcggtggcgcgggtctgcgcgggaagccggccgtcggcagcggcgagggcaaggtagcggcacaggatgccggtgaacaggccgccgtcgcccggtccctcgcagcgcagcacccggcccccgctgctggtctcagtgccggtagcggatcggaccgtaagcagccggtccaccgcgtccaccaccacggctgccctggcaaggtctgcttccccgcccatttccaggagggcgcccagcaccgggccctggttgtaggtgtagaccgcgcgttccaccagcacttccccggccgggccaagccgtgcgccgtccaggtacaggccctggtccgggtcgaaaagggtggcatccagccagtccagcagggccctggctttctgcgggtggccggtccgggcaaagtggagcgctatgggcgccgaggccggggtgttcttgaaatcccgtttcttgctccagaaggcaccgccgttcaggtcatccgtgcaggcggcctcgaactgcagggtgagggacctgcggacgcgggcgttgcgccggcggccgcgcctgcgtgcctccccggcgagggcgtcgagccggtgggtggcgagcgcaagccaggccatgtcgtcgtaatagttgttgacgaaggtaaaggcgttgcgcaggcggatcccggtaaccagccgggatgccaggcgcccggcgctggggtggccggggccgttgaacctggcggccggcgtggcgccgctgcccagttcccgccgccctgcatccaccaggcagtcaatatagtgtgcctgccaccagtaatgccaggggcctgcgagtactcccttggggtccctgcgccacgcgggggaaggccacgtcacggcacccaggtgggtgcccggcaggaagaacagcctccggccgaagagggcggtcaccgactgtgcggcctggttggctctggcgtcccagcggaacgggtcctggcgggcgggggcggggtccaggcgggtcatgctttccaccctaacgcgcgttccccggccggtccggactggccgttggtgcaggccctccgtatttcagttaacattcactaactaacacctggcggcccgcagccgctgcggacccgcatcaaggaggatgtatggacgtcaaaggcgctgttgcactggtgaccgggggagcctccggcttgggggcggctactgcccggcggctgttccgcgacggcgcctccgtggtgctggttgacctcccgtcttccggcggcgcggccctggcggaagagctcaatgcgtcccgggctgcggggccgtctgccgtcttttgccccgcagacgtgacgaacgaacgcgaggtgcaggccgccgtcgacaccgcagtcagcctggggcagctgcgcattgtggtgaactgcgccgggatcgccacccccggaaaggtcctgggcagggacggcgtgcttccgctcgaggcgttcaaccgcgtcatccaggtgaacctggtcggcaccttcaacgtcctgcggctggcggcggcggcgatggtggcgacgcagccggccgtcacggaactgggcggcccggaacgcggcgtgatcatcaacaccgcctccgttgccgcctttgaaggccagatcggccagcccgcctacgctgcctccaagggtgccgtggcggccatgaccctgccggctgcccgggagctggcacgctcgctggtccgcgtggtcaccatcgcgccaggcatctttgagacgccgatgatggcggggctgccgcaggacgcccaggattccctgggcgcgcaggtgccgcatccctcccgcctgggcagacccggcgaatacgccgccctcgtggcgcacatcgtggacaacgccatgctgaacggagagaccatccgcctggatggggccatccggatgggaccgaaatgactggtgctgacatggcggggaccgaggcagcgctggacagcatgccggacctgccctccgcggacttcttcgactttgaatccctgctggaccggaaggaacgggacaagctggccgagctgcgggagttcctggcggcggagatcgccccgtatgcgggggactggtggaacaaggccgagtttccggcgcatatcctgcccaaactggctgcactggagctgagtactccggctgagcgcggctacagccatctgttcgccggcctggtgatcgccgagatgacgcgcgtggacacgtcgatcgccacgttctttatggtccaccacgacctgttcgtccagtcgctctacgacttcggcagtgaggaccagaagcagcggctgctggccgacgcctcaagcctgcgcatcaccggtgcgtttgccctcaccgaaccgaatcacggttcggacgttgccggggggatggagacgcgggcgcggcggatctcctcggccaccggagatccggacgacggcggcgaagcctgggtgctgaacggggcaaagcgctggatcggcaacgggacgttctgcgactacatgctggtgtgggcccgcgacgaggcggacgggtccgtgcgcgggttcattgtggacgccacgctgcccggcgtcagccggacccggatcgaaaacaagatcgcgctgcggacggtgcagaacgcggatattgtcctggcggatgtgcgcgtggccgaggccgaccggttcgcgaatatcagcagtttcgcggacaccagggagctgttgcggggttcgcggatcatggtggcctggcaggccgtgggccagcagcttgccgccttcgacgtcgcccggcagtacgccgtggagcggcggcagttcggccggccgctggcccggttccagctcatccagcagcagctggtgaccatgctgggcaatgccgtggcgggcatggggatgatggccggactggcacggctgcaggatgagggcgccgcggacatgccgcaggtggcactcgcgaagtcgtacgtaagcgcacggatgcgggagacggtggccctgggccggtccatcttgggcggcaacggcattgtcaccgactaccggatggccaagatcttttccgacgccgaagccatttatacgtacgaagggtctttcgagatcaacaccctgatcgcgggccgggccgtcaccggaatgtcagccatcacctgacctagccaatcagctcaatcaggggcgggcagcttctcgcccgcctccacgcgcacgtccagtgagttgttcctcaccggcatggggcacgtgccgtagggggtgaacgcgctggggtagttgatggcgcggttgaaatccaggaccacggaatggtccggccgcgggcggggcacggagagcttccgccagacatccgtggtgtccccgttggtctcgtcatggaacgtgacggtcagtgctccgagcttctcctcttccgcctgcagccggaactcgtggccgctgccggggacccggaacaccacctcacccacgctccggtggacgccgtccaccaaggggttggcggtggcgatgggcacgtccacgggctcgggatacggctcgaaccggcccgccacttcccactccgggttgtatccgtaggtggggacgccggtgaattccgtgagcaccggcgaggccgagtcccgggtccggatggcatagcgcccggcacgcatggccagttccaccaccacctggtccccgccggggccgccgaactgcacccacatcagggactcctcatcggcaagcgccgccgtgatggttccggagacggcttcccctgtctccaccagggacagccagtccccgggcactgcggtgagtgacgccgtcgtgccatccgttgaccagaggccgggtgccagttcgacggcggcgggagagtcctccagccactggaacgaggtgagggtgagccagccgtggcgggcggcgagggcctggttgcggttgtcgcggaagcgctgccagcgttccaccttggcggccgggagggtgcccatggttcctttcgagcgtttcggtttgccccggctacaaccgctccgctccggcgttcattccgggccttgccttgtccgggacggggagtaccctcggaaccagcagggccggttgctttatggcccccgcagctgcttttaacactactttcaagctgtctgctttccggaggggaagccatgaagattgcggtgcttggcacaggcatggtgggacggaccctcgcgggggcgttcagcgcgctgggacatgacgcggaaatcggaacccgggatccaggcgccacgtccgccaggaccgggccggacatgatgggtgcgccgccgttcagcgaatggcacgcggcaaaccgtcacatcccgctgacgactttcgccgaggctgcaggggccgctgagctggtggtcaatgccacgagcggcgcgggagcgctggaggcagtgggttcggccggggcagcaaggcttgccggcaaagtgctgatggacgtttccaaccccctggatttctcccaaggaatgccgccagtgctgaacccggtgaacacagacagcctcgccgagcggatccagcgggccttccccggcgcgcgggttgtgaagaccctcaacacgatgaatgccggactgatggtggacccgcgccggctcgcggacggcgaccattccgtcttcctgtcaggagatgatccggaagcaaaagcggtggtcaaaggtttactggaggagctgggccaccgcgatgtgatcgacctgggcgacatcaccacggcccgcggcgccgagatgctgctgccgctctggctgcgcctctacgccgctctgggcacacccaatttcaatatcaaggtggtccgcgcggttgaataggtgccgtggacatacttgctggagtaagcactgagtggctgagggccctgacctggatcgccgccgccgcagccggcgtggcggtcctcctgtggcggccgcagcggccccacctggcaggactggccgccacggtggtgttcatggccgcgagcgcgggcgccgggatctacgtgctgaaccacctgggcgacggccgctggggcggtgacctgcagtccaggctgagtccgcccccgctctccgatgcgcccatggtggggcagttcctgcaaccgctggaagggatgctcggcggcgtggccgacggcgttaacgagtttgttgacttccgctccgccctgccggtggcactggagttctttggtgccgcgggctgggccctggcgttttccgtgcccctggcactggtggccttggcggccggcgccagggcggccaggcgccgcgccgcggaattcaccgcgtaccgggcggaagtcgaacagctccgggaagagctggatcacgtcaagcgccatgtaggttacccggtgcgcgacattatctgagacggattcccccacggcgccgcagtgcgggtagcatctttagctagttacgtggctcacagtatccagcgcagtgtacgagccaagtccgaaccctcgaaagatagtttccatggctcacactgcaacgaatcccgaaaccgatcttgcctccgaactgagggcagacgtccgccgcgtgtccaccctgctgggtgaatcgctcgtccgccagcacggtcctgaactccttgacctggtggagcaggtccgcctcctcaccaaggaatccaaggaagccgcccgcggcggtgctgatgccaccggcccgtggagcgcgcacgacgtcgttgcccaggtccgcgagctcctgggctcactgcccatcgagcaggccaccgacctggtccgcgccttcgccttctacttccacctcgccaacgcggcggagcaagtgcaccgggtccgcggcctgcggacccgggccgaaaaagacggctggctggccaagactgtagcggacatcgcagagcaggcgggctccggtgtgctgcaggaagtggtcaacgggctggacgtccgccccattttcaccgcgcaccccaccgaagcctcccgccgttcggtgctggacaagatccgcaagctgtccgacgtcctggcccagcccagcgccgagggcacaacggcccggcgccgccaggaccgccagctggccgagatcatcgaccagatgtggcagaccgacgaactccgccaggtccggcccaccccggtggacgaggcccgcaacgccatctattacctgagcagtatcctgacggacgccatgccggagatgcttaccgaactctcggaactgctcggcgagcacggcgtgacccttgcctcgcaggaagcgcccatccgcttcggctcctggatcggcggcgaccgcgacggcaaccccaacgtcaccgcggcagtcacccgcgagatcctgcagatccagaaccagcatgcggtccggatcagcatcggaatgatcgatgagctgatctccatcctgtccaactccactgcgctcgccggcgcggaccaggagctgctggactccatcgacgcggacctgaagaaactgcccggcctggacaagcgcgtcctggagctcaacgcccaggagccctaccggctgaagctcacctgcgtcaaagccaagctgatcaacacgggcaagcgggtggccgcaaacttcaaccacgaacacggccgcgactacagcggaaccggcgaactccttgcggaccttgaactcgtggaactctcgctccggaaccactcggcgtcgttggctgcagacggcgcgctcgcccgggtccgccgcgccattgcgtcgtttggactccacctggccacgctggacatccgcgaacacgcggaccaccaccatgacgccgtcggccagctgatggaccggctgggcgggccgggcgtgcggtacgcggaactcagccgcgggcagcggcttgaggtgctcggttccgagctcgcctcccgccggccgctgtccggacaccccattaagctcgacggcgccgccgacggcacgtacgacgtcttccgtgagatccgccgcgccctgcgcgcctacggcccggatgtcattgagacctacatcatctccatgacccgcggtgccgacgacgtgcttgccgccgccgtcctggcccgtgaggccggcctggtgaacctcttcggcgagaagccctacgccaagatcgggttcgcgccgctgctggagaccgtggaggagctgcgggcctcggccgaaatcgtggaccagctgctgtccgatccctcctaccgggaactcgtgcgcctccgcggcgacgtgcaggaagtcatgctgggctactcggactccaacaaggaatccggcgtgatgaccagccagtgggagatccacaagacccagcgcaagctgcgcgacatcgccgccaagcacggtgtgcgcgtgcgcctgttccacggccgcggcggatccgtgggccgcggcggcggacccacctacgacgccatcctggcccagcccaacggtgtcctggaaggcgaaatcaagttcaccgagcagggcgaggtgatctcggacaagtactctctgcctgaactcgcccgcgaaaacctggaactgtccctcgccgccgtgctgcagggctcggccctgcaccgcgatccgcgcacctcggcggaccagcgggaacggtacgggcacgtcatggaaaccatctccgacgccgccttcgaccggtaccggaagctgatcgatgacccggacctgcccgcctacttcatggcctccaccccggtggagcagctgggctcccttaacatcggatcccgcccgtccaagcgcccggactccggcgcgggactcggcgggctgcgcgccatcccgtgggtgtttggctggacgcagtcacgccagatcgtgcccggctggttcggcgttggctccggcctcaaggccgcccgcgaggctggcaacaccgcgcagctggtggagatgtgggagaactggaacttcttccggtcggtgctctccaacgtggaaatgaccctggccaagactgacctggacatcgccggctactacgtctccaccctggtcccggacgagctgcaccacatcttccggaccatccgcgaggaatacgagctgaccgtggccgaggtgcagaacctgaccggcgagaacctgctcctggacgcccagcccacgctcaagcggtcgctggaaatccgggaccagtacctggaccccatcagctacctccaggtggagctgctccgccgtgtccgggcggaagctgccgaagccgccgaaaaagcagacggcatcagcggcgcagagatcgacgaacgcctgcagcgcgccatgctcatcaccgtcaacggcgtggcggcaggcctccgcaacactggctagcaccgacgctctctcacttaatgcaggttttcaaccaacgctcactcacacgcgagagagcgttggtggatttcccgctttaagtgggagagggtttcaggccttgggatgcgggggagcagccgggataggctggagggcatgccttccttccagacccgactgaaaatcaccgggctgcggccgggcaacccgcccgaggcggtcatggacaccgcggtggaagccctggggacccggcaccatgtggaggcccaccagctgcagcttgccgggggagtgccgcagctgaacctgcgcttcctcgttgacgccaccgaatacagcggcgagaaccggcaggcgcgggattcggcagccatgatgcgtgacgccgtcgaacgggtggccctgaccggatcactgaccgtgctgcgccgcagccggggccgctggacgccagtctaggaggacgtttcaggcttcaggagccaacgggccgggttcctccaccggggacggattgccgcgccggcgcgtgacaataacgccgacgacggcccccaccaccagaccgagcaccaccccgataagggagctggcccagaacggcagccctgtggccgagccggtgaagtagcccaggcccaccagccagcacgcccagagcaccgcaccgatcccggcgcacaggctgaaaccccggacggcgacattggcgatgccggcggcggcggaggtggcaaggcggccgcccgggatgaacctggcgccgatgattgtcccgtatgtggaggaccggccggccctggcgatagcgtcatggatcccgcggtggatccggcggccccacgcccaccggtccagcacgtggctcagccggcgccggaagagctggaaaaccaccatgtcgccaacccaggacgccagggcggaaaggaaccccaccaggaacacgttggtacggccgtccgcggacagggcaccgccagtgatcaccaccatctcggaggggatcaggggaaagatggcgtcgccgaggaccacggggatgatccagaaatagatcgccgacccccagctctcagcgctgccgaagtccatggccacaaggtaccgcagatttggccggccggccctgcctacgtttcggacttcggcgaatggctgaggtgctgccccgccaggaagtaccagtagggccaggcgacccaggcggctgctcccgccgcgactcctgccccgccgatgccgtagcggatccagcggggaagctgctccgcccaggtcaggccagccaccggcaacgccaccagaagtgtgcctccgatggcctgtcccagccgggcgaggtcccgcgggtaggcgcctgaggccaggagcgcccggtgtgccagcacgaaccacccggcctggaccgtcatcgccgcaaccgagataactgtggagctcttgaagccgagctgtttgaaaacaagcaggaacgagcttgcggatccggcggcgcaggatgcggtgaccacccatttgccggcctccgaggccgccgtccgcggcagccggcggtgcacctgcaggatcacggggagggccgccaggttgaacagggcacctgttgcgtcattgatggtgccgaagacgtaggggccgttgcggggtacttccaccgcatacatggcgccgagggtggctatccccactgcgcccaggcccgcggcggcgtaggcggccctggcggcggtgcggtcgcccgggatccaggccaaagcgtccatgatggttccttgccttgccccaggtacccctcaggatagtcctgtccggaccggccatccagagggcgacggcggttcagcgctgggccgggtgtgcctcgctgaggtccagcccgctgcggtactccacgggtttgccgctcatgggatccacgaaccggatgccccgggccaggagctggaggggccgagcgtagtcgtccggagccttgtccagcaggtccgggtagaaggcatcattgatgatgcccagccccagcgacgccatgtgtacccgcagctggtgcgtcttcccggtgtgcggctcgagccggtaccgggccagccgccggggactgcccaattccgcggcagaggtgccggccgcacccgaagcagcgccgccgtcgaacgtttccagccgctcgatccgcgtttccgcgttcggttcgccgtcgatgacctcggcgagcaggtagctgcgcgacttggtcatccggttgcggaccactaccgggaagtcgacggcgggataaccctccgcggggccggcggcggacacgcactcgtattccttctggacctgccgcttctcgaagagcacctggtacctgccgcgggtcccggggttggtggagaacagcaggaccccggccgtcatgcggtccagccggtgcatggggatcaggtccggcagctccagctggttgcgcagccggaccaacgccgactcctggatgtaggtgccgccgggggtagtgggcaggaagtgcggcttgtccaccaccagcaggtgttcgtcctggtggaggatggtgatctccaccggaatccgcgtctccggcgggaggctgcggtagtaccagatgaacgtgtggtcctgcaggggagtggtgcggtccagcggcaccccgccctcaccaacgatctcgcccgcgtcgaacctgtcctcgatgccctgcgggtcgatgtgcccccagcggtgcatcatgtagtccattgccgtgtcccagggaccctcttcggggaggcgcagccgggtggcgttgacgccggcgcgcacggggaggggggattgcatcaccggaccattctaccggcgggtcccgccgcccctcgcggtgcctccgggcgcctaagtcgccggaaccgtgtgaggtcgccggatccttccggcgaccgtgcacggttccggcgaaccggcgcagtaggagtccggggcagggcggccggcagggcatgggcttcggccggtcacgcaatggccacggcaggtgcgctcttcaaggtccggcggagctgcggggcggcatcgagccggtcctgcgctgagcgcagggcgacgaccgcggcctcgagcttgtccggcggcagggtgaagggcacccggaggtaacgctcgaaggcgccgcctatcccgaagcgcggcccggcggccagccggatcccgaagtcgggggcgatgacggtcagcgcagtgctgatgggagcgggcaaccggcaccacgcggacagtccgccggaagggtaggccgtttcccactccggcaggtgtcgggcaaggagctccaggagtgtgctcgcggagcagcccataggcggcagtcaccatggtccggctgacacccagggcttcggacagggcgcgctcgctgggcagcgcagtgtccagggccacccggccgtcgagcaccagaaggcgtacgacgtcggccagctcgcgatagcccggcgttgccccgacattccactcgcccaggagacgggaaaggccggaggcggtgagggatgacatcaggccagtatctcaaactggctatgtaattcaaggccagttctctgcgagagtcgtctgtatgttgacccgcagactcctccagctttttaccggcctcgccatgtatggcgtctccctggccatgttcatccgcgccgggctgggcctggacccgtgggacgtcttccaccagggcgtggccggcaggaccgggctcagcatcggcgtggtggtcatcatcgtgagtttcctggtgcttctgctgtggattccgctgcggcagtggcctgggttcgggacgttgtgcaacgccgtgctggtcggcgtgttcgcggacatcggcctcgcactgatcccggccgtgacccacctgggcgggcagatctgcatgctcggcggtgcggtgctgctgaacggcatcgcttcggcctgctacatcggtgcccggtttggccccggcgcccgcgacgggctgatgacgggcctggccaggcgcaccggctggtccgtgaggtggtcccgaacgctgatcgaggtcgtggtgctggccgtcggctggttcctgggcggctcggtgggcgtgggcactgttgtttacgccctcgccatcggacccctggtgcagctgctgctcccggtctttatggtgcccgcgtcaggccccgcggacaacgcctcgtcggtgggcagcaaccccggaactcctgcgccggcgtccctggccaagaacagctaaggcaccaaacagggccgaggccctaggccagcagcggctggcactgggggcagaagtagatgtcccgctcctcgtcgccgttcagcttgcccagcacgccgcgccggatgggcgtcccgcacttcaggcagggctggtgttcccggcggtacacccagtagccgggccgccccgccatccggccgaccggcatgccgcgggcgttgaggatggtgacgcggcggcccgggcccaggttgacctccaggagctgcttggcgtccgtcatcatggtccgcacgtcctggaccgccgagaccggtgaagcggggtgtacaccggacaggaagcacgtttcgcagcggtagatgttgccgatcccggccaggttgcgctggtccagcagcgccacgccaatggggacgtccggggcggaacggacccgccgctccgcctcgtccaggtcccagtcaggccccagcaggtcgggacccaggaaacccacgatggagtcctcgctggcggtggccacgacctcaacaagccccaaggaaaatccgacggcgtccgctgcagcggtgcgcagcacgcaccgggcggtgtagccgggtttccgccaccttccgccgggcgggtacacctgccaggttccctccattttcaggtgggaatggatggtgagctttttgtcgtccggccccaccacgcgcatcagcaggtgcttgccgcggggcaccacctcagccacggtccagccggcaaggttgagggtggcaaagcggggcacgcggaaatcggaagcaaggagcttttgtcctctcagggcctggtgcagctggttggctgcccgccagacggaatcgccctcaggcacggatcctcagtcctttcggggtggaataggcgccggccgagctcagcgcggcagcgacgggggtgtccaggatgccgtgcccgttgaccttctccatgatcagtttgtccacggctccccgggtcaccacgcccaccagcgccgcgccggcggctgcgaggacggcttcatcgccgctgaaggccagcagtgtcttgccgccccgttccacgtaaaggaccagcgccccgtccaccagcaccaccagggcacctgccttccgcccgggacggtgccccgtgccggcgtcgtcctggagggccggccaggggagggccgctccgtacgggttggcagggtccgttgccgccagcgcgagggcaacgggttcgggcctggcgagctgcgtgtcctccgagtaggaacgcagccggtcaacagtagccgggacggcgaactgggccgcacccaggtgctcaatgaagtagccccgccggcagcgtccggcttcctccagcctcgcgaggaccttgtacatgaggccgaatccgcccaggatctgttccgccatcacggaccccctggtgaccacgccgtagcggtccagcaggagttcagccgtggcccgggcgtggatggtggggtccagttccggctgcggcagggcagaccagcggccggcggccatcgggggagttgacgcacccccggccgacgcaccgtacctgccgcctgccaggcccggcgatcccatgagcccgctcccgtgggaacggcccagcctgctgagccggggtgccctggcgcggggtgcgcgggccacctgccggtgcgcggtgtggccaccggcgatcagcgcgcggaccggggcgaacgtgtccccggtgatccggcccgcccatgcgaggtcccagagtgccgtcaccacttcctggtcgctgaggacggcatccataccgccggcgacgtccgtcagttgccggaagaagtagccgccgccgttgttgcgaaggtgatccaggaggcgctgctgcgcatcccctggttcgtattcgatggcagggttcagcgtgagttcggcggagtcggcaaggtggaggctgatccagccgtcatttcccggcagggctccggcgccggaccacaggacctccccggcggccatcagttcatccagcatggccggctggtagttggagaccctgcccgcaaggaccagcggctcccaggccgacgccggaatgggcaccccggaaagctggtcgactgcggtgatgatgccgtccagcccgcgcagcgacggctggccacgccctccgccgggcgtcctgacgtgctgccaggcgggcaggaagcgcccgtaggcggccgcgtccaccggctccacttccgcgcggagggctgccagcgaacgacggcggagcttgcgcaggacctcggcgtcgcaccattcgctgaccaccgcgtgcggggaaaggctgggcgggggtggttcacttgcccgctggctttcctccggttcattgccctcttcggcggctccgctggtggtgtccggggcggtttccgccggccctgcatgcggccggaactcgccctccaccacgcgcccgtctgctgcgaggcgtttcagggcagtgcttaccactgccacgcccaggccaaggcgcgttgctgcctcggacgcggtgaaggggccgtgcgtgcgggcataccgcgaaaccagatcgctgaggggatccgcaacgggttcaatgaacgcgagcgggacccccatgggcagtggaacgccaatcgcatcccggagccgcgcggcatcctcaacagccgcaaaccgttccaccccgcctatgttcaccttgatggcacggttggcgcgctgcagggccacgaggtgggtggtggcttccgccggctgggcgtggcccgcgtccactgtggtgtggacgtgcccggtgtcgccggattcaacggcgtccttggagtcaaccaagtccccagaggcaacaccggcggcctcgaccggctggactgccccgtccggatcgactgccggggatggcactaccgccgccggctgatcgagcgcggcggcttccagcctggcggccacctcctcgggcgccagggggcccagcagccgcagcaggtctgccactccttccatgccccgcacccgccggtccggagccagccgctgcagctcgcgctccgtggcttcgatgaccttggcgtcgagcagttcgcgcagctcaacgcgccccagcagctcgttaaggagcgtggaatcaagggcgagggcagcggcacggcgctctgcgagcggggagtcgccctcgtacaggaactgcgccacgtacccgaacaggagggacttggcgaacggggacggctgggacgtagtggtctcgacaatcctcagttcgcgccgctccacggaggccgcgatgtccttcaatgccgggaggtcatagacgtcctgcaggcattcccggacggtttcaagcacgatggggaaggttgggtacttccgggccacatcgagcagctgggcggaccgctgccgctgctgccacaatggctgccgcttgcccggggtctgccggggcagcagcagcgcccgggctgaacactcccggaaccgcgatgcgaagagcgcactgccgcccacctcggcagtgacgatctgctccagctcctctggatcgaagaggaacagctccgcccccggcggctcgtcctccatcatgggcacgcggagcacaatgccgtcatcggcggccatcgccgagccatccaggccgtacctctggtggaggcgctgtccgacggcaagtgcccagggagcgtgcaccggcatgccgaacgggctgtgcaggatgacgcgccagtcgcccagttcatcgtggaagcgctccaccaccagcgtggtgtcactgggaacgacctcggtggccagcttctgctcggtgaggtactggatcaggttgttcgcggcgaactcgtccaggccgctggctttgcagcgctcggtggcagggccggcgtcggacgccgagagttcgcggacgaacgcgcccagggcacggcccaggtccacgggccggccgagcgaatcgcccttccagaaaggcagcttgcctggctggccaaaggcgggcgagaccagcacgcggtcatgcgtgatgtcctcgatcttccagctggtggcgccgagcgcaaagacgtcccccacccgcgactcgtacaccatctcctcatccagctcgcctacccgccggccacccttggcggcaggcgctggtttgccatccgtggaaggggaggccgatccttcaacctccgtgccgatgatgtacacgccgaaaagcccacggtcggggatggtcccgccggaggtcaccgccaggcgctgcgcgcccggacggccctcgatggtgcccgcgttgcggtcccagataatccgtgggcggagttcggcgaattcgtcggacgggtagcgtccggccagcaggtccagggtggcttcgaacgctgagcgggggagtgacgcgaagggcgccgagcgccgcacggtggcaaaccattcctcgacgtcgatgctgcccagcgcggcggcggccacggtctgctgggccaggatgtccagcgggttggccgggatgctgaggcgctcgatctttccgccgagcatccgttccaccgtgatggcggtgtgcacgaggtccgcccggtgcttcgggaagaggacgccctgggagacttcccccacctggtgccctgcccggcctacccgctgcaggccgctggccacggacggcggcgattccacctgtaccaccaggtccacggcgcccatgtcgatgccgagctccagggaggacgtggccaccacgcaccgaagccggccggacttcaggtcgtcctcgatgagtgcccgctggtccttggaaacggagccgtggtgcgcgcgcgccagcaccggatctgccccggcagaacttccagcctgcgccatcatgtgcgccggcgtggcggtggaggcgggaacgccgggcgctgcggcttgctggtgagggtcatcccagccgccgcctgccgccaccagctgccgctccgcgtaaatctcgttgagcctggcggtcagccgttcggacagccgccgggagttggcgaacacgatggtggactggttggccagcaccaggtccacgatcttctcttccacatgcggccagatcgatgcctgcggctggagcccggaagcggggccggagtcaaaagcccccgcggcgccctggagatcggacatgtcctccacagggacggagacggtgaggtcccagttcttcttggcaggaggggcaacaatttccaccggcgctgaaccagcgaggaactgcgccacgagctccttgggttccacggtggcagacagtccaatgcgctgggccggtttgggcagcagcgcgtccagccgctcgagtgagactgccagatgggcgccgcgtttggttccggccacggcgtggacctcatcaatgatgatggtgtccacttcggtcagcgtttcccgcgccttggacgtgagcatcaggaacagggattccggggtggtgatgaggatgtccggcgggttgctcagcagggcgcggcggtcagttgtcgtggtgtcccccgagcgaacgcctacggtggtcagcggcgccggcagcccaaggcgcttggcggtctgggtgatgccgatcagcggtgagcgcaggttccgttccacgtccacgcccagggccttcaggggtgaaatgtacaggacccgggtcttgcgcttcggtgcccgggaacgcttgcccttcgtcgtgacggggccggcagcgtccgtggcctccggtgtttccgcggcggaggcaagcagccggtccagcgcccagaggaaggcagcgagggtttttccggagccggttggcgccaccaccagggcgtgcgaaccggaggaaatggcacgccaggcgccttcctgcgcgggcgttggctctgcaaaggcgccgaggaaccagtcgcgcgtgggcccgctgaactgcgccatgggctgagccccggggggccgttcctcgatcatgcctccatcatgccccaaggcaccgacactgatgcgggccccgtgcccgggctcacgccttgcctgcggccggaaggtccttggtggccggcccctccaggagcttcccgtcgctgctgaaacgggagccgtgcagcgggcagtcccacgtcagttcactgtcattccagtgcaggattccgcccaggtgcgtgcagacggcggagagcctgcacgtagtgccgtccacggtggagacggccatcggcttgggtccttcgctgtacaccttgccctcgccttcagccggaacggcaggggcgggcgcaggcgccttcttgtccttccgcaggccttctgcggccacctgtccccagccggaagcaagcctggctgccacgccggcgttaagcgcgacggcggagagggctccggagggcgaggtgaccctgcggtggatggtgtccgcccaaggcacgttgccgcccaggatgtcggcggagatgccgacggcggccgccaccgcgttggtcatgccccacttgctgtatccggtgccgaagtggatgtggcctttgccgcgcgagaacctgccaaagaagggcatgaggttggtgggcatgtaatcctgcgcggaccacgtgtgcgtggcaacggcgccggggtagtgccggccggcccagtccaggaggctgccaagatggtgtttctcggacctggtccggcccacgtggtgcccgtgcccgcccaccaggagcaggcggcggccgtccgtctcgtagtccctcagtgaatgggtgggctgctctacggagaggtacatgcccgggggaggagcctggtcctcctgcagctgcagtgctgccgcgtaggagcggctgggctccagtttggcgaagtacagcccacggtccagcacgggaatgccggtggcgagcactacctcgttggcggtgacggtgccgtggtcggtgtgcaccgtggcgggcccgctgccggtgacgtcctgcagccgcacgccgcccaccacggatcctcccctgctccggatatcggacaccagcgtctccagcacctttaccgggtggatctgcgcctggttcgccaggcgaacggcgccgtggacgggaaacggcaggccggcgtcgcgcacgtattccatgtccagcccggcggtggtgccggcgctcacctcttcgcggagcttttccgtcccctgggcggaggctgcgtaggtgtaggcgtccctgcgctggtactccacgccatgttcgtcgaggtaccgcaggagccaggcctggccctcgcggttggcatccacgtacgcctgcacctgcttctgtgaatactggcgggcgagccgtgagaggaacgttccctggagcagggtgaccttggcagtggtgtttccggtggtcacggcgcccgggtacctggcctccaggacaagcacgttctgcccggagcgcgccagcaacagggccgtcaccaggccggtgagccccgcgccggccaccacggtgtcgtaggtgcctcccggctcgaacggatcggaagtgaattgatcgctgcggtccagccaaatcgacgtcatgcctgctcagcctgcctttggtccaggccctggtgggccagtttgtgatgggtccgttatgaacccccacccatagatgccgtatttgctaagtatacttatgatgtcggggtttaagtctatggtcaggtggcagcccggcagccacgaagtggacataacgacaaatagcaggagaagtcatgacaagcatgagttccgacggccgcgcagtgggccggaccaccatccaaacagcagcccttgcagtgggagctgtcttccttcttgtgggcgtcctgggtttcatccccggcatcaccaccaactacgagaccttgggcttcgccgggcatggctccggggcgctgctgcttggcgtcttccaggtatccatcctgcacaacatcgtccacctgctgttcggcgtggccggtatcgccatggcgcgcagcgccgcccagtcccggaactacctcattggaggcggcgctgtttacctggtcctgtggatctatggcctgctgatcggcaaggacaccgcggcaaacttcgtgccggtgaacacggcggacgactggctgcacttcgtcctgggcgtcgccatgatcgggctgggtgttgccctgtcccgcggcaccgcccgcaccggccggaccaccacggccaccaggtaaccaaagtcccgaacaagtcccacaaaagaaactgcaggcggtccggcatcttgccggaccgcctgcagcttccttgtggagtcccgccgcggcggaaatcaggcaggctggaacgggctgatggtcaggagcgtgatcgcaccgttgctgcaggccctggtgggctggggcaggaacagggattccgtgtcctcgggcgggtagatccggtagccggccgcgtccaccatggcgcagtcggaataattgccggcctgggtgtagcgcagcaccgcagaaccggtttgtccgggggccaggaggacgtccaccgccgccgtggactcgtcgcggaccgccggcgcgccgatgggagcaccggcagcaacggcggtcagggacaccccggcatagccgcggaggacgcacgggtcggagccggtgttggtgaggttgagcttcatgtatacgctgccggccgccccgcctcctgacgcgtcggtggccgccgagagccctgccgccttgcaaagtgcggggtcacccggggcgggagccgcgggggacgtggacgtgcccgtggacgacggcggcgcagacgccgtgggtgccgcggacgacgcatcggggctggctgggctgctggccgagccggtgcctgtacctgtgcttgctgcagtcggctgcgactgcggctgcgctggcccgcaggcactgagcatcagtgccgccgccgcggccgccgtggacatgaccaacccctggaaaattcgctgagacctcatggcaccaccttcgccgcagcagctgcccgcgtcaacggcgcaacgggccgccccggcattttgatgcccggatcgtgatgatccgggcatcaaaagcggcggccctgctcagcggggtctcctgtggtgcggctttgcggtggtgcggctttgcgttggtgcggccctacttcgccgagggttccgccgcgctgcgccgggccgtgctgcggaccagcgccgcaccgcccagtgccagcccgccaacgcccgctgccagccctgcccagctgcgtgcttctgccccgcggtcatctgccccgctgccggtgaccgccgaggcttgttccgtggagtgggatgcggccggggccgccccgtggccgtcagtgcttgccgcttccgtcacgctgaccgacggtgcaggtgccttcagggaatgggggtcctggccgtccgctggaatttcggaccagtcggtctggcctgtttcgcaggtctgcagcgtggggaagtacagggtggttccggccgcgtcaggcagcttcgccgagaggaccagggtgtcccggagctggtgttccaggggcgccttggcggtgtagacaatctggctggtccgcttggtgatggaggtgccgtccgcgagcttcttcggttcagggagctgctcggtcaccttctccacggtccagttcgggttgaccgtgggctgggcgtcgttcagctcggagggcagcgtgatggccaccttggtggtgccggattcgtcgcagccgtgggggaccgcgaacgtgagcagtgcataggagttggccgaggtcttgtccggcgtgacgccgacgtgggcggcggcaccgcccgcggctgccagcagaagcgccgcggcgcctccggatgctgctgccgctgcgagggaacgtcgaaggatggaggtatgcatgggttgcctttctggcgcacgcccggaaccggggtgctaaaagttttttgtgggcccggcgccgcaggacgcggagcgggttaggaggaaagcacgacggcggaaggcgggccgcgccggctgtcctgccggagattgcgccagggacgcaacgggacggcggcaggaggacatgtaactaaaggcggggtgccgtcgtcgtacgccaccggctgggggagcacaacaaggggccgaagccaggcggccaacgcccacagtgcggcctcgcctttggcgagcaaaagcgcggaccccagagtggccaggacgtgcgcagcgagcatcaggggaccggctgttgccgcggctccggcgagatggtccgccgccggggcgaggaggcccgctccggcaaagtggctttcatggggtgcggcagggccggaccccacggcggcgccggaggagctgaaggccgtaaagacctcatgcagtgccagttgcccgccgcccaggagcgccgccagcgcggggaatcccaggcgcaggcgtgttgcggtggtgctgccgagcgcggtcagggacagcgcagccagcatgatggcgggcgcggggagttccccgccggcggcgaggtgtgctccggcggcaagcgtcaggatgacggtggccacggcagtggcacggaggaggtggaagggcgtccggggacgatgcgccagcacggatggtccccctccccatacggaacgggccgcggacggcggcgccggcttaaatgatggccgttcagattctaccggcggaaagggcgggcgtgcgctcgcggacgggccgctgcagccccgcctgccggctatgtaccaccacttcaggcccgcgtagactgcgaacgtaactgccaggcgatcttgaggagaagttcatggactacaccggaagccagtcagagaaggccgttcccgccggtgaactggaccgcgggcatgttggccacacagtcagtttccagccgaacgagttcaccgtggtgttcggaaaaatcgctggaatagcccgcaccgaggccatggtgtacctgtcccttgccggagtctcgggcggcacgcacctcaaggatgaatacgatctcccggtcagccacccggtctacctgcaggtggatgtcatctccaacgccgagtccaccatcaaggacctgttcggcaaggtgcaggagaatctccgcggctcggggcacaagggcggcgaggaacggaccgaccggctgtagctgtccagccgccctgggagcggctggcgacggtaaggctgggatccgaggggtcccggccttctttcgtcgaagcacaaagatcgaccgcaggaaaaagttgttgaacaataccttgcgccgattgttcaacaacctgtaatgtcgatcgggacgaccactgtgactccagtcaccctgacaattggacgaacccatggcagaaaccggcataaaactgaacctgagctcctctgctcggcgcacggccctcctgggagccatgttcctgatggccaccagcgccatcgggccaggcttcatcacccagaccactgttttcaccgcccagattggtgcgtcgttcgcgttcgcgatcctggcatcgatccttattgacatcgcggtccagatgaacgtctggcgcgttatcggcgtctcaggcctgcgcgctcaggaactcggcaacaaagtagtccccggaatcggatggttcctggcaggcctggtcttcctcggcggcgttgtcttcaacatcggcaacattgccggaactggacttggcgtcaacgccatgatgggcgtggatccgaagatcggcggcctcgtgtccgccgtcgtcgccatcctcatcttcgtcagcaagaaagccggcatggcgctggaccggatcgtggtcctgctgggcgccgtgatgatcctgctgatgatctacgtggccatcgtcgccgccccgccgctgggtgaggccttgaagaacacgatcctgcccgagacggtggacttcctcatcatcaccaccctcgtgggcggaaccgtgggcggctacatcacctacgccggcgcacaccggatgctggattccggcgccaccggggtcaagcacgtcaaagagatcacgcgcagctccatcctggggatcatcgttaccggccttatgcgcgtcctcctcttcctggccatcctcggcgtcgttgccggcgggacggtgctcagcagcaacaacatggccgcagaagcctttggcgccgctgccggcgaaatcggcctccggatgttcggtgtggttctctgggccgccgccatcacctcggtgatcggcgctgccttcacctccgtctccttcattacctcgtcccgcactccggagcgtaagcgcaacctcatcaccgtggctttcatcgcaggctgcgcactggtttacgccttcctcggccaggcaccgcagcagctgctgatcttcgcaggcgccttcaatggcctgatcctcccggtcggcttcggtgttctcctctgggttgcctggcggcgccgcgacctcatgcacggctacgcctaccccaagtggctgctgctggtcggcatcgccacctggctgatcacgctgttccttggctggaactccgtgatgggcctggcgaagctgtggtcatgaccggccgcgcgtccatgctccccgccgaagcgcgcgaggccttccgcgccggactggtggagccaacgtcgggctggtcccgcggctacgcgcaggcgaacgtcctgtcgatcccgcgggagcatgccttcgacctgctgctgttcgcccagcgcaaccccaagccgtgccccatcctgggcatcctcgaaccgggccacaccaccgggccgctgctggccggcggtgacatccgcacggacgtccccaagtacaccgtctaccggaacggcgaaaaagtggacgaacccacggacatcacaggctactggcaggacgaccttgtgacgttcctgattggctgctccttcaccttcgaggcagccctgcaggacgggggaatccggattgcgcatatcgaccagggcgtgaacgtgccgatgtaccggaccaaccgggcctgtgccccggcaggatcaatgtccggtccgatggtggtctccatgcgcccggtgccggcctcgcaggttgcggacgcggtccgcatcacctcgcggtaccctgccgtgcacggagccccggtccacgtgggcaacccggaggagctgggcattgccgatctgggccggcccgacttcggcgacgccgtggagatcccggccggccatatcccggtgttttgggcctgcggagtgacgccgcaggcggccgtgatgcagtcgcggcctccgctggcgatcggccatgcgcccggccacatgctgatcacggacgcccgggacagcgactacctggtgccgtaggcgccgcctataaaagttggccgtaggcgccgcctaaaaactggtgccgtaggcgccgctcacgcacaacttaaagaacaagagtgggtcaggaggatctcctgccccactcttgcatgttccggccgttagcttatccggcgcgctgtcgcattgccgaccggcggtcctgctccgcgcccaggtgcaccagcagctccgcctcggcctcgtccaggtaggcccgcagcccctctgcagcttcctggcgttcgccggcgcgcagttgcttcaccagcgtcacgttgcggtccacgtagtggctgtggaagtccggtgccgaagccatggagtggaacaccagccgcatttcggccagcacccggtccatgagctcctgcagcgaagcgctgccggtcagggcaaccacggccccgtgcagtgcctggttggcatcggccatggcaggcacggatccgctgtcccgggcctgctgcgcccgctgcacgatggcttccagtccgtccagcacctggggtgtcagctcgccccacaggacggcggcaggctcgatcatccgccgcacgcggtagatttcgcgcacttcctccacgcccggcgacgccacgaagacaccgcggtttggaatgcgcgtcacgatggattcgccgacgagcgtagtgaacgcctggcgcagggtgttgcgggaaacgcccagcgctgcgcacagcggctcctcggacagcttggagcccggggtcagttcacccgcggcgatgcgggtgcgcagcactgacgcgatccaggccgtggtgtgtgcgtgctcggccgtaccgtctgccggagtgttcattggtttcccccattcccgttcgactaacgatgctagccgacagtacccagcacttcgccgcgggccacagcggcgcccggttcctggccgccgcgccggaaggttccggtggcagaggcaaccaccacggtttccatcttcatggcctccaggacggcaacaggctccccggcgccaaccccggcgccgtcaccggccacccacttgaccaggttcccgcccatgggggcggtcacctcgccgtccgcgtcggcgctctccgtgcccgcagaaggttcgacggcggcccctccgccatggagcagggcgtggaagaccttggcgggcagccccagctggacggccttcccgtcgatttcgacagtcagggtttccctccgggccacgggtccctgggcgccggtctgcagggaggcggccaggcggccggcgaactccgtttcaatccaggtggtgaacacgcccagccggtccggtgcggtgaagtcgggatcccgcacaacggcgcggtggaacggaaggacggtggggacgccctcgatccgcagctcgtccagggcggcacgtgcgcggcgcagggcctgctggcggtcctcgccgtggacaatcagtttggccatcagggagtcgtattcggcaggaatgacggagccggaccggacgccggaatcaacgcggatcccggctccggtgggcgcctcgaacacgtccaccggtccgggggccggcaggaagccccggccggcgtcctcggcattgagccggaactcgaacgcatggccggtgggtgccgggtcctcggtcacggaaacaggcagcccgtccgcgatccggaactgctcccgcaccaggtccagcccggatgtcacctcggtgacggggtgctccacctgcaggcgcgtgttcacctccaggaacgagatcacgccgtcaggggccaccaaatactccaccgtgccggcaccggtgtagccggcctcacggcagatggcgcgcgcggactcgtggatccgggtgcgttgttccgcggtcaggaacggcgccggtgcctcttccaccagcttctggttgcggcgctgcagggaacagtcccgcgtgcccaccacaaccacgttcccgtgggtgtcggccaggacctgcgcctccacgtgccgcggccggtccaggaagcgctccacaaaacattcgccgcggccgaacgccacggttgcctcacggaccgcggagtcgaaggcgtcgtcgatgtcctccatccggtgcgcgatcttgaggcccctgccgccgccgccgaaggccgccttgatggccacggggacaccgaattccgcagcaaaggcgcggacggcgtcggcgtcagctaccggcccgtcggaaccggggaccagcggcgcacccgcacggaccgcaatttcgcgggccgtgaccttgttgcccaggctgcggattgcatccggcgaggggcccacccacgtgagtccggcgtcgagcactgcctgcgcaaagtcggcgttctcggaaaggaaaccgtacccggggtggacggcgtcggcaccggaccgcgcagcgacggccaggagcttctggatgtccaggtaggtctccgcgctggctgagccgcccagcgcgtaggcctcgtcgctgaggcggacatgcagcgcatccgcgtcggggtccgagtacacggctacggacaccaggccggcgtcggtgcaggcacgggcaatccggacggcaatttcaccgcggttggcgatcaggacttttttcatcgttacttctttcgcgtgctcgggagaggggccgggggctgcagtgtttcggggtcaacctccacgaaacgcagggtggcgcccggaggaagctgcgctgcggcagggaggtcttcgggaataacggcaccgatcacgggatagcctccggtgacgggatggtcggccaggaacaggacaggaaggcccgacggcgggacctgcagtgagccggccaccacgccttcgctggggagttccccttcgcgtgcccgctccagcggggtgccggcggcggctccgggcgtggacggcccggtgccgagccggacaccgatgcggttcgattcggcggtcacggtccacacctgcccggtcagggcctcgagggagcggggcgtgaaccagtcgtggcgggggcccgtggtgatgcgcagcaccacgggctcgccgccggcgcctgacgagaggtcttccggcagggcaggcggttcggcgtggcccactgcccgggcgctgtccacggcgccgatgggcagcaccgttccggcggccagcggggcggggccgatgcccgacatcaggtccgtggagcggctccccagcacgggaggaacatcaatcccgccgcggactgcgaggtaggtgcgcaggcctgcctccggcacgccaaggtggaggctttcgccgtcgtgcagggaaaagggggcgtacatcggcgctgccctgctgacgctattgctgctgccctcgctcccgatgtccttgcttcggatgtcagccgtcgcgcccgcgccgctgagcgcaaccgtcagctcgccccgtgcctgcacggaaaggccgcccatgacgttttcgatgacggcatcggtgggcaggtttcccaccagccggttcgcctggcgggcgctcgcagtatctgcagcgccggccggggagactcccaaatcgccgaggcccggccgcccgaggtcctggatgagtgcctgcggcccgggcgaaaggatctccagggcggggccggcggcaggtatgtcagtaattgcagcgtcagcctgggtgccgtccgcctgattcgtatctgtcctgctgagcttgatgagctcgcgcacggcgacgtactggacggtggtgccggggcgcaccagggcgggctgctcgcgctgcaggtcccacatccgcgtggcggtatgcccgatgagctgccagccgcccggtgaccgccgcggatacacggctgagaagttgcctgccagggccaccgagccggcaggtacggcggtccgcggggtgccgcgccgggggacgttcagggcgtccgtttcccccacaaggtacgcgaatccgggcgcgaacccgccgaaggcggcggtccacagctggccggtatgggcggctacgacgccctcgactcccatgccggtgagttcgcccacctccgcaaggtcttcgccgtcgtacacaacctcgatgtgcaccggcttgtccgggacggcagccgcgccggccggcatgctcccgagccgtgcgaggggcccgcgggcagcgcgggcgctggcgcgggagtcgaagacaaccagcaccgtctgcgcggccgcgagcacatcgacctgtcccgcagccgggttgtccctgaggcgggagtgaagggacagcaccgcgtcaagggagtccagttccaggagcagggcccggggcccggcccagcgtatctccggggaactcacacgaagctcctgatgtccacgccggctgcctcgagttcgcggcggaccgcggccgccatggacacggcgccggcggtatcgccgtgcaggcagatgctctcggcggaggttttgatggtggacccgtccctggcaacgatggtgccctcggtggccagccgcaccatgttggctgccacagcatcctcgtcatggaggacggcgccgggttcgcggcgggacaccagtgttccgtccgggttgtaggcgcggtccgcgaaggcctcggctactccgcgcaggccggctgcttccgcagcggccagcgccaccgagcccggcagcagcagcatcggcaggtccccgccgaaggccttgacagcatccaccactgcctgcgcctgcacctggtgggtcacgatggtgttgtacagcgccccgtggggttttacgtagctgatcctgccgccggctgcacgggcaatgccttccagggcgcccagctggtagagcacgtcatccgcgagttccgtgggggagcagtccaggaaacggcggccgaagcctgcaaggtcgcggtatcccacgtgcgcgccaatgctgatgccggcggcgacggcgtcgcggcaggtctgggcaatcgtggaggggtcgcctgcatggaagccgcacgcgatgttcgcgctggagacggagcggaagatggcggcgtcgtcgcccatggtccagttgccgaaggattcgccgacgtcgctgttgaggtcaatggaggccatagtgattctcgtctcgttgaagtggtctctttaggatgcacgagaatccaagattgttcaacaatattgaccaaaatggtgcccaaggcgcctgcccggccgcgcgttccggccacggaccgaacagaaggagcggacgacggcggaacctcccgccgtcgtccgctccccgtgggcggcaggctcagtaagccttgacgcgctgttccaccacgaggtggaccagggcgaagacgccgtcccggtcgatggcggcaagggcggcgtccagcgcggccggaacgtccctgtcctcggtgacggtgatgccgaacccgccgaaggccctggccatcaggccaaagtcggggttcttcagctgggtcccggagacacgttccgggtagtgcctttcctggtgggtgcggatggtgccgtattcctggttgtccatcaccaccaccagcggcgtggccccgtactgggcggcggtggccagctcctgcccgttcatcaggaactcgccgtccccggcaatggtgactacccgtcgtcgtggttcagccagggatgccgcgatggccgaggggacggagtagcccatcgagccgttgcgggcgctgatcatcgaggcgtagcggcgggtggggaaatagcggtgggcccagttggtgtgctcgcccgcgccgaaggtcaccatggcatcctccggaagccgtggcaccaggtttgccatcagggtgtccatccgcgcccggcccggagcgggggaggccggaggcagggcggcgaaccgttgctgctcggtcctcatccttccggtccacgccctccactcctccttggccggcaggctgatgccggcgaggtcgcggacaaaggcttccggtttggccaggatctgccgggacaccggcccggaccggccgcggagggaggggtcgatggtcaccaggaagttctccttggtccagtcctgccggcagacgaatccgtccgtgatgacgtccccggggacggttcccacgaacaccaggaggtcggtttcctccagcaggtcgtaggtggggcggggacggccgtagccgatggggccaacgtaggagggtgaatcgaaggacacagtgccctgggtccgccattcagcggcggccggaatgtggtgccgttccagccagccggtcagctggtctgccgcctcctgcgtccagtcgttgccgccggtgacgaagagcggcttgctggattccgccagggcggtttcgagggctgaggcgtcggtgcggctcatgccgccggccgctaccgggatggcagggtgcagggccgggtcaatctgctgccggatgatgtcctcgggcaggcccaccaccaccgggccgggccgtccgctcatcgcggcaaacattgcctcggccacgatctccgacgcccgctccgcgtggtccaggaccatcacgcgcttcgcgccggtatcgaaccaggccttgatgtcgaactcctggaatgcctcccggtcccggtgcgcgaacgggatcaggcccacgaacagcagcatgggggtggagtcctgccaggcggtatgcagccccacatgggcgtttgccgcgccgggcccccgggtcaccatggcgatgcccgggcgctggttcatctttccgtccgcctcggccatgtaggcggcgccgccctcgtgccggcagacgatggtttcaatgctggagctgtgcaggccgtccagcacgtccaggaaactctcgcccggcaccacgtaggtgcggtccaccccgtgtgccaccagcgaatcgacaatgacgtgcccggcggatttcagcaccggcggggtggcttgaggtccgggcggccggcccggccgtgcgtcggctgctgccgggcgtacgacgccggctggcggggtgggggatgcggcagggattgcttcggtttccgttgtcatgggctttctttggcggtttggacggctttggtcagggtggtttttatctgaaggtgttggcgggtgggttggcgatgacgggggagagtccggtgtggccttcgcgggtttgggcgatgtcgcggatgcgggtgcggcaggcgtaccagccgatgaccatgaggacggaggcgatggcggtgacgagcatggtgaggggggattcgatgaagaccatgatgaggacgcctgcgaggaagaggagggagaggtagccggtgtagggggcgccgatcatgcggaaggaggggcgctcgagccatcctttgtcggcccagcgtttgagctggatctggcacaggacgatggtggcccaggtcatgatgatgccgacggaggcgacgttgaggacgatttcgaaggcctgggccgggacgaggtagttcagcgggacgccgaggagtgagacgccggcggtgatggcgatgccgccgtaggggacgccggccttgttcatgcgggaggcgaatttcggggcggagccgttgacggacatggagcgcaggatccggccggtggagtagaggccggcgttgagggaggacagggctgcggtgaggacgacgaggttcatgatgacgtctacgccctggatgccgatggagccgaagaaggtcacgaaggggctgacgcctttttcgtaggaggtgtagggcagcagcagggccaggaggatgacggagccgacgtagaacacggcgatgcggaagaccacggagttgatggctttgggcatgattttttcggggttttcggtttcgccggcggcggtgccgacgagttcgatggaggcgtaggcgaacaggacgccctgcatgaggatgatcatgggcagcaggccgttcgggaagacgccgccgttgtccgagagcaggctcaggcccacctgctggccgtccacgggggtgccgaagatgacgaagtaggtgcccacgatgaggaagatgaccagggctgcgaccttgatcagggcgaaccagaattccatttcgccgaagaccttgaccgagacgaggttcagggcgaggaccaccaccagggcgatcagtgcccaggcccattgcgggacagctgccatccaggggatgtagttgccgaagaagttcatgtagagggcggcggcggtgatgtccacgatggtggtggtggcccagttgatccagtagaaccagccggagacgaacgcggctttttcgccgaagaattcgcgggcgtaggagacgaaggagcctgaggaggggcggtggaggaccagttcgcccagggcccggaggatgaggaaggcgaagaacccgcacacggcgtaggcgatgaccagggacgggcccgcggcgttcagccggccgccggcgcccaggaacaggccggtaccgatcgcgccgccgatcgcgatcatctggatctgccggggcttcaaattcttgtggtagcccttgtcctcggcatgcagcgccgattcggaagcatgggcatgaccgccgtcgatgacgtggtcaggtgcgaccttgtggtcctgtacaacctcgtcattggggttgatgggcatgggtgatcctttcgatacggagaagatcctgctggttggggaaggaagtagggagagtttcagtgcgcgtgggccaggaacgccagggtgagaaagcgcgtggtcagaaaacggaccagccggtgcggtcggaaaggtcggcgagggcggcggtaccggccagcgagttgcctttggcgtccagccgcggactccagacgcagatggcgcactcacctggaacgatgaccaggatgcccccgcccacgccgctctttcccggaaggcctacacggtaggcgaactcgcccgcggcgtcgtacatgccgcacgtcagcatgatggaaccgacgcgttttgcatcgctgggggacagcacgggacccagcgttccctgcccggcgcgggccaggaacagcccggctttggccaggtctgcgcaggtcatcatgatggaacactgccggacgtagttctccaccacggcttccgccgagtggtgcaggttgccgaagttttttaggaagtgggccagcgccaggttccggctgctgttggccagttcgccggcggccgctgcctcattgatggagggcctgctgctggctgactgcgcggtgaggaactgcaggagccgggcggcggcgtcgggcgccttgtccatcaggtggtccgtcaccaccagggcgccggcgttgatgaaggggttccgggggatgccgtgctccacctcaagctggaccagggagttgaagggcgtgccggagggttcccgcaggacgcgggaccacagtgatcccgagctgtctccgcggagcgccatggccagggtgaacaccttggagatgctttggatggagaacggcacggttgcatcgccggcgctgaacacttctccggacgtggtggcgacggcgaccccgaacctgttgaaggggacggctgccaggaggggaatgtttcccgggatgctgcctgattcccgttccggccggtggcggaggacgatgtcgtcgaggagcggtcccagcggcggtgcctggagtgttgttgtcatttcctgcctgaggtttcgttggaaggggtcccggcccactcctggacgtggagcagggccaccagcgcgtcgcgggggttgctgaagtccaggccggtgacgcgcgaagccttgctgatccggtagtaaacggtgttcttgtgcagctgcatccggcgcgcgcaggcggcgacgtcaagcgcggcgtcaaagtacgcccgcagggtttcggccagttcggcgtcctcacgcagcagccgtgaaaggctgcggtggcggaatgtggaggccgagaaattccggactgcttcccggaacaggatctcgccctcgaagttgtccaccgtgcctacggacgtatctgcggactggcccacgcatcttaggagggcctccgtcacgcgggtcaccccgtggatggacaacaggtccggaaccaccgggccaacggcagcaaaggggctgatgcccaggtgcttccgcgcgtccttgatgatggactctgcgaggcttcgcagcccgggttcggccgcggcagactgcaggcctggaacgatgacggcggtgtcccccttgaactggcccaccacggcggatgctttgtaggcggcggcgtggatggaggcaaggttggcgagttcgccatgcttgagtgctgcatcgtcggcctgcgcttcggcctcagacatgccaatcaggatcagggcggccgggcgctccgccggaagtttctcactgtgggcgctggccgcggcttccgccgggccggacaggatccgcgccacgcggtcttcccgcatgtgcaccgactgctggttgcggtaccggatcagttcggcggaggtccgcgcagcagaacccttcagcacatggtcgacgtcgggcccgaaaccggctcccgtctcttggagccagatgtagcccatgatgcggtcgccggcgaagagtgtaatggccacccgttcgcgcaacccgtcctgcggccgggccggaacccgcacgggcaaccgggtcccgtgcaattcacggtaggcgcccaggtccttgagcagcagctcgtatttgcgcgggccgcggcgcgccagaataaacgccttgcggagttcgtcgatgtcgttggagacggtggagtacgccagcaccttattggcagcgtcttcgatgaccacatggctggaggtgagccgtgccgtggtttgggcgatggcgaaaaggtcctcctccagcagcgtgagcacctcactctggtagctcggcggctggattctgtccttggcgatggacagcagccggtcccagtccgcgccgggatccaccagcagcaggccggtgccggcatcgcgcaggagttcctcggcctcggacagctcctcgcggcttcccttcacggccaccaccggaggcgggctcttcttcaggagccggcgcagggcaggcaaggcggaccggccgcggaccccgatcagcaggacgaaggcggctgcggcgtcgggcgcttcatcgtcggcgtccacgatcaggaaccgttcaatggcggggctggccgacgccggccgcaggaccagggtggcgaaaccaagggggagatccgagaggatatcgtccaccgtcaccgcagccatgagtgtccttctgcatcgatagcaccggacggctctgtccggtcaacccatggtatccagcaggaaacggcaggaacatgtgagcgaaactaaatccaatgcgggcttttcagcccgcagcccaagtgacgagccgcgcgggacccgtgagtccgagtgtgccggcactttgtattgaacggactcatccgcggatgtctccgggctcaacttccagcgagggtttggccgcacactctcaaaccctttggtgtgaatgttctttcgggtcagagcggcgcagggccggtcgaagctcgaatggttaagtgcgtgggcatgacggcaagctggcgactggcccggccagggacaggattcagctgggaaagcaacatcgagacggctacccggcccgcctgctcgatagggctggcgatggtggtcagtggggggttgcagaaatccgcgccgaaaatgtcatcggagccgataatgctgatgtcctcggggacgcggattccccgctcacggagcctttgcagcatgccaatggccagcaagtcgttgaagacgatgcacgcggtggccccagtgcgtacggcggcatccgccgcggctgcccccgaggtggtcttcggagtgaaggggccgatgcggtgggcttccatgccgcgttgggctgattcctcctcgaaaactttccaacgcatccggttggaccaggacgtcggtggaccgctgacgtagcagacccgatggtggcccagggacgccagatgctccaaggcctgaatgacggcggagggcgtgtcgatgaccaccgagggagcgctggtggacgcccggttgatggtcaccagcggctgggtctccgacacctcggccagctgcgcgtcggtcaggcgggaggctgcaaggatgaagccgtcggcagaccgccgcattttgtggagggcttccagctccatctcgctggactcttccgtgtccacgaggagctgcgtgtagccgccggccttgagctggtgctgggtgccacggatgatgtcgaagtagaacgggttggtgatgtccggcactaggacggcgacggcgttggtgcgccccgagctaagtccgcgtgcctgcgagctgggcacgtaattgagttgcgcggccgcttcttcgatccgctccctggtgtagcggttgacccggtccggtttggacaatgcgcgggaaacggttgacgttgccactcccgcaagctcggcaacgtcccggatggttggcactttgtccgtaaccacgcgcctttccggagttcctgcagtccctgttccatccttagtagttgccatggcccggtcctttcatggcgccgccgcggtgcccgttttgatgccctgtgtcctctaattgccggaccatcccctaaatgagagcatctatggcaacttttggcaatcgcttgccgcaacgttgcaccctgcctagactcagtctcgaatcgcctgcagtgacggacgccactagacgttgtggccatgcgggtgtcgaagaggagaaaacaatgaggtttaaatcgtcttccgggctggcagctattgttacggctgcggcattggtgctgacgggctgcggtggtggctcgggatccactgacacccccacaagcgccgacgggaaagtagatggaacgggcaaaaccctgaacgtcctcgtcggtgtattgagccagtacccggaacagcagaagcagtggcaaagcgacatcgcagctaaattcaaggctgaaaccggcgctgacgttaaatttgagaccttcgcctcagccaacgacgaactgacgcgcatccagacctccgttgtctctggccagggccctgacgtctacggactgggcacgacattcacgccaaccgcctttgccaccaaagcatttgtgaccctgtccgaggacgactggaagaaggtgggcggcaaggaccggttcaacaaggctgccctggggatctccggtccggacgaggaacaccaggccggcattccgttcgtcagccgccccttcgtgatggcgtacaacaaagaactgctggctgccgccggaattgagaagcctgccaccacgtgggatgagcttgcggagcaggcgaagaagatgaccaaggacggcaccttcggcctggccacgggctacaaggacaacttcgacccctggaagttcatctgggccatgtccgtccaggcgggcaacccgatcgtggacggtgacgagctcaagctcgatgaccccaccgtcaagaaggcctacgaaacctacttcggctggttgaccgaggacaagatcgttgacccggcatccgtgggctggagcaacagcaacgccgtcgcggcctttgccagcggcaaggctggttacttgatgatgactacctcaagctcccttccgaccctcgagcagtcggccgtcgcgggcaaatacgaatacgcgctgatgcctacaacggcaccgggcgagtcgagctccaagaatgaggacgcagcgagcatcctgtccggcgacaacctggtggtagcggactactcgaagcagaaagacctggctttcgcgtacatcaaactcatcacctctaaagaggagcagctgaactaccagaagatcttcggcgacctgcccgccaacgccgaggccctggagtcgctgagcggtgatgcgaagctcaagcccatcacagacgctgccgccaagtccaaggccacgccgttcacgggagcctggggggacatccagctgggcctgctgaacgtcacggtccaatccgtcccggaccttgccgcgggcaaggtggacagttctgacctcgaagcacgcatcaaggactcgcagagcaaggggcaggcctccttggaccgggcctccaaagggtaagttctgatgtcaactgacgcttccaacgaagtccggcttgcggcggagtccgccgcaagccgggcggcacactctgccgctgacacagcaggccaagagccaagcgggcagaagagcccgcgccgcaaaggcctaagcgaacgcaaccgccccctgtggatgctgatcccgggcggagcgctgatgatcatcatcatcgtcctgccgctgttgctgggcatcttcatgtccaccctcaacctggaccagtacacgctgcgccgctggatcagttcgcccttcatcggcgtcgggaactttgtcgaggcactcacctcgtcgccgctcctccacgccacctggctaagtgtcagctactcgctacttgcgatggttgtcacccttccgctgggcatagctgcggccgtcgcaacccagaacgcgttcaagggacgcgccgtgatccgatccatcttcctgatcccctatgtgcttccatccttcgtggtggccaccgtctggcgcaccatgttccagccggacggcatcgtagacaaggctctggggaccatcggcattgaggccggcctctggctgaacggaccgcagactttctggacgctggtcctggtccagatctgggcctcctggccgttcatctacctgcttgccctctccgggctgcagtccgttgaccatgaggttcacgaggcctcagcactggacggcgccctgtggtggaacaagctgcgctacgtcattttcccctacctcaaggggccgctctcgctcgccttcctgatcggcatgctgcaccacatcaacaacttcacgcttccctatgtgctgtttggggttccggccccggccgatgtagaggtgctgcccatcctgacgtacgtgaccagcttccaaagcttccgttttggactgagcgctgccatggctttcgtttccctggtcctaattgccattccgctgtttgtttacctgcgcgccgtcaagcttgacgacgccgagtcacctggagccaagaaatgaccacctccacagccagcaggatccgcgaagcaagccactctgttccccgccccggttcttcccggcagcacgaagtgacccggctgctgccccgtcccatgctcgcgatcatcctcgtgttcctcggtgccctggtgctgatccccgtgttctatatcttccttgcgtcggtgaactcggacatcggcgtggccaacggtgaattctggccttcaagcttcaccctgcagaactactcgaggatctggaccagtgtggggctggccaccggcctcgccaacagcgtcctggtggcaggggcaacggcaattgtctcggcggcgttgtcggtttccaccgcattcgtcctggtccgctacagcttccggggccggctgaccatcctgcgcgggctccttgcactgcaatctgtgccgggaaccctgatggtgctgcccgtgtttgttctgttttcttcggcctcaacgtacctgggcatccaggtcatcggaacacagtggggactcttcgtcacgtatctgacgttcgccatgccgttctccacctgggtcatggtcacctacctgcgcggacttccacgcgaattggaggaagcggcccggatcgacggcgccagcaacgtgggcgtcctcttcaggatcatcctgccccttagctggcctggcattgtggtctccggaatcttcgctttcctgctgggatggaacgatgttctgttcgcgtccgtgatgacccggccggaaagccagaccgcggcggtggcactgcagatcttcggcgcctcacaggaaggcggcgccatcccgttctatggccagatgatggcggcggccctggtttgcgccgcccccgtggtgattctctacctgattttccagcgttatctagtgggcgggctcaccgccggaggagttaagtaaccatggttccagccacccaggccttttgggccctgtccggattcggcgacgagatcgacgacgaccccgccgttcagattgcagtgctgcaggctctcggcgccaatcacattgaggtgcgaagcgcgtggggcacgaacatcgtggacctctcggatgaccagctcgcggccctcgccaagctgctcgaagaaaagggcatgcaggtttccgcaattgcttcgccgatcggaaaggtggacgtcagcctaccggtggagcacgaggtggaccggctgcgccgggcggccaacgccgccaaagtcctgggcgcgaggtacatccggatcttctccttctactacggcgaatccgttccggtggacagcatccgtggcgccgtcatggaacggatgggcgcgctcgccgccgtcgccgaggaagaaggcgtggtcctgctgcacgaaaacgaaaaggacattttcggggacgtcccggaccgggtgctggacatcatcgaaaccgtgaactcgccggcgctgaaagtggcgtgggacgcagcaaacttcgtccaggtaggcgtgaagccctttgacgaggcctatgccaagctccgcccgcacctggagtacctgcaggtcaaggatgcgctcttctccaacggacatgtggttccggcaggggagggggacggcgacgtgctgcgcaccgtggaagcgctcaaggccgacggcttcaccggcttcgcctccctggaaccgcatcttgccggcgcccacggcctcggcggattttccggtcccacagcgttcggcattgccgcccgggcgtttgcaaaagtcacggcggaagcaggagtaaagacggtatgagtgagacattgaacgttgccatcaccggttgcggcgtcatcggccgcacccacgccgctgccctggcggagtttcccgcggccagcattgtcgcgctggtggacgcgatcccggacgcggctgaggccctggcggatttcatagaaaagagcggccggccacggccctccgtgcacgagtccctccaggaggcctttgccgcagccgacatcgacctggtggcactggctacccccagcggactgcacatccagcagggcctcgaagtcctcgccgccggcaagcacgttgtcatcgaaaagccccttgacgtggacctgagccgtgcccaggagatcgaggcggcagcgaaggaagccgcacgccgcggcgtggtcgcttcggtcatcagccagcaccgctttgaccaagccagcgtcgcggttgcggatgccgtggccaaggggcggttcggccggctgacctccgccatcgcctccgtcgcgtggtggcgcgggcagggttactacgattccggcgactggcgcggcacgtggtcaatggacgggggcggagccctgatgaaccaaggtgtccacacggtggacctgctgctgtggttcatgggccggccggtggaaatccatgcgcacacagcccgcctggcacacgaacgcatcgaggtggaggacacggccgttgccaccgtgactttcgaaaatggcggcctggcagtactgcacgccacaacagccgcttacccgggcctgacggtccgggttcagctgatgggctcggaaggctccgcagtggtggacaacgaccagcttcactacttccactccaaggacgccggcggcgcttccgctgacatggggctgcagggcggaggcaaccaggcccaggaggaactggccaagtaccccgccgaggcttacgaggccaaggaccccacggtgtatccggccggacacatacgccagtaccgcgacatcctcggggccatctcggaaggccgccagcccgccgtcaccgtcagcgacgccgtcaatgccctggccacggtgcgtgccgtctacgtgtcagccacgttgaaccaggccgtgcttttcgacgacgtcctggccggcaagtacaacgacctggaagtccgcaccggcaccacttcgacagaaagcgcctgaacccatgaaattctcagtgttcacagcctctacgcctgactggaccccggaggaagccgtccatcacctggccgcccagggctgggacggcatcgagtggcggatcacagaccaggcggaggcgcccgagcccggtttctgggccggcaacaaggcgaccatcccgctggcgggcctcgaagacaacctggaaagggttgcggccataacgcgcgacgccggcctcgaattttccggaatcggcgggtacgcgcggtgtgacaaccacgacgacgtcgaacgcctgctagcggcgacggcggccttgggagccggccaggtccgcgtcaccacgcctccgcttggaacggccggctgggggaacgaagggccgagcgggattccctaccctgtcctttttgaggcggcccggcacgatttcgaatgggtggttgaacgggctgcccatcacggcgtgaaggcgctggtggagctgcaccaccgcaccatcacggcgtccgcttcctcggcccgacgccttctggagggcctggaccccaagcatgtcggagtaatccatgacctgggcaacctgctgatcgagggccaggaagactaccttcccgcctttgaactgctgggggagtacctggcacacatccacgtcaagaacgccgtctgggtccgcaaggacgagacggacgagtcgggagccgcagtgttccacaacgagtgggcgccgctccagaccggacagggcagtgtcctggcgtacttcaaggccttggcggcacatggctacgacgggtgggtcacggtggaagacttctccactgaactgcccctggcggaacgtactgccggcaatcttgactacctccgccgtacggcggtcctcgccggcctcaccgtcggggccggggcccgttaacgccatggcgcagtcgattgcagcccatcccgaccggctcctgcccgcagaacctggcgtacgggacatagcccgttccctctacaacctggtggccggtcttccgatcctctccccgcacgggcatgtggaggcaggggttatcgaacaagatttgccctttcccgatccggccgccctgttggttacgccggaccactatgtgacccgcctgatccatgccgggggagtcccgctggaccagttgggcctcggcgattcgggcagcgactcacgccggatctggcggcacttttgtgcggcgtggccgcagtttgagggaacagcgtccggctactggatccggcaggaattcgagcacgtcttcggattgcatgaagagcccaatgcggagaacgcagacaggatcttcgatgcgatttcagcaaaactggccgaacccggattccggccgcggcaattgttcaaggagttcaacatcgaggtgctggccaccacggacgatccgctggactcactggacagccacgcagccctggcccaggacccggccttcgccggccgggtcctgcccaccttccggccggaccaatacctcaacattgcgcatccggcgtggcaggacaatgtggagcgtctcattgcagccgatccgggtggttcgggatactccggttacatcagtgcgctggaatcaaggcggcgccatttcgtggagaacggagcggtgtccgccgaccacggcgtccgtaccccggccacccttaagctggactacgccgacgctgaacggctgttcgaacgcgcccgggcggggaaagcgactccggcggaccgcgaggccttcgaagcgcacatgatgtaccagatggccaggatgtcagtggaggacgggctggtcatgacgatccaccccggttcgtaccgcaaccatcacggaccctcgttcgaggcttttggtgcggataccggccacgatattccgttcgccgtgaactacaccgaggccatccggccgctgctgcaggacttcggcaccgccaaggacttccacttggtactgttcaccctggacgaaacggtgttctcccgggaactggcgccgctggcgggcttctacccgtccgtgtatatcggcgccccatggtggttcttggacgcgccggacgcgatgctgcgtttccgtgccgccgtcacggaaaccgccggtttttccagatcctcgggtttcatcgatgacacgcgggcgttctgctccattccggcacgccacgacacgtcgcgccggatcgaatcggccttcctggcacggctggtggccgagcaccggatcagtgaaaagcgtgcacatgaactgatcgtggacattgtggatgcttccccgcgaagggtgttcaagctgtgagcgccggcgacgtgcccgccctggaccgcacgctggtccgccttcctaaggcgccggtccggattgtccatcttggactcggggccttccaccggtcacacgaggcctggtacacgcaacatgcgggtgacggggccgactgggggattgccgcgttcactggacggcggcccgatgcggcgctggcgctggcggcccaggacggcctgttcacgctcgtggagcgctcgggagacggggactccttcgaagttatcggaagcatttccgaagcggtggacggcgccgacgtccggcgcctccgggagctggtctcttcccctgaaacggtgatggttacgctcaccatcaccgaagcagcatatggaccggactccaacggctcttttgacgccgaggctgccggttttgccggagatcttgctgtgcttgcgggctccgcggctacgggcggaaagctgacgacgccgttgggccggctggtgtggtccctcgccggccgcagggaagcggctgcggggccggtcgccgtcgtcagttgcgacaacctttcgggcaatggagacgttgcccggcgcgccatcaccggtctggcggaggcctgggacccggaactcgcactgtggatccgggcgagcgtcagttttgtcagcacctccgttgaccgcatcacgccgcggaccacggacgccgatattgccgaggtggaggagtcctgcggataccgggacagttcgccagtggttgcggaacctttccggaactgggtcctgagcgggagtttcccgaagggcaggccccgctgggaggacgccggcgcggttgtggtggacgacatcgaaccgtatgagaaccgcaagctgtggctgcttaacggcgcccattcgctcctggcatacgccggccagctgcgggggcacaccacggtggcccaggctctggaggatccgctctgccgggatgccgtcgagtccttctgggacgaagcggcgcaacacctggcgggcggggagctgcggattcccgaataccgggaggcgctgcgagcccgtttcggcaacggacggatcgcgcaccacctgtcccagatcgccgcggatggttccaccaagctccggatgagggccgtgccggtcctttcggcggaaaggtccagtggccggtccggttccggcagcgccatgatgcttgcggcctggatcgattatgtagccggacagaaagacctccaggaccccctgtcggacgccatcgccgaagcgaacggagctgacggggccgacaggacaggcatcctcctcaaccttgtcagcgaggggctgggggaggacccggaaatcgtcgccctcgtaacccgcctgtgcggcaccttcaccagtgacgccaacgctctcgcgtccgccacagacacgcccgcccacttaatttccggaaggaacagctgacttcaatgaaaatcgttgcagcagaagtatttgtcaccagcccgtcccgtaacttcgtgacgctccggatcaccaccgaggatggtgtgacgggtattggtgacgccaccttgaacgggcgcgagctcgctgtggccgcctacctcaaggaacacgttgcgcagttgctgatcggcaaggacccgcaccggatcgaggatacgtggcagttcctgtaccggtcctcgtactggcgccggggcccggtgaccatggctgcgattgctgccgtggacatggcgctgtgggatatcaagggcaaattggctggcatgccggtctaccagctcctgggcggggcatcccggaacgggctgcgcgcctatggccacgcctcgggagctgacctgccgtccctgttcgattcggtccgggagcatctggagctcgggtacaagtccatccgcatccagaccgccgtccccggcattaaggccgtctacggtgtggccgcgcaggcccaggcctcgggtgagcgctatgactacgagccggccggccgcggcgcgttcccggtggaggaggactgggacacccgggcctacctccgccacctgcccaccgtgttcgaggcggtccggaacgagttcggcccggagatcccgctgctgcacgacggccaccaccggatgacgccgatccaggccgcgaagctgggcaaggcgctggagccgtatgacctgttctggctggaggactgcaccccggcggagaaccaggagggcctgcgcctggtccgccagcacaccaccaccccgctggccatcggtgaagtcttcaacaccgtgtgggattaccagacccttatcaaggaacagctgatcgactacgtccgcgccgcgtccacccacttcggcgggatcagcccgttgaagaaggtgatggacttcgccgcgcagtaccagatcaagtccggcttccacggccccacggacatctccccggtgggcttcgccgcgcagctgcacgtgggccttgcgatccacaactacggcatccaggaatacatgcagcactctgacaagaccaacgaggtcttcgagcagtccatggcgttcgtggacggctacctgcacccgggcgacaagcccggcatcggcgtcgaattcaacgaggaagccgcggctgcgttcccgtaccagcaggcctacctgccctacaaccgcctcatcgacggaacggtccacgactggtgagtacccttccgtccccaacagccgctgcgggcgccgccggccacgccaagctccgcgtggtcgtgatgggcgtctccggctgcggcaagaccaccatcggagacctcgtggcccggggactcggcgtcccgttcctcgacggcgactccctccaccccgtggagaacgttgccaagatggccgccggcacacccctgacggacgatgaccgctggccgtggctcgccaccgtgggcactgaactggcaaacgcgggcgacggcggcatggtcctggcatgctccgcgctgcgccgcagctaccgcgacgccatccggcagcatgctccggacacggtcttcctgcacctgcacggcagcaaagatgtcctgagggcccggacggaagggcgctccggccacttcatgccgcctgccctcctcgattcccaactcgcgacgctggagccgctcggggccgacgaagccggcatcgtcgtggacatcgcggcgcccgtgcagcaggtggtgcgggaggcactcgccgggattgccgccgtcggccgttccacagaacgaagtgcaggaggtgccgcgggcacccagccccgccagttcgacgtcgacctccaggccccgccgttcaatctcgacgacgacgccgtcgcctgggtggaatccaccctggccggtatgagcctcgaggaaaaaatcgggcagctgttcatcaaccacaacaacgactactccccggagtacctcgacggcgtgctggagaactaccacgtgggcggcatgcgctaccggccagggccctcggctgcggtgcaggaacacatccggtacgcccagtccaggacccggatcccgctgctggtagcgtccaacccggaaatggggggagccggcagctgcgacgacggcacgttcgtgtccacgcacctgcaggccggctcgcacccggacaaggccatcgcccggcagatgggccaggttgccggcgttgaaacagcggcgctgggctgcaactgggcgttcgcgcccatcgtggatatccactacaactggcggaacacggtcatctccacgcggtcattcggcaacaccccggagatagtgctggagcgcgccaaggagtatttcgacggcatcagcgactcgcccaccgcctgcgccatgaagcatttcccgggcgacggcatggacgaacgcgaccagcacgtggtcacgtcctacaacacccttggctacgaggagtggaaccggacctacgggcacgtgtaccgcgaaatgatcggccacggcgtgcagtccatcatgatcggccacatcggggcaccggaactttcccggcacttccgcccaggcatggcggacgcggacatcctgccggccacattgtccccggagctgctccaggacctgctgcgcggggagcttggcttcaacgggctgatcctcaccgacgcctcgcagatgatcggcctgacccaggccatgaggcgcaaggacctggtgccggccaccatcgccgccggctgcgacatgttcctgttcttccgaaaccccgcggaagacttccagtacatgatggacggctacaagtccggcgtcatcaccgggcagcgcctgcatgacgcgctgcgccggatcctggccctcaaggcctcgctgggcctccacaaggctgcccgcgaaacgctggtcccgccggcggaagcactgggcgtgatcggcagcgacgcgcaccgggccattgccgcggagatcgcagacaaaaccgtcaccctggtcaaggacaccgccggcaacctgcccatcacgccggagacacacaagcggatccgcctgtacggcatctccggcggcgccgacttcacgcgcgcggacccgctcgcctacctggacaccgtcaaggaggaactggaagccgccggcttcgaggtgcacctgttcaagacggcggaccagcgggaggccgcaggggagaccggcgtgaacttcatgtcggtcatttcggaggaagccaccggggactatgcggacaagtatgacgccgcttttgtgttcgccaatgtgaaggggttcgcccaggaggcggccatccggatcaagtggtccactcccatggccgcggagatcccgtggtatgtcaccgaggttcccacggtattcgtctcgcttaaccagccaaaccacctgattgacgtacccatggtgaagacggcgatccacgcccacgccgggtcacgcgaggcaatccgggccaccatcgaaaagatccagggcacgtcggaattccagggcacattcaatgacaacgtgttctgcggttccttcgacaccaggctctagaccaggggccgccgtcaggggggactttggcgcggacacgccggcaagatggccgccgtcgccgtacatcatgcccaaagtgccccgggaacgcagagaacgcaaaaaagagaaagcgtggtgcctagatccacgtgggtgcggcgggggtgccctgcgccgcgcccggtccggtggccgtgacgccttgggagccgcggtcggcggcccatccgacgacggcgggcagggtcccggtggcggtcgtcgggttagcggcgcccacatcgccgaacgccaggtccgtgccggtggctttgaccaggagtccggtgtcggtgccgccggtgtgccaggcgccggtgatgtctttgagcgtcggcaacgagtcaggttctggacagtgtccagggcctgacttcgctaggctgccttcaggccgtcgtcgtaaacccccgtcggcgtaacccgccggagggctgaactggtcaggtggccgattcgctcctttggctgtacaagcggccgaaccgctggaggtacaggaacactccaaggaatgcgatgacacccagaagcggcccagcccagatggcaaccggcgtgccgcggacaagtagtgccccggctccaaaaatgcttccaagaacaccaacaccgggaccggcagtggcaagcctgccgtggatcttccggccaacctggcggtaccggacactgtgcaggacaacgacgaggatgaaggctccacccatgaacagaggccaaggccaatctgccattgccacaacgcacagggtgagcccgtacgtggctgtcagggccagccagtagttccttccgacggcgtcattgttcatcagtagccccggctgaaatcgaagctgtacaacatgtgtcccccacgacggatttcacacactctggtgagtgggtgatctgcaacgcccgttggtgcggcgcctcagtcggggccagactatgaatcgggcagacgtggcgcaagtcaggcggactctgcgcttctgagaacccattgcgctccggggactctgagcgccggccctggccctagtcgccttctgcatcgggtccctctgcaccgggttacgcctcgccattgcgtccgtccggcgcaaagacaaaggccctgcttcccttggttatcaagggaggcagggccttctaattggcggtgacggtgggatttgaacccacgttggcttttacaccaaacaacatttcgagtgttgcaccttcggccgctcggacacgtcaccaacctcaatagggtaccggagcaaggcgtgcatccccaaaacgggattgtcgggaggggctcccgctgccctgaccaagaggccggaagagatattcaaaattcttttcagccgggtgcactgggcaccttaaatgtcagaccctcgcacgaggatggatttatggaaaggaatccggtggtggaggcggaggcggcagttgacgcttcggtggctgcttttacggcggtgctcgcgggcggctgtactgctgcttccggtactgctgtttccgggtcgccctatttcggtgttgctggtggcgctgatgatgatccgttgcagcgggttgctgatggggcgttggatgttcttgccgggctggcacgggccgaggcgaagctggcggcgttgaaggcgcaggcggtggaggtgttcgccgccgccacgagcctgttgaacggtccgccgtcctcaccgcatgaggccacggcccaggaccggagcctggtggccgaggtcggatgtgcactggtgatcggcgaccgggccgccggtgccctgttggccgagtcccatgccatgaccacgtccctgccccggacgctcgcagcgttgcagggcggttcgatctcctgggcgcatgcccgggggatggcggacgaggcagccaccctcgatcccgccggggccgccgccctggaagcccacttcctcgaccccgacaaaccaagacccgccaccgcggccacgatcggggaaatgcccccgcaccggttcaaggccaaggcccggacctggcgggaacgccatcatcccgaatcgatcgagaagcgccatgccaagggcctggcggaccggcgcgtcgagtacaggccggaccaggacggcatggcctggctctccgcctacctccccgccgaccaggcaatggcaggctggaaccggctcaacgccctcgcccgggccgcacaaggaccccacgaaccccgcaccctcacccaaatccgggccgaccacttcgcccaagccatcctcaccagcggcaccagccgcggtaatggtgacagttccagcctccgtggaggcggcagcgccggaaacggcgacagcgactgggtgggtaacggctacggtgtcggggcaggcaacagggacggggcaggcgcaggaacggctgccgggccatcttcttccattcgggcgcaggtgctcgtcaccgtgccggtgttcgccctcatgggcctgacagacgagcccgccatgctggacggatacgggcccatcccgccctcgatggccagggacctggtcgccagcggcgccgactcgttccaccgggtcctcgtcgacccgcgcgacggggcgccattggagatcgggcggaccagctaccgggtcaccaaagccatgcggaactggctaaggatgcgggacggcacgtgccccttccccggctgcagcaacagttctttggacaacgaagccgaccacctcctcgcctggcagcacggcggaaccaccgggatcagcaacctgggacaaccctgccccagacaccacaaactcagacacaccaccggctggacaccaacccaggccacccacaacgaaccacccggctggacctcaccgtccggccgccattacaaaagcgaacaccaggactgggaaccaccccactggccgcaatctgtcatgtcggccctgccggcgggcttaagaatccctgatgacctttccgaagcctggcctccgcctgatgagctcttgcagcaacgccattttcctgacgacctttccagcctcaggctttctgccgacgatgtcgccttcgagaacctctttccccacgacgaatttccggaagacacctttgctgactggttcctgcccggataccggcagcctaaggacccgctgtccgaagaggcctggtgggtggtggctggcgaaggaactgcagccactccctgatggggcggggcgcggaaccaatagctggcggttacgaaagagcaatacggtccctttcatggcggcaattgcgcgggccttcagtcgcgaggacaaagccaactttcgccatacatgccgggagggctagattcatcagcaagatgactaatcaaaccggtcccacgcacgcaaccgcctactggacaacggccaaggaacacggcgagctccggactgaggaccttcccgcgccgggcccaggtgaagccctggtgcgtaccctgtactccgggatcagcaaaggcaccgagatggtggtccatgccggcgcggtcccgccccgggtggccgaggagatgcgggctccccgccaggagggcgagttcccgggaccagtgaagttcggatacctgtccgtgggtattgtcgaagaagggccggagggttggccggggcagcgcgtcttctgcctcaatccacatcaggaccgttatgtggcacctgtcagttcactcaccaggatccccgacgacgtaccctcctcccgcgcagtgctcaccggaaccgtggaaaccgcggtcaatgcactgtgggaggccggcccgcgcctgggggaccgggtagcggtggtgggcgccggccttgtgggcggcatggtggccaccctgctgaggacctttccactggaacgcctgcaactggtggacctggaccggggccggaagcacttggcagacaccctcggcgtcgattttgcccatccggatgatgccctcgccgactgcgacgtcgtgtttcactgctcggcctcgcaggagggattggcgcggagcctgcagctcgcgggcgacgaagcggacgtcattgaaatgtcctggtacgccaaccgcggggtaaccctgccgctgggggaggacttccatgcccgccgcctgtccatcagggcaagccaggtgggagtggtggcacgagcgcgccggcaccgcaggactaacgccgaccgcctgaacctcgctgtatcgctgctgaaggatccggttttcgacgccttcctcaccggcacctcgccgttcgccgaactgcctggcgtggtgcaggacctcgcggacggcaacctcaaagctttgtgccacgtcatcgagtaccccggcgacgaaaactccaagaacccagcccgagaagaccagaggtaaaccatgttcagcctgaccgtccgacgccacttcatgatcgcccacagccttccgcgcaaggttttcgggccggcccaggccctgcacggggcaacgttcgtcgcggaggtggccttccgccgtcggacgctcaacgacgacgcgatcgtcctggacatcggcgccgccggaaccatgatcgaggaggtgctggcaggcctcaactaccggaacctggacgagcaccccgatttcgagggcaagctcagcaccacggaagcgctggcagagtacgttgccaggtccgttgcagagaagctgaaggatgacgacgacggcggccagctcgccggcatcgacgtcaccctgcgcgaaaacccggacgcctgggccacctattcgctggaccttcccgccgcctgatcccatggaccgcatccgcctgctggctcccggcaacatccaccatcattccggtggcaatatctacaacgcgcggctggtgcaggggctgaaggtgctgggagtgaacgtcgaggtgctctctgtcgaaggctcctggccctatgccagcgcccacgcccgacgccggctgggcagcctcctcggggcctgggaaaccggaagcgaagtgcaacaaccgcatacggtgaccctcgtcgatgggctcatcgcgatgggcgcaccggatgaactggaattcgccgccaaggccggacgcaaaacatgggtgttggtacatatgcctgccccggcacatccggagcttgaagcgcggtccctccgggctgccacgggtgtggtgtgcaccagcacctgggccagcaaagtcctggaaaaacgccacggactccacggcctcaaggtcgcactcccagggaccgacccggcgccgttggctgaggggtccgcgccaccccacatggttattgtggccgcgctgctgcccaacaaggaccagctactgacggtctcagcgctggcactgctaaagaaccttgaatggaccgcatcgtttgtcgggtcagaccaggcagacggggattacgcacaaagggttcgagctgcggtaagactgcacgggctggacgcgcggatccacttcaccggtgagctggccggtgaggcactggacagcgaatggcatcgggctgacctcagcctcctggtgtcccgtgccgaggctttcggcatggtggtcaccgaatcactcgcccgcgggattcccgtggtggtgcgcgatggcacgggcgccgtcgaggccctgcgcctgggaacagcggggaaggacgacgacggcggcgcgcttccgggagcgaaggttgccttttcggcggatgacgatcccgcgaatcccgccctgctcgcccaggccctgcggcgctggctggaagaccccgggaccagggatgcctggcgggatcgggcgctggatgcacggagcaggctgccgggctgggagcagccagcggcccacgtgctggcagctatccggggtaatagtcactgacagcccgggcgtgaatcagagccgcgagcggtgcccggcgaagaactcacgcagcaaggcggcgcactcggcctcgcgcactcccgaatacacctcaacccagtggttcaagcgcctctcacggagcacatcgaacaccgaccccgcagcccctgccttctcgtcccaggcaccgaagaccacccgggggattctcgccagcacaatcgcaccggcgcacatggcacagggttcaagggtgaccaccagcgtgcagtctgcgagccgccagccgtctccgctgccgccgtcgagcagggaaacctggcgcagccgttccgccgcctcgcggatggcaaccacctcggcgtgcgcggtggggtcgcccagctcttcccgctggttccgtccggaacccagcactgcgccgtcgggcccaatcaccaccgccccgatgggcacgtcctcggtatcgagggcgcgccgggcctcggcgagggcaaggcccatccatgcatggtgtttcttatctgcggagaccatggctcaatgatagtttcgatgaatacccagagcccgtgacgcacatccgccgggaggcacagtgagcacagtccgagaccgcgtggacaagtggatcaagccgtatgccgccttgtggctgaccatgatcatcggcggaacgctggtgatcgccttggcgctcctgggtgccgaggtctactcggacgtggtggacgaggaaggcctttcgagccttgatattcctgcgctggaatactcccagtcgttgcggaacccggaggcggatgccttcgccactggcttcaccaacgtaggcggcgggattggcatgcccatcctggcgagcatcctcaccgcatggctgaccttcctgagcaggacgtggcggcccattgtcctggtgggcggcgcagcccttgtgtccaccctggccaccaccctgggcaagcggctggttggcaggacccgcccggaccactccgaggccgtcccgccgttcgagacctcgccgtcctttcccagcggccacaccctgaataccactgtggtgataggggtcctggtctacctcatgtgcctgcagttccaagtgctgtgggccaggattgcggccatcacggtgggcacgatcttcatcgtcgccatgggcctgagccgggtcttcctgggacaccactggatgaccgacgtgatggcgggctggttcctggggctggcgtgggtgggcatcgtgatcctggcccacaggctgttccatgtgatgcggcggcgcgaacacgcaggcccggcgcccacatttgaacatccggtcctgcgcgaggaccactccggggacgcggaaggcaccaccggtaccgccccgaaggagaacgacggcggtgccccgccacgggtcgacgacggcgcttcccagcccggcacgggccgcgggcggcgggggagcggcccggcggccgggtgatagttttgacccatgcgcactctcgttgtggaccacccgctggtcgcccataagctcaccgtcctgcgggacaagaacactccgtccccggtcttccggcagttgacggaagaactggtgaccctccttgcctacgaggccacgagagaagtgcgcaccgagcccgtcaccatcgaaacccctgtcagcacgactgtaggcacggcgttcaccaagcccactccgctggtggtccccatccttcgtgcgggcctgggaatgctggagggcatgaccaagctggttccgaccgctgaagtgggtttcctgggtatggcccgtgacgaggaaaccctggacatcatcacctacgccgagcgactccccgaggatctcaccgatcggcagatcttcgtgctggatcccatgcttgccaccggcggaacactgcgcgaagccatcaagttcctgtttaagcgcggggcctcggatgtcacctgcatatgcctgctcgccgcaccggagggcctggccaagctggaggaagaactctccggcgcaaatgtcaccatcgtcctggcgtccatcgacgagaagctcaacgagaagtcctacatcgttccgggcctgggcgacgcaggcgaccgcctgtacggcatcgcaggctaggactcaagccttcccgcttcccgccgcaaggcttagcctgagcgcatggactggaaactggaactcgtctttgtccccgtgtccgatgtggaccgggccaaagacttctacgtcaacaaggtgggcttcaacgccgatttcgacgagcgccccagcgacgccatcaggttcgtgcagctgaccccgccagggtctgactgctccatctgcatcggggaagggctcacggatgcgccgccgggcacaggctcaaacctgcagctcgtggtcaatgacatccaggccgcccacgcgcagctgaaggccaacggagtggacgtcagcgatgtggacgtgcaggactggggccactttgtgtactttgccgatcctgacggtaaccgctgggcggtccagtacatcccgcgccgggacgaactggaccgcgaggggaaacctgcttcggtttagtaccagttgttggcgtagtggaagttcagcgctccacacggggactggtagcgctcctggatgtagttcaggccccagttgatctgcgtacggtaattggtgcggtagtcggcgcctgcgctggccatcttctcggcaggcagggactgcacaatgccgtaggcgccgctgctcgggttggtggccgtggtggtccagtctgattccttggtccacagggtctgcaggcactgcatctggtccgcagcccagccgtaggaggccagttggccggcagcgtaggcctgggcgcctgcggggtcgttaaccgcgacgacgggcgccggctcgggagccggagcaggcgcgggttcaggcgcaggagcgggtgcaggctccggggctggcgcaggtgcgggctcagcagcgggggcaggcgccggttcggctgcctgcggaacaacgttgatcggctcggccgcgggagcgggcgccgggttctcctggatttcgcttcgctcaatgctcagcttcgactgtgcctcagccgcctgggtctctgtggcagccacctgcgcggtatccgtggcttggcctgccgccccaacgcccacaaggagggcgccggaggctgcgaggatggcagcgcgctggccgaatgacggaattttgcctgacgtgcgcggggcacgggcttcggagcctggtttcgggcgtgctttagtaaggaacttagacatgatggatcgcctctcacacctgcggagttagctgtcgggttcggatgagggcatccggccacacggaaagatcacgtgctggcttaaccccaagggcagttgaatgcccgggactgttgggtcccccgcctctgcctatgctcaagcggaatccgggaagcggcagagcttggcgtcatccggatatgcggcccgaacgggaaccgcacccaatcgacggtacaggagtgcagcgcttaagtcacattttggtaacagggatcacgtcgacggcgagccgccttgcgcccgtccctgcggcaatgggagctggagcgcgaactgggtgcggccgggctgtgatgtcaccgtgaccttgcccccgtgggcctcaataatcgactcgacgatggacaatcccaagccgctggttccttcagcgccagatgcgccggatccgctggctttgcctgcccgcgccgcgtctgcgcgggcaaaccgcgcgaagacctggtccacgaactccggcggaatgcccccgccgtcgtccgttaccgttaccaccgcggcacccgccggcgtcttcccaacgccggtgaccacggtggtccccggaggcgtgtgcttgcgcgcgttggacagcaggttcatcagcacctgccgcagctgggacgggtccccgtccaccacaacaggctcgtcggggagttccagccgccaggtgtgcccgggcgccatgaccttttcgtcgctgacgccttccaccgccagctggttcaggtcaacctcgctgatcttcagaggctggccctcatcaagccgcgccagcagcagcaggtcctccaccagtgacgtcatccgctgggactggctttgcaccctggccagcgatttctccccgtcaggtgtgaagtgttccgtcatccgcatcagttccgtatagccgcggatggctgtcagcggtgtgcggagctcatgggaagcgtcggccacgaactgccggaccttggtctcgctcctctgccgcgcctgtagcgcgttggccacgttgtccagcatcaggttcagcgcgtggcccacgctgcccacctccgttccgggattggagttcgacggcggcacgcgcacggcaagcgccacctcgccggcatccagcggcagctttgaaacacgggtggcaacctcggaaagctgctcgaggggcttcatggtgcggcggatcaggacggttcccactaggccgatcaggagaaggccgccaagcgagacgaaaacgaacgtccacaccagcgacgcgagcgtgctctccttggccgccaggggaagtcctgtcaccaggacgtcaccaaagtttgtctggatggcaaccagccggtagtcgccattggaaagcgtcctgtccgccggctgcacgttggtgggcagggccagcagggcctgtttgtcctccgtggacaagggggagcgcgtggtattcgaggtgaggaaaccgccgctgttgacctggccgttgaggatccgggcgttgagggttccaacgctctggccgcgggcgtccaggggatccctgccgttgaagccgcccgagggagggcggccgggatcgttggaacgggctgcggcctggcttagctgctcatcgagttgccgggtgaggaacgcgtccatcgacgcatagctcgccacgccaaccgccccgcaaatggcaatcagcagcgtcatggccaggaggataaggcgggtccgcaggtgccaggtgacgggcttcagccagctccggggctgcggccccgtactgtgcgcggacgccatggctttcctactccgccggcttgatgacgtatccggcgccccgcacggtgtggatcatcggcgggtggacggcgtccacctttttgcgcaggtacgaaatgtagagctccacaatgttggcctggccgccgaagtcgtagtcccagacccggtccaggatctgcgctttgctgatgacgcgcttggggttttccataaggtagcggagcagctcgaactgggtggcagtcagctggagctcttcacccgcgcgggtcacctcacgggtgtcgacgttgaggaccaggtcccccaccacaagttcagcggtgtccatcgcggccacaccggaccgctggaccaggcggtgcaggcggagcaggacttcttccatgctgaaaggcttggtgacgtagtcgtccccgccggccgcgaggccaacgatccggtcctggaccgcgtccttggcggtgaggaacagggcgggaacctcgggcgcgaaggcacggatcctgcccaggacctcgacgccgtcgaaaccggggatcatgacgtccaggaccagcacgtcggggcggaagtccttggccactttcactgccccgggaccgtcggcggcaactgccacggaccagccggccatgcgcagccccatgctcatgagctcggaaaggctcggctcgtcatccaccaccagtgccctgataggggagccgtccgggtgggtgagcctggggaggttgtttgtcatggagtgcgaggtggccatggaacaactctccgatcattggtttaagcccggctatggcgttcctgtgcgcaagctgtgaatcccagcctagcgaggtgggtccgcggagggtctcacgcgtggagtctgcacgctcgaggccgcccgtccccgggtactcaaacctcagctcatatcgatctctcaacgccgtgcggccgctcatcgcacaatttttctgtccaaaagcaggaggggctggacacgccatcatggccaggaacgagattccgctatcagacgccctgatgaacgaaaataccttatgaaggtctttgatcgaataatattctgtgaagtatcctcaaacgggctgattgccggataacaaccgttattttttacagcgcccagaattgtgatttgagacactatggcggaatttgtctcattatgcggacgatcgagtccattgttacttgcaagttgccattgttacgctgcacacttccaatgtgaacaagaactcaacagcacctgcagccgcagaatattggcccagcacatccgctgctgccgacatgcgctgttgtcgaatgcacgcctgaccttcccacccttcgaagttcttaggcattcgcccccagcccagcgtcgggcgcccctccccagttcgcattgcggggattcccagcattcgggccgtgatgacggccattcacattgaggtaagcattccatgtcagttgcatccggatacgtccacatttctgtccgtaacgccgccaaggccggccagccctcgggcctccgccccgggtttggaccgcgccccgccctggctccgtcatcatctggaagcagcttcccctcccagggttacgcgccgcaggggttcaaccccaattcctacgggcaactccgtgctgtcccgcctgcggaggcggcacccctgaccgcccccactccggtggtggccggtcccaacaccgtccggcccgtagccaacgacaacgttgcccgcggattcgtcctctacatgggcatcgacgaggagacggcggcagcggccggaacctccatcgccaaactggcccaggagatccgcgcctacgcccagtccctggtgtccggcgccgaaagttacgcagccgttgccgttgccccggccggcacacccggttccgcgctcgacgtcgtccgttccaccttcggtgaccccaccgtcaacgcccgccagcgcactgaggccccgcgtccgtcgcaggcacaggagccgcgcccgtccggcgtcctgatcgacttggcccgccgtgaagtccacctggatggcgaatcgctcaacctgacgttcaaggagttcgagctcctgaactacctcgtggagaacggcacccgcaccgtggggcgcgacgagctccttgaggggctgtggcgcaacgccgaagaggtgcccaacgagcgcaccatcgacgtccacatccgccggctccgctccaagctgggccgcctcgccaacactgtgcgtacagtccgcggccaggggtaccggttctacgagcaccccgaagttgttgtctgggccgctccggaatactcgatctagcactcactcggaagcgcctgtcccatcggggcgggcgctttcgctttcgcggcacgatccctcggcgcgtgcgctggttccgccccctccctcggccccgcaagcccggccagggaagcctcgcggcgtcggcccggcgacaacggcgctttcgggatgtgccgctgcactgcagcgcccttctggccaaaccgtctcctcgcgagagactcgccaggcattggcctccgctgcattgggagtgtgggtccgcgtcacatagggcctgcttttgaggacgtggacttgggaaaagcctgatatggccaggatcctgttcccgatttatggcaaaagcatgccccgcgtgacggttcctggctgccgggttgctcgcgaatgccgcggtcctggcggggaactaggcttggggcatgagtgagcaccatcttcgacggcttgtgatcatgcggcatgccaaggccgactggccgggcggggttgctgaccacgaacgtccgttggaggaaagaggccaccgcgaggcgccccttgccggccgttggctgctcaagcacaacatcgtgccggatttcatcctctgctccagtgccctgcggaccaggcagacctgcacgtgggtttgctcggagctgggggataaggcccctacgcccaagcttgaggacgggctgtacgccgcgtctgcgctccggatgctgactgtcatcaaccatgttccggatacagtcaccacgctgatgctgatctcgcacctgcccggcgtgcaggaccttgccatgcaccttgcctcacgcgattccgaccacgacgcctacatggacgccgccacccggtaccccaccaacgccctcacagtcctcgagaccgaaaagtcctgggcagagctggacggacaggatgcgcgcatcaccaggttcaaagtcccccgcgcgcactaaccaaggaaactgaactgccgggtacgatcatgccgccaaggctcgcttggggcgcttggggtcaccagaggtcgcccgtgtccccgccgggggaacaacgcgcttggggtcaccagaggtcgcccgtgtccccgccgggggaacaacgcgcttggggtcacctgaggtcgcccgtgtccccgccggggaacaacgcgcttggggtcacctgaggtcgcccgtgtccccgccgggggaacaacgcgcttggggttaccgccggggcgcggccttagcgcccgttgccgacgacggcttcccggctggagaggccgacgacggccgcctggcaggcacggacggcaccctcgcgggtgggcggacgccgcctgtgccctgactgcctgtgctctgactgccggtgcctgcaccggctgcgcctttactgtctgtgcctctactgcctgtggctgcaccgcctgtgcgcgctgccggcctgcgctgggccgtcgccttggcagccggccgggccgccgtcgccgtacgtctgttctccgctgcgcccctgcctggcctgccctgcccttgcctgcttttgctggccgcggtgcgcagacggcgcccccgcggccaggccgcaccgaggaacaggacaaagagtgtggccagggccgcagcggcagcaccgaaaaagtagttgtccggatccccggtggggagcggggtgccaaagaatgagggctcgccggcaaacgccagctcccacgtgctgacaaacgcaaggaagaaggcgacggtaaggctggttccggcgccggcagccagcagggcaaagcggcgtccccggttcaggatttcgataatgcatgccaggcacgccagcgccagggcaccgaggaaagccacgaataccggctcggcgagcgtcattccggtcagcaccaggaggccggccgccacgataccggcaatgaccgcgaactttccgcttttccccatacgctccatcatccccgaggaccgggccgctgcagcacgtagccgcgcatgatggccatgattgccgcaacgctttgatcacgggtgcgctcagggtggtacgtctgacggtcgagccccacaacaaagcaggcaccgaagattgcggtttcgaggctgccccgcgaaacggtgctgtccacggggtaggcctgagccaccctttccactgcctgcccgatcacttccagcagctcgccccgcaggacagcgaacgtgccctgccactcgctgggcgtacgccagttctcgctgacccagagccgggcgaaggaaggatattcggacatgaagtccagggcctgcccgatcattgcctccatctcgagcagggggtccgcagacgcggcggtggcagccctttgggccgcgctctcctgccccgagcccacctggattggcgccttctggcccggcgcttcctgcaggcgtgccttcaggatgtccaccccgtggcggagcagctgcgcaatgagctccgatttgctgccgaagttgtagtagacggtccccttggagacgcccgctgccgctgcgatctcgtcaacagtgacccccgctgctccccgctcgccgatgagttccatcgaggcgtcgaagagtttctggcgggtggcggtggtccgggcggggcgaagggtcttcacggctccggctggttcggcggtcataccgcgatctcgggtttcagcgtcttcagtgtccagtacttgttcctgagcacggccaacgtggacatggccacgcccagggcggtgtagcctgccaggcccaggacggtgggggtgatcatggacagctcagcgccataaatgaggtgcctcatgccggtcaccacgtagcccatggggaggatttcatgcgctgcgtggagcggctgcggcgtggtctgccaggggaaggtgcctccggaggagaccagttgcaggaccagcagaatgagtaccacgagtttgcctggcgacccaagcagcgcaaccacgccctggatgatcgcactgaatgccatggccgcggcgagcatgaacagccacatcagcaccggatgcgcggggtcgagtcccagggcgaggttcaccaccagggtgaggaggcttgcctgcaccaccgaaaccgccaggaacggcagccagccgccaaccgcgatcttccaggacggggcgttggaggccagcgcccgctgggtaatgggacgcatggcctgcaccaacatgaaaatgccgatccacaaggcgagggtgaggaagaacggcgccagcccggcgccgtaggactcggccttggcctgcgagacgttgctgaccgcaacgggatcggccatgacgcgggacaggttgctcttctgggcatcatccgggttgggcacctgcccggcgcccttgccgatctcatccgccagggtccgcgaaccgtccgccgccgtgacggcgccttccgccagctgggcagccccgtcgtctacctgtcgggctccctccgccagccggcctgcgccgtcgagggccgcctgctcgccggtggccagcgcggccgccccggtgtggagctggtcggcaccggaggaagcttgggagacggcgtcccttagggcgggcgtgcccgccgcgagctgcgcagcgccggcgctcacagcttcggcgccggaggccagctgctggatctgcgctgcatctgcctggatcttcgtcctggcagctgccaccgggctcgaaccggccgcggcgtcaagatcctccaggatcctgtccgcctgctcctgggtcaggacgccttctgcgatgagcctgctgttcgattccaccacccgtgcccggagcccctggtcagcggcatccagctgggctgcgacgtcctgcactttggtgttcagctgcgcgtttccggcagcgacctgtgacgccccattggcgagcgtctgggtgtctgtgggcagcgtggcggtcttgtccttgagtgtggacaggccgctgctgagctggcccgcgccgtcggtcagctggctggctccatcccgcagtttcacctggcccgcgtacagctcgcccgctccgctgctcagggttgaggtgccgtcatggagtgtggccgtcccgtcgcgaaggtccgcaacgccgtcggccagctggccggcgccctccgctgccttgaccatctgtgagtggatggtcccgaagcccgtcagcagctggtttgccgtttcctcgcccacctctgtggccaccgtgctgtgcactgcggtggtgagcttatccacgatggtgctcagcaggtagttgttggcatcgttggtggtgacgttgagcatggcctggctggcggaatcaaagctgccaggggataccaggtttgccgaaaagtcctgggggattttcagggcgaaggcgtagtccccgctgctgacaccctggtccgcctcctgtgctgtggccacggggatccagtggaaaacattgccgtccaccaggctctccgccaccttgttcccggcttcaagacgtgtgccgtcgctggtggtggcgccggcgtcctccatcaccagggccgcatcgaggttgtccaggttgccgtaggggtcccagtttgcgtacaggtacaccgccccatagagcagcgggaccatggtcagcgcaaggattgtgagcttgggcatcagccctgcggtcatgcgcttaagttcggagcgggccagccgcagtaccgtcacgtggcaacctcggtttcgagttcagtggtgtttgcggcatccggtacgccgccctccgcgcgcttgggggattcaagggggacggcattgccgatggcggcggcgggtccgtcccacgacggcgggagggcgccaacagtggcgacgacggcgagcggccgtccggcgtcggacgccagacgctgcagcctcggcagccagtcagcggcaaccgcggtgtgccggtcaggggaatcgaccaccagcaggtccgtgtgcgggttggcaagggccagcgcagtcaggagttcgagccgccgggcagggtccacttgttccgtccaaaggtccgcgatgtcctcgaaactgttgaccttcagccaggggccgctcaccagggcgccgcggtagcggcgcgggatcagggccaggtcctcggtcaccaaatcgcgcacgctgaggtgttgttcgggctcgttgacgccgggggagtccaccagggcgctcgccagccggcgcgccttgagccgctcgctgccgtcccagctgacgagccctccggacggcttcatcctgccgctgagcagcagggcgagggccgtccggtggtcctggcgcccgccggtcaccaacaggagttcgccccgccggacgtggagtgaggttgccggaaggaggggatccctgcggccatgggcagagagccgttgtgctgagagcaagattggcctttcgcggactgcatctgccatcagcctaactaaactgaccagtcagttcaaatagaagcaggctggtgatgccttagaggccgtacttctcaagaaggcgaagccatacctcgctgatggtcggataggagggcactgcgtgccacaggcggttcagcggtacctcgcccaccacggcgatggtggccgcatgcaggagctcggacacatccggcccggcgaatgtggcgcccagaagcacctgccggtcctcatcaatcaccagttgggcccagccctcgtagctctccgaatgcagcgacgaccccgccacctgaatggggagctccactgaggaggcgttgtaaccgtcccggcgggcgtcttccagggtgcggcccacagtggccagttcaggatcggtgaacactacattcggtaccgcgtgctggttggctgtctgggagtaccggctccagtcctccggtacgccgttcagttcacccttggcacgggctgcgatggcgtcgcccgtggcccgcgcctcgtactttccctggtgcgtcagaaggttcttgccggcggcgtcaccggccgcatacagccagggccggtcgccgggtacgccctggaccacgccggaattgtccgtactgatggccagccggccgtggtcatccggttccacgccgatactctccaggcccaggccctccagtgcggggtgccggccggtggagacgagtaccttgtccgcggtgacggtggtcccgtcgcccaaccgcaggctgaacgtaccgtcgtcgttggtgctgatgctttgggtctccgtgtgaaggcggagctccacgccgtccgcgcgcagccccgcggccacaaggctggcggcctcctccgggtacctgcccagcagcctgctgcgcgtcaccagggtcaccgccgagccgaggcgggcgaatgcctgggcaagctcggtcccggcaacgccgccgcccaggaccgccagccgctcgggtacctcgctggcggacgtagcatcccgcgtaccccagacctgcacgtcctcgagcccctcaatgggaggtttgttgggcatggagccggtggccagcaccactgcgtggcgggcccggagcaggtgcgaggttccgtccaggcccgcaacctggacgctttgaggggcggtgagccaggcgtggcccctgatgaggtcgattccggaatccttgacccaggcggcctggctgtcatcctgccagttggacgtgaagtagtccctgcgcttgaggacagctgctgcgtcaagcgtccgcgtgacagcttccttggcgcccggggttgtttgggccgcatgcagtgcagtcccgggccgaagcagcgccttggaaggcatgcatgcccagtacgagcactccccacccaccagttccgcttcgaccagcaccaccgagaggccgccctgcgccacgcggtctgcaacattttctcccacggcgccggcgccgataacaacaacgtcaaattcctgctcaacaggctcgggcatcatggggaaagcctacgcccgggggcggcggggtgtttcgcgtccgccgtgcaggaaaagcaggatattcggcctgtccgtccgttgcgagtcttaacgcacgtcgcgctgcttaacgcaaaaagtccgccccggcgaaccggagcggacctgattggtgcgcccaaagggattcgaacccctgaccttctgttccgtagacagacgctctatccagctgagctatgggcgcatctcgtgttcctggagaagaaccgctctccctgaacctcgaattactttacgcgaggggtggctgccatgacaaatcgggaggcatgtaatctccgcaactagaccggtataggtgaccttagtcacttaattccgcttttgggctgcgaaattcgttgatttcccgcggaattccatttctgtggcctcgaaaggtcagcctacgtcccaaaaacggcagtggtccggaccatagcatttagcacacaccgatgtaccccaaggaagggaaccgaaatgggcgatctggcgcagaagccgttgcttgagaaagcacccaccacacatgccggcctgctggcgtgggtcgaagaggttgcagagctaacgcagccggaccgcatctattgggtggacgggtccgaagaggaaaacacccggctgactgacgagctcgtggcggcagggacgctgacccggctgaaccaggaactgttccccaattcctttgctgccttctccgatcctgccgacgtggcccgcgttgaagaacagaccttcatctgctcggagaacaagcgcgacgccgggttcaccaacaactggatggcgcccgccgaaatgaaggaaaagctgcgcggcctgttctccgggtcaatgcgcggccgcaccatgtacgtcatcccgttcgtcatgggccacctggacgccgaggatcccaagttcggcgtggagatcacggacagcgcctacgttgtggcctccatgcggatcatggccaacatcggcaccgccgtgctggaaaagatgacagagaccaacgcgttctttgtccccgccctgcactccttgggtgcgccgctcgaagccggccaggcggatgttgcgtggccgtgcaacccggacaagtggattgtccacttccccgaggagcgctccatctggtccttcggttccggctacggcggcaacgccctgctcggcaagaagtgctacgccctgcgcatcgcttcggtcatggcccgggacgaaggatggctggccgagcacatgctcatcctcaagctgacatcgccggagaaaaagaactactacatctccgctgctttcccttcagcctgcggcaagaccaacctggccctgctggatcccaccattgaaggctgggaggttgagacgctcggcgacgacatcacctggatgcggatcggcaaggaaggcgaactgcgcgccaccaacccggaggccggcctgttcggcgtggcccccggcaccggctggggcaccaacccgaacgccatgcgtgccatcgccaagggccacagtatcttcaccaacgtggcattgaccgacgacggcggcgtgtggtgggagggcatgacggacgaggtgcccgcgcaccttacggactggcagggcaactcctggacgcccgactccgacaagccggcagcccacccgaactcccggttctgcaccccgatctcgcagatcgacatgctggccgaggaatacaacagccccgagggtgtggagctctccgccatcctcttcggcggccgccgcaagaccacggttcccctggtaacccaggcccgcagctggaccaacggcatcttcatgggctccacgctctcctcggaaaccacggccgccgctgccgggcaggtgggcgtgctccggcgcgaccccatggccatgctgccgttcatcggttacgacgccggggactacctgaagcactggatcagcgtttcaggcaaggccaacccggagcgcctgccgcacatcttcctggtgaactggttccggcgcacggccgacggtgacttcgcctggccgggcttcggtgacaacgcccgtgtcctcaagtgggccatcgagcgtctcgagggcaaggccgacgccatcgagacccccatcggcttcgtgccggcgggacactcgctggacctcaccggtctggacctcacccacgcccacgtggaggacgctgtccgcgttgaccgcgaggaatgggacgccgagctggcctccatcgaggagtggtacgcaaagttcggcgattcactcccggaggccctgcgctccgagcttgacgccctcaaggagcggatggctgaccacagctgatcccaccggggacaaacagaacgacggcggcgccgcacctttccagaaaaaggtgcggcgccgccgtcgttccccgccggcaccctagcctcgcaagctcggccagggaaccctgccggcgtgggcccacccatcgattgctccgtacttgccgttttcagccctcaaaacgactgttacggagcaatcgatagacttttcagctggccagccagatgtccgggccaaagacctcgtagtggatccgcgtcgccgggatgcccgcgttgatggcctcgttgcggatgttcttcatgaacggcagcgggccgcacaggtacagtgatgcgtcggcgggaaggtccacctcgcgcagggacatgaagccttccttggctccggctaccggctgttcgagccacagttgcagttcggcgccatcgaggcgttcgacgtcgtccgtcatctggctgcgtagcgcccagctgtccagggtgctttccgcgtggagtaccagcacctgccgttcggatccggcctccgccagtgagcgaaggatggacgcggtgggggtgcagccaataccggcggacgccaggaccaccgggccgtcgccgtccttgagggtgatctcaccgtaggggttggagatgtccaggacgtcgcccacctgcacgctcttgtggagcacgggggagacctcgccgccgtcgtcgagcttggtggtaaagctgcggctggtgccggcctcgccggacagggagtattggcggacctggcggaggccttccggcagggttaccttgacgctgatgtactggcccggcagcgcgtcggtgacgggagtgtcgtccgccggctcaagggtgaaggtcatggagcctgcgccggcgggggttttggctgccacccgccacggcatccacatcctgtcattggcctgcgcggcgtagaggcccttctcgagcttgatcagggcgtcggccatcagccagtacacctcggtccaggcctcggcgatctccggcgtgatgacctcggccaggtcctcggcgatggcagcgaacaggtgctcgtagaccacctggtactgcggttcggtgatccccagggaggcatgccggtgtgcgatgcgggacaggacggtctcggggagggtgcccggattgttcacaaggtgggttgcgaaggcggcgatgctgcccgccagcgcctgctgctggttgccggagcgctggttggaacggctgaagaggccgtccaggagttcggggtgggcggcgaagaggcgggcgtagaacttgggcgtgatgctgccgatccgtgaacctacaaggggcagcgttgcttcaatgacggggcgggatttttccgagagcatgggaactcctgagggtagtgaccggggccttcgtccggcctttgcgaatacctgcattcaaaatgcaagttttcttacccaatttctacagcttgtagaaatttgacgcaaatcgggtggtaacagaggctgaggaagggtgcgccgccggggcggttcccgtacgtgcagcggaagtcagagccccgggcgcagtccgatcatgtcgaagaccggagccatctggcgggaacccgggaggtccgctatcaccacggaatcgagttcgcggtaaaaggcttcccgggcccgggccagcgctgagcggagcctgcaatcgttgatcagcgggcagttaccgccgggggccacgcaatccgctgcgtctgtccgggtgtcgagctggcgcagtacctgccccacggtggcgacgcggccggcatggctgagccgggagccgcctgtccggccgcggaccacttcaatcagtcccaggctgcggagtttggtcatcgctttgctgacgtggttgtagggcgtccccaccgagtcggcgatgttttgtgttgtcagcaacgcgccacttggagccgctgcaagcaccatcagtgcccggaggctcacgtcggcgaacgcgttgatcttcatgggggcgttgccggtctagtccacccagatggcgggctcgctggtgtcggcggccagttcaccgaattcccacgtctgcgtcccggcgttggccgcatagggcagcacggctgcgaagacagagccgtcgcggtgctcagctgccacgtggatggcgtctgaatcctcctcaagcagcaggatgtcgcacacgatggcagcagcccggaagtcctcccggttctgccgcagcagggcggtgaggtcgctgatcatggcctcggcgtcgaagtccccgtccgacccttctccggcatctgccggggagaccgccacgagccgcacctcgccgtcgttctgtacggtcagcgcgaagggcaggaaaccgccgttgcgctggagttgctcctgggcggcgctgacgcccgtccccaggaggttctccaggtcggttgcggtggcgtcgggcaccgagtcccgccaggattcctggtggccggaaccctgttcttcggttgcgggccccgtgctttccgtcatgctgccctacgcccggacaagcgccaggacccggtcccggatgcgttccatggtggcccggtccgtggcttccgcgttgagccggaggaagggctcggtgttggacggccgcaggttgaaccagtagctgccatcgttggccgtgaacgtgctgccgtccagggtgtcgatcgtgatgtcctcgccggcgaaatctgcgcggacgcgctccacggctgcgggcttgtcatccacttcggagttgatttcgccggagctgacgtagggttcgtattcccggcccagctcggaaagggggccgtcctgttcacccagggcggccaggacgtgcatggccgccagcatgcctgtgtccgcgttccagaagtcgcggaagtagaagtgggccgagtgttccccgccgaagaccgcgccttcctccgccatgacggccttgatgaaggaatggcccacgcgggtacggacggcgcggccgccgtcgtgctctacgagctctgacacggcgcgtgaagtgagcaggttgtggatgatcgtgggggtctcttcaccctgtgccttcgcgcgggcgatctcgcggcgcgccaccatcccggtgatggccgacggcgagacagggttgcccgtctcgtccaccacgaagcagcggtcggcgtcgccgtcgaaggcaaggccaatgtctgcgccgtgctccaccactgccgcctgcaggtcgcggaggttttcaggctccagcgggttggcgggatggttggggaaggaaccgtccagctcgaagtacaggggaatgatgtcaaggggaagcttggggagcagggtgtcgcccagcactgcgggggtggtgaggccggccatgccgttgcccgcgtccactaccaccttcagcgggcgggagccggaaaggtccaccagcttgcggaggtactcggagtagtccttgagcacgtccctgacgccgatctgcccgcgcttttcggcagccggcatggaacccgcattgaggtactgctcagccagcgcctggatgtccttgagcccggactcggaggagatgggtactgcgccggccttggacatcttgatgccgttgtagccggcggggttgtggctggcagtgaaggtggcgccggcgcggttcaggtaaccgcacgcaaagtagagctcatcagtggagatcaggtccagcagctcaacgttggcgccgcggatggccgcgccgttggcgaaagccttgctgaagtcgggggaggacgggcgcatgtcgccgcccaccaggatggtctggccttcgagtttgaggacgtccacgaaagcggcccccacggcttcgacgatttcggcggtgatggactcgcctacgatgccccggacgtcgtacgccttgaaggatgccgaaaggtcaaaagccgttgtctgttcgctagtcacgggctttatcttacggtgaagccggagctcggcaattgagggagggctatttttgtggataaacacatctggagtagtggccttcagcccctggcgtccgaaatccacatagcggcggcagcgcgttcccgggtgtcggacgtggctgggatactgaatcaatggtcgataaccagcacgccaccgccctctctgaaccagcactttctgaaccagcaaccactgacgtccctccctcgacagcaacgcacgcacaggccctcgaggtcctccgcgagctggtcggcaacccggcggccggcttccacgagggccaatttgaagcaatagaggcgttggtcgacggcggccggagggccttggttgtgcagcgcaccggctggggaaaatcggcagtatatttcgtggcttccctgctgttgcgccgcaggggcgccggccctactctgatcgtctcgccgctcctggccctgatgcgggaccaggtggccgccgccgcccgcgccggggtgcgcgcagtggccatcaactccgccaaccagttggagtgggacagcgtccgcgagcagctcgccgctgaccaggttgacgtcctgctggtttcaccggaacggttgaccaacccttccttccgtgaaaaccagctgccggaactgatccgccggaccggcttgctggtgattgacgaggcccactgcatctcagactggggccacgatttccgccccgactaccgccggatcgcggacctgatcacccagttgccggacacggtcccggtgctcgccaccaccgccacggccaactcacgggttgtgcacgacatcgaagagcagcttggggccggcgtcctgactatccgcggtgcgcttggccgggactctctgcggctgggcgtcctgtccctccccgacgccaaacagcgccttggctggctgctgacgcatctggcggacctgccgggcagcggaatcatctacacgctaacggtgtccgcggcggaggacacggccaggctgctggccgaggccggccacgaagtgcttgcctatacgggccggacggaccccgcagacagggagcgggcagagcagctcctgaaggacaaccaggtcaaggcactggtggccacctcagccctggggatgggattcgacaaacccgacctgggttttgttgtccacctaggggcgccctcttcccccgttgcctattaccagcaggtgggccgtgcaggccgtggggcggccaacgccgacgtcctgctgcttcccggcccggaagaccgcgacatttggcagtacttcgctaccgcctccatgccctctgaagagaaggcagcggccgtccttaccgccctggcagaagcgggcaccgcactttccacagttgccctggaagcgcgggttgaccttcgccgcactccgctggaactgctgctgaaggtgctgtcggtggacggagcagtggaacgggtgggcggcggatggcggtccaccggccagccctggatgtacgacgccgagcggtaccagcgcatttctgaagcccgcgtggacgagcaggactccatggtgatctatcaggacacggccggttgccggatggagtacatcacctccgtactggatgacgagaccgcccacgcctgtggccggtgcgacaactgcgccgggcagtggttccgggcagatattgctgaacaggccacggccgcggccagccagaccctcagcagggcaggcggggtgctggaggcgcggctgcagtggcccagcggaatggaccgcctcggagtttcggtgaagggaaagctcaaaccgagtgaggggctcgccgagggacgcgtcctggcaaggctgacagatcttggctggggcggtgcactgcgcgagctgttcgcggccggcgccgcagaccggccggtcgatccgggcatgctgcaagcctgcgtccaggttctgcgcgagtggggcgccggagactcacgcaatcccggctggagcggggcaggacggcctgccgccatcgtcagcgtcccttcgcgaggcaagccggagctggtgggctcccttgcccggggcatttccgagatcgggcgcatcccgtacctgggagagctgcagctggcccacgggggtcctgccggaagccgcggaggcaacagtgcttaccgcctggcgggggtgtgggaccggctggtggtggggcccgaacttgaggcggcgctgggttccctgcagggcggcagcgtgatgctgatagacgacatcgtggacagcaggtggacgctaacggttgccggccgggcacttcgccaggcaggtgcgggggctgtccttcccctcgtgctggcgcaggccggctagcgcgggagatgctcacacgtggcccgctttgatgcggtaacggccagggcgggccctggccggttcaggcccgttgggccctgcgctggctgacttccgcgccggcgtgccgcggcaggaacaggctgtccgcggtgctcaccagcatcagcaccgccatcgcgaggaatgctccgcggaagggtccggcggcgtcgtgggggaaggcgccgagtccgtcgaacagccggatgagtagggctcccacggcgatgccggcagcagccgcgagctggaccagtgttgctgagaccacgttcgccgaggtgagctgcgcaggcgcgatgtccgcgtactggaccgaggcgtaggcggagaaaccgatggagcggaacgccccgctgcagaccagcagtgcgaaggtcaacggctcgggggtgtccgcggtcagcagggcacagagggcgaaggtccctgcggaagccaacgaggcaaacacgagcattgccttgaagccaaagcgccggatcaggggagttgtggccggcttgatgccgatgttgccgataaagaccgccgccaccatggcaccggcatgcaggggggaccagccgaacccggcctggaacatcagcggcagcaggaacgggacggagctgatggtcagccggtaggcgaacccgccggtggccatcgcccggaacgtgcgggtgctgaaaaccccaaggtcaaagagcggattgcgggcccggcgcatccagagcacggcgcacgccagggcaaccgcgccggccgcggcgctcagggcagcccagggagcatccgggtgcgtgctggccagttcgaggcccaccaccagtgcccccacgcctagggtggtgagggccagccccagccagtccagccgccgtccgccgtcgcccgctcctgcaggcaccagccggagagctgccaggaatgcggccgcacccaggggaaggttgatcaggaagatccagtgccaggacaggtacgtggtcagcgccccgccaaccaggggagccaggacgggtgccagcagtccgggccacaccaagtacgcggtggcgcgcagcagttcggccttgggcgtcccgcgaaggaccacaagggttccgacgggaaccatcatggcgccgccgaacccctgggcgatcctgctgagggtaagggctgtgaggtcctggctcagcgaacacgccagtgacgcgatcgtaaagatggcgatggcaaggcaaaagacccggcgggcgccgaaccgttctgccagccagccgctgagcggaatgcccatggcaaccgtcagcaggtatgccgtcatggtgatgttgatgtccggggccggcacccggaagtcggcagcgatattggggatggccgttgtgaggacggtgccgtcgaggaattccataaagaaggtggcggccaccaggagggccaggcggggactccacgcctgcgcggtcccgggtgccccatccaccgtgttgcttgctgccatccgttcatcctgccaccggcacaacatgcagggcgcccgctgtccgtaccccggacgcaggaaccggacagaaaaggccaggaacgcaaaaagcccggaacgcaaaaaggccccggtcaaggaccggggccaaaacgcggagacggggggatttgaacccccggtggagttgtgccccacacttcattagcagtgaagcccattcggccgctctggcacgtctccaattgctattcctagcccaccaaggatacgcagaacgggccatgcagtgcaaaacggaccaccggccagttcacagcactccgcaaagcacccagcagttgcccgctgccggtttcactgcctgccttactgccggggctgcccgccccggaccatccggatttcgcggaggtgttcccagtccgggatggtgtccgccgcaccgtcggattcgaaaccgaagtgccggtagaagccaatggcgcgcccgttgtccgctgccacccagaggctcgccgggctggggcccagggcggcctcgaggaggcggcgtcccaggccaagcccctggtgtgacgccagcaggtacagtccccaaagttccaggtcaccggacgacggcggcggggcagcatgcgtcgcatcctcggcaggcacgtggcggacgcccgcgaatccaaccaaagtgccgccgtcgcacgccacccacacaacggccggttcggccgactccagcaggtgccgccagagaggcagccggtcggccggcacccgggaggccagaaacccgtcggacagcatcccgcggtaggtctcctgccagcagcggacgtggacctccgccagcccttcaacgtcggcaggctccgcccgccgcaggtccaggaccaccgctacaccaggccgcctgccagggccttccacaggaagtgctggctccgtgcctggagtgccgccgcctgccggttgtccgaggccccggcgtgcccgccctccagcgcctcgtggaaccagacgttcggaatgcccatggccagcattcgcgcggccatcttgcgcgcctggaccggaccaacccggtcatcggaggttgcagtccaaatgaatgtttccgggtattccaccccgtccttgagcaggtggtagggggagaaggtcttgatgaattcccactgctcggggacgtcagggtcgccgtattcggcaatccaggagtggccggcggaaagcctggtgtagcggcgcatgtccagcagcggcactccgcaggacacggcaccaaacagctccgggtaccgggtcagcatgttgcccaccagcagcccgccgttggatccgcccacgcagcccagccgttcacgggaggtgaccccgcgggacatgaggtcccgggcaacggcggcgaagtcctggtaggccttgtggcggttctcctggagcgctgcgcggtgccatgccggcccgtactcgccgccgccgcggatgtttgccaccacgtagacgccgccgcgggagtgcggagcatctccgtcagtgccggcagacaaaggggtccggcgctccagccaggccctgcccacagtcccgctgtaggccggcgtgcgggacacctcgaacccgccgtaaccggaaagctgcgtgggattctgcccgtccagcggcaggttccttggggccacctggaagtaggggacgcgggttccgtcatcggatacggcgaaatgctgctgcacttcatagtcgccgtcagcaaagaacgacggcgatgccttcacctcggcgtgccggctcgccacgccgtctgtcccgtcagtggtccgttccagggtgccgcgcatcagcgtggtgggagtggtgaacccggtggcgacgagccagaagtcgtcacccgcaccgccgtcggacgctgcctcgtcctcatcgtcgaccgcataggcgttcacgtcgtgcagcggcgggcaggcatcgagcagcgtggaggcccaggcgccgtccggaccgtctgccgggcgggaaggatcaaggacccggatttcggacgaaacatccttgaggaggttgagcagcaggaagttccgggtccagctccaggactgcagcgacgtgcgggcgtcgggggtaaacagcaccgccagctcccgtgcaccggccagatagtcctcgaacccgcaggcaagcagtgagccggccgggtatatggattcgccaaccacccagtcctgctgtggccggaacaagagccattcccggtgcgcgctcacgttcacatcggtgggcacgtcgatctgcacccattcaccgtcccgcagcaccaggttcttccggttgaagaagtcgatgtagtcaacggcgaaggtccgctcgtatccgggagtggagtcgtgcgccaccacggccatcatgtgctgctcgggaacctcgaacagccgtggcgcatcggccagcggggcgccgcgcttcagcgtgaccgctgtccgggcgtaggaagaagcggtcttcggcagcccgtccgcggtggaggcgaccagcagcgtgtccgcgtccagccacgacacgttgcccttcgccgtcggcaggtcaaaaccgccctgggccgggtccacgaacgtccggctctccacgtcgaactcccggtaccggttcgcatcaccgccgtcgggggagagcgccagcagggccagccggtagggctcgccggcaccggggcgcaggaaggttgcgccgtggaagacccattcccggccctcggctgcagccagctcatcgacgtcgagcagcacgtcccactcgggggaatccgtgcaatagctctcccacgttgtgcgccgccacaggcccttggggttgtgctggtccttccagaagttgtagtaccagtccccgcgcttgcctaccatggcgatccggtccgtggagtccagcacctccaggatgcttccttcgagttcggcgtagtccgtgtcctccagcagatcttcggtgcgggagttctgctccttgacccaggcaagctgctcttcgccgtagatctcctccagccagacattctcgtcgacgggctcgggcgcggttccgtaggtggcctggccggagccgggcccgggcgctgaatcagcttcagtggtggtcattgggccatccaaacaacttagctgccggcgggcaagtcacgcgttcagcccgtacgctggatgccgtggaaaaaacgcagagcatccggacctccatcatcggtgcaggtccccggggcaccagcgttctggaacgcctgctcgcccacacagccgagctcgccgcaaccggcgcgggtgccgtgcggctccacatcgacgttatcgacccctacccggccgggcccgggcacgtgtggcagccgcagcagtcacggctgtacctgatgaacacgcagtccttctaccccacgctggtgccgcaggaccctgccctggccgcgcccgtcgccgggaccacctttgaccagtggcgggtgcagcagcaggcacacccgtcgccgtccctcactgctgatgaacgggctgaactggccgtcctcgaatccggcgactttcccagccgggccctctacggccgctacctccgctgcaccctggacgagctgacggagaaagcacccgacggcgtcaccattgaattccacgaaacgtccgcagagtcggtgcgtccggcagcggacggaatgttcgacgtcggcctggcaagtggcgccacgctccgcaccaacgccgtggtgctggccctgggacacgtcccgtcccggctgaaccccgaacagcgggaactgcacggcgcggcggagcagctgggcctgcgctacctgccgcccgcggtgcctgccgacgtcgactgggcggcgatccccgccggccaacccgtcctggtccgcggcatgggcctgaactttttcgatgccatgggacagctcacggagggccgcggcgggaagttcgtcagcaatggcgggaagctggactacgaaccgtccggccaggaaccgctgatcatcgccgcctcacgcagggggacaccgtaccgggccaaagcggcgctcgacggctactatcctgcttcggtcaccctgcggtacctcaccgacgctgccctcgaacgcttccgcaccgcggggatccggccgggtttcgaccacgacctctggccgctgctgcaccgcgacacgctctgggcgtactactcaaccctggtgcgctcgcagcccggcgcggtccctgatgccgctgctttcctcactgcgctggaagaggcactgcgcccgcatgcccacagcgctgccaagtgggaggacagtgttgagagcgtcctggccgtgcacgtgggtccgcggcaccggctggacctccccgggctggcagcgccgctggccgggcgttccttcgcttcgcgcacccagcttgacgccgccgtcgtcgaatacctgctcgacgacgcccgccgctcagccctgggcgaggatgatccggtgaaaatggccatcggcgccctgcaccgcggccgggctgtgctgaaaacagcagtggccgacggcggcatcaccgacgagtcatgggtcgccgggctgcggggctggttcgagtcctttgtggaagggctggccagcgggccgccggcgctccgttcggagcagctggctgcgctggcaagggccgggattgtcagcttcgtggggtccgaccccaagttcgacgtggaccgcaggaacgctgtgttcaccgcagcgtccccctgggtggacggaccgcccgtgacggccaggaccatggtggaggcgctcgctcccggcaacagggtgtcggcaaacgattcgccggtgcttgagcagctgctcgcggatgggctggtccggccgcggctgatgatgacggcggagggtgcaccggtgcagtccacgggcctggatgttgtgccccacccctaccggccgctggcagcgaacgggtccgtgacggagaacctttacgtactgggcctgcagctctcgtcctcgcagtggggaacagccatcgccgcggaggccgagcagcctgggcagcccgcctaccggagcggccagcggacgctccgggacgccgacgagatcgcccgggccatcctcgggctgtagctgcccccgggacgctctctcacttgatgcgcttaaagcccagatgctctctcacacgtgagagagcatctggggaaatggcgccttaagtgagagagcgtcggtgattttccggacctttcacacttccaggcggggccgtcagctgcgcaggcaggcccggtaggcggccatggcctggccgtagttcagctggccggccaggtcggcaggccgtgagggcttgaccggagccgtgcacaccggtccggcaggctcggttgctgccaccgtgacccctaccgtgaccctcgtgcctgattccgcagcggtgaggaccaatgttcccggcccggcagcggcgcttgatgggacggccaggttcactgttgcggaaccggccgtgaccggcacggacccgagctcggtcacaaccccggcggtgtccgtgaacactgccgtgagggtcttgttgaccgggctgcccagggaggtcaggtccagcttggagaccgtgaggctgacgggttcgccgggcttgacctccgcggcggtggtgttcgtgacggccaccgaacggcgggcgaaatcgggcgagaccgggctgctgtcctgcaggtagccgatccacgcgtcacggtccaccagccccgagtccttggtgttggaaccttccgtgaagacgcggaagttgtcgcctcctgttgccaggaagctgaatgtgcccacccggtaggacttcgccggatcgagcgcagccccattcacccggacggaggtgatgcggtcaccggccggtcgtgcggcgtcgtacgtgtagctcacgttcttggacagacccagctggatgtaggcgcggctgggaaccgtgccgtccgcgttggtctgccactgctgctccagcagcgtcttgaattgcgcacccgtcagggacgtggtccacaggttgttgacgaatggaagtaccgcgttggcctcggcataggtgatggtgccgtccggggcgtagtagagctcgttccgcaagccgccggcattgaccacaccgatctcggcgccgcccagctcggcgggctgcagcgagttgagcagggaatctgccaccaggttgcccagggtggactcgctgccgcggtcatcgcgtttggccacaccagctgcgtccgtggtgaaggccgtggtgatgtccgcggtgacggcacccacgggctggttgccgacgacggcggcgtccgcgagtgccttcctgacgatcgcgtcgacggcggccacgcgcgggtaggctgcgaccaggtcggcggcaggatcggtggtgcgcttcacgtttccggctttgtacgcggtcacctgcttggtggcggtgtccacggtgagctggatctgccccacgttctcgccgtaattgccggtctggacaatcgggcgggtcttgccctcggcgcccggcacgggtgcgtcccaggcatattccttgtgcgtatggccggtgaagatggcatcaacgtcggcggaggtttcggtgaccagcttcgcgaacgggccgccggcagccacctcctcttccagggtggagccttccacggtgcccgaaccggcgccgtcgtggttttccacgatgatgacgtcggccagtttctccgcggtgatccgtgcagctgcgcggttgatggcgtccacgggatcgccgaactcaaggtcggcgatggcggcgggggtcaccagggaaggtacttcctgggtgaccgtgccgatgacggcaaccttgatgccgttcatgtccaggacggtgaactcgggcagtgccggctcggtggtgcccctcttatagacgttcgcacccaggtaggggaaccgggcgttggtgccgccggctatgacgcgctcctgcaggtcggcccagccgccgtcgaactcgtggttgccgacggctgaagccctcaggtccagggcgttcagcacatcgatggtgggctggtccttggcgacggcggaggcaaacagcgaggccccgatgttgtcgccggctgacaggaaggcggtggcgccgggggcggccgccgcacggagtttctcgatggtgcctgcgaacaggaccgtgttggtgtcgatcctgccgtggaagtcgttgatgcccaggaagttcaggtcaacgtcggcgggagcggactgcaggtccaggccgaccaccacgggatcgtggtcgctggcgcggaactggttcggtgcgtagtagttggtgacgttgttgttgtagcggctgtattccagggccaccgactcaaccgagttgatgttccagatgtcagcacctgtgaccacggcattggcggcgggggacgccaggatgtggtccagcgagcccaccatgccgccgaagaggtaggagtgtttggcggtgccgtcggtgttgcgggctttctcgtcctggttgacgtagccctcagcagtgaagacgttgatggggtcttctttggcatacgcattgaagtcgccgatcaggaacactttgtccgtgcccttggactgctgcaaggacttggtgaactccagcagggacttcgcctgggctgtacgcgccaggtttgatgcgccctgcccctggtccgtgtcctcgggggtggcagccgagcctttggacttgaagtggtttgcgatggcgatgaactctgtccccgcaccgccgcccacgggcttgaacacctgggccagcggtttgcgggcgttggagaacgccacggtgtcgttgtgaatgatggattcacccacgggctccgcaacggcctttttgtagatgaaagcggtgcggatcatgtcttcgtcgctcaacggcggcgcgttggcaggcgagcggacgtaatcccagatgcccggcgtctcgatgttcagggcgtccaccagcttggccagggcatcgtcccggttcttgccgaactgtgctgagttttcgatctccatcagcgagacaacatcggcgccggccttggagatggcggaaacgatcttgtcctgctgccgctcgaagttctcggcgttggcagccccgcgggcatcgcagccgccgcggacggtgatcgggttgccggccctgtcctcgtaatagatgcagccggtcagggtgtcccctgtggtggggaagtagttgagcacgttgaaggaggcgatcttgaggttgcctcctaccgcggcgggagcttccgtcctggtggccccaaaggttgcaggctggagggaggccttgttgtcctccgtcaggtgggtcagcggctggagtttccaggcgttgttgccgtagcccagcaccacgttggtggtgaaggtgacgggggagcccacccgtaccgggtcggccgtggtcaggtagggaaggacctgcgcctttgtggtgacgtccttgaggaagttggtgctggagccgtcgtcgaccttgatcccgcgggcggcgttgtccgccaccgtggctgtgtactccactgagccgtagggagcgacggcggtgggctggaccagaggcgttgttccgccggccaggccgatctcaccgaactggttcagggagtagttgtccgtgacagtcagcggcccctggggtgccaggagcatgccttccagggattcgcggaaggcttcgccggctggcagcgtaaagggcgtggccttgacctcgggcgcggcgtcggccagcttggtcagtccggccgctgcggtgacgttcagctgcgtcatcccgtagtactccgctacggcaccggtcacctgcacgtggtctccggcctggacagacgccaccgtggcgggggaatagacgaagattccgtcagacgcggcatggttcgttgccgtcaggtcgccaccggttcccggagtctgcaggtagtagccgttgaggccaccggtggggaagactgcggtgacctttccggtggtggtcactgttgatccggtgagggggctgtccgcacccgtgccctggatctcggcaatcgaccggactgacggtgcgggggccgggtctggagtgggggcgctggagccgcttggggttgggctgaccgttgtgctgaggctgaagtccgccgcgttgctgttgctgtccgcgcctccgctgcggttcaggctcctgacggcgcccgtacccgcggggcccgcagctactgcggtttcgaaggtgttggaggagccgtagcccaggaggtccgccacgcctgcaggctccacctgggaaccggtggacagcgcgacggcggtgggctgcttggcgagcacgatggtgccggacgtgccgctgaaattcaggacgcccgccacgaggtccggggtggggaggtcggcgccgttggttccgttgctggcaccctggattaggtaatgaccctttgcggcgatggtgccggtaaggggtgccacggcggtaggggctgccagtccggttgcggaacggtactggactgaccagccgtccagccgcacaggggagtccgaggtgttgtagagctccaaaaaccggttcttgtaggcggcgcccgtgctgccgccgctgaggtaggcctcgttaatgacaaccggggatgtgcctgccgcgggtgagacctccgcggctgtattgtctgcaactgcgggaaatgctgccaggggagccagcagccccgccgacaacgctgtccccagcgcgagtttccaaggtgtgtgatgcatccgctctaactttcataagggtgtcccggtggggacccgatggaagatgtccgggttgtaccgacggacaggggcccggatcctgctcctggtcaagtggtatccggcacatcacaacagcgctgaatgaacgcagggttgatagcgcgtgcattcggcgggacgctccccagcggaacgggccacctaccggccgggagccccagtagccccggttccggtgatgctgttggcggtatgtggtggccggcatctaccccagtgtgccgactatcacaaaggataccggccggtagctttgacggaagggcgctgggaaaatttgtcagaacaatttacgggatggcgctggttcccctcacggctgcccacttgggaccggctgcggcctgccgcagattaaacgaaggacccctgtctgccagacattctggcggacaggggtcctttttcgcggaaggtaagagattcgaactcttggtacggggttaccgcacactagttttcaagactagctccttcggccgctcggacaaccttcctcaacaagtagtgtttcataggcacttgcctgcaacaaaacagagtccggaaggtgtccggtgcacactggttgcacgcagtattcagtcagaaacgggagtgttccatgaaagccgtctacatttcggagccgggcggcccggaagtgctggaggtccgcgaagtcgaggccccggtacccggtaccggagaggtgctgatcgacgtcgtcgcggccggcctcaaccgggcggacgtgcagcagcgcaggggtttctacccgccgccgcccggcgcatcggacattccaggccttgaggtatccggccggatcgccgggttcggtcccggtgtcacgaaggcgttttccctcggggacaaagtggtggcgctgctggccgggggcggctacgcgcagcaggtggccgtccgggccgaacaagtcctgcgggtgcccgagggcgtggacctggtgaccgcagcagccctccccgaagttgccgccaccgtctattccaacctggtcatgaccgcccagctgcaggagggtgagactgtcctgatccacggggctaccggcgggatcggcaccatggccatccagcttgccaaggcgctcggcgcccgggttgccaccaccgcgggttctgatgaaaaagtgagcacggcaaaggccttcctgggtgcggacatcgccatcaactacgccgaagaggattttcccgagagcctccgccgccagaacggaggcaaaggcgcagacgtcatcctcgacgtcgtcggagccaagtacctcaagcagaatgtggacgcgctcgctgactatggacgcctggtggtgatcgggctgcagggcggcaccaagggtgagctcgatctggggcagctgctgcaaaagcgggccgccgtggtggccacggccctgcgcccgcggcccgtggaggaaaagggtgccatcatgaacgccgtccgcgacgccgtgtggccgctggtcagtgacggacgggtgcggccgctggtggcaaagaccttcccgctcgaccaggtgcgtgcggcccaccggtacttcgacacaggtgagcacgtaggcaaaatcctgcttctcatgtaagtgctccgccccgcagaccgttgcccgccgagcacaaggaacagcatgtccatccgccatagcctcctcgccctgctgcaggaccagccgcgctacggctaccagctgcgggcggagttcgagaaccgcaccggcaccacctggccgctgaacattggtcaggtgtacaccaccctggaccggctggaacgcgacgctttggtggccagggacggcgacgacgggaacggccacgtggtgtacagcatcacggctgccggcagggcggagatccggaagtggttcgcagcaccggtggagcggaacaacccgccgcgcaatgagttggccatcaaactggcgctcgctgtcaccgtgcccggcgtcgacatccaggccatcatccagggccagcggatggcctccgtccgggcgctgcaggactacaccaaagcccgccgggacacggcttcgaaccagcgggccgttgatacggcatggcttctggtcctggactccctgattttccagaccgaggcggaggtccgctggctggacctgtgcgaggcgaggatgatccagcaggcgcaggggaaataggcaacacaattgggtctttttgaatgcagtggacgggtttagcgtggggtgcaggagccgcccggccgggcggtggaacttggaggaagctcatgacaacccacgtggccgactgcagcgtaacgaactgttcctttaacgatcacaccaactgcaatgctgccgccattacagtcggcggcgccgaaaaccatgcgcactgcgccaccttcatcgacaccggtatgcacggcggactgcccaaagtccttgccgacgtcggtgcctgccagcgctccgaatgcgtccacaatgaccacctgatgtgcaaggccgctgaggtgcatgtgggccccggtgcggacaacgccgactgccttacctactcacacgcctgaggagcagcttcacgctattcccacgagccaaggcctccgcccgaagtgttcggacgggggccttctctgcgttggtccggctgggacgccaatctgatccgtcgttcgtcgccacttcccctccgctcaccgcacgtttctgcgccacctggcagaacacctctggaatggggctgcgggttggtaaggtgcgtcacagcagaagcgaaacaatctcaaggaggagacatggccgaaacgcctgatcaacggaggaatgcatccggggaaaggggcgtggtggccactgacccggccctgcccccaacagccatcgatgaggaggtccgcgaggcagaagaccggaaatggacgccggggaagatcgcgctgtgggccggtatcgccctgctgggcggcctggcatggttcatgctggccatcatccgcggcgagaccgtcaacgccatctggttcgtgtttgcctcggtgtgcacctaccttatcggctaccgcttctactccaaggtcatagagcgctacatcacccggcctgatgaccgccgtgccaccccggctgagtacaaggccgatggcaaggactacgtccggactgaccgcaatgtcctgttcggccaccacttcgccgccatcgccggcgccggaccgctggtgggtccggtcatcgcagcccagatgggctacctgcccggcactatctggatcatcatcggcgtcgtccttgccggcgctgtccaggactacctggtgatgttcttctccatgcggcgcggaggcaggtcactgggccagatggcgcgcgaggagcttggcgtcatcggcggcacggcggccctcattgccaccctgctgatcatggtgatcatcgtcgccatcctcgccctcgtcgtcgtcaatgccctgggcgaaagcccgtggggtgtcttctccgtcggcatgaccatccccatcgccctgttcatgggggtctaccttcgctacctgcggcccggcaaggtcatggaagtgtcgctgatcggctttgtcctgctgatggcggccatcgtcggcggcggcatcgtggccgaaaccccgtggggcgctgacatcttcagcctggacaaggtcaccattgcgtggggactcatcgtttacggcttcatcgccgccatcctgcccgtgtggctgctcctggcacccagggactacctttcaacattcatgaagatcggcgtcatcgtgatgctcgcgctggccattattgtggtccggccggaaatcaccgtccccgccttcagcgaatttgccagcagggacaacggacccgtgttccccggggccctgttcccgttcctgttcgtcaccatcgcctgcggcgccctctccggcttccacgccctgatctcgtccggcaccaccccgaagctcgtggagaaggaacgccagacccggttcattggctacggcggcatgctgatggagtcattcgtggccatcatggccctggtggctgcaatctccatcgaccgcggactctacttcgctatgaactcgccggctgcactgaccggaggaaccgtggaaacagcggccacctgggttaacagcctgggcctggccggcgtgaacatcacgccggacttcctggcagagacggcacggaatgtgggtgaggaaagcatcgtttcccgcaccggtggtgctcccacccttgcggtgggcctcgcgcacatcatgcagcagttcatcggcggcaccgccatgatggcgttctggtaccacttcgccatcatgttcgaagccctcttcatcctcaccgctgtggacgccggcacccgtgttgcccgcttcatgctgcaggactcgatcggcaactttgtccccaagttcaaggagcactcctggcggccaggcgcctggctctgcaccgccatcatggtgggagcctggggcgcggtgctgctgatgggcgtcaccgacccgctgggcggcatcaacacactgttcccgctgttcggcatcgccaaccagctgctcgccgcaatcgcactgtccgtctgcctggccatcgtggcaaagcgcggcacgttcaagtacctctggattgttgccctgccgctggcgttcgccgccgtggtgaccatcaccgcgagctaccagaagatcttctcgtccacccccgcagttggctacttcgccaacaatgcggccttcagcaaggccctcgctgacgggaagacggaatttgggacggcgaaatccgtggcggccatggaggccgttgtgcggaacacggccatccagggctggctctccgtgatctttgtggtgctcagcatcattgtgattgcgacggcgttgctcgccacggtcaaggccttccgcaaccgcgcggacggcaccgccgtcaaggacaacgaggacccggcgcttccgtcgagggtcttcgctccctccgggcttatccccacagccgccgagcgcgaactgatggcggagtgggacaaggtgccggcggagctcaggttcgaaaagggcggccaccactgatggcggcgcggctggctgtgctgacgcggggcgtccgcggcgtcgcccggtatttcggcggcgtcctgggcgcggacgcgtacgccaagtacctggagcaccacagggcggccggccacggggtggcaccgctcacggagaaggaattttggcgcgaccggactgaccgccaggacaccaacccgcagggccggtgctgctgattgagcttgcagcggacaaaccgtcagccgggttcatccggtgggtcgcgggtggatcgctcatgagagtatgaacgcatgagcgatccacaagacactcagccagctgaggacctcccggtagaaggcactcccatcgacgaccggcagccgccggtgcacgcccagcccggccctcctgagggcatgaggcccaaggggagcagcctgcaggacctggtggatgagccggccaaagtgatgcggatcggaaccatgatcaggcagctcctggaggaagtgaagtccgcacccctggatgaggctgcccggggcaggctggccgagatccacgagcgctccatcaaagagctggaagacggactggctccggagctcgtggaggaactggacaggatcagccttcccttctctgacgacggcactccctcggacgctgaactgcgcatagcccaggcccagctggttgggtggcttgaagggttgttccacggcatccagacggccatcgccgcccagcacgcggcccgcgaacacgcggccgcgcagatgcagctccgccagcttccgcccggaaccatgatcgcgcccggcgtggtcatcggcgaaaacggtgagccgcagagggccgcagcaggttcgcgctccggcaattcggcacggcccggccagcgggacgatccggaccacggtcccggacaatacctgtaagggtgcgcttgggctttttcagcgccgccaggcaggggcgcaaggatgatgcggaactggggaagggactgtggcgccgtgcccacgaccgcttccagcggggactggaccgcttccaccaggtcctcgaaggtgtcgaggacgaccagctctacagcgaactgcttgagatagccaacgagctggctgccctcctcgaaagggtacggctggtctgcatggaggcgcagcggcgttcacccaacgagggcctggatattccggttgacctggccggcgtgcaccgtgccctgtccaaggccggcaactcgttggccacaacggcggaggcagccgccatgcttcggctcgccgtgggcccggtcccggtaggtgcggcgtccgtccgccggcgtgccgagtccgtcttccagcaggtggccgacgccgagcgccacctcgacgaggagggttccgggccgcggcaggcggatattcccggttaagcgcctggcttacttccggccaataccctcctggcgggctgccgggtttggcaggatagtcgaatgactctttcacctacactgacgttcaatgacggaaacacgattccccagcttggctatggcgtctggcaggttgaggacgacgtcgccgaaaaggtggtccgccaggcgtttgaggccggcttccgccacatcgacaccgccaagatctacggcaacgaggcaggcgtggggcgcgcaatcgccagttccggcctctccccggatcagctcttcatcaccaccaagctctggaacgctgaccagggctatgagtccaccctggcagcctttgaggcgtcgatggacaggctgggactcgagacgctggacctgtacctgatccactggatgcagcccaagcaggacaagtaccttgacacctggaaggcgctgatcgagctccagaagcgcggcagggtcaagtccatcggcgtgtcaaacttcaccgccgagggcctgcagcggctcatcgatgaaacgggcgttgtcccggccatccaccagattgaactgcacccgtacttcagccagcgtgaactgcgcgagtttggcacttcgaagggcatcctgacccaggcctggtcgccgctgggccagggtggcgatctgctcgaggattccacggtggcgtccattgccgccaagcacggagccacgcctgcccaggtggttatcgcttggcacctcgccatcggcaacgtggtgatccccaagtccgtcaccgaatcccggatccgggagaactacgccgcgcttgaggtagacctggacgcggacgacatcgaggccatcaatgcccttgaccgctcggcccaaggcgaaggccgcatcggcgcggacccggccgtttccgacttcgcgtagagctggcgcaagcctgagctttagccgcccactgccgccctgcctgttcagtacaggcagggcgctttgcgtttaagcactgcagccgaacctcagcagaccggcccgcgggaacgctttaggcggccgtgcggatctgctctacggccacggtgtcgatgacagcccagctgtcctccccggcgcagtgccggcttgcgaagcgctctgcttctgccagggtgtcaaagacctcggtccgggcccggccgcagtcggcgtcgaagtacgtgacgtgaaattcctgtaccagttggttttccatgaatccagtctgcaaccggggtctgacattcaggggaatcagtcccgcgtgttgcccagccgaaggacccgctcctgcgcaagcactgccgtccgctcggctttgtccgcggcccgcaccgcctgtttggcctcggcaacggtgaccgccagcctcttctttgagcgctccagttgctcttctgcggtcctcagccgggcacgaagatctgctgtctcccggaggaattccgcgatgtcggtccgtatttcatcggcctggtcctgcagctcctgtgccgcccgggccgtcccggtctgtgccgcctgggcttcggcaagggcagccctggccctttccaacgcgggtggtaacgccggccgcggagtctgccggactgcctcaagccgcggcttgtccggcctgcgctgttgcggcgctgccgccgtcgtacgcattttcctgccaggggaagccgctggcccagaggcgggagccgcggcggcgggcggcaggaccgaagggactgccacggtgccgtccaggtcaacggcgttcacgccgtctgcaagcaatgtcttgagcaggcgcccgctccgcacggccgctgccgctccctcatccgctgtcagcgcgcgaagtgtctcctcgacctcgcttgccatggcatcgctgatggcccggccgtgctcctgcgccacggatcgggcggtgtcgacggcggcggagagcgacgtgcggcgctcacgtcccaggtcgcggagcacagcagcgtccagcgacgcctgtgccgcgcgcatcctgccgccgagttccgtcagctgggccaggacgtccggttggtgcacggccagcatattgaccgcccaggcggcaaccgacggcttcggcagtgcccggaccgctgccgccagctccttgtccgtcggggctgattccttcgcagcactggcccgggctgccacaaaattttccagcggcttggcgtagagctggttggcaacctctgccaaaacctcgtcttccatgcacgccatcttaggcgccggtgttccctgcagactgtgggtttgacgccatgcatatgctttgcaggcccggccgcatctgagggttccggtcaggtctgaggtgctgcatccccgtcagctggctgcgccggtgatccgcttacttgtacccacccggttggcccgaatccgcgctgtccgaacgttgccggcgccggtcttccgcctggccaatgccgtcacggacagcggcacggataacgccgtacaggacatagaagaaaatcgcggcaaacaccaggttcaggactatcgcatccggggcggtcacggctggtcaccctccacccagaactgctgcacgcctgctgcggcgtcgcgaagttttccgccatccagcaccaccgagctctcggccaggccaaaatccatccactgggcgagcaaacgaaggtccccggtgggaggcaggggccagagccaggcgctgccggtgcccgccagttcatcgtctgcgccgctgccgccaccgctgttgaaggcaatcgtcggaggttccggctcctcgctgctgcccatgaaaccgtggggaccgtgggctcccgtgctggctttggagccgtcggcaagttccaccccgagcatcagcgcggagaggagccgtgtgccgcggcgtgcgctcatccccggttgaaagaacagggaatgtttgtccgcccactcatcctcggtctcgtcgccgcggcgaaagacccaggacaggctgaaggagcagccggtggaatagacctcggcgcttcttacggccaccaccatgcgagggctgcggtgcaggaacctgccaatgtggacagccactggaagttcgttggcgggcggagcggcccacgccggcggcacgaacctggcgctgggctgcctgggggctgatggtgggatggggaagtccttgaagaaggtcacggtcatccttggtctcactggctgcgaccgaccagcggaacggcggcactgccgccctggatcccccaatccgtccttaccccgccagtctagcgctcccttatccaggcggacgtggaaccggcctgagcagcgccgccttccgcggtcgcctggatgctggcaggccgctggcatcaggctcctgcagtcccaccgacggcccctactatcgcaggggcgtgagggccatcattggagttagagagccccgcgatggagatcggagtccgcaatgatccaggctctgcggtgcagattgaatatacgccaccaatggcacgtcgaacataccgaagacggaggcctgtacaagcgttgtttgcgctgcggcaaggatggcggggacggggatggcgcgaacaacggctgggcgctgaggaaatggtggtaggtccgacgcgccctcaccgtgcacaccagggcgggtggctggtgtgtctgctgccgcgggtgaggggtcaccgcggggccgcttaaccagcgaaaaaccccggaaacccctaaaactatgggttatccggggtttatcccgagcttcctatcagaatcgaactgatgaccttttcattacgagtgaaacgctctaccgactgagctaaggaagcaccgcacgaatctccggcagaaccgggcgcttcatgcaagagtcaactgtaatagagtccccgcgcccgggtcaaaatgggcggccgggacagggtgaggccttcagcacaccgtgttgtcggcgggaacctggccgcttaccaggtagctgtccacggcgtcctcgatgcagctgttggaccggccgtaggcggtgtggccttcgccttcccaggtgaggagcgctgcgttgcccagttgcttgcggagcgatgaggcccattccaccggagtggcggggtcgccggtggtgccgatgacaacaacgggggagtcgccgtcgtattccacaggcgacggcgtgcgcacgctctggtagggccagtcgacgcagttggtgcccccgtacgcgaagaagtacccgaaggtgggggagtcctgcatcaggcgctgctgctccgcccgcatggcggccgcatcggactccatggggtagtcaaggcagttgatggcgttgaaggcgaacgtcgaattggacgtgtacgttccgttggaagagcggtcggcccccaggtctgcgagccgcagcataaggcttacgtctcccgtcattgccgcttccagcgcctgggtcagggcgggccagctttggtcgttgtacagcggcgtgatcagcccgctgacgaacatggtggcgttcactacccgcccgtctttggctgtccgcggcgtctgctggacggcggcgatcaggtcgcggatctgctggacaccggaatccacgtccccgctcagggggcacccgtcctggcccaggcagctggcaacataggcacgtattgccttttcgaaggcgcgggcctgcccgctggtcagctcttcgttgctgatggaggggtccagcgccccatccagcaccatgcgccccacattgtcagggaacagcgcagcgtaggttgagcccaggaacgtgccgtaggagtagccaaggtagttgagttttggatcgttgaccacggcccgaagaatgtctacgtcctttgcggaactgaccgtatcgatgttccccagcaccgggccggtctgctcttcgcactgggccgcgatcgctttgttgtccgccaggaccgcagccaggccggcatcggtttcgaggtcgtagattttggccctcgcagcatcccgttcggcgtcggtcatgcacgtgacaggagctgagcgttttacgccccggggatcaaagcccacaaggtcgtaggagtcccgcacagcctgggaaaaatgtgtcccggccgcatccttgacgaagtcatagcccgacgcacccggaccgcccgggttgaccaggaggctgcccgtcttctttccggtgcttggagcccgcagcgcggaaatctggattgtctcaccgtcggggttgccgtagtccatgggcacagtcacgttggcgcactggaactcggtctcgcacggttcccagacgacctcctgcgaatagaactcctccagccctgccggtgcagatgcaacgattgaggggtcggccttggcagtggcggcctcctggctgcggtcttcaccgttcaggaggctgcaggacgccagaaccatggccagggccatggccccgagggcacggacgccaaccgccgcggatcgcgggcgtacgggcagggggcgggcagtcatcgggtctccttgaagcgctagatcaggctggctgccatggactcaatggtcaacagcggtgcaacgttggtggtggtgatgcgttcgcgggctttgttgatggcgtccatccgggcaagcgttgattccggcgtggagcggttggcgaactcctccaattcacccctgagctcaacgtttacgagctccacagcattcccgagctggatgatcagcacatcacggtagaaggaaagaagatccgtcagggtccggtccagcgagtccgtgatggaccgtttggcccgccgcttctggtcatcctccagctgctttacctggctgcgcatggccggaggaagcgtcccggactccggtgcgcccagtgttgccagcagcgcggccttctccgcagcgtcccgttcctcattggaactgttggcctctgcggtggcgatcttgaccagcttgtctgccatcatcaccgcagcggtgacgccccgcaggccgagcggaaacctcacagtttccagccggcgttccctggcggcggggtcgcgcgccagccggcgggcgatgccaacatggctctgcgccgcccgggccgcacgctcagcgagcaccggatccacgccgtcgcgcttcaccagcagggcagcgacgtcggcggcaggcggaagccgcaaggccacgctgcggcagcgcgagcggatggttaccaggacgtccgccggggacggggcgcacagcatccatacggtccggggggtgggttcttcgatggctttgaggaggacgttggtggtgcgctccgccatccggtccgcatcctccaccacgatgatgcgccacctgcccgtcgagggcctgtttccggcggtggccaccagttcccgggcttcgtcgatggtgatggtgaccttctcggtccggacgaacgtgacgtccgaatgggtctcacccaggatggtcaggcaggcggagcagtggccgcatccgcgctggctgacatcgtcctggtcacagttcagtgccgcggcaaatgcctttgccgcattcgagcgcccggagcccggcgggccggtaaaaagccacgcgtgggtcagcccctcgccgctggaggcctgccgcagttgttggacgacggcgggttgcccttgcaggtcgtcccacacggtcacgggtggccacccactgatggagcatggacgggaacgtctgccgggacggcgtggtgcgcggccaggaggatttccacccgctcgagaatctgttccgccagttcaccgaccgcgtgatgggcgggcagcaccaggtaggactccgggcggctgcgggccagctccaggaatgcatcccggatccgggtatggaagtcatcagcttcggattcgagccggtcctcagcagcctcgccggcagtacggcggcggcggccgacggcaggatcgacatccaacaggacggtgagatggggctgcaggccggaagtggcccactcgttaagggaccgtacggcgtcctcgcccagtccgcgtccggccccctggtaggcgaccgacgagtcgatgtaacggtccgtcaggacgatctcgccgcgttccagggcaggccggatgacctgggtggcgtgcgcggcccgggatgcggcaaagatgagcgcttccgtgtgggcatcgatgtggccatggccgtggtccagtaccagtgagcgcagtttttcgccgatgggagttccgcccggctcacgggtacgcaggacggtgtggccccgtgattcgagggcttctgcaagccgggcagcctgcgttgatttgccggcgccgtcgccgccctcaaacgcgatgaaaagcccggccctttgtttgctcacccatcaagcctaccgatccccgctgacaaaaccgatcgggcctgtggacggaggccggtgcacatgcgggcaacagctttccgggggactgctgacggacagtacgatttcaccatgagtctctccgaacagcaggccgcggcgctctcagccgaaacggtggtggttgcggccgggcgtccccccagggaaagggaccagccggtcaatcaccctgtcgtcctttcctccacatactttggtaccggagccctcggggacggcgaccgcgggtacggccggtattccaatcccacctgggatcccttcgaggaggcgctcggccagcttgaaggttccaagctgccggggctgctctactcatcggggcttgcggcggtcagttcggccctttccctgatccccccagggggagtgctggtgatgccgatgcacagctactccgggtccttggtgatggcttccgaactggcgcagaaggaattcgtcgaactgcgcaccgtggacattgccgacacggacgccgtcaaggcggccctggcaccgaatggacccaacgcccgggctgcttccatgctgtggctggaaagccccaccaatccgatgctcggcatcgccgatgtccaggccctgacggccgcggcgcataccgtcggcgctatcgtcgtcacggacaacaccttctcgacacccttggtgcagcagcccctggccttggggtccgacgtcgtcctgcactcggtgacgaagtatctggctggccattccgacgtcgtcctgggcgccctggtgacgtccaacgcggacatccgctcggccctgctccacaaccggaccatccacggcgggatcgcgggaccgttcgaggcctggctggcgctgcgcggactgaggacactggcgctgcggatagagaggtcccaggcctctgccatggttttggcggaacggctcagcaagcatccggcctttgaatccgtccgtttcccgggcctgcccgaggatcccggccatgagcgggccaaggtgcagatgaaggggttcggctccatcatctgcgtgcaggtggcccctgcgggagggctgagcggcgctgacaccgctgacaaactcgtccgcgcgctccggctgtggcttcccgcgacgtcgctgggtggggttgagtcactcattgaacgccgacggcggcacaccgctgagccggtgagcgtcccggagaatttggtgcggctcagtgtgggaatcgaaaatgtggaggacctctgggccgatgtgaagcgggcgctggactcgctgggcggctaggctgggcttgtggacggtgaactgattattcggcctgtagagcaggcagtgttctttattcttgccttggtggcactggggcttgagctgtgggctgtggtcgactgcgcgcggcaccgtgccaacgcgttcgaggccacgggcaaaaggaccaagactttctggctggccttgaccggcggtgcggccctgattggtgtcatctccttcttcagcagcggaggcggctttttcggcacgctgggcctgttcggcctcgcggccgtcgtggccgcgtccgtatacctggcggacgtgcggccggcagtcaaggacgcgggccgcggcggcagccgcaacaccggcccctacggtccctggtaagccagccactggcgtgaccgcgcctttcacaacacaaaccccacaggttacctagggtcgcaagacggcccgcgggaaaccttgttccggcactcaagccaggggtgcaacggcatcccagtccaccgtgagctcgccaagccgccaccgggcggacccgtcctgcaccggccagcccgcgtcccgcaacatccggcacatgccctgccaccgctgccggttcccgaaggacgccagcggcgcgcattccagccatgcccggtccatggcctgcatcagcgcgtggaccggttcgccgggaacgttgcggtggatcagggctttgggcagtctttcggcaacgtccgagggcaggtcgaagctgccgaaccggactgagatgctgagggacagcggcccatcggcgtcgagcgccacccaggtgacgcgccgcccgatctcgtcgcaggtgccgtcgatgaacaggccgccagggcttaggcggtcctgaaccagccgccagatgccgggaacgtccgcttcctcgtactgccgcaggacattgaacgcgcgcaccagcaccggcggtcccggcacgggcagttcgaagccgcccacccggaagctcaggccaggccgttgcagggggagggcggcgcggacgcgttccggttcaatttcgattccgaagacctgcacatccgggcgaacggcggaaagccgttcaaagagctcgacggcggtggcgggcgtcgcgccgtagcccaggtccaccaccagggggtcggcggcgttccggagccgccaggcctgcgggcccgccagccaccggtccacccggcgcatccggttgggattggtggttccgcgggtaacgttgcccaccggcctgcctggcctgccggtgctgttcctgccggaaatctgcggggcggtcacccgttcagccttttgcaccacggcccccaccttatccctgcagccggaggtggcgcgtcacagggatgggcctgtaacgctgggcaggcggcggcagcgctcggctaggatgaaaatcatgacttacaagctgattctgctgcgccacggccacagcgaatggaacgccaagaacctgttcaccggctgggtggacgtagacctcaacgatcagggccgtacggaagcagcacgcggcggcgagctcctggttgagaacaatgttctcccggacatcctctacacatccctgctgaagcgggccatcaacactgccaacatctccctggacaaggctgaccgcggctggatcccggtgaagcgcgactggcgcctgaacgaacgccactacggcgccctgcagggcaaggacaaggcccagacccttgcagagtacggcgaggaacagttcatggaatggcgccgctcctacgacacccctccgccgcccctggacgacgactccgagttctcccaggcgcacgatccccgctatgcggacctgggtgacgcactcccgcgtacggaatgcctgaaggacgtcctggtccgcctgctgccgtactgggagtcggacatcaaggaagacctcaaagccggcaagaccgtcctggtcacggcccacggcaactccctgcgcgccctggtcaagcacctggacggcatcagcgatgaagccatcgccggcctgaacatccccaccggcatcccgctggtgtacgacctggacgagaacttccagccgatcaagcccggcggcacctacctcgacccggaagccgcggaacaggccatcctggcggtagcgaaccagggcaagaagtaagactttgcgtcaaaggtgaattaacgacggcgggctggtcacctcagatgaccagcccgccgtcgttgttcccgccagagtttttgtccagatatgcaggcctccgggcctcggaagtcggcttatctggacaaaaaatcccaaggggtttagctgtgttctgtcccggtgggctgccaggcgccggtcaccaggtaggtgaccttctgggccactgaaacgccatggtccgcgaagcgttcgaagtagcggctggcgagggcaacgtccacggtggtggcgggcgattccttccactccggtgctgcgatggccttgaagacgctgaggtggaggtcgttgatggccgtattcgccttcagaatgtcccttgccaccccaaggtcgcgggtctccaggaggacagtgagtttgtcggcgatttcctggtccagctcggccatgcgcttgaaggtgccggtcatggattccggaatgacggtggacgggtagcgcaggcgtgccaactgggcaatatgccgggcaaggtcgcccatccgctcgagtgaagcgctcatccgcagcgagcccacaatcatccgcaggtcgctggccaccgggccctgcagcgccaggatgtcgatggcgcgctcgtcgagcctgttctgcaggaagtcgatgcgggcatccgcggcgatgacgtcctgcgcaaggtccacgtccgccacttcgaaggaggtggtggccttgtccatcgcttcgctgaccagccgggagatctccacgagctggtcgccgacctgggtcagctcttcctgaaaaaccttacgcacgtgggcgtcctttccttgtaactccagccgccctggtccgggcagcgggaatcgcgtcgccaatcggcactccaactggctactctgccagtgccgggtgaacggcgaggcccttgaaggtgaacgttagttgaaccgtcgcaggaggaggcccggacgcgccgatcagcgacttccagagcataaggtggagctgtggatcctatgctcatcggcttggtggccggcctcgtcggcctggcgctcggcacgttcggcgtgctcgcgtaccgggtcagcgagcggcagcggcaacttctggacgtggacactgaagaaccggctctgccgccgggcgcagccgaagtgctggccgtcgtcggccgtgccttcgtggtggtggacgccgtggacggcgtggtccgtgccagcccggcagcctacgcctacgggcttgtccgcggccacaccgtggtccacaaggaactgctggacatgacggccggcgtccggcgggacggcgtcatcctcgagaagcaactggagcttccccgcggcccgctcggccagggaaccatcatcgtccaggtccgggccgcgatgctcggtgaggaatacatcctgctgctcgcggatgaccgcacagagatcaccagaaccgaagagatccggaacgatttcgtcgccaacgtttcccacgagctgaagacccccgtgggcgccatctcgctgctcgccgaagctttggagtcctcggcagatgacgaacttgccgtccggcgcttcgccaagcgcatgcacaaggagtcagggcggctggccgcactggtgcaggacatcatcgagctgtccaggctccagggggccagcgtggcgcagcagggcaggccggttgccgtcaacgccgtcatcgccgaggccgtggaccggtcccagcttccggcggagagcaagaacatccggatcgtggtgggcgggcggaccgacgcgaaggtcttcggtgaccaggacctgctggtcaccgcgctccgtaacctgatcgacaacgccatccgctactccccggaaaacacccgggtggggatcggcgtccgcagcagggaaggcctggtctccatctctgtgacggaccagggtgagggactcagccccgaggaccaggaacgcgtctttgaacgtttctaccgggtggattcggcacggtcacgccataccggcggcaccggcctgggcttgagcatcgtcaagcacgtggcctccaaccacggcggcgaggtgaccctatggtcccagcccgggcagggctccacgttcaccctccggcttcccgaaatggaaggccaggacggcggggagcagccggaccctgccaccgcacctgccgccgcccccgccgcgggacgccggcagggcccggaagtgccatctgtcacccaaggacccggcgccgccggagcaacagaacgaggagcaacagcttgagcaggatcttgattgtcgaggatgaggagtcgttcagcgatcccctgtcctatttgctgggcaaggaagggtttgaggtggaggtcgtggacaacggcctggacgccatcaccgaatttgaccggaacggcgcggacctggtgctgctggatctgcagcttcccggactctcaggcacggaggtgtgccgccagctccgccagcggtccagcgtcccggtgatcatgctgacggccaaagacgcagaaatcgacaaagtggtgggcctggaacttggcgccgacgactatgtcaccaagccctattcctcccgtgagctggtggcaagggtcagggctgtactgcggcgccagggcgaaccggaggaacttgtatcttccaccgtgcaggcggggccggtccggatggacatcgaacgccatgtggtcagcgtgggcggagagcaggtgctgctgccactgaaggagttcgagctcctcgaaatgctgctgcgcaactcgggccgtgtactcacccgcggccagctgatcgaccgtgtgtggggttccgactacgtgggggacaccaaaaccctggatgtccacgtgaagcggttgcgcggaaagatcgagccggatccttcagccccgcggttcctggtcaccgtgcgggggctgggctacaagttcgaaccgtagggcgccgcctctggcagccgccaggacaggggacagtttacgaatgacatacaaaaggaggggcccgacgggcccctccttttgtattcttgaatgctggccgccagcgtggttgcctagtggccgccgcccccggcggcttcttcggattccgacggcgacgggctggcggaggtgggtgcaggagtgctcccggccggcaggtactccttgtactcgggcagcgtggtgtccagcacgggaacctttacagtgttgctgacgttggtgccgtcttcgctgatcttgacgtccacgagcgagcccgggatgcctcccgtggtgctgaggatggcttcgtcggagctctcgttaagcagggtggacgagttggccttgacgggaacttcggtctgcgaaccttccgcaccgttgaccgtgagggtcacgtcctgggaggaggagttgtagacggcgccgatcaggcggcccggctggtcctcgcccgcggagacgatcaggacgttccggagctggagcgggccgaggtcggcgatgatgccgtcagacgcctggtaccgggcggtggtctgctgggaattggtgtacccgcagcccgacgtcagcaggcccacgccaagggcggctgccgtcagtgccagtttgccgcgctgggcccgggtcatcgcagtgaaacgcacgtcgcgtactcctcaagagtcttgaaacattaatcacgcatagcctatccgcaaagcaggccaaacgaggattcggcggtgtcacatcacccttccttcagcgccctcacatgcactattatccgcgttcgtcaagggggtgaaagggtccgattaggcccattttccgcgtatttctgcggttccaggccctcttcccggccggtcatatgcctgaatcgtgataaactggtcagcgggaaaggggaaatgtccacatggtatttgaggtcggcgagacagtagtttaccctcaccacggtgctgcgaagattgaagaaatcaagatgcgcaccatcaagggcgaagagaaaatgtatctcaagctcaaggtggctcagggtgatctgaccattgaagttccagcagagaacgttgaccttgttggggttcgggacgtagtgggcaaggaaggcctggagcacgtatttgatgtgcttcgtgctgagttcacggaagaacccaccaactggtcacgtaggtacaaggcaaacctggagaagcttgcttccggtgacgtcatcaaggtagcagaggtcgtccgcgacctgtggcgccgcgatcacgaccggggcctttccgcaggcgagaagcgaatgctggccaaggcccggcagattctgatttcagaactggcgttggctgagaagaccgacgaggagaaggctgcaagcgttctcgacgaggtcctggcttcctaagaattgaaccccggtgccacccacgtggcgccggggcttctttttgcccaaaatcctgtcctgaagattcaagcgcaggtgttcaggcgccggcggcccgcagggacgtaggctagtccgcatgagcgaaacacccacccgcccggtcaccgcagtgatcctggtggcagcaggttcagggcagaggctgggctacggcattccgaaagcggcggtgccactgggcggcgaacctattctgatgcatgccctccgaggcattgtcgcctccggaaccggcagtcaggtgtgcatcgcgctgcctcccggcgaggacacgctccgccggctgtgcgaggagttccggcaggaactggccgacggcggtcccctccttaccattgtggacggcggcgccacccgggcagagtccgtccgcgccggcatggcagccctgatggacggcatagaggcagtgcttgtgcatgacgccgcccgtgcccttacacccgagtcggtcttccaccgcgtcaccgacgcacttgccgcaggggcggctgcggtcattcctgccgtagcggtggtggacaccgtcaagacggtcgcggccaccacggggaaggacgccggcctggcgccggaggtagtgaccggaacagcgccccgtgaggaactccgtgcggtgcagacgccccaggggttccacctcgacacgttgctgaaagcgcacgaggctgcgaggagccttgaccagaaagaatcagcagcggtcaccgacgacgcaatgcttgttgaaatgctcgggattcccgtccacgtggtccgggggtccacccagtccctgaagatcaccactccgctggatctgatcctcgccgaagggctcctggagggcccgctgggtgcgcgctgggtggaaggctagcaatggaacctgcggaaatgatcatcccccgctccggcatcggcctggatgtgcacgcctatgcccccgaagaccatccccgcccgctgtggcttggcggattgctgtggccgggtgagcgcggactcgccgggcactccgacggtgaccctgtagcgcacgcggctgcggacgcgctcttctccgccgccgggctgggtgacctgggtacgcacttcggtacggaccggcccgagttcgccggcgccgcgggaaccacgctgctggccgaggctgcgcggattgtccgcgctgccgggtttgagatcggcaacattgcggtccagttcgtcgccaaccggcccaagttcgggccgcgccgggaggaatcgcagcaggtcctgagcgacgccgccgacgcgccggtgagcgtcacggccaccaccagtgaccaccttggattcaccggccggggagaaggcatctccgcggtggccaccgctttggtgtatccaaggccgcaccttcccatcagctaatctggagcggtgaccctgcgcttctatgacacctcctccgccgaagtccggaacttcgtccccctcgtcgagggcaaggccagcctctactactgcggggccacggtgcagggcatgccccacgtaggccatatccgctcagccatcgctttcgaccagctcacccgctggctgacctaccgcggcttcgcggtcacggtggtccggaatgtcacggacatcgacgacaagatcctggccaagtccgctgaatccttcgaacccggcttcgactccggaccggactcggtccgcgaggaagaatggtgggcgctggcctaccgctacgagcaggagttcctcaaggcctacgacaccctgggtgtctcccggcccacttacgagccgcgtgccaccggccatatccccgagatgcacgccctcatccagctgctgatcgaccgcggccacgcctaccccgccctggacggctccggagacgtatacttcgacgtccgttcctggagcaagtacggtgccctgacccggcagaacattgatgatatgcaggcagcgcctgatgctgaccccaggggtaaaaaggacccacgcgacttcgccttgtggaagggctccaaagagggagagccgacgacggcgagctgggcctccccgtggggcgccggccgtccgggctggcacctggaatgctccgcaatggtcaccaaataccttggcaccgagttcgatatccacggcggcggccttgaccttcgcttcccgcaccacgagaacgaaatggcccagtcccaggccgccggccacccgttcgccagcttctggatgcacaacggcatggtgacctaccagggcgaaaagatgtcgaagtccatcggcaacaccatcagcccggccgagatgctcgaactcgcatcgccgcgggtggtccgctactacctggggcaggcgcactaccgctccgtcctggactaccgtcccacttccctgcaggaagccgcagccgccgtcgaacgcattgatgggttcatcagccgtgcggttcgggccctgtccgcgggcggtgagtacagcttcgccacctacggcaccgtgccggaaccattcgaacgtgccatggacgaggacctcaacgtgccgcaggccctggccgtgctccacgaaacggtccggtccggcaacactgctttgactgaaggaaagctggaggatgcgcggcaagccctgcactatgtccacgacatgctgcgcgttctgggcctgaacgacgtcgcttccggttccgtcgcggacacccgggaatcagcggcgttgtcagtactcgtggaagcccaactcgtggcccgcgccgaggcccgggccaccaaggactggactgcctcggacgccatccgggacaccctggctgccgccggcgtggtggtggaggatggaccggacggtcccacctggagcctcaagcgggactgaccggagccaccaccagcaggctgttggcaccggcgcgggcgatttttcctggttcagtagactggtaggcagactcagtcaacacaatcaagggtggaacacaatggccaacaatggtcgccgatcggttaaagcgaagaagggcccaaccatcgggaccggtggccacggccgcaaggccctggaaggcaagggccccacgcccaaggcggaggaccgcccctaccacaaagcgcacaaggccaagcaactctcggagcggtccgcagccaagcgcaacccgggcgcccgcagcgccggggcagcccggtccggccccaagggccgcgccaccgaggaagtcgtcaccggccgcaactctgtggtggaagccctgcgcgccggcatcccggccaaggcgctgcacgtcgccatccgcatcgaaatggacgaccgcgtcaaggaatcgctgaagctcgccgccgagcgcggcatcccgttgctggaaaccggcaagcctgaactggaccggatgaccgatgacgccgtgcaccagggactggtgctgcagattcccccttatgactaccaggatgcctacgaactggctgaagacacagtcgataagtggaagaagggccacatctccaacgcgccgctcttcgtggcgctggacggcattaccgatccccgcaacctcggtgccatcatccgctcggtttccgcctttagcggccacggcgtcatcgtccccgaacgccgctccgtgggtgtgaccgcctcagcttggaagaccagtgccggcgctgcagtccgcgtacccgtggcacgggcatcgaacctcaacaacgccctgaagcagttcaagaacatgggcattttcgtcctgggcctggacggcgacggcgacgtttcccttcctgacctgacgcttgccaccgaacccgtgtgcatcgtggtgggctcggaaggcaagggcctcagcaggctggtccgcgagaactgcgaccagatcgtgtccatccccattgactccgcgatggaatcgctgaatgcctccatggccgtgggcatctcgctctacgaggtctcccggcagcgggcagccaagtaggagccggcgggtactgccaactgtagtgcccgcttcgctgagcagtacccggcgcaaccaaggcgtccgggcaggtcacgtgccgctggcggctaatatttaggtgatggtcatgccgctcttcgacactgcttccaccatggacgcctccacggccgttccgctcggtgtgagtgttccgcgcgctgattcggggggctcacgccaccgggcaggcgggcgtgccaacgtggcctgctatgcgccgggcatctccagcctggaaatcgcgtatatcgcccctggcggggagtggaagctgcagtcgctgcccaacgttacgcatggggtccaccacgggatcgttgaggacctgccgtgcggatcccgctatggtttccgtgcggcgtccagcgagcagtcgctgccttttgccgtgcccaccgcggacgttgatgacgacggcggccagccgctgctgcttgatccgtacggcagggccgtggaccagcgcgatgggttcctgaccagcgtgcgcatggcgggggacttcgactggggaacagacgaacgcctcaggctgccgtggcgcaacacgatcatttatgaggcgcatgtccgcggacaaagcatgctccacccggatgttccggaggaactgcgcggcacgtacgccggcatggcccaccctgccatcatcgagcacctcaccagcctgggaatcacgtcggtccagctgctgccggtgcacttccacctggatgaaccccacctgcaggacctgggactgaccaattactggggctacaacacggcggctttcttctccctgcaccccggctacgccacccgggcagcccaggaagccggtccgcaggccgtccaggacgagttcaagggaatggtcaaactcctccacgccgcagggctggaagtcatcctcgacgtcgtctacaaccacaccgccgagggcggccccgacggccagaccatcagcttccgcggactgggggagcaggcgtactaccgcacggacggacacggaaagtacgtggacaccacgggctgcggaaacagcctgaactttggtgaaccacgtgtggtccagatggtcctggactcccttcggtactgggtggatgagttccatatcgacggcttccgcttcgacctcgccgtgacgctgtgccggaacgctgccaacgacttcgacccccggcacccgttcctcgttgccatcgccgcggaccctgtcctttcggacgtcaaactgattgccgagccctgggacgtgggttacggcggctggcagaccgggcggttcccgggcggctgggttgactggaatgaccacttccgtgacgcgctgcgctcattctggctggctgaccgggctgccctggaagctgggggccacggcgggtccctggccaagctcgcggacgggctgtccggttccgctgccttgttccaggcctccggccgttcccgcctggcatcggtcaacttcattacctcccacgacggcttcacgctcaatgacctcgtctcgttcgaccgcaagcacaatgaggacaacggcgaggagaacagggacgggcacggagacaaccgcagttacaaccatggcgtcgaaggccccaccgaggacggcgtcatcctggccgggagggcccagtcccgccgcaacctcatggcatcgctgctcatctccctgggcgtgcccatgatcaccgccggcgatgagctggcgcggacccagcagggtaacaacaacgcgtactgccaggacaaccccatcgcctggctggactggacccgcactccggaatcacacgaaatgctccgcagcaccaagcggtacattcgcctgcgcaaggagttcctcgccgcgcagccccacaacttccctgtccgggacgagcagtcgtacctccactggttcgaccaggacggccatcccatgtccatggaccgctggaacgatccccatcaccgcgtggtgcagctcctgctcggatccgacaacggcgccctcgccggcctgatggtggtgaacggcagcaacaccgacgtccagatcaccttgccccgggtcaccgcacaaggcacccacccgcagatgttcgagctccgcctgacaacctcgccgctccacgagcttcgccagggcggccgggttgcgtcgggcgagaaggacctcgtcgaagcccattccatcagcatctaccgcacgtagctttatcgacctagctgcatcgacctaactcccgggatcacaagaatgcgcaaccgctccatccttcccttgctgctggccggcctggtggtactggccctgtttgctttcggtggcaccggattcctgggccagctgaccgaaagtacgacgccggaggccaccttcagcgccgtgcctgcgccgggtgccgcttccggagagccggcggcaccagccccggccccgcccacggccgcgccggagaatacttccgggttgccggaggttcgggagtctgcgcttcctgccgagggccgcagggtactcaacctgatccgtgccggcggaccgtaccgctacagccaggatgaccagacgttcggcaacttcgaacgcatcctgccgcggcgggacaggggttactaccgcgagtacacggtgccaacgcctggagagtcggacaggggtgcacgccgcatcgtagccggggccggcggcgacaagtactacaccgaggaccactacgagtcctttaagttcatcgcggaaggcagctgagcaaaaccatgaagatctactccggagacacctggaccctggaggaactgcaggaacaggtggccgccgccggccgccgcagcctggtggtccccgctgcggacagcaggaaagcggttctggaagcattcggcgaggtcctggacttccctgaacactacggcgtgaacctggacgcgctgaacgattcactgcacgactttgcggacagcatcaccgacaacggcaatcctcccgttaccgtcctgtggttggtggccgctcccttccgcagcgacaggtccttcggaatcatgtgcgaaatcctccaggacgctgagcgctacgccggcaaggacctcgccgtcaccgccgtcctgctctagccagcctgcccggcactactcgccgcgctcctcatgcgagacataggtgcccagcaggtccgctgcccggccgccgtcgtcctctgctgccaggcctttgcgcatgttctccgccttctccctgccggcagggaacggcggcaggagggggacctcggggtccgtgagtacttcaatcaccacggggcggtccgacgcgaaggcgcgttcccaggcgtccccgatcaactccggatcctctacccggatgcctgtgaggcccagcaggtcggcgtagccggcgaacgggaagtcaggaagctcctggcttgcggcgaaccgcggttcgccctccgactcccgctgctcccacgtcacctccgtgagctcccggttgttgaacacgcagaccacaaaccggggatccgtccactcccgccaccggtgggccactgtcaccagctcagcgatgcccgccatctgcatggcgccgtcgccggccagggccacaaccgggcggtccgggtgggccagtttcgccgcaatgccgtaggggagggaacaccccatgctggccagtgtcccggacaggtgggccggaacacccggcggaagcacaagctgccgcgcataccagtaaacgcaactgccgacgtcgacactcaccagggcatctccgggcagccggccgttcaactcccggacaacacgttcggggttcaccggggctgccggtacggcggcccgttccgcggccagggcccgccaacgggcgacttcctgctccacgtccgtttgccactgcccccgggaacgtggccgcagccttgggatcaaggcctggagcgccaggaccgcatcacctgccaagcccacctcaaccggataccggttgccgatcttccgttcatcaatgtcgatctggacggcgcgcgctgcgccgggcggcggatagaactccgtccagggatcgttggagcccacaatcagcagtgcgtcgcagttgcccagcaagtgcgcactggcggtgctgccgaggtgtcccatggtgcccgcggcaaagggtaaagtctcgtccacataaggtttgcccagcaggctggtggctatgccggcgccgagtttttcagccaccgccactacctccctggctgcgcgccgggcgccctggcccaccagcagcgccactttttgcgaggaattcaggagggctgccgcggcctccaggtcctgctcccggggagtcttcatcgaggtgctccacgtcggtgcagtgaccacaatcccgtgttcctgctccaggtccggcgcaggcgcggactggatgtcatgcggcacaatgaccacacagggcgaagacgtcgccctggcggtgcggaaagcccggtcaaggaccatgggcagctgctccggggcgttgacctgctgcacgaactgcgctgccacatccttgaacagggacatgagatcgatttcctgcatgtaggccgagcccagcaccgtgcggctttgctgcccgacaatcgccaccaccggcacgccgtcgagcttggcgtcataaaggccgttcaagaggtggacggcgcccggcccttgggtggaggtgaccacccccaccccgccggtgtacttcgcgtggcccaccgccatgaaggcagcggtttcctcgtgccgggcctgcacgaactcaacgcgtccctcggcccgccgcagggcacccataaagccgttgatcccgtccccgctgtagccgaagacccggctcactccccacgtgctgaggcgctccacgatgagatcggacaccgtgcgttcggtcatgcgttcctccccgggcggtcagccactctgcctatgcttccggcgacgctctacgcgttgacgatcagtcccagctcggctttggaggcgagggcgtcgtgccgcggcaggacccggacggtgtacccgaacggtcccgagcggtcgatcaccagagaaccgctgaacaggtggcgcccgctgcccaggtcctcctgcatcttcagctccatcaccgtgatgtccgtgaggctgtcgctctcttcggcccggccgtaggccacttcgacggagacgtcctcaggcgtgaggttgtgcagcgccacataggcgttgacctggaggatgtccccgatctggggatcctcggaaacccccacggagtccacgtgctccacgtgcaccagcggccaggccaaacgtaccttcgccgtccaggccgccagggtgcgggcctgcgagtaggagttggtggacgcactccgccccgcctccgccgccggacggtagaggatgttcacgtagtcgcgcagcatgcgttccgcggagacggccggtccgaggtgcgagagggtgtgcttgatcatggagacccagtgcgtgggcaccttctcggcctccgacgtcgatggccccgcagcacccgcgcccgccgataccgtgctgccgtagaagcgcggggcaacctgcgtttccagcagctcgtacagcgccgcggcctcgatgtcgtcccgctcctccggggacgcgccgttgttggcggtgggaatcgcccagccgttctcgccgtcgtacatctcgtcccaccaaccgtccaggacggacaggttcagcgagccgttgagagcggccttcatgccggaggttccgcatgcttccaggggccgcagcgggttgttcagccagacgtcacagccagggaacagagtccgggccatggcgatgtcgtagttgggcaggaaggcgatcctgtgccggacagcaggatcgtccgtgaagcggaccaggtcctggatcatcttctttcctgcgtcgtcggcagggtgggacttgcccgcgatgaccagctggatggggtgttcctggtgcaggaggagcgccttgagacgttccggctcgcgcagcatcagggtgaggcgtttgtaggtgggcacgcgccgggcaaagccgatggtcaggacgtccgggtccaggaccttgtccgtccagcccagctcggcatcagccgcaccgcgcttcttccaggcagcgcggaggcggaggcggacatcgtcaaccagcgctgaacgcatctcacgccggagcgcccacacgtccgcgtcgctgacgttgtaggcgaggtcccagcggccgttggcttcggcctcgctgccgaactggtcccgggccagcttggagatgcggctgtccacccaggtgggcacgtgcaccccgttcgtcaccgacgtgatgggcacctcggaatggtcgaagcccggccacagtgcggagaacatgccgcgggagacttccccgtgcagcttggccacgccgttggcgcgctgggccaggcgaaggcccatgacggccatgttgaagaccgaggggtttccgtcagcatagttctcgcgccccagctccaggatgcggtccacgggcacgtccggcgccaggccggcctggaaaaagtggtggatctgggcgatctcgaacctgtcgatccctgcgggaaccggcgtatgcgtggtgaagacagtggaagcccgcccggcggcaagggcttcgtcaaacgtcagcgcctgttctccggccatgagttcctggatgcgttcgatgcccaggaagccagcgtgcccctcattggtgtggaacacctccggagcggcggtgccggtgagctgctggaaggcgcgcagcgccttgaccccgcccatgccgagcagcagttcctgctgcagccggtggtctccgccgccgccgtagaggcggtcggtgatgctgcgggcggcgtcatcgttgccgggcacgttggagtccaggagcagcaggggaacgcgtccgacgtcggcgcgccagatgtgtgccagcaggcgcctgccgttgggcagggggagagcgatctgcaggggacggcctatgccgtccgcggagggctcgcgcagcagggtgagtggcaggccatcagggtccaggaccgggtaggtttcctgttgccatgcgtcccgggagagggactgcttgaagtagccggcctggtacagcaggcccacaccgatcagcggcacgcccaggtcagacgctgccttgaggtggtcgccggccaggattcccaggccgccggagtactggggcagcacctcggtgatgccgaactccggggagaagtaggcgatggacgcaggcgcatcagggccgaggccctggtaccagcgtggttcctcaagatagcggtccaggtcctgctccgctgcccgtacccgctccaccacggagcggtccgcagcgagctgctggaattcctcgcggcttaccatccccaggaagcccaccggatcctggccgctttctttccacaggcgggggttcaatccctcgaaaagttcccgcgtggggcggtgccaggaccagcgcaggttgcttgccaggcgggccagcgggcggatcggttcggggaggactgtacggacggtaaatctgcggattgccttcacctgcgtcacactaaccgacaacatgcgcggctggaaccagcttcgggtttcttttgggtaaatgacagttggcgccggggaaatgacgactgacgcgccgaatttagtgcgcagccttagcattcccggtcatttctcgctaacgtcgagcttgtgacgactacatcaggaaccagtgccgcatcaatgaaaatgtcgaagggcctcatcactgacgggctgcggttcggacgatttccgatcaccgcagtgcagccggtcgtggaggatggcaaattccccgccaaagccctgccgggcgaaggaatcgtggtgggagccaccgccttccgcgagggccatgaccagctgggcgtcagtgccgtgctctttgatcccgaaggcaacgaacgccagcgggtcaggctcgcaccgccgcgcggggaacgcggcatggggacggaccgctgggaaggcgtgctcacgccgtcggaatccggtgactggtcctttgccatcgaagcctggcacgaccgctacgggacctggcaccacaacgccgaggtaaaggtggaagccggcatcgacgtcgagctgatgctcgccgagggtgccgcgttgctccatgaagctgccggggacgactcccgcagcgagtgggacaggggcgtcctccgagaggccgctgacaagctggctgacccctccctcagcacggaggagcgcctcggggccggattcagccacgcggtcaccggcgttgtcgcgcaccagcccatccgtgaactggtgaccgtgtcccggcagttccccctgctggttgagcgtgacctcgccggacgcggtgcctggtacgagttctttccccgctccgaaggcgccgtcaaggatcacaccacgggcgcctggacttcaggcaatttccgcaccgctgccgagcggcttgatgctgtggcagccatgggcttcgatgtcatctacatgccgcccatccatccgatcggcgtgcagcaccgcaagggtcccaacaacacgctgatcgcaggcccgaacgatcccgggtcaccctgggccatcggggcagcggaaggcggccacgacgccatccaccctgaccttggcacgttcgacgactttgatgcatttgtggcgcgggccaacgggctgggtctggaggtggccctggaccttgcgctccaggccgccccggaccacccctgggtacagtcccatcccgagtggttcaccacccgcgtagacggatctatcgcctacgcggaaaatcccccgaagaagtaccaggacatttatccgctcaatttcgataatgatcctgagggcctctcaaacgaaattctgcggattgtgctgctgtgggtaagccacggcgtaaagattttccgggtggataacccgcataccaagcccgtctggttctgggaatggctaattgaacaggtcaacaaagaggttcctggtgtggtgttcctggccgaggccttcacgcgcccggccatgatgcatgcacttggccgcgcagggttccagcagtcctacacctacttcacctggcgcaaaaccaagaaggaaatcgagacgtactttgcggaagtaagccacgagtctcctgcgttcttccgccccaacttcttcgtcaacaccccggacatcctcacggaatacctgcagttcggtgggcctgcggcgttcaagatcagggccgcgctggcggctacggccagcccgttgtggggcgtctacgccggctacgagctgtacgagcacgtggcccggcccggcgcggaagagtacatcgacaacgaaaagttcgagtacaaggcgcgtgactgggacgccgcggcgcactccggccggacccttgccccctacatcaccaggctcaacgagatcaggcacgcccatccggcgctgcaggacctgcagaacctgacggtccaccacagcaccgacgacgccacggtggtctactccaagcacaagacccttccggacgggtccaaggacaccctcatcatcgtggtgaacgtggatccgcacggaaccagggaatgcaccgtctcgcttgacctgcccgcgctggatctcgacccccaggacctgacccacaatggaggcttccacgtggatgacctcatctccggggagagctgggaatggggcgagtacaactacgtccgccttgacccgcatgtccagcccgcacatatcctgcgtgtgaggagaatgcatcagtgaatttcaatccgcagggtaccggccagcatttcaccccaaagagcacgtttgagttaaatgccccgggcctgcagcacgatccgctgtggtaccggaaggcggtgttctacgaggtacttgtgagggccttcgcggatgcgaacggcgacggttccggcgacttttccgggctcatcgacaggcttgactacctccagtggctgggcgtggactgcctgtggctgccgccgttcttccagtcgcccctgcgcgacggcggctacgacatctcggactacaactcggtcctggacgagttcggcaccatcagcgacttcaagcgcctggtggcggaagcccatgcgaggggcgtgcgggtgatcatcgacctgcccctcaaccacacctcggaccagcacccctggttccaggagtcgcgcaaggacccggacggcccctacggggacttctacgtctggagcgataccgacgaaaagtaccaggacgcgcgcatcatcttcgtggacaccgaggaatccaactggaccttcgaccccatccgccgccagttcttctggcaccgtttcttcagccaccagccggacctgaacttcgagaaccccaaggtcatcgaagcgctgttcgatgttgtccggttctggctcgaccagggcattgatggcttccgtgccgacgccatcccatacctgtttgaggaggaagggaccaactgcgagaaccttccggccactcatgagttcctccgcaagcttcgcaccatggtggacgaaagctaccccggcagggtcattattgccgaggccaaccagccgccaaatgaagtggtggagtacttcgggacggaggaagagcccgaatgccacatggccttccacttcccgatcatgccgcgcctgtactacgcactgcgggaccagaaggccgcccccatcatcgagaccatgcacgacaccccggacataccggacggggcgcagtggggaaccttcctgcggaaccatgacgagctgaccctggaaatggtcacggccgatgaacgcgccgccatgctgggctggtacgccccggacccgcgcatgcgggccaacatcggcatccggcgaaggctcgcgccccttctggacaactcccgtgccgaaatcgaactgatcaacgcgctcctgctctcgctgccgggcagcccgttcctctactacggggacgagatcggtatgggggacaacatctggcttgaagaccgcgacgccgtgcgcacgcccatgcagtggaacccggaccggaacgcaggcttctccaacgcggatccgggcaagctctacctgcctcccatccagtccctggtgtataactacgccatggccaacgtggaggcagaagccgcccattcggggtcattgctgcgctggacgcggcagatcctgagtgtccgcaagaaccacccggcgttcggccttggtgccttcaaacacgttgaggcggaccatgacgccgtgctggcctatctccgcgagctgcccaaggataattccgccggcgtcgacggggagaccatcctgtgcgcgttcaacctctcgcagcatccggtggcggcccagttgcgggtcccgcagttcgccgggcgcgggttgcgcgacgtcttcggcggccagccgttccccggcatcagcgaggacggaaccctcaccctgacgctcggcagccacgacttcttctggctgcggatccgttcagcagcctccaacccatcgtcgccatacacgcaggcgatgccgattctgtcgatcgagaactgagatgaaccagcccatacttacccccgccctcaccgccctgctccaggaatggctgccgcggcagcgctggttcccggtcaagacgcccgacttcgagatgtcccaggccggcagcctcgggctggaagacccgtccggccacgccgggctggccgtgttcctccttcgcgtcaccacacaaacgcccgacggcggcgcgcggacggccgtcgtccaggttcccttaagtttccggcacgcgccggcagccggaatggagcgggcactcgttggccaggccgccgggatggatccatccaggacctgggtgtacgacgccgtccacgatcccgacttcgtgggcagctggctggaactcatccggcaggaggaaaaggcacccaacggcactgcagcaggcttccgcgtgcccggggagctccggctccctactgcccgcggagttgtgaaggtgctgtccggtgagcagtccaacagttcagtcattgtggacgacggcgaatccgcggccatcgtgaagttcttccgggtgctctcggaggggacgaatcccgaggttgaggtgggtgccgccctcacggctggaggcacttccgaagttccagccacccttggctgggtgcgtggcgagtggctcggcgagggtctgcccgcgtccacaacagccaaggggccccggtatgtccagggcgagctggcggtagcgcacgagttcctggccggcggccgcgatgcatggcgccttgctgtcgatgctgcccgctcgggcaccgacttcacggcagaagcacatgccctgggtgcagccacggccaccgtccaccagcggctggcccaggcgctggggcactctgccgagccgcaacccggacaggtcattgcgtccgcagtagcccagcgggtccgcgaggcatgggcagaagccggtgccgccgtcggaccttatgacgacgccttgaacgcgctcctggaccgccttggccacgagcccgccggcccgctgcagcgcatccatggagacctccacctcggccagatactccaggttcccgggccttcgggaaaccctgcacggtgggccatcctcgatttcgagggtgaaccgctgcggcccgtcgccgagcggaacgtcccggatgttcccctgcgggacgtcgtcggcatgctgcggtccttcgactacgcggccggcgcggctcagcgcgaacaggagggcgcgcaggtgccggcaagctgggtggacgactgcgcggaggccttcctggccgggtacgcgggtgtcactcccggaacggtggacagggagtcgccgctctttgtggcattgtggctggacaaggcactgtacgaagtagtttatgaaatgcgtaacaggcccgactggctggcgatccccgtgaacgcctccagacggctcctgggcagcaaaggcgccggcggtcacgccggggcagcatcggaaggtaacgaaatgacaggctcagcacaaactgaccggccgggggtgccgctgaaggttgacgaaggcacccttggcagaattgccaacggtgaacaccacgctccccactctgtgttgggcgcgcaccttgacgattacggccacgtcactatccgaacggtgaagcacctcgcggaagcaatctccgtcctcacgccggcaggtgaggtcccgatggagcatgaggcacacggcgtgtgggttgccgtcctcgagccgctgcagcagggacacgttcccgactacaggctctccgtcacttacccgggctcggatccggtcaccgtggacgatccctaccgctacctgcccaccgtgggcgaagtggacctgcacctcatcggtgagggccgccacgaaaaactgtgggaagtcctcggcgcccacgtccagcactacaagtccgcgatgggggatgtggacggtgtctcctttgcagtctgggcgcccaacgcacaggctgtccgggtcaagggcgatttcaacgcctgggacggccgggagaactcccttcgctcgttgggctcctcgggtgtgtgggaaatcttcgtcccgggtgttgtagcaggggcgtgctacaaattcgaaattcggaccaaggccggccactgggtggaaaaggccgaccccctggccttcggaaccgaggtgccgcccctgaccgcatcgagggtggtggagccttcctacgccttcaaggaccaggagtggatggaagcccgcgcccagcgggacccgcacaactctgcaatgagcgtctacgaggtgcaccttggttcctggcgcctgggcctggggtaccgggaactggccaaggaactggtggagtacgtcaagtggctcggattcacccatgtggagttcatgcccgtggccgagcacccgttcggcgggtcgtggggctaccaggtcacctcctactttgcgccgacttcccgcttcggccaccccgatgagttccgctacctggtggacaccctgcaccaggcgggcatcggtgtgctgctggactgggtacctgcccacttccccaaggacgcctgggcgctggcccagtttgacggcgagcccctgtacgagcacgcggaccccaacctgggcgagcacccggactggggcacactgatcttcgacttcggacgcacggaagtccggaacttcctggtggccaacgccctgtactggctggatgagttccacattgacggcctgcgcgtggacgcggtggcttccatgctgtacctggactactccagggaagaggggcagtggcagcccaaccgcttcggcggccgcgagaaccttgaggccatctccttcctgcaggaagtcaacgcaacggtgtacaagacccaccccggcgctgtcatgatcgccgaggagtccacggcgttccccggtgttaccgcaccgaccagccacggcgggctgggattcggcctgaagtggaacatgggctggatgcacgactccctcaagtacgcctccgaggagccgatcaaccgcaagtggcaccacggaacagtcaccttctcgttggtctacgccttcacggaaaacttcctgctgcccatcagccacgacgaggtagttcacggcaagggctccatgttgcgcaagatgccgggcgaccgttggcagcagcttgccaacctgcgtgccttctttgcataccaatgggcgcacccgggcaagcagctcatcttcatgggcacggaattcggccaggaagcggagtggtccgaacagcacgggcttgactggtggctcgcagacatcccggcgcacaagggactgcagctgctgaccaaggacctcaacgagctgtatgcatccacccctgccctgtacacccgggacaatgaacccggcggcttccagtggatcaacgggggagacgccgaccgtaacgtcctctccttcatccgctgggacaaggagaacaacccgctggtctgcgccatcaacttctcgggagcaccccacgttggctacacccttggtgtacctgaagccggggcctggacggaagtgctgaacacagatgcaacaacctatggcggatccggtgtcctcaactccggtgagctgaaggctacggacaaggggcaggacggacagccggcaaccctcagcgtcacattgcctccgctgggcgccgcctacttcaagcccggagctcctgccgcaggctaagcacggctcgttgtgaaaggcccggaatccccgtgattccgggctttttcacgctctgttgactgcaggcaggggagggtttgctgcccggttggccttctggaaagagtggtggtagagtttatttccgcgctgctccacggagtcagacggaaaaaccgacactcaagcctttggctaaagagagtcgcggacgccggtttgacaagtgatgagctagccggtaagtttgtgaagttgctccggagcgatccatggctggtttgaggctgtggtggtgccgggtgtgtctgttgtttgagaactcaatagtgtgccaagtttgttgataccaattgttttattgattggttgttttggctgggcctgtccaccccgtggattgggtctggtttttacagctggtttcaaattttgtgcagcctggttccgcgttttcccgtggtgcctggttgtgtctgttcttcaacggagagtttgatcctggctcaggatgaacgctggcggcgtgcttaacacatgcaagtcgaacgatgatcccagcttgctggggg

SEQ ID NO: 25 - DNA, 187555 bp, Arthrobacter sp. OY3WO11
gtagatgccgcctttcggacgaccctctcccacttcctgccggcaataacctccccacccccacggcgagtgggtgagcgtcccggaaaacccgacattaagtgagacagcatcccgtaaaagcctgcatcacgtgagagagcatcccaggaaaccccgcatcaagtgagagagcgtcgcagggggaggggcggtaaagttgggcagcatggacagcctcttcagccacaagcacgaaccgtccggaggtgatggtcacgctgcattcgagatcctggaacccgtggtccacacggtggtagtaccgggaaccgtcgcgcacgcatttgccggcttcacggaccacacccacctctggtggcccctggaatcgcacggcgtctatggggccggctcttacgtggagttcgaggagaacctcatccttgagacggcggacgacggccggaccagcatctggggaacgctggatgactggcagccaccgttgtctttccacgcaacctggcatcccggcaccacggcactgtggtccacggagctcctggtggccttccgtgcagtcccggagggaaccgaagtgcgggtcttccatgacggctgggagggttccgaggaacccgccgccacgcgtgccaactacgccgatgcctggcccgggatccttgccaggtatgcccgttttatgggcgctacctgagcctgcgctcacgccgcggacgcgcgcgggccgcggcatccgccggacggccgcgtcaggttccccgcttagactggggaaaatccgcgacgacgtatggaggccaggttgggaagcgtagttgacgagctggagaggatcctggcgcccggtcaggtagacgcgggggaagtttccctccgccggtacgccgtggaccaggcccccgtgatcgacttccagctgccgctggctgttgtctttccggaatccgtggaagatgtccaggctgtagtacgcgcgtgtgccggcaccggcgtcgccgtcgtgcctcgtggcgcgggcactggtgtctctggtggggcccatgccacgaggaactgcattgtgctgtccctggagcgcatggaccggatcctggcgctcaaccccgacgacgaaacggctgtagtggagccgggcgtcgtcaatgccgtcctcaatgacgcagccgcggctcatgggctgatgtatgcgcctgaccccgccagcttccgcagttcaaccatcggggggaacgtggccaccaacgccggcgggctgcgctgcgccaaatacggggtcactcgggactccgttctggcgctggatgtggtgctcgccgacggctcactcatccacaccggccaccaaacgttcaaaggcgtagcgggctacgatctcaccgggctttttgtaggctccgaagggacgctcggcatcgtcgtcggggttaccgttcggctgaagtacctgccccgggacgtgcataccgtcgcagccttctaccccgacttccggcaggccgccgccggcgtcctggcagtggggagggcccgggtccagccggccatcatggaactgctcgacggcggcacgctggcccagctcgatgacatccacggatccgaccttacgacccggggctgctccctgctcctgatccagaccgacgggtatggcgctgctgccgaggcgcaggtggtccgtgatgtactgctggccagcggcgcggccgtcaccactgaagccagcgcggaggctgaacggctggtggagctccgccgccacagccggggggtagaggtcgacgacgaataccgcgtgggcgaggacgtcgccgttccccgttcgcggctggtggactacattgcagctttggaggccatggcgccgggccacggggtgcacctcaaagtcgtggcccacgcgggcgacggcaaccttcatcccaccttctggattgaccgtacgggcggcggtgtggacgccggcgccctggaacggctccagcgggtcctggacgagtccatcaccgccgcgctggcaatgggcggcacaatcactggcgaacacggggtggggcagtacaagctgcgttggctgggccaggagcagccagagccggtccgcgagctccagcggaggatcaaggaactgtttgatcctgagggaatcctcaacccgggaaaggcgatctagccttagtcgtcggagtccgggtattcgtcaatcgactcatcgtcgccgtagcgggactcttccgtctccacctcgaggatcttcagcatccccgtgtccgggttcagcatgatcgcggcttcatcccggcggtggcgcaggatggagtcgatgtaggactgcacggcctccgccagcggaatgtgccgctcctgcttctctgacatgtaccagcggtgctcgaggacctcgtgcaccacttcagccggttccagcttgccggaaagatcccgcggaatggacctgacgatcggttcgaagatctggctgacccagaggtgggcgctgtattcctcgtccatgtccgggttgttgtccgcccggaaggagtccatgtcgttcagcagccggcgcgcctggttctcctgcgcgtcgatgcccgtgaggcgcagcagccgccgctggtgatgcccggcgtccaccaccttgggctgcagttggatggtggacccgttctgggtggtcttgatggcgtattcctcgacgtcaaagccgagttcgttgagccgccggatccttgcactcacgcgccagcgctcaccgagttcgaaggattccttctctgtaagctccgcccagagccggcggtagctgtccatgatgagctcgctggtggcgactgggtccaccttttcctcgatcagcccgccgtcgagcaggtccatcagctcgccggcaatgttcacccgtgcgatctcaaggtcgtattcgcgctgtcccttggacaggtccggataaagctcgccggtctccgcgtccaccaggtatgcggcgaacgcgccggcgtcgcgccggaacagtgtattggagagcgacacatcgccccagtagaagccgatgagatgcagacgcaccaggagcagtgcctgggcgtcgatgaggcgcgtcagggtgtccttgcggagcatctgggagaagagggcgcggtacggcatggaaaacttcaggtgcctggtgacgagcaccgggttcaggggccgtccgtccagggtggtgcgtccggtgatgacggcgacgggctccacgcaggggacgtccaggcgggccagcttccggagcatgtggtactcgtggcgcgcaacgtgctcggaggtttccttgatggcaatcacggagccgccaaggtgggcgaagcgcacgatatggcgcgagatgcctcgggggagggccgccaggttttccgccggccagtcctcaagcgcgatgtgccagggcaggtccagcagctcgggatcggccgctgccgccgtgatgttcagggagctggaaaccgaggcagccttgccgtcatcggcgctggcggccacaaaccggggcagtttgccgatctgcgcatagtcggtgggttcgtcgtgccactgggcgctgtattcctcggtcatggggtcaattcttccgtacataggcgcggccagctaattctttcgcgtgcgcggttaaaggccgacggcggcccgcaccgtttcgaagggtgcgggccgccgtgggttggtttggtgcggtgccggtgggtgggcccacgccggcagggttccctaaccgaagcgaagcgaggttagggtgccggtggggactagtcgcccaggcgcaggccggtcttggtgtcgaacaggtgcacgtggcccgactgcggacggacgtagatgacctcgcccttcatcggagggcggcggccgtcgacgcgtgccacgatgtcgtggtccttgccgtcaagggtggtgtggccgtagacgtaggcgtcggcaccgagctcttcgacgacgtcgacctcaacctgaaggccttcgccctgcggagcggtttcgaggtcttccggacggctgccgagggtaaccgttgagccgtgcgcctcttccaggacgttgcgcggcacggggtacaccgttccgccgaactggacgccgccgtcgacgacgggcagctcgagcaggttcatggcgggggagccgatgaagccggcaacgaagacgttcttgggcttgtcgtacaggttgcgcggggtgtccacctgcatcagcaggccgtccttcagcacggcaacgcggtcacccatggtcatggcctcgacctggtcgtgggtcacgtagacagtggtgacgcccaggcggcgggtcagcgaggcgatctgggtacgggtctggacgcggagcttggcgtcaaggttggagagcggctcatccatgaggaagacctgcgggttacgcacgatggcgcggcccatggcgacacgctggcgctggccgccggagagtgctttcggcttgcggtccaggtactgctcgaggtcaagaagcttggctgcttcgcgaacgcgctcggcgcgctcttccttggagacgcctgcgatcttcagggcgaaacccatgttgtccgccacggtcatgtgcgggtacagcgcgtagttctggaaaaccatcgcgatgtcgcggtccttcggcggaacatcggtgacgtcgcggtcgccaatgaggatccggccggcgttgacgtcctcgaggcctgcgagcatgcgcagggaggtggacttaccgcaaccggagggtccaacgaggaccaggaattcgccatcggcgatgtcgatgttgagcttatcgacggcgggcttatctgtgcccgggtacagacgcgtagcgttatcaaaagtaactgtagccacagttatcaatcccttcaccggcaggtacgtgccggacgatccgttgtgaatggttcatgtttgttcagttatgtactgctggcgcaattctgccgaggcggaagagcgctgagtgacgccgcacggttcttgtgcgccacatcacaagcaagagtatgtcagatgttctactaatggttgcaaatgttacggacgtcacacgtgagcttgcacaacctgcgtgcgctgcctcactccgcgtctgtccggggatcttcctcagcgacggcgatgcttcgctcctgaagcagtgcctccaacagttccgccacatggaccggagcctctacccggtactgggcctgggtaaaatcgagtcccactttaacgccgacgtctcctggctccagccgcgccagcgcatcctcgtccgtggtgtcgtcgccggcaaacaggaccccggtagcgccggtgatctgccgcaggaaggtgactccctcccctttggaggcattaacgacagaggtctcaaggacccgctttccgtccttgaggaatacccctttccggtcctgcagcagcgaacgtgcagcagccacggcatcgtcggcgacgtcgtcgggggcgaggcgggtgtgcagtaccaccccggcgggcttgtcttcgagcatggtgcccggtgcttccttgacgatgtcctccaagacggtgcgcacatcggcaaggagcgctttttgctcgggctcgagtgcgagcccggtggagccagggcccagccatgcctctgctccgtggctgccgatgaggagggtgttcaccggaggagacgcgactgctcgcaggctggcgagggcgcgcccggagatgagggccgtcgtcgttcgtggaaggacggcgagcccggcgaaagccgctgcggagcgcggcagtggccgcgcgtcgtccgcgtggccgacgataggcgccatggttccgtcgaagtccatggccaccagcaggtgctcggtcccggcgatctgccggatggcctcccgaagttcaggcgtcagcgcgagcttgtccttcgcgtggcgggcatcaggagtcatctcggaccaccttttcgttgagcgcatgcaggaagtcggcagaccagtggtccacatcgtgctcgaggatctgcttgcgcatggcccgcatgcgccgtgcggcctccctcggctgcatctccacggcgcgcatgatggcgctcttgagcccgtcgatgtcgtgggggttcatcagcagggcctgcttgagctggtcggctgcaccggcgaactcactcaggaccagggcgccgtcgttgttggtgcgtgccgtgacgtattccttggcgacgaggttcatgccgtcccggagggccgttaccagcatcacgtcggcggcgaggtacagggccaccatttcctccaccgggtagctgtggtgcaggtagcggacggctgtgttctcgatagtgtcgtaggtgccgttgatatggcctacggtgccctccacttcctcgcgcaggagccggtactgctcaacgcgctcgcggctggggctggccacctggatcagggtggcgtcgccgacagagagcttgccgtctgccaggagctcctcgaaggccttgaggcggtgccggatgcctttggtgtagtccagccggtccacgccgagcaggatggtcttggggttgccaaggtcctggcggatttggcgtgcccgctcaacgatttccggttttgcggccagctcgctgatctgccggacatcgatggaaatggggaaggcctgggcccgggcgatatgggtgatctggccgtccggccccttgacgtgcacctgctgctgcttgacgctggcgcccaggaaccggcgtgccgaccgcatgaagttaccggcgtcgctggtccgctggaagcccacgaggtctgctccgaggagcccgtcgatgattgcctggcgccatggcagctgggcaaaaatctccgggggaggaaagggaatgtggttgaagaacccgatgcggaggtccggcctcgcttcgcgcagcatgcgcggcaccagctggagctggtagtcctgcacccatacggtggcgccctcgtcggcgtggcggacgacggcgtcggcgaacctccggttgaccttgcggtaggcgtcccaccaggtccggtggaactccggcggggcgatgacgtcgtggtagagcggccagagggtggcgttggagaacccctcgtagtacagctccacgtcttcggtgctgagctggaccgggacgaggtccatgccgccgtggctgaacggtttcaccgtctcatccggagcgccgtgccaccccacccaggcgccgtctgtcttggtcatcatgggcgccagcgctgtcaccaggccgccgggggagcggcgccagccggagccgtcgtccccgctctcgccgggggcgcagcggtccacgggcagcctgttggacaccaccatgaagtcgtactttgtgtcgccgccgtggcctgctccggcggcgccggacgccgccggggcggtgggtttttcctggacgggtgtttgcattgcggccccctggggtttgcttgtgcctctgtgcccaccctaacgggacggaatcttccgtgctattcggccgtccgtcaaccccgccaatacttgaaggagcaagctcccagctttctcccctaaaatgtatggagttgccacgaagtggtcccccccacgtcaaccgacccaaggaacacatgagccctgcaaacgaagtccgtaagtccaaggctgagcgaaccgcggaggcgcgggaaaaggcgcgcctgatccgtgaagcgcagctgaaaaaggacaagcgcaacaaactgctcatcggctggggcatcgtggcggccgtcgtggccatcctggctgttgtcgcgttggtggtgaccaccagcatcaggcagaacacgcccgtcgccgaccagggtcccgtgcccgccaacgcgaacgtcaatggtggtgtgacactcctggccaacaccgacgtcaagcagacggatcctgccaccgttgacgtgaccaccctgaccaagcccgagaccccgcccagccccgtggtggccccgggggcagaagccgaagctggacagcctgtcaaggttattgcctacatcgacttcatctgcccggcttgcctgcagttcgaaaaaacgtacaacgaagccctgaccagcctccgtaatgaaggccagatcaccatggagtaccggcccctgggcttccttgaccgccagtccaccaccaactactcatcccgttccgccaatgctgctgcctgcgtagcggagaaggcccccgagaagtatgcggaatacgccaatgtcctcttcgacaaccagcccgcggaaggcggagcgggcctgtccgatgacaagctgaagtcccttgccagcgacattggcgccgacatcaacagctgtgtggacgacaaaaccttccgcccctacgtcaagtactccaccgagctggcggcgaacagtgggatcaccggaacgcctacggtcttcatcgacggcaagcagtgggacggccgcacggacctgaacgctgaaatccaggcagcaatcgacgccaaggcctaaggccccagcagcaccctttacacccagcggcctgttcccggattcttcccggaacgggccgctggcgttaacgcggaatcctgtggagccgcaggcgtttttaccaccggcaccagttgggctaaccttatctagcgccgttcaggcgccgcccgcaggggcacgcctccttagctcagttggccagagcaccgctcttgtaaagcgggggtcgtcggttcgaatccgacagggggctccaccgccgaacattcctttcaggccgaacgcccctccgtgaactccgccagttaagctggtttcatccgcatgatcagcctgctgatgaaaggagtgtgggtggcatgcccaagaccggcaagaacgaccacgcacgcaaggaagagcttccctccaccctgcagcgctctgggcaaaaggcccaggacacgttcgccaagacctacgattcagccctcgaaagctacgacaatgacgagggccgggctgcgcgggcagcctacgcctccctcaagcacagctacgagaaagtgggagaccactgggagccgaaggaaaagcgcggtccctcggacaagcgggccgaggagggcggcacttcgtccgagcccaccgcgggaggggtggacgcgaacgcctccaaggagcacctctacaagcttgcccgggagctggacatcgacggccgttccacgatggacaaggatgagctggtcaaggccatccagaaggccaatgacgccgccacccggaaggctcgcggcagctgatcccaggccctacggctcttgccgatccaccctccagggtgtcgaatcagaggacacatctcagtccggtcggatggcaaagacgccaggaggtttcccatgtcggtcaagggcaccaaggactcagccaggacggcagctggccgcaacggagccgagtcgcgccgtgcagacgcctctgccggtattgccgccgaggatcctgccaaaatccggaatgtcgcgctcgtaggccattcgggtgccggcaaaaccatgctcatagaagcactgctcgctgcccagggaatgatcacgcgcaaaggatccatcccggacgggacaacggtcagcgattccgaccccgcggccgtacaccagcaacgctccgtgaccctgtccctggtgccgctgctgatcgacggcatcaaagtgaacctcctggatacccccggttaccccgatttcatcggcgagctccgggcgggcctgcgcgcggcggacgccgccttgttcgtggtgtccgctgtggacggcatcgacgccaccaccaccgcactatggggtgagtgcgagctcatgcagctgccccgcgccgtcgccatcacccggatggaccacccgcgggcagattacgacggcgtcctggccgcctgcaggaagtcattcggggagggcgtcctgccgctgtacgtcccggtgcgggcgggcggtgaggtcactggcctgatgggactgctgtccggcacggttacggactattcgtccggggagccggccgctgccgtgcgggcagcggatgcgtcggaacgtgccgcctccggtgccgccaggggtgagctcattgaggggattatcgccgagagcgaggacgagaccctgatggaccgctacctcgaaggcgaggacatcgacactgatgtcctcatcgccgacctggaaaccgccgtcgaacgcggcaccttcttcccggtcctgtccacgtccgccgtgagcgggctgggcaccgcagaactccttgaggtgctggtccgggcttttccatcaccgcaggacggcaccgtgcccggggcgaccgacctggcgggctcacccgcaggggccctgcgctgcgatcccacgggaccgctggcggcggaggtggtccggacctccgtcgatccgttcctgggccgggtctgcctggtccgggttttctccgggacgctgcgggaggatgcgccggtgcacgtcggcggccacgggctggcggaccgcggccaccaggaccacgactcggacgaacgcgtcacgcacctctactcaccgctgggagcctccctgcggcccgtgccgtactgcgtggccggcgacatgtgcgcggtggccaaactgggaagcgccgaaacgggggacaccatctccggacgggaccggcccctgctgctggccacgtgggaaatgcccgagccgctattgccggtggcggtggaacccgactcacgcagcgacgaggacgcgctcgcgcgcagcctggggaagatcgcggccggcgatcccaccctccgcgtggagcggaactccgaaacgcaccagctggtcctttggtgcatgggcgaggcccacgtcgaggtagtcctggaccggctccgcgaccagggcgtgaaactgcacacggtggacgtggtgacgccattacgggaaacctttgcagcacccgcggcgggacacggccggcacgtcaagcagtccggaggccacgggcagtacgccgtctgcgacatcgacgtggagccgcttccccgcggcgggggtttcgaattcgtcgacaaaacggtgggtggcgttattccgggaacctttatcccgtccgtggaaaagggcgtccgggcgcaaatggagaagggcgtgagcgcgggtttccccgtggtggacctgcgggtcacgctcacgggaggcaaggcgcacagcgtggattcctcggacgcagcatttcaggcggcgggggcactggcgctgcgggaggccgcggcggccgggcggatccagctgcttgaaccggtgtcgtcagtgaccatcatggtggcggacgagcacgtggggtctgtgatgagcgacctgtcatcccgtcgcggccggctcaccggcacaacgtcctcgggcgaaggcctgactgaaatcggcgctgaagtcccggaccacgagctcctgcggtacgccgtggacctgcgggcgctcaccgccggaacggggcgcttccgccgccgttacctgcggcatgaccctgtgcctgccagcttcagcccctcgtagtagccccgccatgaacgcggctgcccggaagatccagcgcgtctatctcacactgaccctgggaaacacccttgcggcctcgttcatctggggaatcaacaccctcttcctgctggacgccgggctgaccaaccttgaggccttcgccgcgaacgccttcttcactgtgggcatggtgctcttcgaggtgcccaccggcgtggtggcggacagctgggggaggcgggcttccttccttctggggaccgtcacgctggccgggtccaccttcctctacttcctgctgtggcagttcgccgccccgttctggtggtgggccgccgtctcggtcctgctgggcctgggcttcaccttcttttcgggggcggtggaggcgtggctggtggacgccctgcgcttttcgggatatgagggcggactggaggtggtgctcgggcgcggacagatggtgtccggggtggccatgctcaccggctccgtggcaggcggggtgatcgcccaggccacgaacctgggggttccgttcctggtgcgcgtgggtgtgctggtggcgatgtttgctgtggccttcctgctcatgcacgacgtcggcttcacgcctgaacgctcggcccaccccctgcgggccacccgggccgtcctcaaagcttcagtggacggcggcctgaagcatccgcccgtgcggtacatcatgctggctgcgccgtttaccgaaggcgtgggcatctacgtgttctacgctttgcagccctacctgctgcagctgtttggagatccccgggcctacgccatcgccggcctggcggcggcactggtggcaggagcggacattgtgggcgggtggatggccccgcgcatccggaaactggtcaaacggcggaccagcgtgctgatcgccaccaacatcgtcagtgcactcatcctggtggtgctgatgttcaccaccgctttctggctcgccctggcgctccttgcgctgtgggccgtggtgtcctcggcgggcacgcccgtgcggcaggcatacctgaatgacatgattgcatcgaagcagcgggcaacagtgctgagcttcgattccctgatgggctcggcagggggagtcgtggtgcagcctgcgctgggcagggccgctgacctctacggctacccggcttccctggctgtgggcggtgcgctgcagctgatcgcggcaccttttatcctgctcagccgcagacagctgccgaaggcggacacggcatcggacgggacatcggcagcgccctagcagctgcccgggctgcagcggcagttctgtttcagtcagagtccatcagttcgagcagcttcttggccgcgtccctgatgtcatcgtgcccgtactgcgccgccctgccttccagcgagatgacagcgcagcggtggatcttgctgaaatccccgaacgggaagctgacgcttcctttggtcccctccgatttatcgtcgtcgtggccaaggtgccagtccgcgaaggccccgaaaccgtgcttgtcgataaaggagttctcctgctctgtggacggcgcgtgttcactccagtcatcccggacatcgcgttggacctttcccgcctttatgagcttgcgcgcgtgggtgagtgccttccggttcagccgtactgccatcctgcgtccttccgtttctacgctggaattgctcgggctgcggtcagccggaggaactccagcctagaagcgcggcagggaaaccgctacggattaacgccggcgagaccgcgacgaaacgcgcccacaacaatcgctgcgtagctttcaggcatgatcgcaaacatccccggccggttccgcgcgtggctcattgacacgtttacctacgaatccggccaacaggcagccgatgccatggctgatgccacccggtggggatggctgccggcgctgagcggggtggcggtcgggggagaatacgccagacggagccacaatgaatccatggtgcagggcagcggaatgcctggttgaagcacactattgcgccggtagcgggaatatgccctaaactgcttcactgaggtgcctgaaatggcgctgcgcagcaacgaaagtgaacacgctatggctaccgattacgatgctccacgcaagcaggaagaagaatctccggccgactcgctggaggccctccaggcgtcgcgtggcggcaacgcgcagaccgcagtcattgacgtcgacgagaacgacaccgccgaaggcatagacctgcccggcgcggatctttccaacgaggaactgacggtcattgttgttcctgaacagtctgatgaattcacctgctcatcctgcttcctggtccgccaccgctcccaggttgcccgcgaaaagaacggcatgaagtactgccgggactgcgaaggctgacgcctcccgaacttccctgcgccggccacctctatgggtggccggcgctttttcgtctcctgccgtcgttatgccggtaacggcaaggtgcaggaacagttcaacagcggggcataaacagcccaaacagggccaacgaaagcccgttttccgcactggatttatgtgtgcgtgatgcgtggcgccgcagcctaacggttgcgcggcgaagcggccacaggcctcgatctgcgccggtaacgctcctacccttgagctatcacatcgctcaacacatgggtggccccacaatgaaaaagttctccatctggctcgccgccatcctcatggctgccgggctgggactcgtggcaccggggcccgcctcggcaaccacttcctattgcgggctcgtctgggggtccctggcgaaatccgactcggacatgggcaccgccaatgccaccaacgtccgcacggggcagcactactgcttcgacaggatggtggtggacctcaacggccctgccgccggctacaccgtgaggtacgtcccccaaatagtgcaggacggatccgggttcaccatcccggtccggggaaacgggcgcctgcaggtgacagtcaacgctcccgcctacgacgggaacggcaactccacctataaccctgctgaccctgccgagctctccaacgtggccgagtaccagaccttccgccagatggtctgggccggaagctacgagggctacaccagcattggcctgggtgtccgcgcccgccttccgttccgggtcttcaccctggacgggccgggttccggatcacgcctggtggtggacgtagcgcactactggtgacaggtggccgtagacggaaaggtgccgttctccctggtacgggggaacggcacctttcctgcgcccgggcagttgggctaacccagggtgactattccggcaccacgagcgcgggggtatcccgcttgagggtttcgccgcggaagaagcccgggcggaccttggccatgatgagcatgacggcggcgcctgaggccaggatgccgacaccgaggacgaacaccaggcccactccgaagatttccgagccgctgccgaactccggggcccagctgtccactgcggtctgcaggaacaccacgaacaggcccaccccgcccagcaccgggcacaccagccggagaacgaagtgccgcaggctgtcgaagacgctgtggcggaagtaccaggcgcaggccagcgccgtcagtccgtagtagaagcagatcatcagcccgagcgccaggatggtgtcgttgaggacgttctcgctgaccacatgcatcaccgcgtagaagcccgcggacatgatgccggcggcaacggtggcgaagcccggcgtcgcgaacttcctgctgacgcggccaaacggtgcgggcagggcgccgtagaaccccatagccagcatgctccgggagggcgacatgaacgtggactgcagggaagcggccgaactggacagcacggcaagggacatgaggatggcgaacggacccatgatgggggaggccagggcggtgaagatgttctcatggatctcggtattgttcaggccgttgccggtatccccgacgccggcgaacatcatggtggcgatgctcaccagcaggtagatcgccaggacaatgatggcggtgagggtgccagccagcccggaggtcttcctgccgttggaggtttcctcattgaccgtcaggcagacgtcccagccccagtagacaaagatggagagcgagatgccggcagcgatctgcccgaaagtctcgatcctggtgacgtcgaaccattcccagctgaacgggatggcggtctctgacgaggaccagttggcaaaggccatgccgacgaacagccccaggaccagcaactggaatcccaccaggatgtactggaccagcttggtggtgtgaagtccgcggtagctgacccagacggccagggccacgaacacaaagcaggtcagcacgttcagtgccttgtttgcggacagctcggcgagcccgggggagccggtcagctgcgaaaggaagagatagaagaagtcgacggcgactcccgcgaggttggagagcacaatgatgttcgcggccagcaggccccaccctcccatccagcccacccaagggccgaaggccttggtaacccaggtgaaggtggtgccgctgtccggggaatcggcgttgagttcccggtaggccagggagaccaggatcatggggatgaagccgatcaggaagatgacaggcagctggagcccggcttcgttgaccgtggggcccagggcgctggtgagggtgtaggcgggggcaatggtggaaatgccaaggacgacgacggcgagcagtcccagctgcccgcctttcagtcctttggggctgatgccggacgtcccccgggaatgcggcccggaaccggcaggggatgttctggtgcggatggtctcggtcatggcaccactttctggaagatgttgagacaacggtcactatatgaatggcgttcatttagtatgagtgcgtgtgacgcgggacgcaagggtaaatatgaatgccgttcgtttatgtccgtgattcacgaattagtaagctcactgagaaatcccctgcggaccggccacagcgcgctgtggtgctgatagcgtcgggactactggaccaattgaggaggacgcatgaaagcttcaccgacactgaccaacaacctgcaggccgtgctcgccgacctgatcgaactgcacatccagggcaagcaggcgcactggaacatcgtgggaaccaacttccgcgacctgcacctgcagctggatgaaatcgtggatgctgcccgccagttcgccgatgacactgccgagcggatgcgggcactgcacgcgctgccggacggccgcagctccaccgtggcagagtccacgagcctggcccagttccctgaaggcctgatcagcaccaaggacgcgatcgaacgcatcgtcgctgccctggaggctgccgttggcaccatgcgcaaggttcacgatgaagtggatgaagaggatcccaccaccgcggacctgctgcacgagttcatcgccaagctcgagcagtacgcctggatggtcaacgccgagaatatgaagcccactgccagcgttacggcgccggacgcaaagtagcagcgtacgcaacgaagcggagtgcacggcgtccgcagccggaggtgaatcctccggctgcgggcgccttttgctgtccccggcgctcaaggcacctttcagctgtccgctgtgggcactttccgaagtacgacggcggcgaggactgccgccgtcgccatcagtaccagcccaattgctgcggtgatgtgcactcccgaatcgaacgcagctgccgcggccaggcgtatggcctctgccaggggctggggcagccgggccgccagctccacggcgccggcgagggtctcgccggcctgcgcagcccccgcggtggaggcggcttcggtgatgcccgccggcagccgcaggttgtgctggtaggaggccgtaaggatggagcccaggaccgcggttcccagcagggcgccaacctcgtagcccgtctcggaaatcgctgctgctgcgcctgatttctccggcggcgcgcttcccaggatgaggtcgttggagattgtctcggcagtccccacgcccagcgcgagaatcagcagtgcggccagcagcagtgaggggccgcccgcatggctgccgaaagtgaccaggctgtagcccccggcactcatcgccagccccgccgccaccacgaagccggggcggatcctccgtacggccggcactgcagcaagccctgcaacaacggtggccaccagggccggaatcatcgccattccggcggccgaaggtgacatgccctcgatgagctggaggtgctgggccaggaagaggatgaacccgttgaaggagaacagggccaggacgttggccgtgatcgccatgctgaaaaccctgttccggaacagggacatatccagcagcgggctgtgcaggcgctgctggcgacggacaaaaacggcacccattgccacgccgaacgccatggttccaagggccgcgccgccgggtccttcggtggcgaactccttgatcccgtagaccacgggggccatggtgaacaacgaaagcaggatgcttggcacgtccgccttccccggagacggatcccgggattccggaatgaaggcggggcccaggaccaggagggggagcatgatgggtaccgctaccagaagcacagctccccaccagaactgttccaccagccagccgccaaagatcggcccgagcgcggcgccgcccgagaatcccgcagcccagaccgcaatggccagccgccgccggttggggtccgggaagatgttccggatcagcgacagcgtggagggcatcagcatggcgccaaagaaacccagcgacgccctgcccgcgataagccagccggcactgggggcaaaggcggtggctgctgatactgccgcgaagccgatgctgccgatgatcagcagccgccggcgtccgatcctgtcgcccaggctccccatggcaaccagcagccccgccagcaccaaggggtaggcgtccacgacccagaggagctcaactcccgaggagtccaaggcgctcgcgatcgccggcagtgcgaaggtcaacgctgtgttgtccacggcaaccagcaggacggggaacatcagtaacgccagtgccagccagtcccgccggctgccccgggaggtactgcccgtggggtgggcggactggggggacggggcggggtggaagctcttgggctgggacacggcggacggggtcatggacttaactgtaccgtctggacggtatagttaagaaatcgaacaccaaccgtgcatgatgggaaccatggccaggaaacccgtcgcgcgagatgcagtcctcgatgcttttgaagagctccttatcgatgtgggggagcgggccgccaccctcgatgcggtcgccaggcgggccggcgtctccaagggcggcctgctgtaccacttccccaacaaggaagcgctcatcacggccaccctcgagcggctggaccggctggcaggggaggacctcgcggcgatgtccgccgcgcaggaaggggcggccgcgtacttcatccggtcatccctctggtccgacaccccaatggaccgctcctttgttgctgccacccgcctggcggaagtggcgcacgaggaggcacggcgccgctttgctgcgatccagcagcagtggctggacctcatcggtaaggacgtgggcacggccatggccaaggcggtgctgtacatgggggatgggctgtacttcaatgccatgtgggagagcggcccgtccggcaaccccgggaacaggcgggaggacgtggaggaactcctggcggcagtggagcggctgaggggctgaccggcatttgcccgcgggcccgcagcgtaggagaattagcccatgtgtgggccgtcaccggcaaccacaaacactacaaatcaatagcctttgatctgcggcgggagagttctgccagaaggtacaagcaggcgccgtaggagcaatacctccccaggaatctcacaggcccatgtaccgccgcggcgaggcaactctggaaagcagcaggctgtcggctcggagatccggtcccggaaatccaggcagctgtgctcaccgacggtgcaagcggggccagcccaggcaggccacgcggaaactctcaggtccaatacagagcggggagggacacgaatcgatgtggcgtaccctgcgccgccttatttatggagttcctcgtgactgtatctccggcctccgccaccccggcctccgccacccatgcttctgccgaacccgcttctgctgccgccttcgttgaccggcacatcggcgcaaggcgccaggccgacgtcgacaccatgctcaaggccgtgggctatgacacggtggacgcactggttgataccgccgtccccaaggacatccggcaggacttcccgctggaactggcaggtgcgctgagcgaagtggaggccctcactgagctccggaggctggccgccaagaacaagactgccgtgcagatgatcggccagggctactacgacactgtcaccccgccggtgatccggcgcaacatcctcgagggcccggcctggtacacggcctatacgccttaccagccggaaatctcccagggccgtctcgaggcgttgctgaacttccagaccatggtgcaggacctggtgggcctgcccatcgccaatgcgtccctgctggacgaagccaccgccgttgcagaggccgtcctgatgatgcgccgggccaacaaaaataaggacgcccgcgacggcaagacagtgctggacgccgactgcctgccgcagaccattgctatcgtcaagggccgggccgaggcactcggctttgaggttgaagtggccgacctttcccagggactgccggacggcgccatcaacgggatcgtcctgcagcagcccggcgcttcaggcagggtcttcgaccacagccaggtgattgccgaggccaaggaacgcggtgccctggtgaccgtggccgccgacctgctggccctcaccctcatcacccctccgggcgagcagggcgcggacatcgccgtcggctcggcccagcgcttcggcgtcccgctgttctacggcggcccgcacgctgcctacatggctgtgcagaagggcctggagcgctcgatgcccggccgcctggtgggcgtctccaaggacaacgccggcgttcccgcctaccgcctggccttgcagacccgcgagcagcacatccgccgcgagaaggccacatccaacatctgcactgcccaggcactgctcgccatcgtggcctcaatgtacgccgtctaccacggcccggagggcctgaaggccattgcgcagtcggcgcacgcgcacgccaggagcctggctgcgtccctcaaggccgcaggcctcgatgtgctgcacaccagcttcttcgacaccgtcaccgtttccgtgcccggcaaggcagcccaggtcattgccgccgccgaggcaaacggcatcaacctgcgcagcatcgatgcggataccgttggcttctcgaccgatgagaccacgacgacggcaatcgtcgacggcgtcctcgccgcctttggtgccgcgccggcagaggtgacggacgcgttcgcactggacaccgccgtcgaacgctcctccgacttcctgcagcacccggtgttcaacacccaccgctccgaaacccagctgctgcgttacatccggaagctttccgaccgggaccttgcgctggaccgcaccatgatcccgttgggttcctgcaccatgaagctgaacgccacggccgagatggaagccatttcctggccggaattcgcctcgatccacccgttcgccccggactcccagaccgagggctggcgcgagctcatcgcggacctggaagcccagctgaccgagatcacgggctacgaccaggtgtccatccagcccaacgccggctcccagggcgagctcgcgggcctgctggcgatccgcggctaccaccactcacgcggcgaccagcagcgcaacgtctgcctcatccccgcctcggcgcacggcaccaacgcggcgtccgcagtcctggccggcatgaaggttgtggtggtggccacggcgtcggacggcaccatcgaccacgccgacctgtacgccaagatcgaagccaacaaggacgccctgtcctgcatcatgatcacctacccctccacgcatggtgtgtacgacgccgacgtccgcgaggtctgcgacgccgtccacgccgccggcggccaggtgtacatcgacggtgccaacctcaacgcccttgtggggctggcgcagccgggcaaatttggcggggacgtgtcccacctgaacctgcataagaccttctgcatcccgcacggcggcggcggacccggcgtcgggcctgtggcagcgaaggcacacctggctccgttcatgcccgggaacgctgccacctggacggaaggcaatgacgtccccatctccgcctccaagttcggctctgccggggtgctgcccatttcctgggcctacgtgaagctgatgggtggccagggacttaccgaggccaccaagtcggcgctgctggcggccaactacgtcgcggcacggctgaacgatttcttcccggtcctgtacaccggcgaagccgggctggtggcgcacgagtgcatcctggacctgcgcgacctcaccgcccgcaccggcgtcactgccgaagatgtggccaagcgcctgatcgactacggtttccacgcccccacgctggcgttccccgtggccggcacgctgatggtggagcccacggaatccgaggacctgggcgagatcgaccgcttcatcgaagccatgatcgccatccgcgccgagatcgaccaggtggccaacggcgatttcacggtgggggacagcccgctccggaacgccccgcacaccgctgccgcggccatcagcagcgactgggaccgtgcctacccgcgcgagcaggccgtgttcccggtgaagtcactcaagcaggacaagtacttcccgccggttggccgcattgacggcgcggccggtgaccggaacctgatctgctcctgcccgccgctctccgaattcgaaaactgaggacgcttgccatgactgagaagcgcaccgccctctacgacgagcatacgaagctgggtgcctccttcaccgatttcggcggctggcagatgcccctgaagtacagttccgaactggccgagcaccatgctgtccgtaactccgcggggctttttgacctttcccacatgggcgaggtctgggtcaccgggctggaggccgccgcgttcctggactatgcgctggtgggaaagatctcggccatggccgtgggcaaggccaagtactcgctgatctgcactgaggacggcggcatcatcgacgacctcatcacctaccgccggcctgccgttccaggcgccggagatgtcggcgcggaccgcttcctggtggttccgaacgcaggtaacgcggacgttgtggccgcggccctggccgaacgtgcagccggctttgacgtcctggtggacgacgcctccgctgccacctcgctgatcgctgttcagggtcccaaggcacaggagctgctgctgcgccttgtcccggctgcccagcacgggctggtcacggagctgaagtactacgccgccgtggaggttccgttcctggtgggaggtgccgggcaggaactcctgcttgcgcgcacaggctataccggcgaggacggctttgagatctttgtggcgaacgacgacgcctccgccctttggcaggcactcgtcgccatcgcggaggatggggagctgacgcctgccgggctggcctcgcgtgactccctccgccttgaagcggggatgccgctgtacgggaacgagctctcgctgcagggtgacccctttgccgccggcctgggacccgtcgtcgcgctctccaaggaaggcgacttcgtgggaaaggccgccctggccgccaggaaggaagccggagccggatccacggcaggccgcaggcttgtgggactcaaaggactgggccggcgggccggccgcgcgcactaccccgtgcttaaggacggcggccccgtgggtgaagtgacctccgggcagccttcacccacccttgggtatccgattgccatggcctacgtcgaggttgaacactccgaacccggcaccgccctggacatcgacctgcggggcaaggcagagccctttgtcgtcgtcgacctgccgttctataaacgcgccacgtagctggcccgtctctggctgcgtgaccggcggaccggacattttcacgcatgccgtgggcccacgccgtcagggttccctggccgagcttgcgaggttagggagacggtggggagcacgctttcgaaaagtccggctccgccggcccctcgaggtcaggtcgcctcggtgacatgccttcggagtgggcggggcatccggcagcgtgtgtctacgcgagcgtcacgtccgcgcagcgggcgtctacgcgaccgagcacgcagaggatgtcctgcccgctccaccccaaccacccgttttagtaaggaaccacgcgcatggctgttggcgtattcgaccttttctctattggtattggcccctcttcttcccacaccgtggggccgatgcgggctgctgccgtgtttgccggggagctgaaggcttccggcttgctggcggaggtggcttcgttgcgggtggatctttatgggtcgctcgctgcgacgggtcatgggcatgggacgatgacggcgattttgttggggttggaggggttccatccggagctgatcctgccggatgaggtggagcagcggctggccgcgatcgcggaaacggggttgttgcagttggccggtgcggtggcgttgccgtacggggtgaaggatatggtgctgcggccgttgactgtcctgccgcggcatacgaacgggatgacgttcacggtctccgacgccggcggccgggttctgcatgcggcgacgttcttttcggtgggtggcgggttcattgtccgggagggtgaggaggacgcggcgctgcaggagctggaggagtccaagcaggagctgccgttgccgttccggaccgccgccgagttgctggagcactgccgggtgaccggcctggggatcagtgaggtgatgcgggttaacgaggaggacagccgcaccccgggggagatccgggaggggttgctgcacatttactcggtgatggaggggtgcgtggctacgtccctgaagcgtgagggtgtgctgccgggcgggttgaaggtccgccgccgtgccccggactggtatgaccggttgcggaaggaaagtgcacgccctgccgtggacggccaggacggttccgggaacgacgccggggccggggagtttcatgatccgaagtattggcaggagtgggttaatttgatcgctctggcggtgaatgaggagaacgcgtccggggggcgggtggtcacggccccgacgaacggtgcggcggggattattccggcggtgctgtattacgcgcttcatttcgcgccggggatggagaaagccacgcagcaggaccgggacgacgttgtggtgcgtttcctgctcgccgccggcgcggtgggggtgctctataaggagcaggcgtcgatttcgggggctgaggtgggttgccagggtgaggtggggtcggcgtcgtcgatggccgctgccgggctggctgaggtgatgggcgggtctccggcgcaggtggagaacgcggcggagatcgcgatggagcacaacctggggttgacgtgtgatccgatcggcgggctggtccaggttccgtgcattgagcggaacgcgatcgccgcggcgaaagcgatcaacgccgcgaaaatggcgctctggggtgacgggtcccaccgggtgtcgctggacgaggtcatcgtgaccatgcgcgagaccggcaaggacatgagctccaaatacaaggaaacggccatgggcggcctcgccgtcaacgtcgtcgaatgctgacagcaacaaccctttagttgtggaccgcagcccaccagttcaaggtggacgcaaagaccagccaggcaatgtaggggagcagcagcagtcccgcggtccggctgattgggccgaaatagagcaccgtcaccgtgaccgcggcaatcagggccacaataatggccagggccagccagagggcagccgtccccatagcggggtagaggccgaagaacaccggagtccaggcgaggttcaggcccaactggaccgcgtaggccgttaacgccggcctggtcttaggagtccgcttccgccagaccagccaggcagccaccgccatggctgtgtagagcagtgtccataccgggccgaagagccagttgggcggggaccacggtgccttgtcagctgtggaataccacccgtctacattgtcaacggtggagaatccgccgagcccggccaccaggaaggatgccagcaggaatccggccagcaccgctgcctggacccgcgcgctgtacggctggccgcttccatccggcggggatgacaactcttcacggttcggctgcatgcctccacccttgccaaccggtccacccgagtcaagggcacgggtcaccccaggccggggcgggctgctgaaaagccgtagggccttcaggctttagacttgaggctgcatgtccgcacgcagacacgagtaccgaaaccgcgcacgacaccgattggacacggcccccttgcgagaatttaccgcacgctttgccacagccgaagagattgaaaactgggacaagcacgtcacggccaaccccaacggcggcaacatgctgcagtccgccgcgtacgcgtcggtaaagaacggcagcggctggaaagtccgcttcctggtcctcgaaaacagtgaatctgccagcttcaacctggtgctcgaaaagagcttccccgtgctgggccggctctggtacctcatcaaaggccccgaccttgaagcggcggcggacctgaaagcggcgctggaggcctgcgcagctttcgtgcgcggccggaagctcaacgtcttcactatcaagatcgaaccggacatcgtggattctgaagaggctcaggcgcgcctgttggaagcgggcctggtcaaggcgcccaacatccagtccaacgactccactgcgctgctggatatctcccgccccgaagaagcagtgttcaaggccatctcctcccgggcacgtaatgccatccgacgggccgagcgggaaggctgcgaggtggtccgcaaggaacacggtccggaaacctaccgggtcctctatgacctgatggcggacaccgtcaacgccaagggctccatgcccctgcgcagctacgcgtattacgctgcgttctgggacgaattctgcagccggggccagggcaacttcttcttcacctatgaggacggcaaacccagtgtgggagcattcgtcatcaactacggtgccaaagccacctacaaggacggtggttccacccagaaccgtaagcagtacggcgattcgcacctcgtccagtgggctgccatccggcgcatgcaggaactgggctgcacggaatacgacttctgcggcaccccgccagcctcacggatcaaggacaagagccacaatctctacgggatgggcatgttcaagaccagcttcaccaagactgtcaccgattttgtcggctgccacgactacgttctgtcgcccctgaagcaccggctctgggtcaagggagcagagaaagtgttccgccggatcgaaactgcccgcaccggccagcagttctactgacccggcagacggagccgctgctgaccgctccgccaaccgccgcctccctgcccacatcctgcctatgccagcccccacccgtgaagaaggtaaccccttgactgcaatctccgccgccgacctggagttcgccgtgctcagcgatgccgaatttgaacagttcgcgctgaagcacccacagaacagcttccttcagtccctcgacttcgcccggttccagcgtgcccggggccagcaggttgaactcttcggagtgcgccgcgacggtgaactggtggcggctggcaaactgaactacaccaccacacgcctcggctacacggtgtgtgaatgcgccaagggccccctgatggactatacggacgctgagctggtgcgcgccgtcgtcgggctcctccgcaaacgtgcagtggagcggaaagcggccgagctgcggatctccccgaacctcaggtacatcgcccgcgatgccgacggcgcggaacaccccgaggtggaggacaacaggccgctggtggcacagctcggcgggctggggttccagcaccaggggctggacatgaacttcgtcaacgtcaactggatgttcatcaagagcctggaaggcatccaggacgcggaagaactgatcatgggcaccagctaccgcacccggaaggccatccgcaaagcggaaaagaacggtgtgttcctggaacaggcaacgctggagaccctcgatgagttctacggcgccctgagccgggcaggcgacgaaaagggttttgtctaccgcgaacgcgcctattacgaacagttgctccgcaccacgtcggccgagttcaccaaacttatgatggccaagattgacattcccgcctaccggaaatccattacggagcggctggccgcggaatcggaaaccgcggcagaactccgccgcgaagtcgaagagaccggcagcaagaagaaggccaaccggctcaaagtgatccaggacctggtggacagctacgagcgaagcctgaaggacatcgaacgttttccggattccgttggcgttgccacggtggccgccatccacttcgtctgctacggcgacgaagtggtctgcgtcatcggcggcaccgtgcaggactacatctacttcaacggcgccacgtcgctgtactggggaatgatgctgcacgcccttgaaaagggttacccgcggtacaacttctacgggacgttcggcatctccggccaggacgaggaaggccacggcggctacgagttcaagaagggcttcggcggggaagtggtgcaactcgtgggcgacttcgcgatgcccgtccgcccggccgtgttccgcgccaacaagcttgcccgcgcggcagcaggcgccgcccgcctcctgctgggcaagctgcccctgcggcgctccgcctgacgcgcactgcacatcaccacaacgggaggagggacccatgaccgaccggcctgactatcccggcggcggaataccgaaggcaacgtcatcaccgaaggcgccgccgcgcacggatggcctgcccaaaaccgagccgctgaccccctcccagctacggcagaacgctgcggcgaaaaggatgctgcggcgcctggtccagggcgagaacccgcccacggctcccatgagcatcgtggaccggctcaccggtagcccctatgcaaaccccatgatccaggtcggcggcgtggacacgtccgcccggaagaccctggatttcgccctgcacctggccgaaaccatgttccgctacggtgcgggagccctggaggttgaaaccagcatcattgccgtcacggcggcactgggcctgaaaaacatcgaagtggacatcaccaaccagtcggtgggcatcaactacgcccccaaggaccaaacgcccattgcgctgctgcgggtggtccggtcctggaccaacaactacgcgggcctggccaaggtccaccagctggtgacggacattgttgccgggggagtggggcgtgacgaggcgatccgcaggctggatgaggcgatcacctctcccaagccgttcccccgctggatggtgacggcggcgttcggggtatttgccgcagctttcgttgctgtgctgggcggcgggccggtgtcctccgccattgcgttcgccgtcaacatcggcgtgagcctgctggcccgccagctgggccggtggcgggtgccggacttcttcaccaccgccagctgttccttcgccgtgaccctgcttgccctgctcctgtggcagttcgggctgacaacctcgccagccatcgtggtggtgggcggaatcctgctgctcctgcccacgggccggctggtctcctccgtacaggacgccatcaacggcttccccgtgaccgcagcggggcggttcctttccacgctcctgacctttggtgcgctcgtggcaggcatcgccgtcgcttttgtggcgggccagctgacaggcatgcagggaatcgacgtgacgcagaccttcccgcccgcctacgacttgtgggtgctggtaatccttgttgcagtggcggtgatggccatcggggtcacggaacagaccacctggcagctcctgcttcccaccgcggcagtgggggtggcgggttaccttgtcctgttgggcggcggcctgctgggcatcggtgaccggttctcgccggccctggctgccgtggtgatcggcctgctggcccgggtggtcgctttgcggatgggtgcaccccagttggtggtagcggtgcccgcggcactgatcctgctgcccggcctcaccatcttccgttcgatgtacgtgctgaccatcgaggaagccgagatcctgctcggcgccggtgggatgctcaatgccggtgccattgtcctggggactgccggcggaatcgtgctgggggataccttggcgaggccgctgacccgcagcctcgccagcaacgagcgccggcgggcccgccgccgctgaccgggcctggctgcctagagctgccctacgggcagtttcttctccgcctggaaaacgtcctcaacgcggcccttggcccaatacccggacagggacacctgcttgcgttccaggccgcgctgcacgaaaaggacatcacggagcgccttcatgtacccccgctcgccgtgggcgaaaacgtccactttgccggcgggccagtcagcatcggcgacggcctgcaccaggaggctgctttcgccagccgggacaccacggcggaagagccagtgcagttcaagtccggccggggcggcaatcggttggatgtcggcctcggaatcaacctcaaggaaagcgacaccggccgcttccgccgggagggattcgatgcaggcgccaatggcgggcagggctgcctcatcaccggcgaacaggtaccagccagcttcggggtccgggttgtaccctccgcccgggccggtgaacgtcagggtgtctcccggctgggccctggctgcccatggccctgccagtccgtcgtcgccgtggaccacaaagtcgatggcaagttcccgggccgcggaatctacccagcgaagggtgtaggtgcgcgtgaaaggccactgttcccgcggcatggtctcccggatgctccacagatcaaggggtaaggggtactggacacctggctgcgggaagacaatcttgacgtagcggtcaacaaagctgttgttgacgaaatcggcaaaaccgtccccgcccgcaacaatccggaccatatgcggcgtcaactgttcgctgcgcaccaccgtgaggttgacctgggggcggcttttcttgctggcgctggtggcagcgggaacaatgctcataaggcaagcctaagctagggcactgccgggagctcccaggttacgcctgcggccccctgctcccgcaggagcgcgttgacacggctgaaggggcgggaaccaaagaaaccccgtgaagcggacaacgggctggggtgggcgctggacaccgcggggaccccgggcagcagcgggcgcacgccctcggcgtcctttccccacaggaccgcaaccagcggcaggggtgacccgtccggtgcccgccgtgcgcccaaagccgtgactgccgccgtcgtaatctcttcccagcccttcctccggtgggatcccgcagatcctgcccgtaccgtcatcacgcggttcaggagcagtaccccctggccggcccacgcagagaggtcaccgtgcaccctcggtgggattcccaagtctgcctcgagctcgcggtagatgttcgcgaggctccggggaatgggccggacatgcgggtcaacggcaaaggacagcccgacggcgtgccccggcgtggggtacgggtcctgtcccacaatcagtaccttcacctcggcaaggggctggcggaaggcccgcagcacgttcgacggcgccgggaggacctggtgcccggccgccacttcaccggccgcgaaccgaagaacggcgcgaagtccggcatccacatccgagagtgccgcggcccagtccggtgccatcagctctgccagcggcagctgcgcctgcccggcgaagcccgtgctgccggcgggttcctgctccagctcaaacaaggcgtctgattcaaacatcagtccattctcgcaggcggcgggaggcgccggccgtacctgcggcgtgcgcggcagggccatccgcaaatgacaatggtgttgttcgtccgtagcatgggggtcagacatttacgtaaccagctaaggagagtgcgccgtggcggagccagctcgggagcacctgccggcgcaggaacaacgcaacaccctgctggcggatttcaccctgcgggagtcgccgctgagcgagcgggaccagcagatgctcgcgctggagcggcagtggtggaagtacgccggcgccaaggaacaggctatccgggaactgttcgatctgtccgccacacactattaccagctcctcaacgccctgatcgacaccgaggatgcgctggcgcatgaccccatgctggtcaagagattgcgtagactacgtacgtcgcgtcaccgtgcacgcactgcacgccgcctggggtccgacgcataagacgctcgcgctgagtcctcagcagctacacacaaggatgtctctttcccatgaccaaatacgcccgcgatgaattcgacaaggtcccggagaccgcgtcgcgacaaggtgtacaccgcacagccaccgctcctgcgcgggtccgtctttggcccatcctgactgcgggaattgttgcgctggccatcggcgtggtttccttcctgatcctgcccaagctcggattcgacggtccggcaacccaggcgtcgtcgagcctggaagcagcaccgctcgccgaaaccggatccactccgtccgttaccccggaaacgtccgccggcccctccgccgagccggagccctcgtcttcctccgaaccggctggcacggcggggaacgggaccccgtccagcccccagagcactgagcaggccgcagcagtggacaaggcccaggcagtggccgtctacaacgcggccggaactgccgggctggccagccgggtggccggaaccgtgcagtcggacgggtgggccctgggccaggtaggcaactgggcaggggctccccaacagggctctatcatcttctacgcgggagcggcgcaggaggccaacgcgcaggccctcgcggaactcctgggcgttcccaccgtggtggagagcgccgaattccaggttcccctggtggtggtgctcggccccggataccggtaggcctggtccccaagaggacgctttccgtcacgtgcgcccgcgtcagtgccgggggttacgcctgaataacgtttgcggccggtcatgctgtgccccggcgctgccagcgtgcattggctagagtgaattccgggcttcgagccacggcggcaccggcgcagcatcccggacctaacggaaagagtggtcatcatggcacgaggaaccgtcaaatggttcaacgcggaaaagggctacggcttcatcaccgttgacggctccggggacgacgtctttgtccactggtccgccatccagggcgagggctaccgcgcactggacgagggacagcgcgtggaactcgaactcggcgaaggcgagaaaggcccgcaggctgaaagcgtccggccggccgagtgaagcacccgttttcctccgctgcacccatccgtccgttgttcgccgcggccctctgcggcacgctggccctgaccggctgctccggggtgaccggaaacgcgcgcacggagccggcggaggcctcgggtgacggcacgctgcggatcggcctcatcctggacaacgccggtgccaacagcttcctgaacggtccccaactggctgccgccaagctcgctgtcaaggaaatcaacgctgccggcgggcacaagggccggccggtggaactcctgcccgttgaaacaggccaggacacagcgtcccaggcgcagtccctggtccaggccaaagcggatgtggtcatcggccccaccgactccagccacgcctccgcagctgtcgatatcgtctccagggcgcggacgccactgatttcgcctgccaacaccgcagccgggctcagcagcattgccagcggcggatactacttccggacggccgccgccgacgtcgcgcagggacccgtgctggccaagctcgccaaggacgccggcgccgcaaccatctccgtggtgtaccaggaaggctcctatggcagtgatgtctccgctgctgtctccgcttccgctgaacaggcgggcctggacgtactggcagcggttggcttcacaccgggtgaagccggatctgcggctgccacaatccgcgaggcgcaacccgacgccgtcatcctggtggcccgtgacggcgcacagggcgccctggctgagctgaacaacgccgccctcgcaggctcaaggctcatcctgagcgacggagccttcagccggtacggctccaggctgggaaccaaagccctggacggtgcacgggcggtcgtcccggggcagctcccctcggcagggttccaggagagattgctgggcatcgatccggccctgaaggacgtgtccttcgcggcggagacgtacgacgccgtgacccttgccgcgctcgcagcgtccagggctgaggacgattccggccgttcaatcgccgcaagcctgatcgcggtatcaggcgggaccgctgacggaacaggcccagccgggacggcgccctgccccagctacaaagactgcctggcaggcaaggcttccggtgcggacattaattacgacggcgaatcgggccccgtcgccttcgatgccaacggtgacatcacctcggccgccttcacagtgttcacgtacggcgctgccaacattcccgcggccaccggcgttgaaacggcaggccgcgccgccggctgatcgccctcggcgaagaggcgcccgccagggcgctttctgctggttattcgcttgcactctcacgtggggagtgctaattattgagttagcactctgacgtaccgactgctaagcaaagtgtggcttcggccagcggcgcccggcatcggccaaggagcgaagaaacacctaactggagtgagacccacatccgaaggcatacagaggccgccggcaacgggtcgtccgtcgcgggcactgcagcgaaggttcattcttaacgactgtcccgaaaggactactgccgttatggccaagatcattgcatttgatgaagaggcacgccgcggccttgagcggggcctgaacatcctcgccgacgccgttaaggtcaccctcggcccgcgtggacgcaacgtcgtcctcgagaagaagtggggcgcccccacgatcaccaacgatggtgtttccatcgccaaggagatcgagctggacgatccttacgagaagatcggcgccgagctggtcaaggaagttgccaagaagacggacgacgtcgccggcgacggcaccaccaccgcaaccgtgctggcacaggcactggtgaaggaaggcctgcgcaacgttgctgccggcgccgacccgctgtccctcaagcgcggcatcgagaaggccgttgaggccgtcaccgccgaactgctgaactccgccaaggagatcgaaaccaaggaagagatcgccgccacggcgtccatctccgccggtgacgaggaaatcggtgcacttatcgccgaagccctggacaaggtgggcaaggaaggcgtcatcacggtcgaggagtccaacaccttcggcctggaactcgagctcaccgaaggcatgcgcttcgacaagggttacatctccgcctacttcgtcacggacgctgagcgccaggaaacggtccttgaggatccgtacatcctgatcgtcaactccaagatctccaacgtcaaggaactggttgctgtcctggaaaaggtcatgcagtccaacaagccgttgctgatcatcgctgaggacatcgagggcgaggccctggccaccctgatcgtcaacaagatccgcggcaccttcaagtccgtcgccgtcaaggctccgggcttcggcgaccgccgcaaggcacagcttgccgacatcgccgtcctcaccggcggccaggtcatttccgaggaagtgggcctcaagctggagaacgccggcctggaactcctgggccaggcccgcaaggttgttgtcaccaaggacgagaccacaatcgtcgaaggtgccggcgacgccgaccagatcgctggccgcgtttcccagatccgcgccgagatcgagaactcggactccgactacgaccgcgagaagctgcaggaacgcctggccaagctggctggcggggttgcagtcatcaaggccggtgctgccaccgaagttgagctcaaggagcgcaagcaccgcatcgaggacgcagtccgcaatgccaaggctgcagttgaagaaggcatcgttgccggtggcggcgtggccctgatccaggccggcgccaaggcattcgccaaccttcagctgtccggcgacgaagcaaccggcgccaacatcgtccgcgttgccatcgacgctccgctgaagcagatcgccttcaacgcaggcctcgagcccggcgtggttgtggacaaggtccgcggcctgcccgcaggccacggcctgaacgcggcaaccggcgagtacgtcgacctgctggctgccggggtcaacgatcccgtcaaggtaacccgctctgccctgcagaacgcggcttccatcgccggcctgttcctcaccaccgaagcggtggtggctgacaagcccgagaagaacgctgcccccgcaggcggagacgacatgggcggcatgggcggcatgggcggcttctaagccttcctgccgggacctgtcccgctgcacacgaatgtggccccctctccggagggggccacatttgtgtttaccgcgggctgttgttacttggcgctggccagcatcccttcaacttccttcttgaaggcttcagcggcagcctgcggggtgaggcggtcgtagagaacctcatcggtgtagcgcttgatgacgttctgcacgctgcccgcgcccaccggcgggaccggtggcgcctccttgatgtcgggcgcgatgtccttcaggaaacccaccaccgtggtgtcggcgggcttcagggacggcgtgatgctctcaacgatttccgggttggtgggcacgccgcggtccgtcatcaggattgccccggcctcagggctgttggccaggtagttgatgaaggtggaagcggcttccgggtgcttggaacgtgaagaggcggaccagaacatggtgggcttgtagtacatcccgttctcagccgctgaaccgtcgatgcttggtgcccggagcatcttgatgctgctcccggtggtggactcaagggatccgagctggttggtccaccaccatgccatgcccaccctgttggtgccgaagaggctttcctcgagtcctgcgccggagtcctctgtggccaccgtggccggcgggcttgccttggagtcgcgctgttccttcagccgttcccagaaggatgctgcggtggcggtatcgaagtcgagctcgccgtcctgggagtataggttttccccgtgctggcgcagccagatgatcaggtctgcttcattgctgccgtacgcggcgccgtagttcttgccgtctccggcggcgctgatcttcgaggccgtttccatgaattcgtcccacgtccacgtggtgtcatccgggatgggaacattcactgcttcaaagaccttggtgttggccatgatgacgtaggcgttctggccggtgctgagtccgtactgggcgccgtcatactggcccgaggccagggcttccttatcgagtttggaagtatcgatgccttcctgcttggacaggtcaaggagagccccgcgcccgccgtattccgcgatgtacttctggtccatctggatcacgtccggcgcatcgttggcggctgtcttggtggcaagcttgtcccagtagctgccccactcgcccggctcggattcaatcttgatgttcgggtgttccgcctcgaaggcgtcgataaccttctcggtctgggcgttgaggtactcgttgccccaccaggcaaaccggagggttacttcctcgttgctctcagagcctgaagaggtgccgcagcctgtggcgaggagggagagtgcaacggcggcggcgccgagctggaacttcctccggctgagggttggaatcgtcattgatgtgccttcctggtgctgagggcgctttccgttggctgccgcggcagcggtgcgtgtcggggccggatgagaaaacgctttctcgtttcaatacagcgattgtgcctgcccggctctctccgcgtcaagtactttcggtaaccgctttccgagcaatggcccgggccggactccggtttgtcgtgccggtctggcaggatggaccggtgacgattactgcagcggctgacggttcggccttgggaaaccctggtccggccggctgggcctggtacgtgaatgacgactgctggcgtgccggcgggtggccccacggcaccaacaaccagggtgaactgatggcggtcctggatctgttccgggccaccgcccaccttccccaggaggaccttcacatcctctgcgacagccagtacgttatcaattcgatcaccaagtggatgccgggatggaagcgcaaaggctggcgcaaagccgacgggaagccggtcctcaatgtggacctgctcaaggagttggaccgcgagcttgccggccggaagtacgccttcgaatgggtaaaagggcatgcagggcatgacctgaacgaagccgcggacgaacgtgcgcgggccgccgcaacggcctaccagcagggcgtggctgcgcgctcagggccaggctttcccggtgcccaccatgcacacccggcgccggtgaaacaggaagccagggacgcgcgcccggaaccagcaaagccggcagtagcctacgaggaaccggatctgttcagccagctggacaaccgggggttcgacgcgcccgggactgccgcaaaggcggctgaagccccgcctgaggccgtggtggaggaactcgagcgggaactgctgggcccgctggtgcgcggggatatcggccggacagccgtcctgctccaccccgattttatggagatcggcagctcaggcagggtgtggacccgggacgccatgatgatggcgctcgaggaggacccgggcgaacggacggacatcgaaatcctgggtgccgaacgcgtcggtgctgaggcggtcctcctcacctaccgcagctatgcccgctccggcaccaccctcaggagctcgctatgggtactggacggcggccggtggcggctgcggttccaccagggcacacccgaagcctaggctccgctcagctgaaccgctgggtattgccctgctccgcctgcgcgtacgtggctgctgctgaggcaagcgccgtgttgatggatgccagtgaggcctccacccttccctgcgtaatagtccattccgtaatcagtgactggaagttcgtggcggcggagccccgccaggaaccctggagttcgtccagtccgcgtttcatggcctgcacgtcggcgctgattctgtccatggtggcctggacggtggcggacttcagctggaggagttcggtatcgacggagataatgctcatggtggggcctttcgctgtgcggcatcttgcgcctgcgggcccggccggtccggccccttgccctcgagcatagggaaaccgctccggacgctgccactgcaagcggctatatgtgcataacctcgccgccgctgccctcattctgttccacacggttcttttccacgcgaataccggcatccgggacgtcgtcacgctgcggaaggctgaccacgagggtggcgccgccgccgtcggtcttttcaacccggacgctgccgccgtgggatcccacgatcgcagcaacaatggcgagtcccagcccgctgcctcccgtttcccgcgtcctggacgtgtctgcccggtagaaccgttcgaagaccttggacgcgtcttcttccgagatgcccggcccgtggtcgcgaacttcgataacggagcgcagcttcccgtcttccgccgcccggacgcccaccgccagctcgatggggctgccgtccggggtgtaacgcagggcgttgcccacgaggttgccaactacctggcggagcttggcttcgtcgcccagggcaggggcgggggtggcggggccgccgtcgaggcctgtcagcgaaatcacgcgggagcggtcgctggcctgggtgtccaccacggcgtcatgcgcaataagctggaggtccacgggcttttgctgcagcggccgctgctcatcaaggcgggccagcagcagcaggtcctccaccatcgaacccatgcgcttggcttcgctttcgatccttcccatggctgtggacacgtcttcctccgtagccagcgcgccgtgccggtacagctcggagaacccccggatggtcacaagcggggtgcgcagctcatgagaggcgtcggccgcgaaccgccgcatcctcgcctccgatgcggtgcgggccgcgaaggctgtttcgatatgggcgagcatggcgttcaacgacctgctcaaccgcccgagctcggtgccggggttttcgacctccacgcggcgggagagatcgccggcggcgatggcggccgccgtcttttccacccgggccagaggccggaaggagcgggagacggtccagcttgcaatgagggacgcgagcagcagggtcagcagccccacccccgtcaccaccagggtggcgtgcttaaggacgtcgtcgacgctccgcaggggcagccctatggccaccaccgctgtggtttggccgttttggacggctacagcgaccacccgccagttctcgccgtccgtgccccgcacctggtacgggaccgtcccgcgagcctgggcctgctctacggtgatggagctgatgtccgggcggttatccggatcgccaccgaacggatagggctcctcgccgggggcgaagagaatcaatgaatagtccgtggggaccatcgggttcgtgggagcctgcagcggggtgaaggagcgctgtttccgggcaaggtccacagctgcatacagcttgtcgtccacttgcccttgcaggtaactgtgcagcagggccagtgttccagccccggtcactgtcagggcaactatcagcagcgccatgatcatggccacgagctgcgtcctcagggacgccgacttccatcgctgcagcaaggtcagcgcttttctgccgttcggagcacgtagcccacgccgcgcttggtctggatcagtgcgggggcgtcggggtcgatgtccaccttccgacgaaggtaggagatgtacgactccacgatggaggcgtcaccgttgaagttgtattcccagacgtggtccaggatctgcgacttggagagcacccggttggggttgagcataaggtagcggagcagcttgaactcggtgggggagagctcaatgacggtgccgccgcggcgtacttcgtgcgcgtcgtcgtcgagttccaggtcgtcaacgcggatcacggcgtcgtcatccaccatcggctgcgtccggcgcaggacggcgcggatccgggccaccacctcatcgaggctgaacggtttggtgacgtaatcgtccccgccgacggtgaggccggtgactttgtcctcggtgtcgtcctttgcagtgaggaacaggaccgggaaatgcttcccggcggcgcggaggcggcgggtgacggtaaagccatccatgtcagggagcatgacgtccagcacggccaggtccggtgtgtgggcgtccgcagcagcaagggcgtcacgtccgtttgccgccgagacgacgtcgaatccggcaaaccgcagcgaggtggagagcagctcgcggatgttgggttcgtcgtcgacaacgaggagcttcgcttctgggccgttcttgttcatgctcccatcatgctcccagactctgggagttgtctggatatttgttggaagacaggtggggatgtgggtgcctaccagcccatggtcccgggttcgcccttgaacgggccagacacgcggtcagtgatccagccgccgtagaagccccccgcctgcggacggacacgctcgccgtccacttcgcagtagtccatcctgcccgggtacacggccacgcggtcagccagggcctcgtaccccttggccggctccggatagaaccacgctgctgcttcagccaccgtcccgccgccgtgaacagtgaggtactgcgctgagcctttgaactcacagaagctgcttccgggggccggttccaaggcccctggccggaacgctgaccggggcaggtagtaaaccggcgggtggctggtttcgagaaccctgagcgagtcaactgtgtccaggatcagctcgccgcccagcacgatccggatccgttcggtgcccggctcaacgcgtgggggccgggggtagtcccacacggattcctgtccggagcgggggatggcgggggtaacttttcggcgcatgcctccagtgtgcaggacgggaacccaaaccggagtgagaacgttccgggcttcacgccttccgccgggtgcagcacgggaatacagtgatggtgccgggcccggttccgtcccgaatccggcatcgcagggcccctcccggcgcccgcagacccgcgcttggctgctccacattatgttcttcaatgatttccggcccaatgaaggggatagaccatcatgactgacctgagtgcatccgaaaacaccgcatccaacgaacgcagtatccgggactgggcggacctggcggaggaaatgtggtcatatctcaccggcaagggtgccgcgatcaactaccagttcgtggatatgaccatcgaagtgccgcgtgacattggccctgatgctccccgggccacctggaagctgaacggcagcctgcgtgtcaccaccagcgacaaggatgctgccggctccgatctgaaccgtggctgacggatatggctgactaccgcctggacgtggatctggacttttcgtatacagatgagtccggatcggttacgagggggagtgcccggtcctcgggcacggacgtcacagtatccatggacagcctggcacccctgggaggcggcggcatcccgtcactggaggacatcaagccactggcggagatgctggccggtaaaggactcagtgtcaccctctccggtccggacggaagtatcgtcagcctgggggcggtgaacagccccgcctcgcagcgcctggtgacgcgctcgccccacatcaagctgggaaagctgggagcgctcgtgcccatggtcaggcagggccggcgcaagtcggcaggcgttccgctgctgccgccgtccactccgttgccgctgctccccaccgtccggcggaagatcagccgccggatcaccaccacgcactacacccggggcagcggccggccacggctgatcttcgtgcaggatgcagcctcatggaccggacagattcccagggaggtgacgcttgcaggggagaagaccacgatcggaagcgacccgggctgcgacatcctcctggaggggctggaagggctccacgccgaaatcaggcatgatgagctggatgagtacgtcctggttccgcatgggactgtcagcggcagcgtggcgcagggtggcccttccgtgctccgtaccggcgccaggatacagatggggcagtggtgcctcgccttcttccgggaagaattcgccgaccacgggcgcccttacggcggccgcagcggtggagaactggcttacgagcgcccgcagttcgatccgcggaccggaaccatggaaagggacagttcgcgcggcgttacctgacactgctctgcctcacgggcaacggtcctagtcagccgtttccacatccttggcgtccatgatccggtacgcgtagccctgttccgccaggaaccgctggcgtttggcggcgaagtcctgatccagggtgtcccgggccacgagcgagtaaaagcgtgccgagcggccgtccttcttaggccgcaggagcctgcccagccgctgggcttcctcctgccgtgaaccgaaggagcccgacacctggatggccaccgaggcctcgggaaggtcgatggaaaagttcgccaccttcgagaccaccagcgtctggatttccccggcacggaaggcgtcaaacagtttctggcggaccttcaccgaggtgtcgcccttgatcacgggcgcattgaggcgctcgccgagctcgtccagctggtcgatgtactggccgatgaccagcagctgttcaccggcatgccggctgaccagctgttccaccacctgtgtcttggactccgaggtggcgcaaagccggtacttgtcagcgtcctcagccatggcgtaggcaacccgttcgtccctgggcaggtccacgcggacttccacgcagtcggccggcgcgatgtaaccctgggactcgatgtccttccagggcgcgtcgtaccgtttgggcccgatcaagctgaatacctcgccctcgcggccgtcctcccgcaccagggttgccgtcagcccaaggcgccgccgcgcctgcagatccgccgtcatccggaagatcggcgcgggcaggagatgcacctcgtcgtagatgatcaaaccccagtcgtgcccgtccaccagctccaggtgggggtagaggccaccgcgcttcatggtgaggacctggtaggtggcaatggtcaccggccggacttccttgaccgctccggagtactcgccgatctcgtcctcggtcagggacgtgcgcttcagcagttcgtccttccactggcgcgcggccacggtgttggtcaccaggatcagggtggtggtggagccggtcgccatggccgctgcccccaccagcgtctttccggcgccgcagggcagcaccaccacgccgctgccgccggaccagaagttgtcgctcgccatttgctggtagggcctcagcttccagccgtcctcgttgagcgcgatcaggtgcggtgtgccgtccacgtagcccgccaggtcttccgccggccagccgatcttcagcagcagctgtttgagctgtccccgctgggaggcgtgcaccaccactgtttcgccatcaatccttggcccgagcaggggctggatctttttggcccggattacttcctccagtaccggatagtcatcggtccgcatgaccagcccgtgctgggggtccttctccaggcgcagccgtccgtaccgtgacatggtttcttcgacatcgatcagcagcgaatgaggcacaggaaagcgcgagtacttcagcaaggtatccagcaccttctccgcatccagtccggctgcgcgggcgttccagagccccagcggcgtcagccggtaactgtgcatgtgctccggcgcccgctcaagctccgcgaaaggggcaatggcatggcgggcttcagttgccagctcatggtccacttcaagcaaaatggtcttgtcgctttggacgatcaaaggtccgtcgttcacgccgggaagtccttcactggcgcagtttcccctgcagcctcaatgtcgatgatgcggtggatggacagcacgcgttctgtttccctggcgggatcaaatacccggacgcgtccgccgcttacagagagcggaacaaccgtttccaggttggcattccccaggccgtccaccacattcatgctgatccgctgcttgagcctgatggcgcgctgcagggcctcaagccccagctgcgttcccgtttctccggcgtggtctccggaaccaccgcggtgtccgacggcggcgcccccctggcgcaggaccgcgagctgggcctccacctcctccgtcccgggcgccatccgcggtgcggtgtacaccgggcggtgggcgtcctgggcggcctgggttccgcggagccggaccacgggctcatccgcgccgtccacagccggggagaggcccagggtgcggagaacctgtgcggtttcccgcggtggcgcggaggaaaccaggacagttggggcaatcttctccagcttcaggtgggctgccttcggcccggacaaaagctccagcagggcgtcctcgtcctcgctgtggacgaagcttgccgccggccccacccgcagccttccatgccgcagggcggtgtcctccacgaggtattggagaggctggggcaccgcggtggcggagtgctcgcgcaggaactccaggatgccggcagcgtcgtaccccgtgtccagggcccgcttgatggagccttccgagaagcggtagatggtggccggcccctggccctcggcgtcagccatcaccagcagtttttcggtcagcccgggggcgaggtacccgggggcgacggctgtgaggtctgcctggagcaggacatggctcaaagctgccggcaggtgctcgcccaggatggcaagggcggcctcagggttgtcttccgccagcgcgctgcccaactggctgagggcgccggaccccaccaggcccaggagttcagcttcggcgagcacgccgcggatcatcgagctgaagcgccgtgccatccgcggctgggcccattcggcgcgctggagaactgctgccgcgtcgagcaccggcgcggtgccgtccgccgggcctgcctccaccgtcagttcgtgcaaaatttcaaggatgcgtttgcggaccaggggagcgtcaggccgttgggcttccgctgacaacgcgatgatggtgcttccggaggctgaacggtgccccgccggcacgccgcgcgccccgttgatgggctggcccaccagggacggcacgcgctcgctggccagccaggcattcaccagccagagccactgttcctgccgcggcaggatcagccattcaagctgcggaggctggacccaggacgaggaatccacgtccaggcggatcaggcctgccagtgcggccagttccagcaggagtcccgcttgttgctggtcgatccgcagcagctcggccagccgcctcatctcgcgcaccccgacgccaccgctgcgaagtgtggccaagggttgctcccgtacggcatggaggacgtcgcccatcagccgcagcgtctccgatattgcgctgagcgcagcattcctgcgcaggaccgcagaggtccggccgagctcagggacggggggctggagggtgaagtcgttgatgatcgcgccgccgcgaagcgagacccccacgctgtggggcagctccacgtgcgcggcgtccagcggcaccagcaatccgcgcgccagcagccagtcgacgggcccgacgtcggacccctcggtggtgatggaggccttgcgttgcgcctgggggaccgcccccattgcccagttgcggaacctggcgagcaacgccgtcgtccgctccggcgccgtggacaggatggtgttgagtgcctcaggagaggaggtccagtgctgcagcgccagtgcggcctccatgggagtggtggcatcgtggatggccacgccgctgcggtgcagctcggagaccagctgcactacgcgctgcgcgaaggctggttgaaggcggaccagttccgtgtagctcctgccgaggccggcgggatagatccccaccacgtccttcagggagcccaccggcaggtagtggcgctgtttggccgcggaatccggagtgccgtggggaggttcggcacggtgtaccagcgccaggtcctgcagggaatgcaggatccgctcaacagcggccccggacgatcctggaatcattttgcggagtccggccgccgtggcgctgtgcccggtgtccgtattggtgcacaggtggagtgtttccaggacctgcatttgcggcctgttgagccgttccagcgcacgctgcacgctgagccgggcgctggcccgcgccgcgagggcgctgaagtcggggacggggggagagatgaggtccggccgggcgtcgaacagcgcacgcagtgaatcatcgctgcgtgcctccagttccttgctcaacgcacgaatgagggacatcagtccaacgttaccgccggtccggctttcctgcccggcgccgcccggcaacgctgtccagaaccaggaaaagcatcaggaggaacgcggccggcaggccgtacagcgccgagtatgtcacccaggcgggggccactgacccggcgaaggccaatgccatcacggtgcctactgccaccagggacagcacggcgacagctgcggcgaggatcatcagggcacgccggtaacgcgagggtgtcatggacgtaacgctacagctcccgcagcctccggcgtgaacgctgccgcatggagccccggaatggctccacaaggcgggcaaaagcaggaatagggcggtgggcaggataaccttgagggatagaccaacacggcctgcagccgccataccctaaacccgcacagcaatgcggatgcggtggcgggcggccgtgtcagaagacgcagaacgaagaaggttgattacgtgcctaccggcaaggtcaagtggtatgacaaggacaagggctttggtttcctcgcgggcgaggacggccaggaggtattcctgcccaaatcgtcgctgcccgagggcgtaacagagcttaaagccggcacccgggttgagttcggtgtggctgacggccggaagggcgcccaggcgctgggcctgcgagtgctggacaagacaccttccatcgccaaggcaaagcggcccagtgcaaaggatcttgctccccttgtccaggatctggtgactgtcctggacaacctgtccggaacgttgtccgcaggcaagtacccggaaggcaacaagggcaaggccatcgccgctgccctgcgtaaggttgccgacgagctggacgtttaggcactgatgatcccggaagctgaacagccggtcccggccgcgccggaacaggacatgccggaacaggacggcacgacgccgggtggcgcggctgctgccggccccgccgttgcgggggctaaggctgcgtccaagcgccgcgcgggtgtcccggcatggcggacagggaagccggatgccttccttgccgccgccgtggacacggcgcgtgccgctgttgaggacatcacgcctgcaccgaccattggccgccacctggcggctaaaagcgaaggcgaccgcctggtgacgcacctgtttgaatgcaggctgcctggctacctgggttggcagtggtacgcggtactcacccgcaactcccgctcgaaggcggtcaccgtcaacgagctcggactgctgccgtccgaggattccatcctcgcccccgaatgggtgccgtgggctgaacgcgtccggccagaggatgagcaggaccaggagccggagcaggtccgggcgatcgatccggaagctggcgggcagcaagccgggcccgcggaaggcgaagccgacgacgacgcccaggatgccgtaacagagcctgccataacagagcctgccgtcgaagcctctgatgccgctggtccgcccgctgagcccgcggaagacgacgccgttacgccgtaagggagacggcgccccagggcgcgctcctcacgacatacacaaaggcgccgcccggaactaaccccgggcggcgccgtcgtcatttaacgctatctgtttcttggttcgctgcttggtccgatgcttctgggtgcgctgcttttgggaccgctgagccgcagcgcggactgctgctggagcccggctacttgcgcagcttgcccaccacgaagtcgatgctggccagcagcgcggaaacgtcgtccggttcgatggccacgaaagtggcgatgcgcagttggttgcggccgagcttgcggtagggctcggtatccacgacgccgttggcccgcaggacctttgccaccacggctgcgtccactgaatcgtcgaagtcgatggtggcgatgacgttggagcgctcatccgggttggtgacgaacggggtggcgaactcggaagattcggcccagctgtagatgcggccggcggaatcggcggtgcgtgctgaggcgaagtccaggccgccgttggcattcagccactgcacctgcgaatccagcgttaccagggtggacagcgacggcgtgttgtacgtctggttcagccgtgagttgtcgattgcggtctgcaggtcaaggaaatcggggatccagcggcccgtggccttgatgcgggccgcacggtccagggcggcgggggagaacaggccgagccagagtccgccgtcggaggcaaagttcttctgcggggcgaagtagtagacgtcgctctccgccacgtccacgtccaggccgccggcggctgacgttgcgtcaaccagaaccagtgcgccctcgtccgcacctgctacgcgcttcacgggggcggagacgcccgtggaggtctcgttctgcggccaggcgtaaacatcaatgccggcttcagcctgcgcggccgggcgggtacctggttcggacttgatgatggaggaggcatccaggaagggtgccttgttggtggcggccgcgaatttggacccaaactcaccgaaggagaggtgctgggccttctgctccaccaggccgaagctggcaatgtcccagaacgcagtggaaccgccgacgccgagaaccacctcatagccctcgggtgcccggaagaactggctgaggccctcgcgcaccgaccccaccaggttcttcaccggagcctgccggtgcgaggtccccaggatggttttcgacgcagcggaaagcgcatcgatctgctcctgccggacctttgacgggccagcgccgaaccgtccgtccttgggcaggaggtcggcgggaatagtgatgctgttttcgctcacaggtgctccaatttcggcgtggacgcggctggggtccggacgggtggttgcttggcggacagtcggctgcgactgcaactttcggccctcctcattctgcctgaacaggcgttggggcgggaaccggcaccgtcatagtccagacattgagacggcctgctgtgccggccgccaactattaggacaaagtcaaaataggctaagctttccaacggactacgtcgcgcggaaggcgttacggtgggacaacgctaggtactgcgctcgaggagctgagctggatgacggatctgatcgacactacggagatgtaccttcggaccatcttggagcttgaggaagagaacatcgtggccctccgcgcccggatcgccgaacgcctgcgccactcagggcccacggtctcccagaccatcggcaggatggagcgggacggcctggtggtggtctccggtgaccggcacctggagctcactgaaattggccggaagcgcgctaccgaggtgatgcggaagcaccggctggcggagcggctgctggcagacgtgattggcctggactgggcttacgtccatgacgaggcctgccgctgggaacacgttatgagcgaacgcgtggaacggcgcatctacgaactgcttgaccatccaacggagtccccgtacggcaaccccatccccggcctggctgccctcggcggccagtcatcacaaggcttcgccgacggggccatcagcctgctggaagcaatgaagtcctacggtccggcgtccgaggtgaccgtaagccgcctggccgagccgatccaggtggagccggaactgctggtccagctggacgagggtggtatccgccctggggccgcggtctccctggagcgggtgggagactacatttccgtccgcgtgcccggaatcgaaggcgctctggagctgcccccggaagtggcggcccacgtcttcgtggccatccggtaaaccggcgccctaccccggctgggatggagtaggcaaagataacggaattgttactttgggacttctggccctatagttaaacccaagcgtagatactaaagcgttacctgatctggagccgagctctgccagcggatcaggtgcacgagtcattactggcagaggcgggggaaccacaaccggcagacgggggactgccttggggtgaagtccgtcagcagcaagcctcttccagtgtaggatcctcccggggatacctctgtgccgagcttgcttaggcggaccgggtctttgaactctctgacccgaatccgacagctaacttcgcaggctttccagagaggaacccttacttgtccatgcagacccccaaggggcgccgccgcgcggctgcccttgtttcaacgccgcgcgttgtcgaggtcatcaccacggaacgcccccgcgatccgcaccgtgatgcacgccggcgtcgaggacccttccggcagatcactgaatttgccgccgccagtgggatcggccagaaggccggaatcgcgttggccgccactggactggtgctgaccgtgaccgttccggcaaccagtcccgtcatggccaccgacaatgcaggcagcgttgccccggtggcagcctccgctgttacgccgcagccgcaggtatcggccgaggccggcgcccagatcgacttcagccgctccgcggtggtgaccgaggcggatcccgacgggaagctgaagcaactgctcagtgcccagtccgccggttccgtgtcccgcgcagcatctgccggaagcctcggggccccgttggccgccctctccacagcctccccgttcggttaccgggtcagccccatcaccggcggctccggtgactttcaccgcggccaggactacgtggcccagtgcggcacctcggtcctggcagcagccaccggcaccgtcacgttcgtgggctggcaccagtacggcggcggaaaccgggttgtcgtggaccacggcaacggcctggagaccacgtacaaccacctgtcgtccttcagcgtcaccgagggcaagacagtctcccggggcgatgtcctggccctcagcggcaccacgggagcttcaaccggctgccacctccacttcgaggtccaggtcaacggcgaggtcgtcgatcccacgggctggctgtagtcaaatgatggctcgctatcgaatcatcgtgactagccgtgacctgaatgtgacattcaacaaaaactgctgtaccgtctaactcgcgtcaacttttccgaagttgacgctcttgtgcggattgcctagctctgccaccgctcaaggtccgttcgcatttcatcgtctggcaggggcgggggaaccaattttggtctttgcttcagcgaaggccttggggttaagtcgcaaagcttccttggaagctgcgtggccgggtgactcccatccgaatccgacagctcacctcgcaggcattgggagaggctaccttcgtgtcttcacgccataattctgcgcgccaccgtgcgcaaacggttcgtaccaaccctttggacaccgtgtccaaggctgttagtgccaatgccgggacagtaggtcgccaggctgccgttatcgcagcagcttccggtcttatcttcagcatgggcctgcccgccaacgccgcggacaccaccgccggcgtttccgcttcgaccgagtccgggtctgcccagtctgccctcgcggtgaccgcagcacccaccgccaccgtctccttcgagcgtcccgtggtgaagaccaccgccgctccgaagccggcaccggtgcgcgcacagtcgaccgattccgagagccgggctgcttccggaacccggacggcctccaccgcgtcggctcccgaagctgcagctgagaagctggccgaaacggtatcgtcggcctccgcctccggcgttgccgcactcgcgtacaccggcatcggccgtccgtacgtctggggcggcaccacccccaacggctgggactgctccggctttacccagtgggtttacgcccaggccggcatcagcatcccacgcgtcaacgcctggacggcaatgacgcccacctccaccccgcagccgggtgacctggttatgcagaacggtggcgcgcacgtaggaatctacgtcggcaacggcatgatgatcagcgcgctcaacccctcgcagggaacgctgcttcactcggtggccgccaccggaagctccgccttcttcaccatcaacaaatagttcttgggccttcgggcccaagagctatttctttgctccacacgctttccacacacaccacatccccgttcggggcgtgccggcgtacccccaagatgccggcacgcccagaccccttggtgcccacaacggcctgaggaaaacgaaagagagaactgatgactactcgtgccaccgcacggcatcgcgccgaagtcaccaagaccaactcaatcgccgttatcgccaaggctgttggcggcaacgccggtggcatgggccgccaggcagcggttatcgccgccgcttctggcctggtgctgaccagcggcatcgctgcaaacgcggctgactccagcgtccagcgcgactccgcccccgcgtccaccctggaagttgagtcctctgtagaggcaccgatctccgctgcttccaccatcgccatcaccttcgaaaagccggccgtcaccaccacgccggcgcctgttgtcgaagaagagcccgctcctgttgaggtcgaagaagccgagccggctcccgccgtcgcccagcctgccgcagccccggccgcagccccagccccagcccccaaggtgaccgccaaggtaaccaccgcctctgcacccgctgcagctcctgccgcttccgccagcggcaagggcgcagccatcctctccgctgcgtacgcccagttgggcgtaacgcaggactgcaccatgctggtgaccaactccctggccgcagtgggcatcaacttccacgactggcctgcagggtacctctccctgggccgcaccgtaagcgccgcggaagcccagccgggcgaccttatctactacgcagacggtggcgcaggcatggcccacatcgctgtctacgcaggcaacggccaggctgtccacggtgggtacaacggaaaccagaccgtggtcttcagcgcaaacgttggctccggccccgttttcatccgcgtgaactaacaagcctcgcgtgaggcagtcccatagggacggcacgaagaacccctgcccgcggcaggggttcttccttttaactaccggctgggttaattgacaatgaagtgcgggccgcatccgcccgggaacacgcgctgatggacccgacacggcagttttggaaaaccgcgattagctgataatgcgcttctatgtttactcttgtggtgtcgatccatagcccggacatgccgagggcagccggccctcgtgcccctgacgggtgcggccgtgaagaggtacgtgcatgcgcactctcgttctgaatgctggatatgaaccgctggcggtcatcacgttccgccgggcgctggtgcttgtgctcacaggcaaagccagcgtggttgccgagggtgacgatcccgtggtgggaccccaggagatattgggccgcccgtccgttatcctcctgaaccgctatatccgccccagatacaaccaggccacggctgtcagccgccgcggagtgctgaggcgtgatggccacagatgcgcgtactgcggaaaagcggcccacaccatcgaccatgtccagcccaagtcccgcggcggtgccgattcctgggagaacctggtggcggcgtgcctgcgctgcaacaacgtcaagggtgaccatactccagccgaaatggggtggaagctgcggttcgtcccggagcccccgcatggaaccatctggcagatcaaggaactagaaaagcccacccctgcctgggacccgttcctgctgcccgagcgcgccgcctgaccccaccccgcaccatgcccttggtgactaggctgggggagtggaagagaaccggttgcccttcgatgccctcatcctggccggcggccggtcgtcccggctgggcggagtgcctaagcaggaccttgtcttccaccacgccactctcctgcagcgtgcgcttgctgcgtccgcaggtgcctccagcacggtggtggtgggtccccgaccggaatcttccgctcccggagtgatctggtgccgtgaagagccggagttcgcgggtccagctgcggccatcgcggccggactggaggcccttgcgcaccacggcatcgccacacgtgagtacacccttgtactggcgtgcgatatgccgctggtccaggacgccgtggcggcgctgaaggaagcactggtcccgggggagggtgacggcgtcatggcctgttccagtgacggcaccctccagccgctggccggcatgtaccgcacggccgggttaagaaaatcagccgcggaactgtcttcacgcggtgccttaatcaacggctccgtgcgctccctccttgctagtctggaggtgcagccaatcaccgtccccgcaggttccacggcagacgtggacacgtgggatgatgccgccgcactagggattgccgccgggaaccaggacaagggccaggaccggcgcagccgcagttaacttgggaggcacgttcgtgaaaagtcaggatgaaacgctggaggagtggtgcaggtccctgctccaggcctatgagcttgaggacgtccaggtggacgtcaacgccatccttgccctggctggtgtggccgcccactcggtggtccgcccggcagcaccgctgacaacctttatcgcgggctatgccgccgggctggcatcggggtccgggcaggcagcgaatgccgcttccatggaatccgcgctggccgtggcccgtaccctggccgccgactacgatgctgaagccgccgggactcccggcgaatgaccagcgacgcccaggaggaaccgagcaaacccgaagctgaccatccccggcacctcgaccacacgtgggacgaagcccggcaggccgcctttgacgccgcccagccgattcccgccgggccagttgcgctggagctggccctcggacgaaaactggatcaggacatcgtggcgctgcaggacatgccccactatgcttcttcggcgatggacggctgggcggtgaacggcaccggaccgtggatcctggttgaacccggtacgccccttgccccgcaccaggcaagtcccatcgccacagggggactcatccccccgggcggcaagtcggtactgcgcagtgaaagtgcccggttggacaaagacgaggacggactgcccatcctgatgacgggtggaacggcccgccccggcgagccccgcaccggccagcacgtgcggaaagcgggggaggaggcttccgagggcgacgccctggtcagggccggggtggtgctcaaccccgcacacctggcactggccgccctggcggggtatgacgaactagtggtacagggaaagcccatggtccggctgctgctgaccggctccgaggtggttggccacggcgtgcccgtccccggccaggtgcgggacaccttcggcccgcaactgccggcagtggtgggcatgctgggcgggatccccggcgggcagcaaaggatcggcgattcgtatgctgagtggctgggcgcgctggaggacgtggtcccggaggtgccgggggcaccggacctgccggccgacgtcgtcatcaccactggcgggacgggaaaatccggcaccgaccaccttcgccgggccgtagctgagctgggagggcggctgatcatcgacggcgttgccatgcgtccggggcatccagccgtcctggccgaacttccggatggacgcttcgtgctcggactgccgggcaacccgcttgccgcaatgattgccctgtccacggtaggggccccgctgctggcggcgctggggcacggcggcatgccagcggtacaggaggtgccgtgcggaaccaccctcgagccggagccggggcgcacacgcctcatgccgttccggttgctgtacgggatggcctcgcctgcccggcacaccggcccgggcatgatgcgggggctggcttccgccgacggcgtgatggttgttcctccccacggggtgaagctcggtgaactggtgccagcattcgccctgccctgggggccgcccatccctgcacctcctgaccccaatgccaggccgaagacgcgaagtgccggacggacaggccggacagctgccaaacctgcggccaccggcccggtggactggagcgaactccttggctgacgaagcccgggaacggccggctgcgctggcatcaccacggggcggttgcgatgatggagtcatgaacaggaacggtgggacatgggacgtgtaacccagcgccgcaaggtgcacaagtacgtgctggacggttcgccgaatgccctcgagttcccggtccggtaccgggaggatgtccttgcagtggaggaaccgctggaaatccggctgggcagcatgtcctactccgtcacgatgcggactccgggccatgacttcgacctagtggccgggttcctggtgtccgagggcgtcatctgggattccgggcaacttgtctcgctgcgcttctgcgccggggaagacgaaaacggcgtgcagaccttcaacgtggtcgaggcccagttgcggccggatgttgaggctccgtccataggccggcacgtgtacacctccagttcgtgcggcatttgcggcaccgattccatcgagtccgtcagcaagtcctcgcactacagtcccgccgcagatcccctgagcgtttccgcggaggtgcttgcctcgctaccggacattcttcgggagtcccagcgcctcttcgacgacaccggcggcgtccatgctgccgggctcttccggattgaggacgacggcggcgcaaaccttctgtgcctccgggaggacgtgggacggcacaacgccgtggacaaggtggtggggtgggccctgcgtgaaggcctgctgcccctgagtggcacggtcctccaggtctcgggccgggcatcgttcgagctggtccagaaggctgctttggccgggatacccgtcctggctgccgtgagtgcgccatccagccttgcagtcgaactggccgaggccagcggcctgacgctcgccggcttcagtaggggaaccagcctcaacatctacgcaggcgacgggagaatacggcggccggtggcagcttcgccgtcgtaggcctacccagccgcctgctggcccggaaaacagtcggggaagcggttccgaaaaggttggtaaaagacctgccagcgggtagatttatccatcgaatggacaccaggatccagtcccaagcgctaaagagggcacacattgcatgacgaccgccggatcacggaagtgcgcctgcacaggttcctgcgcgagcgcataatcccggcggtctacagccggactcttcccctcaccctcagtagttgggatgccccggacgaacccgttcccgcgctggaagccatgcggcaggagttccagccacaggaatacggtgccttgtggggtaagccctggggcaccaagtggctccgtctccagggcgaggtccccgaatcgtggggcacggaaccggacaccaccgttgaagtgctggtggaccttggattcaccgttgaagtacccggtttccagtgcgagggcatcgcgtggcgcccggacggcaccatcatcaaggcggtctcgccgcggaaccagtacatcccgctgaaactcttgggcggtggcatggcggtggacttctacgttgaggctgcggcgaatccggacgtcgcccagggctggacgttcgcgcctacgccctacggggacaagtcaacggccgggacagcaccgcagtacaggctgggaaacctcgtcatcgccgaactgaaccaaaatgtctgggaactgcagcaggatatttcaacgctttcaggcctcatggcggtattgcccctggaactgcccaggcggcacgagatccttagggcactcgagcgcatgatggacatcatggatccggacgatgtggccgggactgctgccgcaggacgagaagcgctcgccgacgtacttgcccggccggcttatgcctctgcgcaccagctggtagccaccggccatgcccacatcgattccgcctggctctggccggtccgggagactgtccggaagtgcgcccggacgttctccaacgttgtggcgctgatggacgagaacccggactttgtattttcctgctcctcggcccagcagttcgcctggatcaaggagttctaccccgaactcttcggccgcatccgcgagaagatccgcgccggccagttcgttccggtaggcgggatgtgggttgaatcggacaccaatatgcccggcggtgaggcaatggcgcggcagttcgtggagggcaagggtttcttcctcgcggagttcggtgtcgactgccacgaggcctggctgccggattcctttggatactctgcggcgctgccgcagatcgtcaagtccgcaggcagccgctggttcctgacccagaaaatctcctggaaccagatcaacaggatgccgcaccacaccttcaactgggagggcatcgacggcacgcggctcttcacccacttcccgcccgtggacacctacaactcggagctgagcgggcgcgaacttgcccacgcggagcggaactaccgcgatcacggccacggcacagtgtcgctggtgccgttcggctatggcgacggcggcggcggaccaacgcgggaaatgctggcggctgcctcacgcgccgcggacctggaaggttctccaaaggtccggatcggctccgcggaaagcttcttcacgcaggccgaggctgactaccccgtcctgcccgtgtgggtgggcgagatgtaccttgagctgcaccgcggaacctacaccagccaggccaggaccaaaaagggcaaccgccgcagtgagcacctgctgcgggaggcggaattgtggtgtgcaacggctgctgtgcgcaccggcggcagcttcgcctacccggctgcggaactcaagcggttgtggcggctggtccttctgcagcagttccacgacatccttccaggcagctccatcgcctgggtccaccatgatgccgagcggaactaccaggcagtcagcgatgcccttgaagcaatcatcagcgaggctgcggccgccgcgctgggcagcggcggccggacattcctcctgaacgctgcgccgcactccagggacggggtgcctgcactggccgcaggcgagccggctgcagcggatggcgcggtccaggccaccgctgacgacggcggctttgccctggacaacggagtcatccgcgccgtcctggacgccgacgggctgattgcctcgctggtggattacgccagcggccgggaagcgatcgctcccggccagcggggtaacctccttgaactgcaccgcgacactcccaacgagtgggatgcctgggatatcgacgagttctaccggcgcaacgtttcgccactgacccgggccgcttccgtccggctggttcacgaaggggcagatgccattgtcctggtggagcggctggccgggacttccaccattacccaacggatcgcacttgcgccgggcagcccgtccctctccatcaccacctcggtggactggcaggaacgcgagaaactgctgaagctcggcttcgcgctggacgtccgggcggacaggtcggctgcagagacgcagtttggccacgtgttccggcccacccacacgaacacgtcgtgggaaacggcaaagtttgagatttgtgcccaccggtggatccatgtggcggagccggggtatggtgtggcgatttccaactcctccacctacggccacgacgtcgcgcggaacatcagggatgacgacggcggcaccaccaccacggtgcgcctgtcgctgttgcgcgctcccaagtttcccgatccggaggcggaccgcgggctgcatgagctgaccgttacgatccgtccgggggcggatattgccggcgccgtggaggaaggctaccgaaccaaccttgttccccggttggttcacggcggttccccggtggaaccgctgttctccgtgacgaaccctgccctggtgattgaagccgtcaagctggcggaggacgggtccggggacgtggttgtccgcctctacgagtccttgggccaacggtcggcaggaaaggtgaccgcgaacttttccgtgcagggcgttacttcagtggatttgttggagcgtccgctcgaggcgccgggcgtgaacgcctgtgctgacggagcggaactgggcctgcggcctttccagctggtgaccctgcggttcgcccgcgaccaggggtagccgcttctttagctcatggaaccgtgaattcgggccaggcattgaagggtgtctgcgtcaggaaagcacgcgcccaaacgggctttaaccaggctgagtgggggcggtccccaacggccgccaccactcatccccccaataggtgtgaaggcccccggagcggccaacgtcttggaatttatccccgttcgaaaacgaccttcgctccaccttcacacattcatgattgtttcacattctaatgattttgtgaaagccagcagggttacttttcggtatatgtccttttggcggacgacgtctttctgttctgcacccgtgccgcccagatcagcgccaggccaaggacgaagcacagtacggcggtgtagttgatgacgaactccgccgccccccactcgggaggcaccacgggaaagagcagtgtcagggcgatggccactccgcctgttgccaggagtgcggcggcaacccgcacgaggaccggcaaccggctccggacagcgctgaccatggcgggcagcagtactagggatacgtatgcgggataagcccttccggctgctccgtagtactccaccaggacaaaattccgttcgctcttttgtgacggtcctgcaaggcctgccgaagaacccgccgtgtccatcatgaagaacaggatcatcaacgctagggagatgaccagcagcacaaccatgccggctttccccgtgatgagccggtaggcgctgtcggcgccgaaaccgcgggtgacccggatgccgacaaagtagatggctgcgaagatgatgaagcgcagcagcaggttggccaggttgatgccgcccagggcctggtcgatggccacgtagggcgcttcgatgctcaggaggatggcgacggtcatcagtccgaagatgtagaacagcgacctgttctctccgcggatggcactgggcacgcgggccgctgcggtgagcgcgcagatggccagcgtggaccattgaagaatgtcgatcatcccaggttctcccaaattttttcagtttgcgcttggtcctgctcctggcgcttcagcaccttgcccagtgcctgcagccggtcgcccgccaaggcggtgaggtcgccgtcggacaggctgtccagggcggcctgccgcgcacccggcggccagcccgcttcctcttcggtgatcaggccggtagccaccaggccaccggccggtccgacgccggcagcaagcgcggtggcaagcgccagctccggagacagccggttggcagtcagttgcgctgaatagttttggggcgccactcccgtggccgcggaaacgcggtgccgcacttcgccgtcgtcgatggcgtcaacccagttttttaccgaggtggcgtgcggggcggcggtaaggggtggtgacgctgaccccgaagtgccggcgggctccgttgccggacgcgcaaggacagcccgcaggagatcggccgtggaaacctggctgacaagttcgcaacgcgttggcagagcctggggaccggcgaggtcccggtatgcctcgaaagtggccagggccgcgagcgggttgacgtcgtaggcgcggctgatgctgaccacggtgctgaccgagacttttcctcggaccagctgctgggcaagggtagtccgcttgatccctgagatcctgcagacgtcagccgtgctgacgtccggcgcaatgccttgcagccaccgctggaacgccttggcggggatggtcatggagggctctctgcagaacggatggtgtgtcgattttagcgtgccgcatcggggcggttttacccgtgctgccgtttcgactatgcttgatggtcgagcccgttggtccgtacaccccccaagtccggaccagcgggttctttcatgtcctgccgcccgcgctccttcctcccgggtaaatgtcagggccctgccagccagtgttcgggcaggaaacccgctgcggacgcagtggcgaaaggatagaacgatgactgcaaccctcgtagcgaaggacgtttccggcggtcacgaccaccggcagcttttctccgggctctccctgacagtggcccccggggacgtggtgggcgtggtgggcgccaacggagcgggaaaatccacgctgctgcggctcctcgccggcgtggaccagccgcaggaaggctctgtcagcctcgcccccgccgatgccttcgttggctggcttccccaggaacacgaacgcgtgcccggtgagacagtggcgggatacattgcccggcgcaccggctgtgcccaggccaccgccgagatggaatcaacggctgaagcccttggcagcggcgcgcccggagcggacgacgcctacgcgctcgccttcgacaggtggatggcctccggcgctgccgaccttgatgaccggattcctgccgtcctggcggacctaggcctggagaccggtccggaggctgcaatgaccggcctctccggcgggcaggcagcgagggtggcgctggcggcgctgctgctgagccggttcgacgtggttctgctcgatgagcccaccaatgaccttgacctcgaaggcctcgccaaactggaggactttgtcaccggccttcgcggcggcgttgtgctggtaagccacgaccgcgagttccttgcgcggtgcgtcaccacggtggtggaactggacctggcgcagaacgccgtgggcgtgtacgacggcggctacgatgccttcctggaggaacgggcagttgccaggcggcacgcccgggagaagtacgaggaatttgcggccaccaaggccgacctggtgtcccgggcgcggacccagcgtgaatggagctcccagggcgtccggaacgccatgaagaagagcccggacaatgacaagatccgccgcgcagccagcacggaatcctccgagaaacaggcccaaaaagtgcggcagatggaatcgcggatctcacggctggacgcggtggaggagccgcggaaggaatggcagctgcagttctccatcggtaaggccccacgctccagctcagtggtggcaaccctccgcgatgccgtggtccggcagggcggcttcaccctgggtccagttaacctccagctgaatgccggcgagcggatcggcattacggggcccaacggtgccggtaagtccacgctgctgcgcctgctgctgggcggcgtcgagcctgactcgggcagtgccgcgatgggcgcttccgtggccgtcggggagatcgaccaggcccgcggactgcttgccggcgagctgaccctgggcgaggccgtggagggagtcctcgtagaccttaacccggccgaggtccgcacactcctggcgaagtttgggctcaaggccgaccatacgtcccggaccgtggagtccctgtcacccggcgagcggacaagggctgcgctcgcgctgctccaggccaggggagtgaacctccttgtcctggacgagcccaccaaccacctggaccttcccgccattgagcagctcgaagaagccctggaaagctacgagggcgcgctgctgctggtcacccacgaccgcaggctgctggaaaacgtacggctggatgtacgttggaatgtggttgacggcgtcgtcactgaagtgttggccgccagcgccgcgaaaggcaccaaaaaatgagcatggacagggttgcctggagctccctctacaacatcacccgcgcctccaacggctccaagccgttttccaaagagctcctcaaacgggtgtttggcttcgcgcggccgcaccgcagccggttggtcgctttcgtgctgctgtccatcgtgatggccgtcctggcggtggcgacaccggtgctcgccggccaggtggtggacgcgatcattgccaaggcagacgccggaacggtgatctggctggcaatactgattgcggtcgtggccgtggccgaggcagggctggggcttgtgacgcgctggctctcctcttcgatcggcgagggcgtgattctggacctgcgcaccaaggtgttcgaccacgttcagaagatgccaatcgctttcttcacccgtacccgcaccggtgcgctggtgagccggctcaacaacgatgtgatcggggcgcaggcggccttcgccggcacgctctccggggtagtcagcaatgtggtggcgctggccctgacgctggtggtgatgctgaacaagtcctggctggtgacagtgctggccatgatcctgctgccgatcttcctcctccccgcccgccggatgggttccaggctggccgagctgcgccgcgaggccgccgagcacaacgccaccatgggcacgcagatgactgagcgcttctccgcccccggcgccaccctggtgaagctctttgggcgcccggacgaggagtcccgtgagttcgcgctccgggccggacgggtgcgggacataggtgtccgcacagcgatgctccagttcaccttcgtcacagccctgaccctggtctccgcgctggccctggccctggtgtacggcctcggcggctggctggcgctgggagggcagctggccgcgggtgacgtcgtggtgctggctttgctgctcacccggctctacgccccgctcacggccctctccaacgcacgtgtggaaatcatgagtgcactggtcagcttcgagcgcgtcttcgaaatccttgacctcaagccgctcatcagccagaagccggacgctgtggaatcgccgcgcggcccgctctccgtggagttcgacgacgtccggttctcctatccctctgcggacaaggtgtccctggcgtctctggaagacgtctccaccctggatacccgtggcggcgaggaagtcctgcacgggatcagcttccgggtggagcccgggcagacggtggcgctggtcggctcctcaggcgcgggcaagtcaaccatcgcacagctgctggcccggctgtacgacgtcgattccggcgccgtccgttttggtggcgtgacgcccggaaaaggggtggatgtccgcgatctgaccttcgactcgatgcgggaaaccctgggcatggtgacccaggacggccacctgttccatgagagcgttgcctccaacctgcgcctggcccgcccggacgcaaccgaagaggagatgtgggaggccatccggcaggcccggctggaagccatgatccggtcactcccggacgggctggacacagtggtgggggagcgcggctaccggctttcgggcggcgaacgccagcggctcaccatcgcccggctgctgatcgcccagccacgggtggtcatcctcgatgaggcaacggcggcgctcgactccaccaacgaagctgccgtgcaggctgccctgggggctgccctcgaggggcgcaccgccgtcgtgattgcgcaccgcctgtccaccgtccgcgccgcggacgccatcctggtggtggaggacggccggattgtggaacgcgggacccacaccgaactcctcgctgccgagggacggtacgccgagctctaccgcacgcagttcaacgaggccaccgctgttgcccaggaagcagttcccgagctctaggcctgcctgtccgcgctgccggaccttgccagctccgggaggatatggtccgtcagcagcggggcaaggtcccgggtgggttgggcatcgaggtccagccacctgatctcggcgatttccgcggaagggtgggcctcccacactccgggggccaggaagactgttgcctcgatgtccgttgcggcctcattcgcggcgtcggcgatccacacccccatcagctgcagttcccggggatcgagcacgatgcccacttcttccgtgagttcccgtgctgccgcctggaccgctgtctccccggtctcgggcttgccgccgggatgcatgaacatggccgtgccgcgcttcctcacggtcaggagccggcctgccttgtcgaacacgcagacggccgagaccacaatgcggtccttcatgcagcgggcccctgcgtgcgcaccaggtgtgacgtcagcagcaggtccttgcgcgggccccggacatcccacgtgtagctgaacctgtccccgctttcgtagacgtaggtgacgcggtacgaatcgggatcgcaccagtggttgtcaaggttggacgccggagcgaagctcatccggtggaaggggctgccgtccgggaagaatacgtccagcgtgtcagggctcccggtagtccgcagcaggtactcgcgggaggcggggccggtgaaggagggccagcgcatggtgccttcctcacggaaggccaggccgtcgtcgtccgtgggaacaaaatgtacgacgccggagaaggttccgcgggtgccttccgcccggtccagcaggtcccgctggaccgtccactgcccggcactggcaacgtccgcggcggggccggtcggcgtggggccaaggaggtaggcgcggagtgcgaactccgggggaggaaagttcacgtgccctcgattggaatcgaaccaacgacaccggctttaggagagccgtgctctatccactgagctacgagggcttgcatccggcggatcggcaggccagtccggccggacacggatacaagcatacaaggtgctgggccgtactacgctcaaggcatgagttcagcgccgtccgccgccaggcctgccacgataattccggacaccgcatccacccgccagtacatcggcgcctggtcggtgctgagcgtcctgcagtactttgccgcggaagcggcagtgatcggtgcctgggcgggccccaggccctatgacctgcggacgggatacatcagcgaccttggcgccctgaactgcggcatcttcgacggccgtgaggtgtgttccccgttgaactggctgatgaacgcctcattcgtggtccagggtctcggtatgctgctgggtgcccttttgctgagctccgggctgctctgcgtggcggcccgggcggatctgcgggtgcagccgcagcggaggccctggctggcggctgtctgggttcggatcctgaccgggaccgccggggccggcactgtcatcgtgggactggtgcccgaggacgtaggttccggctggcacatcgtgggcgctgtgatgtacttcctcgccggggcctccgcactgctggtcctgggtatcctctggctgcggaaaacaaacttcgcctggttcatcgtggtgtgtggtgccgtgtccctcgccgccctggggacggggggcctgacgggaatggacgttccggagcctggcacgctggagcggctcatgggatatccggtcactttgggcatggccactgcaggactggttattgcacgccaggtccaccgccaccgcaaaatgatgcgggccggggcagccctcagctagcggctttgggcttgcgggccccgaggacaacggcggcggcacccgccagcaggctgaggaccaaaagtacccaaccggccaccgtgagcccggaggcaagggccacctggccggcgtcggcagtgccggatgccagcaccccgtcgatggcggtgttgccccaaagccggaccacaacgaacaacagcggcaaggaccagagcgcccagcgaagggctttccgggccacgttcgtgccgatcagcagcagccaggtgaatccgaaaatcagcgggaacagggtccccgctgttttgtgcacgtagttaagctggccgcgcgcgtcgtcgtccatgacggcctggagctggctgacgtaggccgcatcgaagccgccgatgagcgaatccggcatggccaggtctgtggagaggtcacgcatctgctccagggccagcaggtgcaggtaccagaagaggaacaggctggccaccacgccggcgatcaggatgaggttgctgttgttttgggctttctgcggcgtgcgcgccgtggtggggttcaccaccggcggtagatggtgctgcggtaccgccgccttggagccgtgcttcttgatccgctgggcaggtgttttggccatggcttcattatcgcgccccataaactgaagccatgaccactggccggcacagcgctgttgaacttgacccatctttggacgactacgagctggcagcagcccttgtgcgggaggccgggcagctggcgctgctcatgcggatggcaggcctgcagtcgcagcagaagacctccatttcagatgtcgtgaccgccgctgaccatgccgcagaggcctacgtcctggagcagctgcagcgatgccggcctcaggacggcatcctgggcgaggaaggcgcatcggtacagggcagcagcggccggacctgggtcattgatccggtggacggcacctacaacttcctgcacggctccacctactggtgctcggccatcgcgttgaaggaccaatccgatgtgctgctcggcgccatcttccagccggaggaggacaagctctggctcggtggccgggcgcatccggccagcctgaacggtgaacggctgacggttttccacgacaacaggggagcgcgcaacgcaacccccgcggcccagctgggggcggcaacctacatccaccccagctggctgatggatccgctgtgcgccatgccctggcacgcagccgcgacgtcggctgccgccctccggatgctcggctccggctcctgcgaccttggccgggtggcggacggccagctggggtgctggttccagcacagctgcccggaatgggactggctgcccggcaaggccatcgtccgggctgccggcggcgccgtggatacagtgcgggtcaacggactcgaatggttcatggcgggcgggacgacggcggtgcgcgagctgcgtgcggccctcgagtccggctccgtggcctagcccaattttcacaccgcccttcgctggttgactgaattcggtgtccatgtccttgaccagccccaacgacacggccgagcacctgcaccgccggttttatcccgtggccgtgcccgtgttctgttgggtacgagcgcactcctgaagcccttggctgtgggtgcacatcacgaccgtgggcttcaacgtctctggccagcgcacgggccgcgcttaccgggggagccgccgcaagtgccgggccctttgcagaagcagctgtagcgctggctggtgggctcgtgtggatccctgttcggggtggtggggtgcggttcgcaacggcagctgacataccggcccatgggctggtctcgagccctgtgccgggtggtggggggtgcggtggagtggtaggtgtggccggtgggggtttggagttgcactgtgtgtcgtggtccgggaatggggcgggctgtccaaccggctgtttctttggtgtggttgcaggcttcgcagaggccttgggcgttggtgctggtggtgggcccgtcctggtgccagggggtgatgtggtcgtggtggcggatgggcgcgtcgcagtagggggtgcggcaggtgtcgtcccgtatctggaggaagcggcggagcccggcggggaagagccgggccttcgaatccatggcgaggagttcgccggtgccgggtgcggtgtagagccggcggagccacgtggtgaactcaccggtttcaggtccctgatccaggacggtttttctggcccacgcagcggggacgatgccgtagcctgcgaggcgggcgggttcgctgtcgccttggagcagggtgcggtcggtcatgacgagccggacttcgatgctgctggcccctcccggggtgccggtgacggactcgacgaggtggtcagccatgatcgcgcccttaccgcggtcgtcacctgaggaccgcctggcgtcagcgtgccgagtcagggccgcgtaggcggcgacgccctgagctaccgggaggagcgcggtcaggcgggtcatggtgtccggcgccgggcgcagaatgacggtccgctcattggcggcgtgggcggcgcggttcgtcaccgagtgtgggtcccgccggtaggcggccgcccggacggcggcgataacggcacggtccccgcaaccggcaagggaaccggtgtcggcggcgatttcctcatccaccgcgcagcggtcctcggcggacaggcacgctgtttccttcaccacgagggtggcccgccattcattcagctgcccggtttgcaaagcggtcagggtatggggcatttcggtacccagcgctttcgacaaacccagaagccggctgccgcgggccgggggctcccgccgcgccaacgcaacctgcgcggccacccctgccccgagctcctccgctggcataccagcagcagcctgctcccgccgctgctgagcatcgaaagcaacggcaatttcggcctgcttcgctgcggccagcgacttcagatcctcaagcatccgcaattgatcaatcatcccggcgccggtagaagcaggacggacggaagccagggtttggacaacgtcgccaatgcgagtgccagcgaggctccctgcactgcgccggcaccgccgtcgttattgcttccatcacctaagcctttcaaccgcatgccctccttgcacgcacccttcagcgctatgtggataaagcttgcaggaccgccaaaagggcacgggtctggagccggtaatccacaggctggaagtccgtgtcggtcccaccgcctagacttgtaggcaccatggatatgttgtttgacccgtactctgacggaccgttcaaggctgcttccccggcagctgcccgcaccaagtcgcgccctgaaggggccacggcggccggtccgggcggtgctgcgccctgggagaagagggccggagcagggctgtccgaaggcaagcaggcggaagggcagcgcactgaggcccagcacgcacaaggccagcacccggatgggcatcgccatgggcacggccggccggacgcggcccagctcctcgaagggctgaatccgcagcaggaggaagcggttaagcatgccggttcagctctgttgatcgtggcgggggccggttcgggcaaaacacgtgtgctcagtaacaggatcgcctacctgatagctaccgggcgtgcccatcacggcgaaatcctcgccattaccttcaccaacaaggccgcggccgaaatgcgggaacgcatcgaagtgctggtgggtggacgcgccaagatcatgtggatctccacgttccactcgtcctgcgtccggatcctccggcaggaagccgcaaacgtcggtctgaagtccaacttctccatctacgacgctgcagattcgctccggctggtcacccaggtatccaaggccctggacctggacccgaagaagtttgcgcccaaggccatccagcacaagatctccgcgttgaagaatgaactcatcgacgccgactcctacgcctccgcggcgaactacaacgatccttttgagcaggccgtagccgacgtcttcaagggctacacccagcggctgcggcaggccaacgccatggacttcgacgacctcatcgcggagaccgtctacatgttccgtgccttcccggcgctggctgaatcctaccgccgccggttccggcacgtcctggtggatgagtaccaggacaccaaccacgcccagtacgctttggtccgggagattgtgggggagggtccgggcgcctccgagctgaccgtggttggcgattcagaccagtcgatctacgccttccggggtgccgatatccgcaacatcgtggagttcgagaaggactaccccgaggcgcggacgatcaagctggagcaaaactaccggtccacgcagaacattctcaccgcggccaactcggtcatttcacggaaccccaaccgtcccgagaaacggctgtggaccgctgaaggcgacggccacaaaattgtcggttatgtgggtgagaacgagcatgacgaggcccagttcatcgccaaggaaatcgaccgcctgcaggatgaggacaacctccgtcctggcgacgttgcgatcttttaccgcaccaacgcccagtcccgctccatcgaggacgtgctggttcgggtgggcctgccgtacaaggtggtgggcggcacgcgtttctacgagcgcaaggagatcaaggacgccctggcgtaccttcgcgtcctggtaaacccggacgacgacgtcaacctccgccgtgtgctcaacgaaccgaagcgtggcattggcgaccgtgccgagggcgcggtagcggcactggcccagcgggagcggatttcgtttatggcggccgcccgccgcgctgaacaggccccggcgatggcgacccgatccgtcaatgccgtccttgggtttgtgaagctgctggatgaccttgcagaagtggccgcgggttccggcgccgcagcagcccttgaagccgtcctggagcagaccggctaccttgccgcgctgcgctccagcaccgacccccaggacgagtccagggtggagaacctggcggaactcgtggccgtggtgcgggaatacgagcaggagaaccctgaagggtcgctcggtgcgttcctggagcaggtctcgttggtggccgacgctgaccagatccctgacgcccccggagcggacatcgacgcagcagtggcagaggccaaacgcctgggcgtcgtcaccctgatgacgctgcacaccgccaagggcctcgaattccccgtggtgttcctgaccggcatggaacatggactgtttccgcaccagcgctcagccacggatcccaaggaactggctgaagaacgccggctggcttacgtgggccttacccgtgcacggaagcggctctatgtcacccgctcggaggtccgcagcatgtggggccaaagccagtacaaccctgccagccagttcctggaggagatccccgcggaccttgtggaatggaagcgcgagggcagcagcaggcagaccggcggctggggtaacagtggttccattgggtcgaaccgctacagcggatctttttggggcgccgggacggcccggggtgcggctgctgactcgtcagccggattcaacgccgacgtgcccgcggccattgcgaagaaccgtgtgcagccgcagaaagaaatcgtggcggtcactgtgggggacaaggtcaaccacacgagcttcggcaacggtaccgtcctcgcgctggagggggcgggggacaagaccgtggccaaggtgaagtttgacgtcggtgagaagcgtttgctgctgcggtacgcgccgctgaccaagctcgacgcctagcagttccagggcgaaggcgggggcaggcaaggtacaaagccttgccggcaccggcgcccaggactaaggttcaggaaccgtcctgctgcagcgcaggaccagtcggagcgcggccatgaaaatcctgtttgccagccaggccatcgatggacacttcaaccccatgacgggagtggccgttcgcctcaaggaacgcggccaccgcctcgcctggtacaccggtccagtgttcggtgacaagctccgggacctggacattccgctccttcccttccggcgggccattgagcaccgcgtggataacctcttcgagctgtacccggagcgcgcgaagctcaagggtccgcgggccatcgggttcgacggggagaagatttttgccagcaacgtcagcaacttcttcgaggacatccgggaactggaacaggactttgcctttgacgtggccgtggttgacagttcgatgttcattcaccgcctcgtgacgagcctgatgggcaagccgctggtgaacttcgtggccatccccaacatggaaagcgaccctcaggtaccgccgctgttcttcggcttcaagcctgcgcgcaacccggtggagaggtctgtccacgccgcggcgggcttcctgtccgacaacgttattctgcggcccgccggccttagctaccgccgccagctggcggcctacgggcaggtcgcccccaggcacggacggctgacggacgagccctaccggtcctcagcggcagtcatccagaccggcccggaagcactggacttcccgcggcggcacagtaaccccgcggtgcactatgtgggggcactcctgccgtacaggtccccgagtccggcagggaccgtggctggaagtgacgccgaagaagcagagcattggccgcagtacccacgcacgttgctggtgacccagggaacggtggacaacgtggaccaggacaagctgatagttccggcgctggaggcggtcaaggacatgggcgcgttggtgatcgtggccacaggaggccgcgggacagaggccctccgcgcgcgctacccgcagcccaacatcgtgatccgcgacttcgtggacttcgccagggtgctggatttcacggacgtgttcatcaccaacggaggcttcggcggggtgcagcttagcctttccaaaggagtgcccatggtggtgtcagggatcaacgagggcaagagcgatgtcaatgccagggtggaattcgccggcgtgggcatcagcctgaagacggaacggcccaagccacagcgaatttctcacgcagtgcaggagatcctctcgaatgctgcctggcggacgcgggcgcaacagatgcgtgaccacttcgccgccggggatcctgccgccgttgccgccgccgtcgtcgaaaaggcagctggcctggcaacagactgagcgccgccatgaagcataatggaccgcatgcgacggactgtacgggggatgctcgccgcccttttcctgctggctgcaacaggctgcaccgtgacggtggaggaccccggctacgtggcaccgcctccactgccaccgattgagcagctggaacaggcgccgctggttgacccgcaggaattttccggcggtgacgatgtcctctccttcatcaccgaggaccggacagtggcctgcgcgctcacggcagcccgcgggccgcacatcaacctcccctatgagcagaacagcttcagcgacagcgaaaacaacaaactggcgatcgtgccggtggcccactgcgagctggccggatacccgaaacctgccccggacgacgtggcggatgactgtgcgggaacgaatatcggatatctgggcggggcagccctgttgaccccggacaaagcaacgtacggagagtgccggtccggcgtcacacaaatggaagccacatatggcccccgcggaagcaaggccggcccgatcgcggaattgtctgtgctggctgacggtcagaacctcgaacgcaacggactgcgctgttccgcctacaacggcggcgtagcctgcggaaacgtctcggccggcgtggggttctttgtttcggaggaccgttacgagctgatttccagccctccggaaagtgccccgccggcactgtgaagccctcaaaaaccgcgtaaatccgcggtttttctacgttccatagaatagtgtccttactcacataaggggtactctgggacgggccggtcctcccaaaggactagagttcccagtggagcatcacgccgcgtggctcgtttccaacaggccgccggtgcgtgcaattccgcagcccggtcatcgtcttcgatggtgtccgactgtacagaaactacttcgacgtagaaggacactaaaccgtggacctgtttgaataccaggcgcgcgatatgttcgaggcgcacggtgtacccgtgcttgccggcatcgtggcgtacaccccagaagaagcaaaggcagctgccgagaagatcggcggcgtaactgtcgttaaggcccaggttaaggccggtggccgcggtaaggccggcggcgtcaaggttgccaagaccgccgatgaggcacttgagcactcaaccaacatcctgggcatggacatcaagggccacaccgttaacaaggtgatgattgcccagggcgcggacatcgccgaggaatactacttctccgtcctgctggaccgggccaaccgcaactacctggccatgtgctcggttgaaggcggcatggaaatcgaacagctcgccgtcgaacgccctgaggcgctggcgaagatcgccatcgatcccgccgttggcatcgaccaggccaaggctgacgagatcgtcgctgcagccggcttcgccgaggaactgcgcggcaaagtcgccgccgtgatcctgaagctctgggacgtcttcaagaaggaagacgccaccctggtggaggtcaacccgctggtcaagaccggtgctggtgagatcgtggcactggacggcaaggtctccctggatgagaacgccgagttccgccacgccaagcacgccctccttgaagacaaggacgctgcagacccgctcgaggccaaggccaaggcgcaggacctgaactacgtcaagctggacggcgaagtgggcatcatcggcaacggtgccggtctggtcatgtccaccctcgacgtcgttgcctacgccggtgagaaccacggcaacgtcaagcccgccaacttcctggacattggcggtggagcttccgccgaggttatggctgcaggcctggacgttatcctgggcgatgagcaggtcaagtcggtgttcgtcaacgtcttcggtggcatcaccgcgtgcgacgccgtggccaagggcatcgttggtgcgctggccgagctgggccactccgcgaacaagccgctggtagtccgcctcgacggcaacaacgttgaagaaggccgccgcatcctggccgaggccaaccacccgctggttaccttggccgccaccatggacgagggcgccgacaaggccgccgagctcgccaacgcagctaagtaaagggacgcaccatgtctatctatctgaacaaggactccaaggtcatcgtccagggcatcaccggcggcgaaggcaccaagcacaccgccctgatgctgaaggccggcaccaacattgttggcggcgtcaacgcccgcaaggccggcaccacggtcctgcacggcgacaacgaaatcaacgtcttcggcaccgtcaaggaagccatggcggaaaccggcgccgacgtctccatcgtgttcgtgccgccggcatttaccaagagcgccgttgttgaagccatcgaagcaggaatcggcctggtggttgtcatcaccgaaggtgtgccggtccaggattccgccgagttctgggcactcgcccagtccaaggttgacgccgacggcaaccaggtcacccgcatcatcggcccgaactgccccggcatcatcactccgggcgaggcactggtgggcatcacgccgaacaacatcacgggcaagggacccatcggcctggtttccaagtccggaaccctgacctaccagatgatgtacgagctgcgcgacctcggcttctccaccgccatcggcatcggcggcgaccccgtcatcggcaccacgcacatcgacgccctggccgcgttcgaggccgaccccgagaccaaggcgatcgtaatgatcggcgaaatcggcggcgacgccgaagagcgcgctgccgacttcatcaaggccaacgtcaccaagccggttgtcggctacgtggctggcttcaccgctcccgaaggcaagaccatgggccacgccggcgccattgtctccggttccgccggaaccgcccaggccaagaaggaagcacttgaggccgcaggcgtgaaggtcggcaagacgccgtccgagactgccaagttgctgcgcgaagtctactcagcgctgtagttcccagtaccagccaacgcggggtcgcttcccgcccgtcactcgtggacgggctcgaagcggccccgcgttgctgttaagtacgacgacgggtgggtcaccttccacatggaaggtgacccacccgtcgtcgtactgttgcgtcctacacctttgccccgctcagcagctcatcgagccgctcatagccttccgtcatgcctccctccatgccggactgcgccatgccgtcgcgggcctcctgcgtggggtagacggaatgtccgcggattcggcaccggccactgcccaggtcctcgaacgtcatgaattccaggctgacgacgtccgggtacccgccgaactcaaaagtctggatggcgaactcgttctcacggaccgtgtggaagatgcccttgaactcatacggcacgccctccggcccggtgtgcaggtagctgtaactgccgccggtccggaagtcgtaatggtcgatgtccatcttgtagccacgcggacccagccactggacgatgaggtccggctccttatgggcccggaacacatcagcgacaggaaaatcgaactcgcgctcgtagtcgatgaaggggactccctcaggaacgctgagcttcagggaattgctcatgatgactccttgtatctgggccgctgccggttgcagcgtttgacctcagcacagcatcgagactgcggaactgcccctcgcggaccaacctgtactggtcgatccatgcggtgagtgcctcaagccgcgcgggattcaggtgcacgggccgccgctgggcttccctggtgcgggtgaccaggttcgcctgctcgagtacctggatgtgcttcgagacagcctgtttggagatctcgaagggttccgccaattcattcactgtggccggtccccggctgagccgggcaatgatgctccgccgcacgggatcggccagggccatgaaggccgagtccagagccgctgcgtcgggttccattcgtgccactccactcatcacctgggacttcaatcaactaatacgtttatcaacctttcggttgtttaagcgtacgcccgttgagcccaacccggcaatacctctcttgcagactcttcgaatactttgttagtatgtcagtacaaactatggaggagatgcagtgccactcgttcgaatcgatgtaaaccagggccgcagcccagaggacctgcagcggctgagccgcgggatccatgatgcaatcctcgccgagtacggcatcccggagcgcgactacttccatatcctgaccgagcatcctgcagggcaaattttcgcccaggatgcggggcttggttttgagcggaccggcggggtggtgatgatccagatcttcacccagggcggacgatcgcaggaagccaagcagcgcctctttgccgccgtggctgagaagctcgcggcgattggtattgccggggaggacgtatttatcggctatgtggagaacaccgccggcgactggtctttcggtttcggccgggcgcagtacgttacgggcgagttggctgtgccccggaagtaggcggcctttgccggccaaaattgccctgctgggcgcccaaaaatgcctttatggcaagttgtaaacatgtcagtacaaacctttgacaggacattgattctagggcaaagtagtggatgtgaccccgctcatggaggggccagccagtcaccggagctctagctgtcgaggtgcagagttcaaactagaaaggtccgcgataccgtgacccacgaactgctcacgatcgggcgcatcagcgttgatatttacccgaacgacatcggggtggacctggaggacgtgacgtctttcggcaagtacctcggcggatcgccgtcgaacgttgccgtagcagccgcccggcatggccgccggactggcgtgatcacccgcaccggtgccgacgctttcggaacctacctccaccgggaactgaagaaattcaacgtcgacgacgcgttcgtcacccctgtcagggagtggcccacagcggtgacgttctgcgccatcaagccgcccgaggattttccgctgtatttttacgggcgctttcccaccgccccggacctgcagatcagggcagaagagctcgacctggacgcgatccgcaacgcagggatcttctggtcaaccgtgaccggcctgtgccaggagcccagcagggaagcccacatcaaagcacacgaagcacggcccagaactggcctcaaggaaggccagttcaccatcctggacctcgattaccggcccatgttctgggcatctgaagaggaagcgcgggcagaggtggccaaaatcctgccgcacgtcaccgtcgccatcggcaacgacaaggaatgcgccgtggcggtaggggagggaacccccgatgagcaggcggaccgcctgctggccgccggagtcgagatcgccgtcgttaagctcggccccgaaggcgtcatggcgaaaacccgcacggaacgcgtagtctccgcccctgtgcccgtgcaaaccgtcaatggcctgggagccggcgattccttcggtggtgccttctgccacggactgctgtccggctggccgcttgcccaggtcctggactacgccaacgccgccggcgcgatcgtcgcctcccgcctatcctgcgccgacgccatgccgacgccggatgaggtcacctcgctgctcgcggaacgcggccgcctggtgcctggccagtttgccaccgaaggagcagcactgtgaccctcacgccgctggcctcgaacaatgcgctggacgacgacccgcgccgctacgcccacctgagcaccatccggctcgaggacccggacgctattgcccgggcagccaaggcgcgccgccggcaccccggcctgaagtacgggcggcagaactttatcgtcgccgccgaccaccctgcccgcggcgccctggccgtcggcagtgacccggtggccatggcagaccgccgccagttgctcgaccggctgcagattgccctggcaaacccggaggtggatggcgtgcttgcgtcgccggacatcatggatgacctgcttctcctgggtgcgctggaaggcaagctggttttcggctcgatgaaccgcggcggactcgccggcctggtcaatgaaatcgacgaccgcttcaccggccacacggcagccgccctggaagcactgggtgccgacggcggaaagatgctgacccgcatctgcctcggggatccggatacggtggcaaccttggaggctactgccaaggccatcgactcccttgccgagcgcaagctcattgccatggtggagcccttcctctcggtccgggacaacggccgcatccggaatgacctctccacggatgccgtcatcaagtccgtcgccatcgccgagggcctgggatccaccagcgcctacacctggatgaagcttcccgtcgtggcggacatggaacgggtcatggcggccaccaccatgcccaccgtcctgctgggcggggatccggacagcagccaggacgaggttttcgcaagctggcaggcggccctcgcattgcccggagtgcagggcctcactgttggccgcacgctcctgtacccgaccgacggcgatgttgccggcgccgtggccacggcggcctcactgctgaacaacaccaccccaaaccgaaccgaagaagtatcggagtagcctccccatgagaacatcatcaggaactgccacccgcagaatgacggtcgcccaggccgtggtggaatacctttccaagcagtacacggtggactccattggaggcgtcgagtaccgtgagcggctgattccgggaactttcggcatcttcggtcacgggaacgtcgccggcgtgggccaggccctgaagcagtaccagcagctggacccagccatcatgccgtattaccagggccggaacgagcaggcccaggcgcaccaggccgtgggctacgcacggcacacccgccgccgccagaccttcgccatcagcacgtccatcggaccggggtcctcgaacctgctgaccggcgcggccctggcgacgacgaacaggctgccggtgctgctgctgcccagcgacacctttgccacccgcgccgcggacccggtgctgcagcagctcgaacagccctacgcctacgacatcaccgtcaatgacgcgttccggccgctgtccaagttctttgaccgcgtctcccgcccggagcagctgttctccgcgttccaccacggcctccgtgtcctcactgatcctgcggagaccggcgccgtgaccatctccctgccccaggacgtccaggctgaggccttcgacgtcccggcggaattcctggcagagcgggagtggcggatccgccgcccggacgcggacgacgacgacatcgcccgcgcggccgaggccatccgttctgcgaagcggccgctgatcatcgccggcggcggcgtcctctacgcctacgccaacgaggaactcgcgaagttcgtggaactgaccggcatcccggtgggcaacacccaggccggcgtcggcgtgctgccgtgggaccacaagttctcccttggagccattggctccacgggcacgacggcggcaaacgccatcgctgccgacgcggacctgatcattggcatcggcacgcgctacgaggacttcaccaccgcctcccggaccgcgttccagaacccggacgtgcgcttcatcaacatcaacgtcgctgcgatcgacgcctacaagcacggcgccacgctgccgatcgtggcggatgcccgcaaggccctggtcaagctgaaccaggcactcggaggctaccgcgtcggggcggacctcgagcagaagatcgcggcggagaagaagcgctgggacgccaccgtggacgaagccttcgatacccgctccacacccctgccggcacagaacgagatcatcggtgccacgtcccgcgccatggacgcggccgacgtcgttatttgtgcggccggttccctccccggcgacctgcacaagatgtggcgggtccgtgatccgttcggctaccacgtggaatacgcgtactcctgcatgggctacgagattccgggcggcctcggggtcaagcgcgcggcgctggcggaagccgccaacggcggaacccagcgcgacgtcgtcgtcatggtgggggacggctcctacctgatgatgcacacggaactggtcaccgccgtcgccgaacggatcaagctgatcgtggtcctgatccagaaccacggctacgcctccatcggatccctttccgaaatgctcggctcccagcgtttcggcacccagtaccgggccctggacgaggaacagcacagcttcgaccaaggcgagaccctgcccgtggacctggccctgaacgccgagtccctgggcgtgaaggtcatccgcatcgaaccgggggagaaggtcatcgccgagcttgagcaggccatccgggacgccaaggcggccccggagcgcggcgggcccatcctgatccatgtcgaatccgacccgctgctggacgctcccagctctgaatcgtggtgggacgttcccgtgtctcaggtttccgagctcgactccacgcagcaggccttccagacctacacggaccacaagagccgccagcgcaagctgctgggctgatttccctcttcgacacccgaacgctttcaactcaaggaagagccgccatgactgttacaaccgagacctccaccatcaaccacttcatcaacggcgccgaaagcgccggcgagggtgaccgcaccacgaacgtctacaacccggccaccggcgccgtgtccgcacagctgcggctggccaaccgggcagacctggacgccaccgtcgccgctgcccgcaaggccgccgacacctggggcgacatctccctggccaagcgcaccgccgtcctgttcaaattccgcgagctcgtcgcctcccacgtcgaggagctggcccggctggtcaccgccgaacacggcaaggtcctctccgacgccaagggtgaaatcggacgcggcctggaagtcatcgaatacgcctgtggcatccccacgctgctcaagggcgactactcggaccaggtctccaccggcatcgacgtgttctccttccgtgaacccctcggcgtcgtcgccggcatcaccccgttcaatttccccgtgatggtgccgctgtggatggcaccgatggcaatcgccaccggcaacgccttcatcctcaagccctccgaacgcgacccctctgcctccatgctcctcgccaagctgtggaagcaggccggcctgcccgacggcgtcttccaggtcctgcacggcgacaaggaaaccgtcgacgggctcctgacccacccggacgttgacggcatctccttcgtcggctccacgccgatcgcccagtacgtccacgaaaccgccatcaagcatggcaagcgcgtccaggccctgggcggagccaagaaccacgccatcatcctgcccgacgctgacctggacaacgccgccgaccacctcgcagcagccgccttcggctccgcaggtgaacgctgcatggccatctcggtcgccgtcgccgtcggggacgccgcggacctgctggtcaagaaggttgaagagcgcgccctcgccgtcaaggtcaacaacggcaccgcccccgatgccgaaatgggcccggtcatcaccccggcctcgaaggaccgcatcgtcaagatcgtcaccgaggcagaacaggccggtgccgccatggtggttgacggccgcgacctggtggtccccggccacgaggacggcttctgggtcggccccaccgtgatcgaccacgtcaagaccgaaatgaccgcctacaccgaggaaatcttcggacccgtcctggtggttgtccgcgtcgacagcctcgaagacggcatcaacctcatcaacgccaacccctacggcaacggcaccgcaattttcacctcctccggcgcccacgcccgtaccttccagcgctccgtaaccgtcggcatgatcgggatcaacgtgccgctgcccgtcccggtggcgtaccactccttcggtggatggaaagcctccctgttcggtgacaagcacatctacggccccgaaggcgtctctttctacacccgcggcaaggtcatcacctcccgctggcccgaacccaccgctgcttcgggcgcgtcctacaacttcccctcccacgctgacgaccatgcagtgcgccacgacggaatcgcagaagggctccctgacgagctggcgcacggagaagacgccgttccgggccgggccgacgatgcaactgaaggccgcggacggcgcgactgacccccttcgctatcccagctgagcacctcgacaatagaaagacaacgctgtcatgactgaaaacaagctgatcatcggcaccgctccggactcctggggcgtctggttcgcggacgaccccaagcagacaccgtgggagcggttcctggacgaggtggccgaatccggctacaagtggattgagctgggcccctacggctaccttccgaccgaccccacccgcctcgcggaggaactgaagcagcgcgacctcaaggtcaccgccggcaccgtcttcaccgcgttccaccgcgggttggaccagtgggagaccgcttgggagccggcccgcaaggtggccgaactgacggcagcaatgggcggcgagcacattgtggtcattccggccatgtggcgcgacgacgtcacgggtgaggctgtggaaagcggcaccctgagcgacaaggcctggagtgacctcttcgacggccacaaccgcctgggcaagaccctgctggaagactttggcctgaaacagcagttccactcccacgccgactcccacgttggcgcgcaggaagacattgagaccctcctggccgccacggatccgaactacctgaacctgtgcctcgataccggccacgcggagtactgcggtgcctcgagccttgagctgatcaagaactacccggaccggatcggctatctgcacctgaagcagattaacccggagattctgaagaaggtcaacgaggaaaacatgacctgggccgcagccaacctggccggcgtcatgactgagccgccgagcggactgccggatctccgggccgtcgtcgaagccgtggaggccctcaaccggcccatcttcggcatcgtggaacaggacatgtacccggttgccttcgatgtgcccatgccgatcgccaagcgcacccgcaactatctgctgtcctgcggttcccgtaccgctgtcagctgaccgcttccgccacagacactgaaggaacaaaacaatgactgaaaccctccgcgtcgccgtcatcggcgccgggcgcatgggcgccgatcacatccagcgccttaacacccgcatccacggagccgaagttgccgccgtcgtggacgttgacctggcccgcgcccaggcagctgtcgcaggcatcccgggcgccgtagcccttgccgacgccgaggaagccctcaataacggcgatgtcaacgcagtactcattgccactcccggcttcctgcacgaggacatcctgctcaaggcgattgccaaggacatcccgatcctgtgcgagaagccgctgaccccggacgccgagtcctcctggaagatcgtccaggccgagattgcactgggccacaagcgcatccaggtgggtttcatgcgccgcttcgacgccgaatacgcggcgcttggccagatcatccgcaaccatgagttgggtgagctgctcatgctgcaccaccagcaccgcaaccccacgacgcctcccgggttcaccaacgagatgctgatcaacgactccgtggtccacgagtttgatgccatccgctttttcacgggcgaggaaatcaccagcatccaggtccgcctgggcaaggccaccaagaatgccccggccggccagcacgacccccagcacgtcctgctggaaactgaatccggcgtcctggccgacgtagaaatttttgtcaacgcaaagtacggctatgaggttggaacccaggcgtcattcgaagaaggcgttgtcagcatcggcggcgacaagggcccgtacacccgcagtgccggccgctggggcggcaacgtcacccccgggttcgaagagcgcttcggcgcggcctacgacgtcgaaatccagtcatgggtggacgctgcgcttaagggcgagatcggcggtcccaccgcttgggatggttacgccactgcggcctgctgcgaagccggcgtcgaggcgcagaagaacggcgaaaaggtggccgtaaagctggccgccaagccagccctttacagctagcagccctactattcctgactcatccctaatggagtgttcccgtgaaaatcgcgcttgaccccaccccgttccaccacagccacaacctgctggaatttccccgcgtggctgcggacctgggctacaaatacctgcagatgacaccgcatgcagacatgatccccttttacaaccacccaaaagcagacgacgaactcgttaccaaaatgaacaaggcctgcaaggatgccggcgtggaaatcgcctcagtgctccccgtgctccgctggtccggtccggacgaggacgcccgcgaggctgctgtccgctactggaagcgcgccattcagatcaccgtggacctcggcgtcagcaccatgaataccgaattcagtggccgcccggagaaagctgaagaatccgagcgggccttctaccgctccatggaggaactgctgccgatcattgagcgcgagggactggatgtcctgatcgacccgcacccggacgacttcgtcgaagacggcttggctgccatccgcgttatccgcggagtgaactcgcccaacatcggcatggtctacgtggcgtcgcactcgttccacatgggcaacaagccgttggagatcatgcgggcagccggcgacaaacttcgcctggtccacgtttccgactccatggaccaccacgcctcccacggcttgcgttacatcaccaacccgccgggcaacgccgtgcgcgtgcaccagcacctgaaagtcggcgacggcgacgtgaactgggatgagttcttcggcgggctgaaggaaatcggcttcctggacaaggacaacacggtgatggtgtccagcgtcttcgctgaagacgagaaggccgaggacgtctcccggtaccagctggagacgatgcaggactatatcgccaaaacgaaatagtggacgcgccgatggacaacagcaaaggaaccatgaccgcgcccggcgcggcgggaacgcccggcattgcaaggaactccacaccgtcaaagtcctccgacccgaagaaattcatgcggaaggtggcgctcttctccaccttcggcggcctgctgttcggctacgataccggcgtcattaacggcgcactgccctttatgcagcgggatcttggccttactccgctgactgaagggcttgtcacctccacgctcctcttcggtgcagcatttggcgccatcagtgccggacgcttatcggaccgcttcggccggcggaaaaccatcatggggctggcgctgattttcgtcgtcgccaccatcttttgcactatttctccgagtactgaactgctgatagcggcaaggaccttgttggggctcgccgtgggtggtgcgtcagtgatcgtcccggtatacctcgcggagatgtcgccggcggcccagcgcggccgcatcgttactcagaacgaactgatgatcgtcaccgggcagttcctggccttcacgttcaacgcggtgctgggtaacgcgtttcctgaagaagcgaacatctggcgctggatgctcgtgatcgctacgttgccggccgtggtgctctggttcgggatgctcgtcctgccggaaagcccgcgctggcttgcgtccgccggcaggttcggcgccgtcctggaagtgctgcgctccacccgcgctgccggggacgtgtcagcagagttcgacgaggtgcggcaagcggccagggaggattaccaggccaaactcggaacggtcaaggacctcaccgtcccgtggatccgcaggatcttcgtggtgggtctcggcatggcaatcatcaaccaaatcagcggcgtgaacgcgatcatgtactacgggacgtccatcctgtcctcgtcaggattcggcgaccgtggcgcactgatcgcgaatgtcctcaacggcatcacttctgtggtggccgtggtcataggtatgtacctgatgtcgcgcgtacgccgtaaacccatgctgattgtgggactctgcggcacgtcctcgtccctgctggcgatcgcgatcatctcgttcgcactgccggaaagcaccctgcgcggttacctggttctgctattcatggtgaccttcctggcttccatgcagggctgtattggcaccgtcacctggctgaccatgtccgagatctttccgatgcacgtccgtggcgttgcgatgggtatctgcgtttttgtgctgtggatggtcaacttcctcattggtttctttttcccacagatggtcgcgtggatcggtgtttcggctacgttcctcatctttgtggcactgcagctcggcgccatcgtttgggtcaagcgggtggtcccggaaaccaaggacaagtccctcgaggagctcgagcacctgttcaaggaacgctcccgcgtggacgcctaaggcccccaaccacggggcggcgcaccaggcgccacaagaaacgcccgacgccggccggcgtcgggcgtttctgcgtccagggtgacggcggtgctagagcgcaatcaccgtgtttcgcaacgcgctttcgcgggcggcatcaagaacctccagtgtccggatcccttcagccgccggtaccggttcggggccttctcccctgacagcgcgggcgaattccacgtagaagccggcgtagtttccctgggctgaggcgataacctcgcgccctccctgtaaagaaagcgtcccccagttttccggggcatcaattccccacgccgccggttccgccgcaggacggcggcctgcgaacagggcctcggcctggacatccgcacctgttgccacatagctgccgttgctgccgtaagcgcgcagttccctggtacttgaacggttcagtttgctggcggacactgtggagacaactccggatgcatgcctcatggtgacgacgaagccgcagtccgtccgtttcctgaagcggtccgtccagtcaagggttgcataaacggagctggccggacccaggagccacagcatctggtccacaaggtggctgccaagatcccggaggagtccgccactggcaccaagttccaaggtgtccgcgttgtcctgatccatcgtcgagtggacccgccacagctcaccgagtttccctgatgcaaggacgttcgcgagagtaatgatatcggcgtcccgccgccggttgtgataaacgttcaggacaaccccggcctggctggccgcgagttccagctccctggcgtctttcgctgtgggcgcgaagggcttatccgccacaacgtggacaccagcgctgatggcttccaagaccagatccctgcgggtgtgcggcggcgtagtgatggttactgcatccacccctgttgccagcatttcggcaaggctgccatagaccggaaggcccggatagtcctgttccacgtgtgcccggttgaccgccgacctggccaccaccccggcgagttccacgccgtcggccgcttccacaaacggggcatggaagtaccggccgcctgctccatagcccacaacgccgattcgcatcattcgtttcctttggctgttggatttattgttccggtggactgaatggaaaacagcaggaggggcgacgcgtttgcgccgcccctcctgctgtcagggtgtcccccgggttatcaggcggtcgggttcaacgaggctgcgagggctgcgtcagcgtccttcaaaactttggcggctacttccagtccttcgatcctgcccagcgaaacgtcctcgtgctcgatattgaccagcatgtccggatctacctcgtgcagtgcgcgaaggaactccgtccagaaggctgtgtcgtgcccgcggcccaaggccacgaagtcccacgcggagttcttgggccactcgttggcccattcatcgccgccaaggttggtgcggttctcctccggcgagagccgacggaaactgttgtccagcacgccgtagagcgcggcattttccgtattcacgcggacgtcttttgctgcggcctggaacaccaacgggccgagttcgcggaccacagccaccggatccatctgctgccagaacaggtgcgaggcatcaagttccactccgacgtgtgttgcacccgtgagctcgataagtttgcggacatcggcggtgttgaaaacgaggttttgggggtgcagctcaagagccaccttgacgtcgtggtcagcagcaagacggtcagtttccttccagaactccgctgccacgccccactggtagtccagcacatccagtgcagccgagttccacgcgttgaccacccagttgacggtggtggcgcccggttcgcctccgggcaaaccggacatggtaaccacccggttctgccccaggcggtgtgccagccggatggaacggcggatgtcttcggcgtgcttctcaccgatctcacgcttggggtgcagcgggttgccgttgcagttcaggccggcgatcgagacgcgggtgccttcgaaaatcgcaaggtagtcgtcccgcgcggcgtcgctttccaggatttggtccatggtggggacatggacggcggggaggaaaccgcccgtgttgatttcaatgccagtgaggccaagatcggctatgaccttcagcgcttcgggaagtggacggtcatgcaggatcgcgttgtagacgccgagtttcatagcgtgattttctttccgttgttaagggcggattcggtgacggcgccaagcagttccatgttccgcacgccctcgtcaaaggtggcgcagcgggggagggacttttcttcgctgaggccggcaatctcttcgaggaatgctcgtgcctggtagccaaaggcatcgttctggccaaagcccacttcgggggcgtccatggcgagcccgccggcgatgtacgggtggcccgggcccaggatgacctgccggtaaccattttcgttgccggagccgtcgttgaggaacagctggatttcggacggacggcgctggtcgaatttagcggcaccgttttcgcagaacacctcgaattggaggctgttggcgtgtccggccgcaacgcgggagacttcaaagctgccggcgcccgtggcgaattccgcattgaaagccgcatagtcgtcgttctcgacggcttcgaaggtgtcactgacagcggcatggtcatggcccatcacagcagcgagcggcagtggccgcttgttgatgaccgtgctgagctgcccgccggatacagacttgatgtcgccgcacaggaactcggaaatgtacgtcaggtgggatccgacgtcggccagggcgcctgagccggggccgcctttgtaacgccagctcatgggagctgacgggctgaagccgtaatccgtccagtagcggccgctgaagtgcaggacgttgccgagcaccccggtccggatgaggtcccggatataggcgatgcccggtgtgcggcggaaggtgaacccgatccgcgcgatgctggacgcgctgcgggctgcgtcagccatggcccgggcgtcttccatggaatcgctcaggggcttttcgcacagcacgtgcttgccggcggcgagcaggccctcaacaacctcacggtggagggagttggcgatgaccacgctgaccacgtcgatgtcatcggcttcggcgattgcctgccatgaggtgtcgttacgctcgtaaccgaagcgccgggcggccagggagccgaattccgcattgacgtcaccgatcgaaaccaggcgcaccggaggaaggaccgggctgtagagggcggacgccgtccggtatgcggcagcgtgggccttgcccgccatgcctgcaccgatgacggctacaccaaggctttcagccattgatttctcctttgaaattcagccgcggtattgaacgtccggcggcattttgtagcgctacaatttttacgctgaccttgagcgtagccatgtctatttgtcctgtcaatcatccgccgggatattctcaacccagagatgaaaggctttttgatgacgcatgatcgccccaaaacccggcgccccaccatctatgacgtcgcaaagcaggcgggagtctcgccgtcgctggtttcgctggtgctgcagaatcccgtgcgggtaagcgagaagcggcgcgacgctgtgcaggcggcaatcacggaacttggctaccgccccagccaggcagccacggccctagccagcagccggacgaagagcataggcctcgtgatcgacgactaccgaaacctgtggttcgtcgatctgctgcggggcatggagtctgtgctgacggaggaaggctaccgggtgatgctggctgactcccggcccggcgagaaccggatcagtgaagccgttgacggcctgcttgcaatgcatgttgacggtttggtgattgcggctgaacccagtgcgtcaatgctcaccgccgctggtgtgcccacggtggtggcagggtggcggaacggcgtgcctgccggggcggacttgatcaccaatgacgacgacggcggcggtgccatggctgcccaccacctgctgggtctcggccacaccaggattgggcacctgtcgggattcggcggtgccgccgcccaccgccgggccggttttgccggccgccttcgggacgcaggcgccgacatgcgtgtcgttggggaggcggggggtacgtcggaggaggacgggtacgcgtcggcctgctggctgctggaccaccacccggacacaacggctattttcgctgccaatgacaccatggcgctgggtgcttttggagccatcaaggcgcggggcttggcggtcccgtcccaaatttccgtgatcggatatgacaactcaaccctcgccaagtcccgctatctggagttgacctcggtggacaaccgaagtgaccttgtgggtaaggaagcggctaaggtgctgctggcccggatagaaagcggtgccccaagctcagggcggacccttattgcgccgacactggtagtccgcggaaccactgctccgttacccggctgagggtgcaggaggccgggcgtccggctttggtctaaacatcctaatgtcaggacaaactcttgacattcgtgaattagatcaccatcatcgaggtaggcagtgccccggaggctgcaaagtggcagcccgggacctgagatcaaaggagattatggtggctaatttttcttggcgtaaagcggctctggtgacggcagtagttccaatgctggcgttgagcgcatgttcaagcggtggtggacggacccccgagactggaacagggggcggtggtggccaggttgccaccaccgagcggatgaagatagcactgattgcgcacgcccccgctggtgacaccttctgggataccgtccgtaagggcgcagaagaagctgcagcaaaagacaatgtcgaactgctctacacgtcagatcctgaggccggccggcaggcgcagctgatcgagcaggcggtggaccagaaagtggacgggatcgcggtaacgctggccactcccgacgcgctgaagagtgcgctaaaaaaggcctctgatgcaggaatcccgatcgtcagcttcaatgctggcgaagcggcttctgcccagctcggggcgttcacccacttcggctcgaatgagaagctcgccggtgaagcagtgggttccaaactcgccgagggcggctacaagcacccggtctgcgtcatccaggcgcaggggcacgtggggctcgaggcccggtgcgccggtgtgaaggccaaagtgcccggtaccgaaattttgtacgtcaacggtgcagacatgacgtctgtcgaatcgacggcgaccgcaaagctccaggcttccgcggatgctgacgtcatcatcggcctcggcgcacccatcacgctgacgctcatgaagtcagtgtctacggccggaagctcggccaaggttgccagcttcgacctgaacaaggaactcgcacagaaggttgctgatggcagcgtactgttcaccgtggaccagcagccttggctgcagggctacggcgcagtggatgcgctgtggcagaacaagcggggcggcttcaagctcggtggcggacagtcagtcctcaccggtccggcaatcgtcgaccagtccaatgcaaccgaagtcctgaagttcgccgaacagggaatccgctaacagcccgcttgccgggccggccagcgccggcccggcagcaaggagaaacatcatgaccatcacccagaccaagatcgcatcaccggcggccgatgagcgcgtcgccaagcgcaatcccttgcagaagctcctcggccggcctgaggtcggtgccctggtgggcgcaatcgtccttttcgtcttcttcgcgttggtgtccccgactttcacccagcccaatgcgctggcgaccattctctacggcagctccacaatcggaatcatggccgtaggggtgtccctgctgatgatcggcggtgagttcgatctttccactggtgtcgccgtgatttcatcggcgctgacggcatcgatgttcagctggtacttcagcacgaatgtctgggtgggggtcctcctggctttgctggtgtccctcgggatcggcttcatcaacggctggatcctgatgaagaccaagctgcccagctttatcgtcaccctcgcaaccttcctgatgctgaccggcctgaacctgggcctcacgcgtctgatcggtggctccgtctcatcgccgtcaatctccaacatggatggcttcgatacggcccgcggggtcttcgcctccgcggtgaacatcgccggcatcgaagtaaaaatcacagtcttcatctggatcgcactcgtcgccgtagccacctgggtgctgatgcggacccgggttgggaactggatcttcgccgtgggcggggacgagaacgcggcccgcgcagtcggcgtgccggtcaaggccaccaagatcgggctgtttatgggcgtgggattctgtggctgggtcctcggcatgcacaacctcttcgccttcgataccgtgcagtccggtgaaggcgtgggcaacgagttcctttacatcatcgccgcggtgatcggcgggtgcctgctgaccggcggctacggttctgcgatcggcggcgcgattggggccttcatcttcggcatggccaacaagggcatcgtctatgcgcagtggaaccctgactggttcaagttcttcctgggcctgatgctgctcctggccaccatcgttaacctcatcgtcaagcgccgcgcagaactgaagtaaggggcaggagaatgaacgcacatgaaatagaccagcaaacgctgctccagaacgaacgggaccccctcacccacacccctgtccacctgctctccctcgagggcgtgggcaagcattacggcaacatcatcgccctgagcgacgtcaccatggccgtggacaacggccgggtcacctgcgtccttggcgacaatggtgcaggcaagtcaactttgatcaagatcatcgcaggcctgcaccagcatgacgcaggggtgttaaacatcatgggcgaggaacggaagttctcttccccccgtgatgctttggatgcaggcattgccaccgtgtaccaggacctcgcggtggtgcccctgatgcccatttggcgtaacttcttcctcggctcggaactaaccagcggtttcggcccgttcaagagcatggacgtcgagaagatgaaggccatcacactcaaggaactggccgaaatgggcatcgacctccgcgatgtggaacagcccatcggccagctctccggcggtgaacgccagtgtgtggcgatcgcccgggctgtctacttcggcgcgaaggtgctgatcctggacgagccgacggcggcgctcggcgtgaagcagtcaggcgtggtcctgcggtacatcctccaagccagggatcggggactcggggtcatcttcatcacccacaacccgcaccatgccttccccgtgggggaccggttcctgctgctcaaacgcggcaagtccatcggctactacgacaaaaaagacatcaccctggacgagctcaccgcccagatggccggtggcgcggaacttgccgaactcgcgcacgaactcgaacagctcggcggccatagcgacgtggtcaaggcggtgcaggcagaggtcgccgacgtcacgcacagcacggagacgccaaaggaaaccggcccccggcacgcctagttcagacagcgcggggcccgccggaaagccggacgggccccgtccggcatggcgaacaggaagcaaacagcaggcgggaggtcatcatgccgatcggggtgggcgttatcggcgccggagtcatggatgcagaccacatcaaaaacctgtcagccacagtccacggcggctatcagggcaccgtgggcatggaggcgtgggcgaaggatgacagtaacgcagccctcgacgccttccggactgccttaaccgtctatgcagaggaaaaagcatgaaaaacgtaacgcttggactggtcggagtgggccggatcggcgtaatgcacgccaacaacatcgctgccctcaacggggtattgaatccggaggggatcaacgtgagtctccggctgacggacgtggctgaagagcatgcccgtagagtagctgcgggcttggaggcggagtatctcccctcggttgatgcactgctggcctcgggagcggacggcctggtggtggccaccggcaccgccacccatcccgaactgatcaaggcgggagtggacgccggcatcccggtcttctgcgagaaacccgtggctttgaacgtcgcggacgccctgccggtgctggactacatccgggacaaaaacggcgttgtgcaggttggccaccagcgccggttcgatgccggctacctggaagccaggagggcttaccgggccggcgagctggggtggatccactccctgcgcgcggtgacctgcgacatgaccccgccgcccgtagagttccttgcaacctccggcggactcttccgcgactgctcggtccacgactttgacatcctgcgctggctgaccggccgcgaaatcgtcgaggtctacgctaagggctcgaacaacggcgacccggccatcggcgaagtcggggatgttgacaccgcgctggccctggtgacgttcgacgacggcacggtgggaacgctgtcagccacccgctacaacggggccggccatgatgtccggctggaaatccaggggtccagccgttcgctcatggtggggctggacgataagacggcgatggtgtcagccgaacccggcgtcgctttcccttcgggagagccgcacaggacgtttgccgagcgcttcaaccaggcctaccgttccgaaatggccgctttcgttgagcttgtcctgggccagcgggacaacccgtgtacccccgaggatgctgtggccgcctcccgggtggccgatgccgcccaggagtccctggccagcggccttccggtgcgggtggcaggagccgtggccagccacctgtcctgagcggcaccgaacccgttcaggacaccgcgtgcagcttggggagcgcgtcaaccaggggggccagctcagggatgccctgcgctgctcccagcgcacgctcaagggtggcgtcgtgcaccggcctcgcttcctcaaggaggctgaggccggcgggcgtcagttccgtgtaaattcccctgcggtcgtcatcgcacaggatgcgcgtcagcaggcccctgccctccagccggttgaccagccgggtggtggcgctggggctcaaagcagaagcacgggcaagttgctgcatccgcatatgccagccgtcctgcctgcttagcgcgtccaggactgtgtactccaccacggacagctttgactcaccctggagggcgcgctccagctcgtcctcaatcagcccgtgaagggccgccaaagtccgccatccttgcgcccggacctcgacggcgtcgtccttaatgcccatggtggtgctcctcatgcatatagttgcttgcgcgggataattgcgcgtgcaacgataaataccgcgcctgcaactagtttatggcgtcatcctgcgcccagcaacatgcgcgttcccacacaacacggaggagtgccggcatgcccgtcggtttgatagccctggccctcggagggtttggaattggtcttacagagttcgtcattatggggctgctgcctgaagtggcagcggattttggtgtcaccgaagcagaagccggctggctgatctccggatatgcactggcggtggtggtcggcgccctcggtctcaccgccgccgtcacccgcttcccgcggaagcctgtgctggcggcgctgcttgtcctgttcatcgtgggaaacttgttgtccgccaccgcacctgactactggcccatgatggccggccgggtcattgcagctttggcccacggtgccttcttcggcatcggcgcggtggtcgccgcgggcatggtttccccttcaaagaaggccggtgccattgcgctgatgttcaccgggctgacggcggccaacgtcctgggggtgccgttcggcactctcctggggcaggctgcgggatggcgcgcgacgttctgggcgatcaccgtcattggtgtcgtggcactcgcggggatcctggcgctcgtccccagggcagccggagcgcccggggaaacaggagggctgcgcggcgagctgcgggccttccgctcccggcaggtatggttctcgattgtggtgaccatcctcggtttcggcggcatgttcggtgccttcacgtacatcgcctacacactgaccgaggtatccggcttcgctgccggcacggtgccctggctcctgatcctgtttggcctgggactcttcgcgggcaacacgctcggcggaaaggccgctgaccggaaccttgaccgcaccctgcttgtggtccttgccgtcctgtccgttgtcctggtcgccttcgcgctgaccgccgccagccaggtcctggccattgcgtcattggtgctcatgggtggctttggctttgccaccgtccccgggctgcagatgcgcgtcatgaagtatgccagcagtgcacccaccctggcatccggcgccaacatcggggcgttcaatgtgggcaacgccctgggcgcgtggctcggcggtgtcaccattaccgccggactcggctacacctcacccatatgggccggtgccggcatcactctggtgggggtggccgtcatggccttcgcggcggccgccgccaagcggagcagcgtcgggcggcgaccggaggctgaagtgccagcggaccgcaaggacgccctgcaggtgtgagttttgtccaggtatgcagggctggaggcccctgaagtctgcatacctggacaagaactccagccggatcgcaggatatgcggcgcttaggcgccgaacggaagccgcggatcgacgtcctggccgtcccaggtctggcgcacccagccatggtgggggtcgtcgctgatgagccattcacgcacgggccccgggcccgccatgacgttcaggtagtagaggtcgtacccgggtgcggccatggcaggaccgtgccagccgtacggaaccaggacaacgtcgccggtgcggacctccgccgagacgtcgatggggcgctcgtccgaggcgtagacgcgctggtagccgattgcgtccgcatcggcgggagcggctgagccctccgccacccgcgtctcgaaatagtagatctcctcgaggtgggtctcgccgtccttctcctcgtcgtgcttgtgcgggggataggaggaccagttgccggcgggggtgaggacctcgcagacgatgaaccggtcggcctccagcgcggccggcgtgccgaagttgtggacctggcgtgagcagttgcccgcgccgcgcagctcaaccggggtttcggcggcggtcaccagccgggtggggtacgcatcctgtgccggggcagtggcaaccgccaccctcccgccgtcggccgatgcgatgctgacggcgcgtccggtgcccgagtacagaacgtcgctggggccgtggaacacggatgcgcgcccctccagttggtattcggtgccatcgaccgtgacggtgaaggatccgttaaggggcaccacaatgcgttcctcatcggcggcaggaaggacgacgtcggctcctgcggcgagcgtggccaccttcagtcctgtatgtgcccagccgtccacggacagggatgagtccgaggtcccgatcgagacgtcccatgtgccgtcggtggcggtgcccagtgggtagacccagttggtcatggagtgtggctccttgtgctagcgctgtacgagtgtcatttcaaaactgtaggaatccccgcggtacacgtggtgcccggtttccacgcggcggccggtgtcatccgtggcggtacgctccatggtgaccagcgcggatccgggcgcggtctcgaggagggtggcctggtagtcgttggccaccacggcgccgatccgctggttggcgaggcggaagttcacgccgccgcgtcgcaggatggcgtagaggccctcagcggacagcgcggcttcatccatctcggcaatgtcatcccggacccagttctccatgagcgccagcggcttgccccccactttgcgcaggcgggtgaagtggtagaccttggagccggccggcagctggagggttgccagcgtggcgtcgtcggcctccacatgggcgaagctcaggacgtcggtggtgggcttcttgccgttgttggtgaggtcgtcataaaggctggagagttcaagcggacggcgcacctggcttgagaccacctgcgttccgacgccgcgtttgcgcaccagcagcccggaccggaccagttcgtccatggccttgcgcatcgtggggcgggaaaggttcagctgggccgcgaggtcgatttcgttatcaagccggctgccgggctccaggactccgctgaagatggcggcttcgattccctgcaccacctggtggtagagcgggacgggggaggagcggtcgatgctgagacccaggttgtgcgccacggtagttccctcatgttccttgttgcgggacgtctccgcccgggtggggcgcgaacggccgccttgccgctatatgttcgcttgataggacatactttttacttcttcgatcctagcagccgtgccatcccggtcaaggggagcgccgggaaccagcgcagcggcgtccggcattgcaataggtttggacagtgaacctttccggaaacgtgggcccccacccgcacaacctcgaagtgcaggacctaaacagcttcgaccggctggtcagcgccggcgcggtggacatgcatggctggcacgcgcagtcccttgaccttcgggggaggaccgacgccttgcagcgcctgcacgtggagggcgcgatcttcctgggctgcacgttcgatgacggggtggaggacctgctgcggcgacggggagcgctgatcttcccgcggctggagaccgtgcccttcaacccctaccgggccgccttgtactcgccccaggaactgtacgccgggctgcccgacgcaccgtacgaagcccttccggacgcccggatctaccagtggagcatccagtccggcatgcggcaccggctggacgccaccctggcttcagcgctgcacgaccacgccatcggcgatgccctggacgaagtgacccggacgggcccgttccacggccgggccatggtgggtgtcatgggcgggcacgccgcgcagcgcggcagcagcgggtttgcgcaggctgccctgctggggaggctcctcgcccgggacggtcacgtggtggccaccggcgggggaccgggggccatggaggcggccaacctcggcgcgtacctcagtgaagtggacgacgacggcgtgcaggctgcgctggacatcctcgcttcaatccccggcttccgtccctcggtgtccgcgtgggcgcgggcggcggcgtccgtcgtcgaacgctttcccggcgggacgccgtcgctcgggatccccacctggttctacgggcacgagccgcccaactacttcgccacgcacatcgcaaaatactttgccaacgccatccgtgaagcgatcctgctggaactgtgcacgggtggcatcgtgttcctgcccggggctgccgggaccgtccaggagatcttccaggatgcgtgcgaaaactactacggggcgcgggagaaggtgactcccatggtgctggtgggccgggaccactgggagcgccagtacccggcctggcccatgctgcaaagcctggcggccggccggcctatggaggaccggattttcctggtggacactgtccaggaggcggtggaggtgctgcggctgtccccctaagccgtggagcagccgggcggtcagagatccttccggcactgtgccttgctgagctcgtagagcccgttgaggtccccggcggacagtccctcaggggtgccgatctcgggatacatcagctgggtggggtcgtccacatggtcgaggcccatcacgtggctgagctcatgcaggatcaccgcgcgggcgtacaggtggccgtcggggttcagcagttcatcggcgatctgcggcgcgtccaggtccaggccgccggtgacgaaggccttggggccgtcgtcgtaactgaaatgggtgctgcccccggtgccgatcaccttgcccttgagctgcggagccacctccggtgttgtccaggcgatgagcagcggcgcccagcgctcgccgtaggcctcgggctggtacggcggacgttggggggagggctgctccgcggtggtgccgtcgtagatgaaccggatgccggtggcggcggagatggtggcgatggattcggtgaccagctgctgcgagccggccggtgcaagatcgtcattgatgacatagtgcagtggcctgcagggggaataccctaccgggctgccgtccccgttgacggcgaggaagcggtaggaatcgctgcccagcggcggagggtttgcggcggccaggggagcgtccgactcctccatgcccgggggaggcgcacccagccggccttcggcccggggcgcctggcccgcttcccctgctgtgcccggatcctgctgcccggcggactgcccgtttcccgggccgatccgcacatccagcagctctttgaagcgcgggtcattcagtgccagtgctgctccgaacacagcgcccgcggtcagcgcggcggtgagcaaaagctccacgccccggcgcacgcccaggcgggctttggtccccgcatggcgcgacggcgcgcggcgcggcggccggtcttccactagcccacaactgtgccgaaggccagccccagcaggtaggtgatggccgcagcgcccaggccgatggccagctggcggagtccacgcgtcagcggtgacgtgccggagagcaggcccaccgtggcgccggtgaccaggagggcgaggcccaccagaatgcccgccgctaccagggcagcggcgccggtcaggccaaacaggaacggcaggataggcacgatcgcaccggaggcgaagaagcagaagctggacagggcagcaccccacgcggtccccacggcttcatgctggtcctcgacgtcgggcaggtccggctgcagcgacaggctgggatcgcagtcgcagggcagcagccccatccgttcggccacccggtgctcggctgcctcctgggtcatgccccgggccagatacaccagcagcagttcattgtgttcgaggtccagcttgggggccgccagcaaggtcacctgggtggggcgcgttgccgcgagcagttcacgctgggacctgactgagataaactcgccggcgcccatggacatggccccggccagcagccccgcgatgccgctgagcagcaccacactgctggcgacgccggacgcggccatgcccatcaccagggacaggttgctgaccaggccgtcattggcgccgaacacggcggcacggaacgttcccgccaggcggttgcgtccccgggttgccagtccgcggaccacttcctcgtggatctgctcgtccgccgccatcgcatccgtggcgttggggtccttggcataaggggagcggccttctgcgcgctgggccagggccagcacaaacaccgacccgaagtggcgggccaggaaccccagcatccggctgcgcagcgatgcacgccggggcttgccggcacgctcacccagcagtcccagccagtgtgcttcgtggcggccctcggcttcggccagagccaggaggatgtcacgctcttcgccttggcggttctgcgccaggtcccggtagacggcggcttccgcccgttcgtccgcgaggtactgccgccaccgcttgacgtccgacggcgagggctgggcctgctgccgggcgccggctggttcctggggtgctgcaggttgcgacgcttgcggcatggcgtggcggttgaacttggcgtgctgagacacggaaactcctgggctggatgaggcatggtgcggccccattgcagtgcaagcttactgcgaaaatccgcggatttttggccggtcagcctccctcggatatttcggtgcgccttaacccgggcgggatctttaggtcccgcggcgcgctattgacccctctgcggtgcggtgctgtgatgaaggtgtggcgcggccagcgccctcactgaaagagcacgtcaggcgaacaaacggaggttcaacatgagcaccaccggacagcacccggacatgccgcacctggatgccgtagaggcggatcccgcctatgactacgccgaggatgcaccggtagttgaggacgactgggacaccgaggacgaactcctggacgaggaggagccggtggtccaggtgcctcccgtcgtggtcgacgccgaggaccgcgtggtcccgctggatgaccctgacgaggtccgcgaaaccggctaggagaccacgacacaacgacggcggcacctcaccttcgctggaaagcgaaggggaggtgccgccgtcgtgccctgctcgtgctgttctaccctgccggggcctagcgggcagcggagggaaggggcgattcttccgcggcctgcccggccacgcggcgctgccagttgcgcataacctgcgggtcggttggtttggtcagcagggaaaccgcgacgtagaccagggcggaggccagcaggccgtagtagatgggctcgttggcgtagatgccttccagcggtgcctcggcgttgatttccaggatgatcatggtgcccagcgtcaccacggaacccacagccatggatgctgccgcggcgatgcccgtaccgcgcttccagaccagtccgccgaggatcgccacgaggaggccgcccaccaggatgtcgtaggcaatggtcagggctgccacgacgtccttggtgatgatggcgatgacgatcgcgatgattcccagggcaaggacccagatgcggttggccttgacgtcgtgctcagggttgtccgagtcctccgtgttgacgtccttgccgaaccagctggcaacgaacggcaggacgtcggcccgggccacggttgcggcggcgatgagggcgcccgacgcggtggacatcatcgctgccaccgctgctgccaggaccagcccgccgatgccgacgggcagcagggtctgggctacctcggcgtagacgtcgtccttgactgcgatgtcaatgccggagagggccacgctggcggccatgccgatcagggcgccggcaactccgtaaaggatgcagtagatgcctgcggtggcgccgccccagcgtgccacggtgggcgttttcgccgtgaagatgcgctgccagatgtcctggccgatcagcaggcccagggtgtagacgacgaagtaggtgatgatcgtctggacgccgatgccgtcaatctggaagaaactctcgtccacacggctgcggatgccctcaaagccgcccgctgcgttgagcgtgaagggcagcatcaggaagaagatgcccacggtcttgatgatgaactgcacctggtcggccagggtaatggaccacatgccgcccactgtggagtagaccagcacgatggctccgccaacggcgatcgcgatcgcccgctcccagtcgaagagcaccacgaagatggtggcgtaggcgccggtggacgtggcgcacagcatcagcgtgtaggcgagcatcacaatcccggaggcctccgtggccctgctgccgtagcgcagggtgagcatctgggagaccgtgtagatcttcagcttttggatggtcccggcaaagaggaggctcagcagcaggacgccggctccgatggccaccaccagccacatgccggagatgccgaacttgtagccgaggcccacgccgcccacggtggaggcgccgcccaggacgacggcggccatggttccggtatagaggaaggggccgaggcggcggccggcaaccaggaagtcgctgttgttcttggtacgggacttgccccaccagccgaaggccagcatcgcgagcaggtacaccaccacgatggcgatgttgatgaaacttgcatccatgttgggctccttggagcgtgttggcagcgtggcgcacgccggaaataaggtggaccgggcgccgctgcaggatttgggggagtgaggggggattctcagctattgctctataggcaacaagtgtttccaaagcgtaggctgtgacggtgataacagtcaagacaacgccgggccccgggccacgcgtgcaatgaggcgtcacagaaggggccggccactagtattgctccaaagtggagccgggctgccggccatgaaaggttcgtagatgaaggcactgccagttgagccgagcaacgttccagtggccatcggctcgaggatccgggccgcccggcagtcgcagcggttgactattgagcaggttgctgacgcgacggggctgaccaagggattcctcagcagggtggagcgcgaccttacgtccccgtccgtggcctccctggtcacgctgtgccaggtcctctcggtctccgtcggcgacctgtttgcggcgcccgagacgcacctgaccaagcgcaatgacgggccgcggatctcgctgggcggccagggcatcgtggagcggctcctcacggcgcgttcagaacgtcgcgtccagatcatccaggcctgcatcgagccgcacggccgtggcgaatccgagctctacgctgtggactgcgacgttgacgtcctccatgtgatcaagggcaacatccggctgatcctcaccaacgaggaatacgacctcagtgccggggacaccgtcaccttccccggccgtgagccgcacacctggatcaaccccaccgacaagcccgttgaggttctgtgggtcctggtgccggccgccagccggtaactcccgccaaagtaggtagcggtaagtgtcgttatgagcgctcataacgacacttagtgctacccagttgcggccagctgctggcttagtaaacatatgatgctcattgggcaacaagctgtatgatggcaatcacaacagtccctcaactcctcgaaggagaggcctccattggaagagctgcgcatcgaagccaacggcaaccttggccccatcgattcatcccggattccccgttacgcgggagctgccacctatgcccgccttccccgcctggaccaggtggccaaggccgatgtcacggtggtgggcgtgcccttcgattccggcgtctcctaccgcccgggtgcccgcttcggcgccaaccacgtccgtgaagcaagccggctgctgcgcccgtacaacccggcatgggacgtcagccccttcgagaacatccaggtagccgacgccggggacatggccgtcaacccgttcaacatcaacgaggccatcgaaaccatccagcagaacgccctggacctcacggcgggcggcggcaaactggtgaccctgggcggtgaccacaccatcgctttgccgctcctccgcgccgctgccgagcgtgccggcgggcccatcgccatgctgcactttgatgcgcacctggatacctgggacacctacttcggggccgagtacacgcacggcaccccgttccgccgggccgtcgaggaaggcatcctggacacggaagccatcagccacatcggcacccgcggccccctctacggcaaaaaggacctcgacgacgaccatcgcttcgggttcggcatcgtcacctctgccgacgtctactaccagggcgtcctggaaaccgtggccaaggtccgtgaccggatcggcaaccgcccgctgtacatctccgttgacatcgacgtcctggaccccgcccacgccccgggcaccggcacccccgaagcgggcggcatcaccagccgcgagctgctggaaatcatccgcggcttccgtggcatgaacctcgtgggagcggacatcgtggaggtggcccccgcctacgaccacgccgagattaccggcgtggccgccagccatgtcgcctacgaactggtcaccctgatggccgacaacgccgtgccaggcgaccgcttcggaacggccaacggttacgccgcccaggccctcggccaggaatcccgccgcccggcaggcttcgccccggcaggcaaggagtagccggatgggcgacgtcactgcgggcgcggctgccgcacccgctgcaaagaatccgggcccgggagtgcgcaacggcggggacctcgtcgtcgaaacccttgaggcactgggcgccaaaaccgtctttggcatcccgggccagcacgccctgggcctcttcgatgcgatgggccgcggcaacctgcagttcgtctcctcccgggtggaaaacaacagcgcgttcgccgcagatggctactcacgggcaacgggcgaggtgggtgtcctgttcctgtccaccgggcccggcgcgctgacatccctggccgggctgcaggaagcttacgccacgggggttcctatggttgtggtggccagccagatcccgctcgagggcctgggggccaggcgcaagggcatgctgcaccagctcgatgaccagaaggcgtcggcggccaacgtcaccaagagccagcggctgatccagcacgcgtccggcatcccgtctgcaatccaggacgcctggaccgaggcgatctcctcgccccagggtcccgtttggctggagatcccgcagaacgtcctgctcgatcccatcatggtgcccccggtggaggatgcgctcgccgaggcggcggacaatccgccccgggtggagctggtccgggaagcggtgaaatggctgcagtccgcggaacgtccggccatcatcgccggcggcggcacgcggcggggccgggccgaaaagtccctgctttcgattgccgagaagcttcgtgcacccgtgatctgcacgccgggcggaaacggtgccttcccctggaaccacgagctcgcgctgcagtcctggatcgaggaccgctacatgaccgacctgctggaagacgcggacgtcctggtggtgatcggatcgtccctgggcgaggtcacctccaactacttcacgttcgagccccgcggccggatcatccagatcgacgccgaaccgagggtcctggagtccaaccgccccgggctggggatccgggcagacgcaggccaggcgctcgccgcccttgatgaagccctggacgccggggctggccggacagcgccaacctggcacggaaaaccgcccgaggaactggtcaaggaatccctggcgaaggtccgcgcacgcctggagtcgcaggacctgtccaaggaactgacgttcatggcggacatccgcgaggcggtgccggcggacatgcagaccttctgggacatgaccatcgcggcatactggggctggagctgctgggacgcccgcgagggccagttccattcggcccagggcgccggcgggctgggcttcggcttccctgcagccatcggcgcggccgtgggactcgaaaccgttggcaggcccgctggctctgcccgggtactcgcagtgtccggcgacggatcctcgatgtactccatctctgaacttgccaccgcgaggcagcacaacgttccggttacctggctgattgtggacgacggcggctacggcatcctgcgcgaatacatggtgggcgccttcggcaaagccacggccaccgaactggcccggccggacttcgtcaaacttgccgaggctttcggtgtgcctgccgtcaaggtggcgccggagggcgtgggggacgcgctgaaggcaggcttcgctgctgacgggccgaacgtcgtcgtggtggaaaccctgttgaagatgtttgcaccaacgcacctgacggaatgaccagccccggctcccgaaactttgacggcgaaaggccccagctcgcattgagctggggcctttcgcgtgcatcaccgcaagcggttagtttcccaaagcaacaactttgggatatggttgcttcaggcaagcaagtgaggggcatttcgaccatggcagtagcgccggatacggcagcggatcttgtttaccagatcttcgacctccagcgggcggtgcggtgcatcgccaccgccagcgtgcgcgggcaggacaccggggtggcgctccagggcgtgctgcgcttcgtaggtgagggggaggcccgggccacgcgcctcgccgagcggctgggagtcagcgcgccggtgctcagccggcacatcgctgaccttgaggagcatgggctggtggtccgcaggcaggaccctgacgacggccgggcacagctggttgccctgacgcccttgggggcggaaaaactccgccacatcgaggaccagcggacggcggtcctgcaggactacctgcgcgactggagcgaggaagacgccggcaatacggccagaatcctgcacaagctcaccgaatcactcaagcaatcagcccgggcaacggcggccggcaccatcactaccaccgcttaggagcagacctatggcaagaactgccgcccccgccgcatcagccggcgcccccgcaggcacgccgcccgagatgtcccaccgccagatcatggaagccctcaccggcctcctcgctgccttcttcacggcgatcctcagcagcaccatcgtggccaacgcgttgcccaccatcatgtccgacctgcacggcacccagaccgacttcgcctgggtcatcaccgccgcgctgctggccaacgccgccaccacccccatctggggaaaactggccgacctctttaacaagaaggtcctggtccagctcagcatcatcatcttcgttgccggctccgtcatggccggactgtccgaaaccatcccgctgctgctgggtgcccgcgtgatccagggcgtggccatgggtggactcacggcactatcccaggccatcatcggcaccatgatcccgccgcggaaccgcgggaaatactccggctacatgggcgcggtcatggcagtcggcaccgccggcggaccgctgctgggcggcttcatcgtggacagcccgctcggctggcgctggaccttcttcgtctgcgtgccgctcgccgtcgtcgccctcatcctgctgcaggtcaccctcaaaatcagccacatccggcggcccgccaagatcgactggctgggctcaatcctgctgacctccggcgtgagcctcctgctgatctgggtctccttcgccggcaaccccgcctactacgactggatttcctggcagtcggccgccatggtgggcggcggcatcctcctgctggccctgctggtgctggtggaatccaaggtggagcagcccatcatcccgctcaagatcatctccgaacgcaccacggcgctggccatcctcgcctcggtggccgtaggcgtggcaatgttcgggtcctccaccttcctgggccagtacttccaggtggcacgcggcgccagccccacggaagccgggctcctgaccctgccgatgatcgccggaaaccttgtcggttcagtggcctccggacagttgatcagccggacgggcaagtggaagggctacctgatcgccggttccatcctgctgatcggcgggctgggactgtccggaaccctggaccacaccaccgagctctggcatgcaggggtctttaccgccgtgctgggacttggcctgggcatgctgatgcagaacctcgtgctggccgtgcagaacacggtccgggcttcagacatcggcacggcgagtgcttcggttgcattcttccggtccgtgggcggcgctatcggcgtctccgtcctgggcgccatcctggccaaccgggtcagcgagctggccacccaaggactggcaaccgcaggcatacctgtcgagggaggcgcggccggtgccagcatggacctggcgcacatgccggcaccagtccgcgacatcatgcgggccgcctacggtgacgccacagcggaggtgttcctaatctccgccgtcgtggccgtcgtggcgctggtgtccgtgctgttcatcaaggagaaacccctccgccgcacggtggacatccagccgggtgccgaggaaaagagcacgacggcggagctcgccccggcaggcaggtgaccctgaggggtaatccccgcggatgatctttcccggagcctgtttcaccgcggggaggagtttcgtagagtgggaaggctgaggatgtcggccccggctgctactacttaagcctcctaacactgtgcgaccccatcatcgaactcatctctaaggacccgtgggcatgctcctcaccctcatacggcggttttccaggccgtataggccgttcatcacggccgtcattgtgttccagctggcgtccaccatcgcggcgctgtacctgcccagcctgaacgcccagatcatcgaccagggggtgtcccgcggggataccgacttcatctggcggacgggcgcggtgatgctggccgtggcgttcatccaggtgggcaccgccattgcaggtgtctacttcggctcgaagactgccatggccatgggccgcgacctgcgccgcggagtgttccgcaaggtcaccagcttctcggccatggacgtaaatgcctttggtgccccgacgctcatcacccgcggcaccaacgacgtccagcaggtccagatgcttgtgctgatggggctgaacttcatggtggcaacgcccatcatgtgcattggcggcatcatcatggccctgcgcgaggacctcaacctgtcctggctggtgtgggtttccgtgcccctcctgaccgtggtggtggggtacctggtggtccggcttatgccgctgttccggtccatgcaaacaaagatcgaccgcatcaatgccgtactgcgcgagcagatcatcggcatccgggtggtccgcgccttcgtccgggaaccctatgaaaccgagcgttttggcggagcgaacaaggaactaacggatgtctcgctaaagatcggcgccctgtttgtcctgatgttccctgccatcggcatgatcctccacctgtccacggcggccgtcctgtggtttggcgggcagcgcgtggactccggcgagatgcaggtgggggccctgaccgccttcctgcagtacctgctgcagatcctcatggcggtcatgatgggcaccttcatggccatgatgatcccccgcgcgtcagtctgcgcggaccgtattggcgagctgctcgacgtcgagccctccatccacgatccggaacgcccggaggtgccgggcacgctggccggcgtggtggagtaccggaacgtcaccttcgcctatcccggtgccgaatctccggtgctgagcaacatcagcttcacggcgcagcccggccagaccatcgcgatcatcggctccaccggctcgggaaaaacctccctcctgtccctcctgccccggctctacgaccccgcggagggggaagtgctgctggacggggtcccggtcagcaggatggaccgggccgacatcacccggcgggtggccatggtgccgcagcggccatatctcttctccggaaccatcgagcacaacctgaggttcggaaaaaccgaggccactgaccaggaactgtgggaagcgctgcaggtggcgcagggcgacgagtttgtccgcgccaagaagaacggcctcggatcccgcatctcccagggcggaaccaacgtctccggcggccagcgccagcgcctttgcatcgccagggcactcgtaagcaggccccgcgtgtacctcttcgacgattcgttctccgcactggacgtggccaccgatgcccggctccgggccgcgctgaaaggcatcaccgcagacgccaccgtgatcatcgtggcgcagcggatctccaccatcaccgaggcggaccaaatcctggtgctggacaacggacgcatcgtcgaccgcggcacgcaccaggaactcctggaaacctcgcccacctaccaggaaatcgttgaatcccagctgagcgtggaggaaatggcatgagcgcccgcaggaaggactccaccgagattagcgaagcagcagctgcccaggaggcacccgacgcggagctggtggacaaacacgtcgaggacgacgacttcgtggaggaagagttcaagccctccgaagccgacggcgacatgttcggcgggatgcccgccaagaaggcgcagcacttctggccctccgccaagcggctgatggggctgctgaagcctgaggccctgggaatctacgtggtggtgggcatggtggtgatcgccgtggtcctgaacgtcatcgcccccaagatcctgggccaggccatggacgtcatctttgccggagtggtgggaaagcagcttccggccggcgccagcaaggaacagttcgtggacggtctgcgccagcagggccaggacaacttcgcggacatggtctcccggatggaactggtgcccggcaccggcatcaacttcgacaagctcagcatgctcatcgcggtggtcctgctgatgtacttcgtggccaacatcttcctctggctgcagggctacgtgctgaaccgcattgtgatgaaggtgatccggcggctccgcgatgacaccgaacggaagctgaaccgcctcccgctcaactacttcgacacccgccagcgcggcgacgtgctgtcccgggtaacgaacgacgtcgacaacatccagcaggcgctccagcaggccttcgcccagctcatcaactccttgctgaccgtcatcggcatcgtggtgatgatgttcatcgtgtcctggcagctggccctgatagcgctggttgcccttcccctctccggggtggcagcggggatgatcggtgtgcgcagccagaagctctttgccgcccagtggaagaatacgggggcgctgaacgggcagatcgaggagtccttctcggggcatgacctggtgagggtgttcggccgcgacgcggacatgctggaacggttcgaggagcgcaacgaggaactgtacaaggccagcttcggggcgcagttcgtctccggcatcatcttcccggtcatgcagttcgtctcctacctcagctacgtgggcatcgccgtggtgggcggattgcgggtggcttccgggtccatgtccctgggcgacgccaccgcgttcatccagtactcccgcgagttcacgcagccgctgggccagatggccggcatggcaaacatgctgcagtccggcgtggcctccgctgaacgggtcttcgagttcctcgacgccgacgagcaggacgaggaaaccgccaccgagcacctcccggccaggactgacgggcacgtcgacttcagcaacgtcaccttcagctacaccgaggacaagaagctgatcgaggacctgtccttcaccgccgaaccgggaaacactgtggccatcgttgggcccaccggcgccggaaagaccaccctggtcaacctggtcatgaggttctacgagctcaacgccggttccatcatgctggacggcgtggacatcacccacctcagccgctccgagctccgctccaaggtgggaatggtgctgcaggatgcctggctgttcggcgggtccatctacgacaacatccgctacggcaacctcgaagccaccgaggagcaggtgatggccgccgccaaggccactttcgtggaccgcttcgtgcgggccctgccggaaggctacaacaccgtcatcgatgaggaaggcaacaacgtcagtgccggcgagaagcagctgatcaccatcgcccgggccttcgtggcgaatccctcgctgctgatcctcgatgaggccaccagctccgttgacacccgcaccgagctgctggtgcagaaggccatggccgcgctccgcacggaccgcaccagcttcgtgattgcccaccggctctcaacgatccgcgacgccgacaccatcctggtgatggaaaacggcaggattgtggaacagggcaaccacaaggtcctcctcgccgcacggggcgcgtactaccgcctgtacatgtcccagttcgccggggcggacgcagaggacgtcccggtggatgattcgacggcggtgcacagttgagcgccggcggccggatcgaggtcctcgtccccatgcgctggggagacatggatgcctacgggcacatcaacaacgtccagattgtccggatgcttgaggaagcccgcatcgcggccttcggcccgccccgcggtgccggcttgcccggagttgagccgcacgtctccctgttcaatgacgtcccggacggcaccatggctttggtggtggaccacaagatccggtacgtcaggaccctcgagtaccggaacgtgccggccgtggtgcaggtgtggatcggcgccgtcaaaggggccagcttcgacatccactacctcatccaggaccccgttaccctggaggactgcgtcaaggcgagcagtcacctggcgttcgtggacgaggccacgggccgcgtgcagcggctgacgcctgaacagaaggaacgcctggcgccgttcacggcttgacgcggaggggcggcaccggcaggccccgttgcgcaggagcggcaagcatcggaaactgaaaacctaaacaaggagcaaacatggcccagaaaaagacctggaaagaaatgtccccgtcagcaaaggccggcaccatcctggtggccatcgcgcaggtgtccctgctggtggcagcgcagcgggacatctcgaagcggcccgcggcactcatcaacggtccaaaggccgcctggcgggcagcatccttcatcaacttcatcggccccgtgggctacttcaccttcggccggaagcgtcccggcaccggcaagtagcagtaccggagccgcggggccaaagaagactagaccggcacccggaacgtgaaggtggtcccttcgcccagggcgctgtccacctcaatggtgccgccgtgcgcctcaacgatcgccttgctgatcggcaggcccagccccacgcccgggatggcagtcctgcggacagtgctggcgcggaagaacttggcgaaaacctctgacgcgtcttccggactcaggcccatgccggtatcgctgacccggcatgccacctgcccgtcctcccgcgcgagcgacaccatcacgctgccgccgtcgggggagtacttgatggcgttggacaccaggttgtccagcacctgcgagatcctgggcccgtccacgtgggcctccagccggtccggggtatcagcttccagcgccactcccgaagctgccgcccgggggatggcagaggagacgctggagcgcaccagctctgccacgtccacggcctcgggcgtcacgatcagctggccgttccggctggacagcaggtccgataccagtgtcaggagccgttcggagttccggcggataatgtcgagcatgtcacgctgggtgtcctccggctcatcaccgagcaggatttccacgtaacccaggatggaggtcagcggcgtccggaattcgtgcgagacgctggagacaaaatcatccttggccgtcagggcgttcaccaggtccgtcacatcactgaagacaatcacggaaccggcaaacgcgccgtcgtcgtccttcatggcccgggccgtggtcacgaaggcgcgctgttcgcttccggagcccagccacacaaggtaatcggtgaaggtttccccgaggacggcgcggcggaccggccgctcctcaacgggaaccagcgtcacgcggtctgccccgaaaaccagcagctgggactcgttcggatccgcgatgcccttgggccgggcgagttcgtggttgatccgctgccttctgttcatcaggacgtcatgcccgtccgcgtcgactgcaaggacccccaggtggacagtgtccaggatggtgttcaggagcgccccctggcgctggctggtgcgcaggttgtcctgcagttggacatccttctcctccagcgcgcgctgctgccgcgtcatgctgagcgtcaatacgctgacggaaaccccgatgccgagcatcatgacaggaaggagcagggaccgcgccaggtcctggggcgtcgggttaccctccagcagcagcgggacccaaatgatggcaagcggggccaggaaggacagccacagggaggtccgcgggtaatatcccgacgcgcacagccagatcaccgggaacactgccagcaggctgatcccagtaaggctttcctgcccgccgccctcccggcccacggctatggacacaaagtccagcagcggaatgatgaggaaactcgtgtacggcagccggtcccacgggaccaggtagcagagggccatgatcaccagctgggacaccaggaaggccacgaacagcgggttgtccatggtgacggggaagaacgcccacaccaagaatgctgtgaggagcgtcgtcacgaacagcggcatctggctcagcgccacccggtctgtcagccggtactcgtggaagggccgccggaaaaacctgagcctgcccgatgaccaggccacggggtggtccatggcgcggaacttgcggggcggggtgtgtgaggccatgccagcaggatatcggcagccagctatacttcagacgttggctgctgagggggcgctatgagtgatgcacgagtgggactggtcatcgaggatgaccacgacatccgggaactggtacgcactgtgctgtcccaggccgggttcgacgtaagcgtggccagcagcggggcagagggtgtcctcgttgccaagaccctcaatccggacgtcatcaccctggacctcggcctgccggacatcgacggttttgaggtgtcccgccagatccgcgaattttcggacgcctacattgtgatgctcacggcccgcaccgaggagctggacaccctgatcgggctggagtccggggctgacgactacctcaccaaaccgttccgccccagggagctccgcgcccgcattgccgcgatgatgcgccgtccgcgttctgtagccgatcctgctgacgccacgcccggagatcccgcagccgacggcggagccgtccaccctgagcgggggaacttcagccacaacgggctggagctgagctacgcgtcccggaccgtggttgttgacggcaaggaaatgaacttgacccgcacggagttcgaactcctgcacgccctcctggaagcgggccggacggtccggaccaagtccgacctggtgcgccgcctgcgggacgaggattacgacgtcggcagctacataagcgaggcagacgaacggtccgtcgaggtccacatgggcaacctgcgcaagaagctgggagactcaccccagaagccgcgctggctccagactgtccgtggcgtgggttaccgcctggctccgggcgagcactgagactgcagacggtgcatggtctgccggctgcactggctgatgggccggaggaaggcggcggccagctgaggcaggactactgccacatctgagtggcgggcttcgccgcggagctcgccctccaggtccatggccaggccggccagccgctcggcgcccaccatctggctggaggttttcaggctgaggaccgcgtccacggaaccttccaggtctcccgtggtcagtgccagccgaaggcgtccaatccggtgcggcaggtactcgatgaagttccccacgaagaccctgcagtacccctcgtcctcctccagctcctccctcaaccggtcgagaaccgactggtccaccaagggccggggggcatcatctgcggcgctcatgacggtcctttcggcgggaacagtcccttcctggaagggggcggttacgtggggcatttgtttcacttcaggttaggggcgttgctttcgcgcgacgggttttggaaacagaattgtgggtttcttgatgagactgcgggtttacccctactccgtggaaccgtggtttttgcgcctggtttcgcacccggtttccgctatcgggagcggctgcagcgggccgagaataaggctgtgctgccggatttgaaccaatccatccttccggccagcactcaagaattgcggcgggaatgcctaaagattgactcaagatgccgtgaaagcggtgaatcctgatgggagcaggcacgcaggagcggcgattcagcggcctgtttccaggaaccgcaccagctcggtttccagcgttgaactgtccttgagttcgcattcccacaccgtgaggacctgccagccggcatcttccagcaggctgcgttgattggcgtcccgatcgcgggtccggctgcgcttggcagcccaaaattcagcgttggctttgggggcgtgcagccccacgcggcagtcatggaagtgccagaagcagccgttgacaaagatcaccttgcggcggccggcgaacaccaggtccgggttgccgggcaggcggatggcgccagctttgccgtgcagccggtaccggtagcccttggcatggaggagcctgcgcaccagcagttccggcttggtgttcttgccccggatccgggacatgttccagctgcgccgctcaggagtgagcttgtccgccatgccttcagtctaagagctcctagatttcgcgttcgggctgttcgccgaactcgaagtggcggccgctgacggaggtgggctcaatctccacgtagaagtccttcagggtgggcacccaagtcttcagccccagttcctccactgctgccagttccgcagagttgctgagaacgcgggcttttccgcgcagcactacggaccatgcctcctcggagaggatgccgtccgtttcgaagagaaccgtggagttgatggtcaactgggccagcttgttgcccggagccgtccgcagatagattttccggttggccgtgacatagttgaccgggaagatatccggctctcctgcgacggagaccaccagcctcccgtgcttggtgccctccagcagacgccaggactgctcgtcgtcgagctcgagtacgggttgtccatccacatgttcaaacatcatgaggccattcttctacctaatgtagaaacgcgccagagggttgcggaacttctggcgccggtcaggagatggcggttccgtgccgcgagcagctggcactccaggcatggggtgacacctggaccttgaggcggcgcccgcactggccgcagtagcgcggcggttccagctgaagccgcacagcgcactcccggtgagcggcgccccccacatgcacatcgcacgtctgggggacgttcgacggcggtgcgctcccgccgtcgaacgtttcctgcgggtacaactcgccgcagtggccgcaaaagccgccggtgattgggctcgtcaaacggttggggatcatagggttttctggagttccttgatgggcatgttgaggtccaccagcaggttgaggtcggcggtggcgggacggcccagggtggtgaggtagttgccgacgatgacggcgttgatcccgcccagtagcccctcgcgcgtaccaaggtcaccgagggtgagctcccggccgccggcgtaccgcaggaccgttcggggcatggccagccggaacgcggcgatggcgcggagggcgtccttgccgtccatcagttgctggttttccagcggcgtgcccggcctcggattgaggaagttcagcggcacttcgtgcggttccagggcagccagttgcgcggccagttctgcacgctgctcgagtgactcgcccatgccgatcagcgccccgcagcacagttccattccggcgtccttgaccatggcgcaggtctccagccgttcctcgtagctgtgggtggtgaccacctgcgggaagtagctccgtgccgtctcgaggttgtggttgtagcggtgcactccccatgaagcgagctggtccacctggtgccgggtgagcatgcccagggagcaggcgatgttgatgtccacctcttcattgatgcggtcgactgcgaacttgatctggttcatgagtttgatgtcgggtccgcggacggctgccacgatgcagaattcagtggcccctgttgctgcggtttccttggctgccttgaccagctccgggatgtccagccagacgccgcggacggggctgtcaaagagtccggactgactgcagaaatggcagtcctccgggcagccgccagtcttgatggagatgatcccttcgacctccacgtcctctccgcagtgcttgaggcggacctggtgggcaagctccagcgcggcggggacggcagggtcggggagccgcagaacctccaccagttgcgcctccgtaaggccgatcccatcctccaggacctgctgccgggcggtctccaagattggatagtccgtggtgtgggaagtggttgccatcgccgtcctagctttcggttgcgtctctttcccgacagtaattccgtaatgtgcggccggttttgtggaagggcaacaatggggggtggccgcttttgtttacagcagcagtcaaggcttaacgccgtcgaaacaagcccgtgaccaggctgtcgttcgtgccggatagcgtcgcatcagatcccttagagacgaaagcgacgcaattccatgagcaatgacaaagaaacaacgcagctattggagccgccggcacagcctggcgccgccgtcgtcggaagcgctcccgcgagcacggcggcgggcaacgccgcagcgctgaacgccaccaaggaaagcctggaggactacacgctccgcttcgcgccgcgctcctaccggaagtggagcgcgggggtggtggcaaccagtgcgctgggcggcatcgcctacctggcggacttctccatcggcgcgaacatcgggatcgcctacgggaccgtcaacgctatcttcggcatcttggttgccgccgtgatcatcttcgccaccggcttcccgctggcctactacgcggcgcggtacaacatcgatcttgacctcatcacccgcggctccggcttcgggtactacgggtccgtggttaccaacgtcatcttcgcgacgttcaccttcatcttcttcgccctggaaggctccatcatggcgcagggcctggaagtgggtctgggtattccgcagtggctggggtacgccgcctccacggtgatcatcattccgctggtgatctacgggatgaacaccctggcgaagttgcaggtttggaccaccccgctgtggctgctgctgatggtggtgccggtgggatacctgctggtttcgcacccggagagcatcaacacgttcttcgcgtacacgggcgaatcgggcgacggcggccccaaccttgcggcggtgatgctggctgccggcgtctgcctgtccctgatggcgcagattgccgagcagattgactacctccgcttcatgccgccgcgcactgaagccaacaagggtgcgtggtggcgggcggtcatcctggccggacccggctgggtgattttcggtgcgatcaagcagattgtgggcctgttcattgctatttacctcatcgcgaccctggacccggcggcgtctgccacggcgaatgagccggtgcaccagttcctgggtgtctaccgggagatgatgcccgcctggctggccatgacgctcgcggtggtgctggtggtcatctcgcagatcaagatcaacgtcaccaacgcgtattcgggttcgctggcgtggaccaacagcttcacccgcatcaccaagacctacccggggcgcatggtgttcgtggtggtcaacctggccattgccctggtcctgatggaagccaacatgttcgacttcctcaacacgattcttggtttctacgccaactgcgccatggcctgggtggtcacagttgcgtccgacattgccatcaacaagtacctgctgaagatttcccccaaggttcccgagttccggcggggcatgctgtacgccgtgaacccggtgggctttgtgtcgatgctggcgtccgcggcgatttcgattgcggtgttctttggtgcctttgggtccgcgatccagccgttctccccgatcttcgcggtgggcctcgccctggtccttccgccggtgctggcccttgccacccgcggccggtactacctccgccggaccgacgacggcatcgacctgccgatgttcgacgctgacgggaaccccagcgacgccaagctcctctgccacgtcaccgggattgagtttgagcgtccggatatggtgcggtcggcacaggacgctcccgacggcggcccgcagtatgtctcgtcgctcgccttgtccacggacaagacgggggagttggtgttgcctccgcagaagtaggtggcctttgcggccacttgaaagtgctttgaagtaggagagccggcgcattcatgcgccggctttttctatgacttcttttactgtctctgtggggacaaacctttggcggtagctgtggataagtcttatcgctgaaatgtgacctgggctacccttaagtcattgtccggagttagccgtcttgaaactactgggggattagcggcccatgacattgatcaacgtctctacgccttggggaatgcgctcagctgctgcgggcgctgttgttgctgcggcgctgctgctggctggatgcgcgggcggggcgccggcggaccccgggactgtttcagcgacgcctgcagagtcggccacctcaagcccttcagccacctcgactccaacacccagtgctgtctacaagccggccgacgcgtccggccccgcccaaaacgtccccgtccccgtgctgcccgaggtggcgaagacggagacgaaggaggggctcgaggcgtttgcaagatactggtactccacgttgagttacgcctatgaaaccggtgacatgtcgcatctggaggcagtttcgcagccctcgtgcgggagctgcgcgaaggtgaaagttgaagtaactgattggcactcagagggtcgatggttggctggcgggaaaatggtcgtggaaggtgttcacagtgacttcgtggagaccagccttaacgagtatcaagcagttgttcaggtttatcaggacaccattgattaccacttgcctgatggcactatcaaaggatccttgccccgcaaacctgcggtaggtgacatcgtcgtcgcagaattcagtggcgacggttggaaggccaaaacggtagagcacctggtgaaatgatgagtgggcaggacttccgtaatcgctgcctcgagtcagcggttgtagccttcttgcttctctgcttttcagtcacgggggtaagagcggatacgaaaagctcgccttccattggaacaggatgggagggtaacggggccgcagcctccggctggtaccaagatccagccagcaagggttggacgacgataccggtgggtgtaccggatgaccccttcaaatatcgttttaagcatgtctgtcgggctgatccaaacctcgacggttcaaactgcagcggtccggacgtccagtgcacggaaggtgagaatggacgcaccgtaaattggtacaggtccttaaaagctcttgatgccttctccttttttgcaggccctacgtgtatctacgatgaaaagcccgtggatgcattggagcagatcgcagctgacatccagcgggagttccagagcctgccggtcaatgctggaacggtcgtggcccaacccagcccgcacacgttgaggggcgctgacaccaacttctacgcggaggcagccgagcagcagttcgacgtcaccatgttcgggcagcaggtgcacatcgttgccaccccggtccagtacacgtggaactacggcgacgggaccgtgttcgggccccagccctccatgggtggcccgctgccccaggaccgttggggcgaaaagacccggaccagccacgcctacggggccaccggggacttccaggtggtgctgaccaccaccttccagggaacctactcggtcaatgccgggccgcccctgccgattcccggccagggccagttcagcgcgcctccgcaaaccatcagcgtttggcgctcgatgacgcgcaactacgccgacgactgcaacgccaacccccagggccagggctgccccgggaccgcaaggtaggcgacggccaatagcctcgaagcccgccctccacatgctgtgattcccatcgcaacaggaatagttgcagctgcaacccggttggccaaggcagtaagtcttcagccctcgaaaggaaccgcgcatgctgttttcccccctcaacctcggcgaacttgagcttccgaaccgcctggtcatggcacctttgacgaggctccgcgcaggtgaggcaggggttcccggtccgctggtcgcagagcattaccgccagcgcgcttccctcggcctcatcgtcagtgaaggaacgttcccaaccccggttggccgctcctacgccggccagcccggcatcgtcaccgaggaacaggttgccggctggaagaaggtcaccgacgccgtccacgccgaaggcggccgcatgttcgcccagatcatgcacggcggacgggtatcgcaccctgacatcaccggcgggcttgagctggtggcccccagtgccgtcgcaattgacggcatcgtccgcaccccgcaggggaagcagccctacccggtgccgcatgccctgaccacggacgaactccccatggtgatccaggaattcgtcaacgcgtcactcaacgccatcgaagccggattcgacggcgtcgaactgcactcggccaacgggtacctgctgcacgagttcttggccccgaactccaacgtgcgggacgacagctacggcggctcacccgagaaccgtgcacggttcgtcatcgaaacggtcaacgccctggtggcagccgtgggcgccaaccgcgttggcatccgcatctccccggagcacaacgtgcagggcatcgccgagaccgacgccgctgacgtccgcgccacctacgaggtgctggtggacagcatcgccccgctcaaccttgcctacctgagcatcctgcaccacgagcctgcgggtgacctggtccaggacctccgggttcgcttcggcgggaccttcctggtcaacaccggcttcggcgtgatcaccacccgtgacgaggcagcgtcccttataaacgacggacatgccgacgccgtggtggtgggccgccccgccatcgccaacccggaccttgcccgccgctggaaggaaagccttcccctgaacgagccggatccctccaccttctacgctgacggcgcggagggctacacggactaccccgcctaccagaactaggacggcaattaaccagaactaggacgacaattaacgacggcggcggcacccggcttgggtgccgccgtcgttggctgcgcggtgtgctgtcccggcagcgggcgccgcaggccatccgacggcctttggctcaagctctggaaatttggcccgccgggtcctccaggatgccggcggtgatcgaatcgtactccagcgaatggacttttactagggccatatgtgggctgcgtcaacccgctacagcagcgcttccctgccggttccttccttcatgacaagccttccgtcctcgatcgaaacgagcacgctttttggcctgccgctcaccttggtgattgccttcaggccgcggttcgtgacctccacgcccacctgtgcacctttcgccggcagctccacggacacctcgttagcgatgccgagaatcgggttggtggagactccaacgtcccgccgcgcctgcttcccgttaaccgtcacggtgatgttggcctcgtcgaacccctcctgaaaaatgataagcagttccctcatggtggcctcttcctcgagcattggctgcctgtgacggcatctccactacagcactttgccagcggcagcggaatacccttgcccggaacaaccggggtgagcggactcgtgcctcagcagtggagccgcgcaacccggtaaggcaagatgttctggtgactcaactgccgcaggccccttccgccccgtccgcctccccgacaacggacgatgccatccatactcagatcgccaccgagctgggcgtcaaagcatggcaggtgaaggcagccgttgaactgctcgacggcggatccaccgtgccgttcatcgcccggtaccgcaaggaagccaccgggacgctggacgacacccagctccgagagctcgatgagcggcttcgctacctccgcgaacttgccgaccgccgtcgtgccgtcctggaggcgattgaagtgcagggtcagctgacgccggagctgaagaaggccatcctcgcggcggacaccaagtcccggctggaggacatctacctgccgttcaagtccaagcggcggaccaaagcgcagatcgcgcgggaagccggccttgaacccctggccgattccctgctcaagcggccggacctggacccggaacgcgaagccggtaagtacctcaaccccgaacacgccatcaccgacgccgcagcggcgctcgcgggggcgcgctccatcctggtggagcgggtggcccaggacccggacctggcagctgacctgcgcgagcggctgtgggcgcagggccgcatggtctcacgcgtgaagaagggaaaggaaagcgacggccagaaattcgctgactacttcgagttcgcccaggctcctgcgggcatgccgtcccaccgggtgctcgcgctgctgcgcggggagaaggacggcgtccttgagctggaccttgccgaggcagatccacaggacgacgccgcccttgcccccgcgcgcacgcgctacgagtcagcggtggccaggtgtctcggggtcgccgaccggggacgtcccgccgactcctggctgatccagaccgcgcaggtggcgtggcgttccagactgctgtcccggttgacggccgaccttcgcggcaggatgttcgccgccgcggaggacgaagctgtccgcgttttcgcggcgaacctgcgggacgtcctcctggctgcccccgcagggaaccgggcaacccttggcctggaccccgggctccggaccggcgtcaaagtggccgtggtggacggcaccggcaaggtcgttgccaccgacaccgtgtaccctcacgcccctttgcggaagtgggacgaagcactggcaacactggtccggctggcgcggcagcacgccgtcgaactcgtggccatcggtaacggcacggcgtcccgtgaaacggacaagctcgcagccgaactgattaagcggctgccggatgtggaccgcaagccccagaaactggtggtttcggaagcgggcgcatccgtgtattccgcctcggcactggctgcggccgagctgccgggcatggatgtgtcactgcgcggcgcggtgtccattgcccgccgcctccaggatcccctcgccgagctggtgaagatcgatccgaaatccattggcgttggccagtaccagcacgacgtgacagcctcgaaactggaccgcagcctggacgcggtggtggaggactgcgtgaatgccgtgggcgtggacgtcaacacggcctcgcccgcgctgctcagccgggtggccggcgtcgggcccttgctgagcgaaaacatcgtggcctaccggaacgaacacggccccttcgccaagcgcactgacctgaagaaggtgccgcggctgggagcgaaggcgttcgagcagtgcgcgggcttcctccggatcaccgggggagcggagccgctggacgcctccagcgtccaccccgagtcctattcggtagcccggaagatccgggccgcggcgggatcggccccggcctcgtcactggacccccgcaacttcgtggacgagacgttcggcctgcccacagtgcaggacatcctgtccgagctggacaaaccgggacgggacccgcgtcctgcatttgcggcggcgacgttctccgacgggattgagaagatttcggacctcaaacccgggatggtgctggaaggaaccgtgacaaacgttgcggcgttcggcgcgttcgtggatgtgggcgtacaccaggacggactggtgcacgtgtccgccatggcgaaccgctttgtctccgatccgcgggaagtggtgaagtccggccaggtggtccgcgtcaaagtgctggaggcggacccggaccggaagaggatctcgctgacgctgcggctcgacgacgaacccattgccggacgcacgggcacagggcgcgccggcggcgccccgcagaactcgggacgcggcagggaacagggtggcagtccggcacggaaggcgccctcgcccggccgttccccggcggcgcccgcgcctgcgaagaaggaagctcctatcaacacagccatggctgaggcgctgcggaaggccggcctgggcaagtagctgttttgtggggcttcaagcgagcgacaggacgaaagcgaggacaaagcctgccgcggtgctgagtgctaccgcggggccgccgtgttcgtaagcttccggcatcagggtgtccgccagggatgcgatcacagctccggcggcaaatgccagcggtattgatattgcttccggatcggtcccggacagtggcccggcaccaagcacgacggcgatgaccagcagggcggcacaggccacccacagcccgatgatgctgccggccgaccggccttggctccgcatcgaggcggaacctaccagcgcctcagggaagttggagacaaagattgcggccagcaacgccagcccgcctgttccttcgcccagggagattcccagggccatgttttccgggacgccgtccagggtgacggcggccagtaaggccaggccggccgctccgcctgtggacgctgaggtggggcgtttgtcgcttgccgctgcgtcagtatcgagcttggcgctgccctggacctcgtccgccgccttggcccgcttcaggtctccggcctgtgcccaccggtccagcaaagcgctcaggaccgtgaagaccactgcgcccagcatcaggccaagggcggcgcggataataccgccgtgttcgtaggcgtcctcgaacagttcgaaagcgagggcggtgatgagggcaccggcggcgaaggccaggagcatggccagcaaccgcttgggaagttcgaaccggacgccgacgaaggcacccagaaccagggcactggatgctaggacgccaaaccacagcgacatcatcatccggcaagtataggagcgtccggttgacgtgggaagacgccgcgttggctcattgaaaacctccgcgcaggcgggctttcggcgccgggaggattctgcgaaggtggtttcatgacgtatttcctggagtacacgattcctgcagcagccgacgacgccgggtttgaatttccccatgacgagatcaaccccggcaccaccattccattgtcggagaccggcgcggagaccgtgcacaccacggagctgccggccaggactggcatcatcggcgccaccgttccggaggcgaaacttgaagctgagcagctgatcatccacagccgcgcgtctgaaggctccctctactttgacccgtccaattcactccaggccggggttggaaccctcgtggccacattcagcgaaggccggggctggcaggacgcctgacttccggggctctggcttactcccggcatggccccgccttatccccgggtgctggtgaccaccctcggccagccgaactgggtccgcaccccgggcgagtacaggaccgattcgggcgggccgcccacctcaatgcctgcggagctgatgagcccatcgtcaagctcgtggagatccgccttgtgtaatgcccagggttcatgggtgttgggtatgtggatggtccgcccgcggaacctgctgtgcagtccgaaccgtgctgtgacgtgcatggacagggggtcgtcggcaaccgatcctaggtcgggagtgacgctaaagcggctggatgcgcccttccggaaacggctgacggaatagccgctggcgccgtcacccgtgtctctgggcggtgttccccaagaccggatgcgggaccacacataaggtatccccgcctgccgggcagccaggacaacgggcagccggttcgcgtcaaggctaaggaacaccacgcccctggttccgtccggctcccgcgaatagagtcgaacgttgacctcgttgaagctgcccaggtacggaactccggggccgtgtcctattcctgcacccttcatgcggaagccgatgaggcccacccaggaagagccgtcgaaaacgtccggctccacccctgacggcatgaaccgggcagcggatgatcccgggatccgccaatgcaggaaaaccgcatcaagccagcgctggtccatgatgaccggcagcggcagttcaggcggatcgggccagaggtccgcagcgctcgagcgttgttccatagccaagatccctacgtaggacgcgatatttaagcgagtactcattactggtgtctaccttgcggggccgaccctatgctcaacctacccggcgcctaggacggaaccaaggcccggtgatcgctcctgcagcggggcgtcccatcggtcggagccctctgagtgcagtgaagtggtgaggcgtttgtctatttccacccagcccccaaaatcgttccccaagccttcggcagtcccggagggagcgtctatcagcgtcgtcatccccactttgaacgaggcccaaaacatcccgtgggtccttcggcgcatgccgttatacgtggacgaggtggtgattgttgacggtcgttcgacggacaacaccgttggcgtagcccgagcactgcgcaaggacatcgtggtggtgaacgagctgcgcaaaggcaaaggtgtcgcgctgcggtccggattcgccgcagccaagggcgacatcatcgtcatgctggacgctgacggaagcatggatccgagggaaatcggctggttcgtctccccactccagcacgactacgactttgtcaaaggctcccggtacgtcacgggaggggggtcggaggacctgacgtggctgcggcggacaggaaaccgtgcgctgaccgggctggccaacgccgttctgcgcagcaactactctgacctttgctacggctacatcgctttccggcgggagtgcctggaagtcctgcagctggaatccgacggattcgaaatcgaaacggagctgatcgtcagggccgccaaggctggcctccggatcgccgaggtcccaagcctggagctggaccgtatctccggggcatcaaacctccagactttccgggacgggtggcgggtgctggggacaatggcccacgagtgcctcctttgggaggcccccactgccggcgcacgccccgaggcgctgcgtcgcgtgaagtacgcctacgccaacgtgagcttttcgcgaacgcccaccgatccgatgagtgttcttcctgcaataggtgtgtcttgaacatgaccaatgttgtgttcccgacggttacagtgatcatctgcgcctacacggcggaacgctgggtgtggctgctggacgtcatcgattccctccgcgtgcaaacctgcgctcccagcgaagtcttcgtggttgttgaccacaacgaggaactctacgagcagttaacccggaccgttgatgacgtcatcgtcgtcaggaatgccggcccccgcggactttccggggcacgcaacactggcgtgggcctggcggattcagatgttgtcgcctttctcgatgatgacgcagaggccgcgccggactggctggaacgcctggtcaccctttatgacgatcctgaggtgctggcagtcggcgggcgggtggaacctgtctgggaggcgggccgtcccggctacttcggcgaggagctggactggatcgttggctgcagccatcggggcctgccacgggttgcaactgaagtcaggaacgtcatcggtgccaacatgtcgttccggcttgatgtcctacggacggtgggcggtttcaacctctccttaggccggcagggttccattcccttgggctgtgaggaaactgagatctgcatccggtcgaagatgggggcccccgggtgccgcatcgtttatgagccggccgcgctggtgcgccaccatgtgcccgcccgacggggaacgattcgctacatgctttcaagatcctggtcggaagggatttcgaaggcccaagtcagccaagtcgtagggcacaagcgggccctgggaccggaacgccgatatgtccgcagcatcctgccccgagccgttcttgcagggataggggactggagccgtggcgatgctggcggccttggccgagccgccgccgtggtggcggtggtggcctttgcgtcggcgggctacctccggggtcgccaccttgcacgtttccctgggcgtccactggaccctccggtcctggctggggtcagtccatggcgggaagtgcagtgaacgtcgccatcggtccacccgtcgccacctgccacggcgacgacaccgcggacaccgtcgacactgccggcaccgtccacatcatctgaccgactccacccagacaggggacgacaatgcgcacctcgcagaccaatacactgcacttcgatatccacggccgcgtcacgatccgcgtcgacgccaaggcgccggcagcacaccaactccggagcatgttggcctgtttcgccaccgacgccgaacggccggccgacatcgtcgtcgatgaccagccggagccgatgcctgatgcgggcctgctcgagcacgagcttgcctacacggaggacagcgtccgattcaatgccgacagggtccaggtggtgagggacggagaacagtggcgcatccacggcgcgggcgagctgctgacctccgtggtacccgtcctggacgccgccatgatcggccggggagccgccatgatccacgcggcgacgatggcttaccggggccaggccatcgcgcttcccgccgccggggggaccggcaaaacgagcaccgccgccaaactgatgcgccgcgacggatggtcatttatgggagacgactgggctttcctcgccgaggacgccacgctgcttggctacgcaaagccgatgttcatcaaaccccatcaccgggccatctacccgcacctgttcgaaggtgtccggaagccacttgtgccgtcgcggctctcgcagagcgtcggccggctcaccacggtggtgcacccgtacgtcatccgttatccgcgcctcgcggacttctcccgccgatggtcgccggaacaccgcatggtgacggccgagaccgcgttccccggacggaaagtcaccacctcggccccccttgcggccgctgtgtacgtcgagcgcttcgagggcacgcggacccggattgtcgagcggacagccgattggatggtcgaccgcatgatcggcaacttccatatcgagatggcgggcttttcgcaacaggttgtgaccggcctggcggccacgtccgttgtcccgtggcgggaacacttcgcggccaagggggtggtgctgagcaaggcactcgacggacggccctgccatctgctgcaagtgccctcggcgtacacggcggacgaggcgtcggacgacattgtccggcatctcgaacagctgctgccgtcggtcctcgacgagcaggcctagggggcggacaccgtggatcacagtcctgccgaggtcaccgcggttgtccctgcccgtaacgcggagcacatgcttccccgttgcctggaggccctgcgccagtcgggggtcgccgagatcatcgtcgtggacggatgctccacggacggcactgtcgccatcgcccgcgcggccggcgcacgggtggtcagtgacgagggccgcggcctgccatgggctcgaacactcggtgtgcggaacagcagcacccgttgggtcctgcttgtcgactccgacgtggtgttcgggcccacgggcgtcgccgacctgctcacggagctggtggagggcggctatgacgccctccaggccgggttggagagtgtgggcggaccggggtactgggggcaggcgctcgcccaccaccatcgcaccgggcggagccgcaactggttcgggctcgtcgccacgctcgttgaccgggaactgatgctgggcgtgggtttcgacgactcgttcaagtcgggggaggacatcgagctgcgctggcggatgcgggactcaggcctgcgaacggcagtgtcgcagcgtgtgatggttgaacaccgtttcgccgcagacgacttcgacttcgcgctcgatcagttcctcatggacggaaccggcctgggaaagatgatccgcaaacacggctggcgcggtgcgaggcttgcgctgctgcccgccgccgcggcagtccggggcagcgctttgagtcttgccgcgggccagccccggtggctgcgctactacgttgccttctgctggtacaactacgcaggcctggcacggggtctcgcgtcgtgagggctgggcgggcgataactgagacgaacgcctcaaccgtccggcactccgccctgcgcagctcgcttggtctcgtcgtcgcaaaagccgcccagacaggcgcaggtttcgccttctggatcgtggccgcgcgtgccacgtccgaccgcgaggtcgggctcaccatggccgcggtctcggcggtgatgctctgcacgcagctcgcggtgctcggtgcagggtcggccgtgatcgtctcggtgggacgaggggagccgcccgcgcgggtgctggacgccgcgttcgccatcgtgggggtggccggcaccggattggccctcggctaccttgtgctgcaagcggccgtgacgccggacacggcctcactgtcggttctcttctggctcactttcctcgttgctgccgtcaccggcaccctggtcatcgtgctggatcaggcgctcgtggcgctgggacgcggtgccagcgcggccccaaggtacgcgttgggcggcggggtggccctgggggctgcagggctcgtggcctggcgggcgaacggtgccaccgccgatgtgctgatggcctgctggacgctcgggaccaccgtggcgtgcgtcgtgggcgcggtccagctgcgacgactggtcggctaccggccgaggcccaccttgcgcgcggcgcgcggccgttcactgctggccctgggcctgccgaaccagatcctgacgctcaccgagcgcgcccccggactgttgctgccgctgctgctcgcgcacctggtgtcgccggaggctgctgcctactggtatcccgcctggatgatggcgtgggccgcctacaccgctcctatgctgatgggtatcgtccagttttccgaaggcgtccgcgagccggaccgcctggtagccaccacctgggcgagccttcgatggtcgctcgccgtaggaggcctggccgccgtcgtcctcgtcgtcttcgcccgcccgctgctcggtctgctgggcgagcgctacgcagactcgtccgcggatgccctgcggctgttggctgccggactggtggcatacgccgtgctgcaggcctacaacgccgtgtgccgggcccgtggccgctacgctgaggcgatcattgtcggcgtgatcctcggagcggccctctgcgccggagccctgctggccgccgggagcgggcccagcgccatggcccttacctggctggtggtgctctccaccggtgcagtggcggccggcatccggctggtcgccgtcctccggcgagtaaaacaggacgcacgatgaccaggacgctcgatgcccccagccgaactgaacggcgctggaaaccccgcgacgtggggtgtgctgtggcgggcgccgtgtcgctggctcttgccgcgggagccgcctccaccgtggcggtccccgttaacagcgacctgggactcctcgccgtgctgccctacccgttctgggcgggggtcgtgctcctcaacgtcgccttcgccgtcgcgctgcgcggggacgactcaggccctgcgcgccgtccggtgatgctgtggctcatcgcagtgctcgtgctcatgctctttgggaccgcagccttcgtgacggacatcccgcggggggaagtcgccttccgccacctcggcatcgccgacgccctctccgaggcccaggggatcaacccggacatcgacgcgtacttcaactggccgggcttcttcgcactcctggcgaccatgctgggggcgaccggcctcgacccggtcaccgttgccttgtgggcgccggttttcaacatgggtctgtggctcgttgccatgggcgtgctgacgcgctacctgacgcgcgatccgcggcgtcggtggcttgcgctctggctcttctgcctcggcaactggcaggaccaggactacctgtcgccccaggccttcggcttcttcctgtaccttgtcgtcgtcgcactgctcgtcgggcccctggcagcaaggaccccggtcttcgccggcttcaaacgcagcgccctggaatggtggtggcggcggcggtcgcccgccgagccgcggcacgcccaccgggtaagcgccatcgcggtggtcatcctgctcgtcgctgtcatctgtgcgagccaccagctgacgccgttcatgttgctcatcgccatgatcgccctcaccctgagcggacgcgtttggccgagccggctgcccctgatcaccgctgtggtgctgtcactctggctcgtctaccccgcaagtgcatacctcgtggggcacccgcccctggaggacgcaggcctgctcgccgcggccgaggcgaacgtggtcgaccgcgtgagcgggacccccggacacctgttcgtggtccaggtccggatggctctcaccgtcgtgctgtggcttctcgccgcggcgggagcgctgcgggaccggcgcagggggcgtctcgacatccgggtggtcctcctcgccgtcagcccgctgctgctcttccccgcgcaggcttacggcggggagatgctcatccgcgtctcgctgttcgcgctgcccttcgtcgcggtccaggcctgctcggtcctgcttcccgcgcatcgcggctggcgcccctccgccggcgccgcggccgggcttgcgcttacctgctccctgctggccatgctgaccgtgacagggcgcttcgggaacgcccagtatgacgtcttcaccgacggcgagatggccgccgtcgtcgccgcacagcgtctggcgcccccaggctccgccatcatctcggccgcccacccgacgccctggcgcagcgattcctaccttgagcacaagtaccggacgatcgacgaactgtgccagacagacttgtctgcggcagtgtgcggacccctcgtctacaactacgcccggcacaaccctgccggtgcggtggtggtgctcacgcgctcgtcagaggcgagcctcgtgatccagggcgccaccagcgagcgaggattcgccgaactggagaactggctgggcgcacagaacggcgtggagttcgtcttcggcaacgccgacgcacgagcgtaccgggtggcgccatgagcggcagcgtcagccggcctaccctggcgctcggtcttgcggcggtggcactgtcgctggtgacgctcgtcgggctgccgacaccgctgcaggcggtgacggcgacggccgtcctcatcctgctcccggggcaggccctggcccggctcacgccggtgaccgatgccgcgctcggcgcactgctcgtcctagcgctcggcctcgccacgctcacggcggtgtccacggcgatgttctaccttgctgtgtggtcatggcaggcgtgcgtcgtcaccatgggcgccatcaccgtcctcgcctgcctggcccgcgcacggcgggaggcggcaacgtgatcgacgtattgatcgacctggcaggcctgctcgcggccgcagccttgcttttcaccctcgtcgcactcgaggtacggcgcacgcaaccggacaccgggcagcccgcgcgcccaaggatccttggccggacggtgggccttagggtggttgccgccatgtgggtgatgtacctgatcctcttccttccacgcgtgctgggactgctcgtatgagcggcgcagcacggtggctgctcctcagcgacctccacctgggcgtggcggaccacgacccccggtaccccggcagggtgctgacaggcttcctgcggcgcgaggtgctcgcagcccacggccctcggcagcacgtcgtgttcgttggcgatacgttcgagctggtcggctgcagcggggacgggagcgtggcccggctcgaggccatccgcgcctgccatcccgacaccttccaggtgttggaggagtgtgcggcgcgcggcgtgcagctgcactttgtgtgcggcaaccacgatgtggatctggcccgcccctcggtggctgcccgcctggcggcgctgctgtcaccggccgagcccgcgcgggtccaagtgcacccgtggttcctgcacgtccccggcgtgctggtggccgaacacgggcaccagcaccacgcgctgcaccggatacccgacattctccgcgctacggtcaccggcaccgacgggctggacctgcccccgctcgccgcctggaacgccgatgagtcagggtcgcgcctgggccgtgccggggcggttgcccaggcctgcctggcgtccgagcgggcggaacgccgggtgagggagcccgcatacgccgagctgttgcaggccgagtcattccggctggggctcgacggggttgccgtccgggaccttgcgcgcctgtcccggttccggaccgtgtcggcgctcccggcggccgctacccgcatggcgctcgcggccgccggacgcagtgccgccgaagggaaggcccctaccgcggcggtccgggtggcacgtacccttaaggcgcacggttccggggtggcctggtacatgtcgggccacacccaccgggccctggaatcggttctcggggcctgccccacccggtacgtcaacaccggcacgtggtcttctgacgtccgaggccgcgggcccgaccagtcggaccgccgggtgttcccctatgccgtggtggacgtcacccccgacggcggcaccagcggcggcctgcggtactggcgtccggacgccggctgagcagcacccgcagcgccggctgagcagcgcccggcggtgcagtggtgcagcgtgcaggagtgccgcgggagttcctagcgtgcggaagccgccgcgggctctgcgggctttggggattccttctgccagggccagcgcccggtaatttccagctcaagcgagaagctgaggaacgtacggatcagcacgatgatcgccaggaccccgacgctttcaaacgtgggggttacagccacggtgcggatgatgtctgcggcaacgagcagctccaggcccagcaggatggaccggcccagcaactgccggtaggagcggtagaagctcagcctgtccgccccggcgggcagattgcgtggctggtgcccgcgaagggccatcgggatggaaatgagggcgccgatcaccatgacggcaactcccgcaaagtcgacaaactccccgacggcctcgatgatgtgccgaaaatccatggttcacgccttccgctgcttcgggacccaggcagccagcctagcgccggccccaacaccttgccccagctaggggtgacgaaccccagcgccggcgaggacggcccggtagccctcccggaatgaaggataggtgaacgcgaatccggtgctgcgcaggagctcgttgcggcagcgcttgttgccgccccgcgccggcccggcatcacccaccgggggttcggggaggcccatctcggtggcgaggaagcgcagtaccgtgccgagatcggcgggatcgttgtccacgccaacataggttgctgccggcctggcggccattgtggcgaggtggaccatggcagcagcagcatcgtcccggtggatgcggttggtgtaccggatatcctccggaacaacggcggaaccggtgcggacctggtcgatcaacctggtccggcccggtccgtagatgccgcccagcctgagggaggtggccgtggtggccgtgccgctgaaccgggacctgatgagttgctcggcttccagcaggattcgtccggaaaacccgccgggcgcggtaggggtgtcttcgtccacccagccgcccccggcgtcgccgtagacggccgtggaggaaacaaagatcacccggcccggctgtacgccgtctcgttccagggcgtcgaggacgtgggcggatccatccacgtaggctgcgcggtaggcctcctcggacggtgaatcggcagcaacggctatgacgacggcggtggtgtcggcaggaaccggcggcagtccgggggcgcccaggtcagccgcgacagcttcgatggcggccggcagcttcgaaggggaacggcgccagcccaccacgcggtggcccagggcgtggaaccgcagcccggcttcggtccccaggtcaccacagccggcgaggaggatggtcatgggttacggtgcctccaccgggaagaacacgcgcgggtcctgcaggagcgccgggtaggtgaacgcggaacggtcgatgacttcggtgaccgtgaagttcctgccgaacctgccgtcctccagcgtgatgggccggccgacgacctgccccaccgcgaacttcgcaccatgctcgaacgggacggcaacgggcgtctttccgggaagcgtcgagaatgcttcctcctgcgccagccgcttgcgggtgggcttcttcaccagctgcttgggcggtgctttgcgggactgacgggacgggcgccgggacccgtcgtcgacgaatacgggggagtagtccccgtccgcttcagcggcggcagcggggctcccgttcaccggcggaagggccacggtatccagcgtctggggatcgacgtcgtcgtgcggggacctcaggatccacaggatgtcaccctcaggctcctgcggcaggaactcatgccggggctcgggccagatgtagtccatctccggtatggcatccgcgaagaccggggtgtagaacttgggttccttgcgtaccagcttggagcggtggctcaggtggaagtccgggtcgccgagccacggcggcatggggatcttcgccgcatagtccgggtgggctgcctgcggcgcgaactccgcgatgttggcgcgggtgttgtcggggtggccgcgcttggtccactcgtcaaccattgccagcccgtacatggtgagggccggcacgtaccccatccacatccggatggccgggtgggtctgccagccgtagccgggaatcaccagggcacgcagtgtctgcagcgcctcaacgcgctgcttgcccagcctggcggtgtccagggcagcggcgctctgccggaaatcggggtacgggaggaaggtttgcatcccttcagtctgacggcacccggcggatgtgccaattgcagtgccacggaccacatgcgcacggcccggatgttcacatagtggacctatgcatacgccggtgctctccacccactaaaatcaccgcaacccgcccagcgttttggaagctccctcatgacatcaacacctgaaaagaccaccgcaaccacccccgccctgccccgatacgggcagctgctgggcccggaagcaaagggcatccttgtccttgacgagttcaccattgatcccgccgcggcccgcaaggaacagcaccgcttccgcgacggcatggccgcagtcgccctgacaatgcgccgcatcgcggcgctccgcattgtgatcgcaatcgtggccatcggaaacctgccgctgttcctgctctcgagcggctggtggatctacggcgtttcgctcaccctcgtggttgccgtccacgccgccgtctcctggctgaaccggcacgagccgcggctgaagcagcgctctgccctggagctgcacaagcaccgtgaaagcagcgcgaactaccgcaaggtccgcgacgccgtgaaatacatgatcgacacccccgcgaggatgaacgagcacctctaccttgagctcctcgccgccaagcgcgtcgccctcaacctggcccacggcactgtcgccctgctggacaccagcgacgattcagcctggaaggtgcggatcgtccgggaactgcccgccgccgtgtaaggccccgtccctgctgcggccttacaagacttaaagaacgacgccggcacatcccttgtgggggcgtgccggcgtcgtacgcggtcaacggaatttgtctatcgccgacctgattttggtgccccgaagggcagctgcctcaacagccactaggccggaagctggatgacctgtcccgcgaatacaagattgggatctgcaatggtgtccaggttggcgtcggcaaggtgctgccagccgccctcgatccccagcttctcagccacgatgctcaacgtgtccccggcctgcagcgtgtaggtctccccgctcagggccacggccgtcacgtgctttgcaaccggagcggcctgcacggcgggcgcgctctgctgcaccggtgcggcctggaccggagccgcctgcactggtgcgctctggaccggaacggactgcggcgcaacgccggtgccgctgccgctcaggcccagctgggcggagcaggagggccaggcaccccagccctgcgaggcctggacccgctcagctacggcgatctgctgctcgcggctggcgtcagcggcggaacccgtgccgccgtaggcagcccaggtggtggggctgaactgcaggccgccggagtagccgttgccggtgttgatggaccagttgccgctgctctcgcactgtgccagggcatcccacgtggaggtgctggtggcgttggccgcggtggctgagagagccagtcctgcagcggagatggcggctacggttactccgcggcgtgcggcagtacggaatttggtgtttttcatgatgggtgatgctcctgaaggccacctgcgctgcttccgtccccggagatcatcgcgccactgcccgcccctgacgaatagaggtcgtttcggtggctgcctgctgggcagttgtggtgaaggcagcaccgggcattcatgggtccgccagcggcgggcatgccttttacgctaagacattgcaccgccgttatcaaatcgagatgtttctgggcgttagctggtggttccctgaccgagggcgtttgccaggtatggggcggtgcggctttgggctgaacgggccacggcggcaggcgtcccggtggccatgatccggccacccttgtcccctcctgacgggccgaggtcaatgacccagtcggcgccggcaaccacggccatgtcgtgttcaacaaccaccaccgagttgcccgcgtccaccaggccgtggagctgggccatcaggagctgcacatcggcgggatgcaggccggtggtgggttcatccaggaggtagaggctgtggccgcgctgtgcccgttgcagctcggtggccagcttgatgcgctgcgcttccccgcctgagagctcggtggccggctgccccagccgcagataacccaggccaacatcccgcaggctcttgaggctcctcgccgcggcgggcacggcggccaggaacccggacgcggcatccaccgtcatggccaggacctcggcgatgttctggccgcggtattgcacctcaagcgtctcagggttgtaccgcgatcccgcgcactccgggcaggggccgtagctgccgggcaggaagagcagttcgacggcgacgaacccctcgccctggcaggtttcgcagcgcccgcctgccacgttgaaggaaaacctcccggcgccgaagccgcgggccctggcctgctccgtggcggcgaattccttgcggacggcatcgaacagcccggtgtaggtggcaaggttggaccgcggggtccggccgatgggcttctggtccacagtcaccaggcggtcaatgcggtggctgcccaggacgcttcccagctccaggggctccgcggacccgtcctgctccacgggggtcctgagaccggagccgactgcctcacccaggaccttgctcaccagcgtggacttgccggagccggacaccccggtgactgccgtcagcacgcccaggggaaactcggcatccagcccacgcaggttgtgccgggtgatgtccttcagctccagccattcctccggttccctggtcccgccggcaccggaaccgccccccgggacggatccgccgtcgtcgaacaggaacggcctggtgacggactcctcaatcccggcgaggccgtcaaccgggccgctgtagagcacctcgccgccgccttcgccggcgcgggggcccacgtccaccagccagtccgcacggcggaccacgtccatgttgtgctccaccacaaacaccgagttgccggacgacttcagctgctccagcacttccagcagcggctcggcgtcggcggggtgaagcccggcggacggctcatccagcacgtagatcacaccgaacaggccggaccgcagctgggtggcgatcctgagccgctgcatctcgcccggtgagagggttggggtggcccggccgagcgccaggtagccgagcccgaggtccagcaggaccgtgatgcgctggagcaggtcccgggtgatggccaccgccacctcgttggactctccggaaagctgcgtgcgggaggccgtgccggcgtcgtccaatacagcggtgggacggacaacctcggcgagctccgccatagggaggccgttgagctccgcgatggtcctgcccgcaaacgtgacggccagggcctcaggcaccagccccgttcctgagcagcgggggcacggccctgactccatgtaggccagcacgcgttcacgcatggaggtgctctgcgaatcagccagcgtatgaaggacatagctcttcgcgctccagaaccgccccttgtacggtttggccacgcggtcgcgctgcggtgtcaccttcactacgggctgttcctccgtgaagaggatccagtcccggtgttttttgggcagcttgcgccacgggacgtcgacgtcgtagcccaggtgggtgaggatgtcccgcaggttcttcccctgccaggcgcccggccaggccgcgatggcgccgtcgcggatggtcagggacggatccggcaccagcgaggactctgtcacggtgtgcgcgacgcccaggccgtggcattcccggcaggcgccggcggcggtgttgggggagaaggcatccgagtccagctgggtgctcccggccgggtacgtgcccgcccgggagaacagcatgcggagggagttggagagcgtggtgacggttcccacggtggaccggctgctgggagcgccgcggcgctgttgaagggcgacggcgggcggcaggccgctgatcagctccaccttggggttgtgcccctgctggatcaggcggcgggcgtacggggcgacggattcgaagtagcgccgctgcgcctcggcatagatggtgccgaacgccagggaggacttgccggacccggagacgccggtgaatgccacgatcgcatcgcgcgggacatccacatccacgttgcggagattgttttcgcgggcaccccggacccggacaaagccgtcggcggccggggcaggagccgggtactgcaggtcatcagcgggcttagcgttctgcattggttcgactctagtggtgattccggcgctgggcattatcctgacccgatggataacttcgccgccggcactgccgtgcccgaaacagaactggacgcagcagagctggaagtccccgccaggattcttccggtggccgagctgcacctgcacattgagggaaccctccagcccgagctgatcttcgcgctcgcggagcggaacggcatcgcgctcccgtatgcaggcctggacgagctccgggaaaggtacgagttcacggacctgcagtctttccttgacctgtactacgccaacatggccgtgctgcagacggagcaggacttcgccgacatgacccgcgcctaccttgagcgggccgctgccgcaggggtgcggcatgccgagatcatgatggacccgcaggcgcacctctcgcgcggcatcccgctggaaacgtgcgtcaacggcgttgcgtccgtcctggccacgtcccaggaggagttcgggatctcaacgctgctgattgcggccttcctgcgtgacctctccgaggaatccgcgctggaggtcctggacggcctgctggccatgaacgctccgattgctgccattggtttggactccgccgaggtgggaaacccgccgtccaagttcgagcggctctacgcgaaagcccgcgaagccggcctgcggctgaccgcacacgcaggggaggagggcccggcgtcgtacatcatcgaggccctggacatcctgggcgttgagcggattgaccacggcatccgctgcatggacgatccggacctcgtggaacgcctggtggatgcgcgcaccccgctgacggtgtgcccgctttccaacgtccggctgagggccgtggacacgctcgccgaccatcccctccccgctatgctggcagccggcctgaacgtctccgtgaactccgatgatccggcctacttcggcggttacgtggatgacaactttgcccagcttgacgccgtttttgagctctcggacttcgacaaggcacggctggccgcgaactccatccactcgtcctttgcttccgaggaacggaaggcggagctgctggacgaactgaacggcggcgaagtggcgcatccctaacgtgtccgaggcaacagcagcgccgacataccgctaaactgggtgccgcaggcgtgtctgggaagtgcagtgcggcacccatgtcagcgctcaagggttgtgcagccagcccgtttcccgagacctcagcctcacttgttgggacgtccgcttaatagtcggtcacgacacgcagtgttaaccatttcaagtcgcgcgatttaacgggcagttggcaagatgcctaagaccgatcgcttttataaaggggaatcatggccaagtccaccgcagaaaacaccttccttcgcctcaagaccgtgctggatgtcctgaccgaaggtgtgtggtccggcgatgcactgaacgcgggccaggtcctcgccgaggcaacggcccgggtaccgttcaacgagcatgaggccgagctgctcagcggcggcattccccgcggccacaagacgctcacctcggccaccgcaaagctggtcaaggccggctggctggtcaagggccgctccggctggaccatcaccgacgaaggcatgcgcgccaccgtcgccttcccggatgcagtgtccttcgccagcgcgctcgacgccggcacgcccatccccgccgaggtccaggttcccactgctcctgagggcttcgtccggaagaccaccgcggttcccgaagcagcagctgttgccacgggcaccaacaagaccgccaagaagacccctgccaagaaggctgcggccgctgttggcaaggcagccaaggtacttgaggacgccgtcgaaccagttgtgaaggcggtccgcaagggcaaggcgcaggccacaactgcggaagctgccgcacccgcagcgccggaggcttttgaggacgcggacgtcgagacgcacccgcagcctgaagccgtggctgttgcaggcgacttcaacaccatccttggtgctcccgagaactgggcgccgcagtacgacgaagcgcagatggagttcgacttcctagaccagatctggaagaagagcgccgaactgcccgccggtttctacaccttcaagatcgccatcaaccgctcctgggatgagaactacggcgcctacggcgcgttcgacggccccaaccacgaactgcaccacgccggcggcaccgtcaccatccgctacaaccacagcacccgcgacatcaccatcaactaacgggttgccctcccgcccaactaggtcgcgccaagtgtcgttttggaggctcaaaacgacacttactgctacctagttgggcgggggcggcgctgacgcaggggaggcaccatgacgaggcacgcagggccgtcatccggagcacctgatgcgccggacaatgacgctgcggcgggcacgcctgaaggggatgccgtccggctggaggcgcgcgttttcggcatggtgcagggggtgggcttccgcttctggaccatgggcaaggctgaagagcttggcctcaccggcgaggtgaaaaatctcgacgacgggtcggtcgccgtgatcgccgaggggccccagtggaaaatccacgagctccggacctggctgaactccgatcggacaccggggcgggtggagcaggtggaggactcgatttccgaagctgagggcaacttccgcggcttcagggcacgctaaggctgctcccgcgggctgaggcccaggaacgcgcccagctcctccagggctgcgggccggtgcggcatgtagctggtgagctcgggggagcggatgatgactgcgcgccactgcccgcgcgacactgcgacgttgatccggttcctgttcagcaggaactccgctccccgcggtgcttcagccacggccgagcaggccatggacacgagtaccacgggtgcttcctgcccttggaacttatccaccgtccccacccggacctgaggcaggccggcctcctccagtgccttgcggaccaggtggacctgggcgttgtaggcggccaccaccagcaggtcctgctgcccgaggggccggaactcattctcggcgccaggcttccacttcaggcccaggtgccgccgtgcctgccggaccacttcggcggcctcctcccgggatgcagtggtattgccggagtgctccacgaacacggtctcgacgccgggcggcagctcctcgaggttgcgcagcgatgccgccggtgcggactgcagctttccttcatagctgagccgtgacaccgcacggcacaggtccggatgcatccgccagctgtcggcgagaaagtagccaaggctggcaggcagggtggcatgcccagcggccagccagcccaacgccgattcatcaaccggttcagggtgggcgccctgggtgacctggggcagctgctgcggatcaccgagcaggaggagccgcttggccgcccgcgcaacggcaagggtgttggccagcgaaaactgtccagcttcgtcgatcaccaggaggtccagcgagcccgccgggacttccttgcccgtcatggtccacgcggttccgcccaccaggcagccgccgggagatccgagcaactgggcgacgtcgccgtcggccgtccgggtccaggggacgccgtgcggtgaagccagcttcttggccacggacgagggggaaacaccgcccgtgtcgatggcacggcagagcaggttttccaccacgttgtgcgattggcccaccacgccaatcttccagccgccagccaccaggctgccgatgacgtgggcgcccacgtacgtctttccggttccgggcgggccctggacggccagataggagtggtcaagatctcggagcgatgccgtgatggccgcggcgtaatccggggagcccgcggtgtcatggcgtacttccaccgggccgggaagcgtgcggaatcgcggggcctttttccgcaggatgtccaggccggggtgggcaggcagtgagggcacggaggaaccaaccgtgcgggcaagctcggcgatggcagcctcaatgctggcggtggccagtggctggtcctcggtcagtgcaacgggaaggtgcgggtaggcggccacctttccggtctcccgctcggcaacggtgatgatggtgtgctccgggttatcgggcgccggcgccacgttgctgatcctcgttccaaaggagaaggcccgtgcgccgggagcagcgtccggagcggccatgccttccggtggcggcgcgtcgtagagccggcaccaggtggagtccgctcggaagtccgagccttccgtcatggtgccgcgcagccggagggtccgggtccgcatccgttcccgcggtttggccagcgcccagtccgaggcaacctccgccgacgacaccaggaacacgttccgctggtccgcccagttatcgaccggtgcctccacacggtcgaagtgctgccaccagaactgcttgcgttcgcggcggtggtagccggtggcggcggccaccatggcgatggcgcgatcgtcgtcagtccaggcccggtcctccggcaggcttgccaggtattcgcgcagccgggtttcctcaggtgtttcctgagccgagacgggaggatcttcctggggcgtttccactgcctctgcgtgctggcgggcctcagcttccacggccgttgtcctgccggcctgccctgctacgtccagcaaccagtcccggagccggagcgtggacaggcagtcgtactggttgtaatcggagatggacgccaggaccctccctgcttcggctgagcggcctgcgtccctggccgcacagtaggcggcgtaggcaacaacggatgctccggcgtctttgacgtcacccgagcgcaggttgctgcccatgtacagcggttcaagtttcttgattgaataggacgcctccgaaatgcgcagtgactgccggacggtggcgtagagatccaccagcagcccttcacgcaaccacgtgtccactgtgtcttccccggactggtgcgccagggagaggttccggagggccgtcttttcataggcggcatagtggtagacgtgcatgtccgggtagcgggcgcggcgttcttccacatacgcgaggaagtccaggaacgcgcggcgctcctcggcccgggaatgggcccagaacgggcggaacgcggggtcgccgtcatggtccggaaccggtgcctcaacaacgccgaacaggtactcgatgccccaggcgccggtggccggatcctgccagagggggtcgccctcgaagtcgaagaagatgtccccggggctgggcggtgggagcgacccgatggtgttttccgggaggacggtgaacgagacggtgtggggctccccgtccttggtgaacgtccgggaacccgccacggcgtccagtcccagctgcatccgcgcttgggcccgcagccggaccacggaattcctggcgtctccggctggcatggccgccagttcatcgatggtggtgatgcccgccgcatggagcttcttccgttgcaccacggacattcccgccaccatcagcaggtcccggtgtgcctggacctgctcggcgcagtagtcgcaccggccgcagtggacgagccccggttgctgccaccgcacagtggcgtcacctgccctgtgctgcgcggtcatctcgcggaagcgccggcgccgttcacggaataccggcaacaggtcgggaagggaatggctgctgcggagccagtcctcacccacgcgggtccccagcaccagggtgaccaccggcgagggctccagccccatcccgagcagctggtcgccgtaggccgcaagctgcaggagggcacccaccttggcgtgccgcgccagtttcgtgtcccagacctcgtaccggcccgggttgcctgtgcccgcggcctcattgaccaggaagtccgcgtagcccaggaactccccgtcaaagaaggtggcctgaaacaccacatcagccccggaccgcagggcgagctcggtttccgcatgcttggcctgcaggtccccgcgcaggttctggccgcgttcgagcgaatagacaccggcgccgcggctggcatcccactcaccgtacttgttaatcaggcttgccaggacggtctgctcgtggtggtcgcccagttcgccggcgcggacctgcatctcatccgcggggaactccgccttgggggcgcggcccagcttctcgtcaaggatccggagcgtgcggtactcacactcgctggcggcaacgaggtcgctggccgaaaacaccaggtccggcggcacgccggccgctgcggcttcgagcaagaacatggggcctccccatcgacagccgggctgtcatcgccgggccggagacggttcccctggccctggtccaaacgtagcaaggggcactgacaaacagacaagcctcaaaagtaggtagcagtaagtgtcgttctgagccctcaaaacgacacttactgctacctagttgggtgggacggtcagttttcggcggccgcccgcacctgggctttgtcgtgttcgacgtgggctttccgcaggaggtccaggaactcggtttcgttgcggatgagccgcttgtacttctccgggagcttgcggatctcgttctcctcgcggcacattgcggcgaagatcttgtcccgctcgttcatgtccgtctcgtagttgaggtccaggtactcgacggcgtgccgccgcgccccggagacggcattcttggccttgcccttggggctgaagatggacgccaggaccgtgatcaccaggacgccgagaatgacgctcagcgaaacgcccgtgctgacttccaccacgctgacgtgctcgccgtcgttgatgaacggcagggtgttctcgtgcagggcgtgcaggatgagcttcacgccgatgaaacccaggatgacggcgaggccgtaggacaggaagatcagccggtccagcagtccgtcgatcaggaagaagagctggcgcaggcccatcagggagaacgccgtggccgtgaagacgataaagacgttttgggtcaggccgaagatcgccgggatggagtccagcgcaaaaaggatgtccgtgccgccgattgccaccatcaccaggagcatcggggtcaggacgcgcttgccgttctcaacggtgaacagtttgtcgccgtcgtagtgttccgacgccggcaggaacttcttggcgagccggaccaccaggccctcggagtcgtcgtcgtggctgcccggcttgagcaggttgcctgctgtgatcagcaggatcaggccgaagatgtagaacacccacgcgaagctgttgatcagcgcagcgcccaggaggatgaagcccgtgcgggcgatcagggagaagacgatgccgaacagcagcaccttttgctggtcagcgcggggcacccggaagctggccatgatgatcaggaagacgaagaggttgtccacggacagtgccttctccgtgatgtacccggcgaagtattcggtccccatggtgggtccgccgaacagcagaacgcccagtccgaaaagcaccgcgatgcccacatagatcgaggaccagagggcagcctccttgagcgagggtgtgtgggccttgcggacatggaagaagaagtcgaaggccagcaggcccacgatcccggcaatggtcagggtccaaacataagcaggtacttccatgctgcgggcctttcgtcggagtctccttaaagcctacccacctatgccggcttcaggagttcgtgttccacaacggcggcgcgcgagagggtcttgtagccctcgtgttcgaacaggacggtgatgacgtcgtcctcgtgccgcatcaccaggcccggtccccactccttgtggaccacggcggactggagcgggaacggttccgccgcccggccacccgaggctgtgccgccgtcgtccgccccgtcactggcggggtgcctggcggcgtcggcgcaggcatcgcagttgccgcaggcctccgccagttcctcgccgaaatagcccagcaggaactggcggcggcagctgtccgtctcggcataggcgcgcatcatggtgagccgggactggtcaacgcgctggcgggcttcggcgagttcgacggcgccgcgcaccagggcgggcagctttgctttggaggccagccggacgccgcgcttgccatgggcgacggcgccggtttcctccagttgattcagcagcccggtgatgcggcgggcgggaagccccgtgaggtcaggcaacgatgacttgggggtggggccatcggctgatttcagtaccttcaacacggccaggagggagtcggaatcgggggagtgggttgcgaagaacttccgcaggcccaggtcctctgaccggtagtggagcacagcggaggcgggttccccgtcacgtccggccctgccgatttcctggtagtaggagtccagcgattccggaatatccgcatggaccacgaagcgcacgttgggcttgtcgatccccatgccgaaagctgtggtggccactaccgcgtcgaggctgtccgccaggaactgttcgtggatgtgttcccggtccgcggcggaacggccggcgtggtacgcttccgcgcgcagcccctccttgcgcagcttggcggcgtatttctcggtgtccttgcgggttgcggcgtagaggagcccatgcccgttttgggccagggcagccatctgcttcagcacggccttgcgcttgtccttgtcctcgtggtggcgcaccacgtccagcctgatgttgggccggtcgaacccgcggaccaggaccagcgggtccttcatgcgcagccgttccacgatttcgtcccggaccgggggcgatgcggtggcggtgagggcggctacgggaggattgccgagctgttcgcggacgtggcccaggccgaggtagtcagggcggaaatcgtggccccaggaagagacgcagtgggcctcgtccaccacgaacagggaaatgcccagggctgcgatgcggtccacggtcttgtgcttggccagctgctccggggccaggaacaggaaggtggctgcgccgctttccaccgcctgccaggccgcctccacctcggaatcactgtgggaggagttgacggccaccgccgtgccgggccccaggtccccttccagcccctccagttggtcctcctgcagggcaatgagcggggaaaccacgacggcgggacgtcccgtggtgttgtgcaggtgctgcgccgcgacctggtagatcgcggatttgccgtagccggtgggcatgacggccaggacgtcgcggccggccgcgagggctgccatgccggccagttggccgtcccgcaggtggggcagggcgaaggaggatgccgcgagggcggaaagggcagaatcgtcggacatgggggcgctccgcgcagagtggttcctgcggccgcttgcttcagccaaggtcaccagcctaacgccagccgcgtgccgccgtcgtccgttgcccatgctggccgcccggcaggggagctgccctccttgacttccccgcccccctgaacaagtgtgggaatcgaaccggcccgccgaaacatcggaagatggccgcgcctgcagaacgcaaggagaaccagccgtgacgcgcaagaatcccgaagttgaagaggccgacgaatctgacattgaagtcagcggccacccgaagacatgggcagcgggagtgccgggcgtctaccattccatgcagcccgcgctgaagcacatgggcctggaacggtccaggaagaccctgctggcgctgaaccagaaggacgggttcgactgcatgagctgcgcgtggccggatccggggcaccgcaagacgttcgaattctgcgaaaacggcgccaaagccgtgacgtgggaggctaccccggtggtgattggctccgacttctggcgggagcaccccgtcagcgaactgctgcagcgctccgaatactggctgggcatgcagggacgcctgaccgagccggtgtacaagccggccggggaggaccactaccgtcccgtcagctgggacgaagcgttcgggatcatcgcggacaagctgaagtccctgcccagcccggaccaggcggccttctacaccagcggccgcacctcgaacgaggccgcattcctctaccagctgttcatccgcggctacggcaccaacaacctgccggactgctccaacatgtgccacgagtcctccggctggggcatgggccagaccatcggggtgggcaaggccactgtctcctatgacgacttcgccaaggcggacctgatcatcatcatgggccagaacccggggaccaaccatccgcggatgctcacggctctggaggaagcgaaggaagcgggtgccagcatcgtggcggtcaacccgctgcccgaggccggactgatgcgctacaagaacccgcagaaggtcaagggcatcatcggccgcggcaccgatctggcggatcagttcctccacatccggatcggcggggacatggcgctgatgcaggcggtttccaaacgggtcctcgacgccgaggccgcgaatccgggaaccgtgctggaccatcagttcctcgaggaacactgccagggccttgaggagctccgggcgcacctagctgaattggacgagccagccgtgctggaagccaccggcctgcgggccaaggaaatcgacgaactggccgaccgctacctccgtgcggagaaggtcatcatcacgtgggccatgggcatcacccagcagaaaaagggtgtggctaccatcaaggagatcatcaacctgctgctgctgcgcggcaatatcggcaagccgggcgccggcgcctcacccatccgcgggcacagcaacgtccagggggaccgcaccatgggcatctgggagcagatgccgccggcgttcctggacgccctgggcaaggagttcagcttcgaaccgccgcgggagcacggcgtggacgcggtggaaaccattaggcagatgcgcgacggcgggatcaaggttttcattgccatgggcggcaacttcgtgggcgccatgtcggacaccctcgctgccgaggcggcgatgggcggcacggacctctccgtccagatctcaacgaagctcaaccgctcccacgccgtgaccggcgccgaggcgctgatcctgcccacgctgggccgcaccgaaatcgacctgcaggagtccggcccgcagttcgtctcggtggaggacacagtctgtgccgtgcacgcctcccacggcaccgttgcaccggtggccccgcacctgctctccgaggtggcgatcgtctgccagctggcgcagcgtgtgctggggaacaggatttccgcagactgggccgggttccagaaggactacgacctgatccgtgagcatatctcccatgtggtggtgggctgcgaggactacaaccggaagatccggcaggaaggcggcttcgtcctgcccaacggcccccgcgactcccgcacgttcaacacccccaccggcaaggccatgctcacggtgaacgaactggaacatgtggagcgtccggccggcaccctgatcctgcagagcatgcgctcgcacgaccagttcaacaccaccatctacggccacaacgaccgctaccgggggatcaagaagggccgcgaggtggtgttcgtaaatccggaggacctggccgagctggggcttgaagacgggcagcacgtggacgttcgcggtgtgtacccggacaacgtggagcgggtcctgcggaactatcgcctggtgtcctacccgtcagcgaggggatgcgcggccgcctactatccggaagcgaacgtcctggtgccgctggagagcgtggcagagggcagccagacgccggtgtcgaaagctgtgattgtccggctcgagcccgttactgcgctcgaggaggagccgaccgccgccgggtagtcactgggcggtgtccgctactgggcggtgtccgcccagcccttgctggccgggccgccgtcgtgcccgtcctcgcacagctggaaggcgacgtccgccgctttcgccactgacgccgtcgacgcttccttggtgccggcactgcccgtgccggcttcaaggccggcggcgtagcccaccatgaaggtggtgatcggggctgcggcgtgggtcacggagtcggcagatttgcgggccaggtccaggagcagatcgtggtccaccttcaggtccaggatttgcagggcctgcgccagccggttgctccattggtccaggatctgcatttcgtcctcgttggctggcatgtccgctccttggttttccgtcagtgtcgggacattggttcgtcctccgtgccgagactacaaggcttcgcagcggaagtcattggttcaggcggatgcccgcgtaacccccaatccacaaacgggtagtcagccgggcttacgacccctagatatggcggcggtccgtgcttagactgagcgcaccccactccgggaagctctccggcaactgatccccagccatcagcagatgctggacggtgcccgtccggcggggtgcgcatcaccactcatgaatcacggccgccctgccgggcaaaccgtgggataacaggagaaaaagatgacagggaacaaagccgttgcctacaaggggccagggaaagtcgaacttatagatatcgactaccccacgttcgaactgaaggacgggccgggcgtcaacccggcaaacgtcgggcgcgccgtcaaccatggcgtgatcctgaagacagtggccaccaacatctgtggctcggaccagcacatggtgcgcggccgcaccaccgcaccgccggacctggtgctggggcatgagatcaccggcgaagtggtggaaattggccgcgacgttgaattcatcaaggtaggggacctttgttcagtcccgttcaacattgcctgcggccgttgccggaactgcaaggagcgcaagaccggcatctgcctgaacgtgaacccggaccgcccgggcagcgcctacggatacgtggacatgggcggctgggtgggcggacaggccaactacgtgctggtgccgtatgccgattggaacctgctgaaattcccggacaaggaccgggccatggagaaaatcctggacctggccatgctttcggacatcttccccaccggcttccacggtgccgtgagtgccggcgtgggggtgggttccacggtgtacatcgcgggggccggtcccgtgggcctggctgcggccaccagcgcacacctgctgggcgccgccgtcgtgattgtgggcgacctgaacgaggacaggctggcgcgggcgcgcagcttcggctgcgaaacggtggacctcaccaaggggggacctgccgagcagatcgaacagatcctgggcgtaccggaagtggactgcggcgtggacgcggtgggcttcgaagcacgcggccacggacacggcaaggatgccgaagaggctccggcaacggtgctgaactcgttgatggacatcaccgctgccggcggtgcgctgggcatcccggggctgtacgtgacaggcgatccggggggcgttgacgaggcagccaagaagggtgccctcagcctgagcctgggtaccggttgggccaagtcgctgagcttcaccacgggccagtgccccgtgatgaagtacaaccggcagctgatgatggccatcctgaacgacaaggtgaacatcgccaagaacgtgaacgccaaggccatcacgctcgaggaggcgcccaagggctacgcggagttcgacgccggtgcggccaccaagtacgtcctcaacccgaacggctacctgagctaggccgaaacggggcaaggggcgccgccgtaagcggggcggcggacggtgctgtccggcaagggacgggtgcggaaatagaagcccttcggctgaggttaggctgaaggacaccgcatcgaaggagatccccttgagtgacatcaccgtccgccacaaccccgaccgcgaccgcttcgagatcctcgacgccggcaatgtgattggcaaggcggcgtacaaggagtacgacggcggcgcctcgccggagcggattttctaccacacggtgatcaatgaggaatacggcgggcagggcctcgcgggccaactcgccaccgttgccctggacgagacggtcaaggcgggcgtgggcattgttcctgtctgccccttcatcaagaagttcctcgtcaagcaccctgaatacgccggcaatgcggtggccgtgaaacccgcgcacctggagttcctcgatggagccctggccagccgcgcccgctgacgtgcagggcatccgcccgcctttgtgatcgttgagttggcaggagctcccatggcgccggacccgcggctgaccccggccgggcgccatttccgccagccccgccgggtgcggaaaaggctggtggcgctgttctccgccgtggtgctggtcatcgcggcaatcgttggggtggccgcagtccggtcagtgcccttctccggcgcgggggtcccggtccccgcagccatccaggagaccccggtggctgttgccccggcgtcactccaggaccgcatcgacgccgtcctggcggaggagcccggctacaggatcgggctcgcgctggctgacgtctccggtgatgctgcgctgaccttcggggacacggacgccttcgcggccgccagcacggcgaagatcatcaccgccgcggcctactaccacctggttgaaaccggaaaggctgacctggacgggccgttgggggattacgacgctgcgttccagcttgaagccatggtgaaccaaagcaacaacgattcctggctgctgctgatggatgccgtggggtacccggagctgattgactatgcagcctccatcggcgtcacctatgacccggaggagaaccgcctggcgccggcggagatggccctggtcctgaagaagctgtacgccggtgacctcctggatgaggatcacacggcccagttgctcgggtacatgcaggagaccaacaacgaggacctgatcccggcagggtcacaggccggagttgaagtgttccacaagtacggggagctgggcggtgcccttcacgacgcagcggtgctgagttaccgcggctcgtcctttgtgctggtgatctataccgagaatcccgaaggtacggagctgcccggccagtccgaggtgatccgcaagctcaccggcattgttgaggaaaccctgttcccgcccgtgcgggcaggcgccctgggccggtaggttccatccaagtcgcgccggcccggcggtatgcagcagactgtttccgtgagcaacaaaccccggactgcgctggccgtcgccggcctcagcctgggcacggcactgaacccccttaactcctcgatgatcgccgtcgccctggtggtgctccgcgctgactttgggctcgacgtcgccgccgtcacctgggtggtcacatcgttctaccttgcctcagcggcgggccaaccggtgatgggcaggcttgccgacaggtttggaccgaggcggatgttcatgttgggcatggcgctggtggcggtcacctgcgcgctggcgccgtttgccccgaactttgctctgctctgcgtggcccgggccgtgatggccctgggcacggccaccgcctatcccagcgctgtggtgatggtgggtgccattgcgcaccgggcaaacgtggaaccggcccgcccgctcggcatcctgcagatggccaacacgtcggcggcagcagtggggcctgtggccggcgggctgctggtgggctttgtgggctgggaggcgttgttcatggtcaatgtcccgctggcgctggccgcgctgctgatcgtgcggcaggcggctccggcggacaaagcccgggaacacggcagcgtggccgagctgctgcgggactcggacattcccggcatcctgggttttgtcaccgcgctgctgctggtgatgatggccgccctgaatgtcttgccgggctaccgctggtggatgctgggtgcgggaatggcagtggcggcactctttgcctggcgggagctccgctttgcccgcccgttcctggacctgaggctcctgggccgcaacaagcccctgatgctcatctacctcggcttcgcggtattcagcagcgtctattacttcgtcttcttcggcttgccccagctcctgcaggaggccggcggctacgagcccggcgtggtgggcctgctgatgctgcccctggcgggcatgtccgtcctggccacaccctgggcggtgaaagcgatgggaaggttcggcgtgcggcgggtgctgattgccggcgttgtgctcctgaccgtggccgccgccctgatgtggctgctcaccggcacgctggcgatcccgctggtagtggtgctgacagcattgatgggtatcccgtacgggaccgtgggcatcgccacgaaccaaggcatgttcgtgtccatccggccgcaggagcggggcgtcgcggcgggcatctaccagacgtgccggtacgtcggcgcgatcacggccacggtgatgatcggcgtgttcgcgggcggcggcgtggaccaggaaagctgggcccggatggtcctggcaatgctggtcctgtgcgtggtgacgttcgccgtgagcctgctgtggaggcagcggacaccgtagccctacggcgttatggtggattgatgaagtacctgaggggcccgctctacctcgacgtcacagcgaaaggcctgtgcatcctcggcgctgcgctgatgattttcggccggggcggctggttctacgtgggcgtcgccaccgttgtcctgggtgtcctgttcatcggtgcttccctgctggccacccggcacctgcggcagcggggatgggacggcaggaagcgcgcctaggtgtacatcagcgagcccggcgtggtcagcttctcgccggtctccagccaggtcttcaggccggagaggatcatcggccagccgccgtagagctgttcgttggcgccttcgcggaggtcgctgtgggtgacggtcaggcggcaggaatcgcccacgggctcgatgtcccatgtgatctttgaggttccctcggccttgacgtcctcaccccagagggcccgcatggtctggaccagccggcgtggcgggtccacctccaggttttcgccctcacccaggggagcacccgctttgacattgttcatggtgaagctgctgcccggggtccagtccgtttcaatggtgttcccgaactggtacttgctgcggatcccgctgtccgtaatggcttcccagagccgttccggcgtggtcttaatgtagatttcgaagatcttttccatgggactttccaatctggatttaaggtcgctgaggccagcggcccatggttctgaatatttgctcacccagcggtcgtggatgagcctgatgggcacgggattcaggaagtggagcttttcccgcccccgacggcggctcaccaccagtcctgcatcttccaggagcttgaggtgcttggcaatcccgaagcgggtcatgtcgaagcgggcctcaagcgcgctcagggactgcccgtcctggcggaacagttcatcgaggaggtccctgcgggtggggtcggagagtgccttgaacactgcgtccataaagaaaatgataggtgaccatatggtcacctatcaagggttcttctcaagttcgagaggatggcctatgggcgcccgctgaccttgtccggcatcggtttggtgatgggccgcggctccagccacacccgctcccgcggaccctgcgggtacgcgtgcttcttgccggccagggtgatgatccaggctgccactaccggcagcgccgcggccacgggaaccagcatcgggccacccaccaccagcgccgcggagccgtagagcgctccgacggtgatgccgagctggatggtcagcacggtgaggccgttcgccgcttcctggtactcgccgccggcccgcaggatggcggactggttgtagatgccgatcgcgccgagccctgcaccccagacggtcatgaggaccagagccacggtgaagttgcccaccgcgaggggcaggaaaaacatggacagggcgatcgccgccgtcgtaaccagcagggaacgccgcggccgggagtccacggtgaggcccgcgatccagatgcccagcagcccggagccgcccagcacggtgagcgagaggctgatggcgtagtccgggaagccggcgtcgcggataaacggagcaatgtacgtgaacagggcgaagtgcgccaggaccagcagcggccaggcaatggccaccggcttcaccccgggctgggcgatggccttgcggagtgaggggcggacggcgtcggaaatccgctgaacgcggggcagcaggaagaacgccagcacggtgaggaccaggccgaacccggccagcaccatgaacgcggcccgccagcccaggaacccgcccagcgcagtccccacgggggcgccgatggccaggcccaggctgttgccgctgaagacgatggccagggccttgcccaccttgtccgccggaaccaccctggtgacaaacggggccatggtggtccagagcagcccgtgggccaggccgcccaccaaacgggcaatcatcgcggacgtgaagtcaggcgccagtcccaccatggcgttgctggcggcgaacgtcaggaccagccccaccagcagcgcgtgccttggtatcttccccagcagccgggcagccggaaccaccgtgaccacaatgacggcggcataggcggcagccaggtagccggccaccggctcggacacgttcaggccggagctgatctgcggcagcagcccggaagggaggagctcggtggtgatggcggtgaaggcgatggtggccaggaccaccatcgcggcgtacggaaaacgggcaggtgccggcgcggaaatcgcggaagacatggggggagggatccattcaagggggaggggtggaatgcggctcgctggccggacaattcctcccttaaatttacaggatcccgccccctgctccgtgccgttcccggcgcgtccccggtgctgctgacggcgcgtcgtgccgcaccgctcgactcagcgggcggccggttcccggacctccgtgacggcgctgagccgtgagtccagcaggcctgccgcgacggctggagccagccccggcgccagcggaaggcgcggtaccaccaggcagtgccagaggtggtagatgtccgcctttccagaccaaacagtggaggtgacattgccgtgctcgtcgagctcctgcttccaggatccgtgctcgtagtcgatgaaccagtcgtgggcatggtcccagattcgctcgtaccagtccgaatactttttctcgccggtggcgatgtagagggctgccgccccgccgatcgcctccgcggggacccagcggatgcgggtggtgaccaccggtttgccctcccagtcgaccgtgtacacgaatccgggattgccgtccggctgccaggcgtcgcggatggcggcgtcgaacaggccgcgcgcgtcttcgagcagccaggccgggacgtccaggccgcgggcctcgagcccggcacggaggtggaggagcagccgtgcccactcaacccagtggccgggcgttccgccataggcccggaactggctggcccggtcatcggtgttgtactccggcatcggggtccactccgggtcgaagtgctcgaacacccggtagttgttgttgcgcgcaaatttgtggatgagcacctcggcaatgtggagggcccgttcgagccagcggtcctctccggtcacatcagcgacgatcaggtaagcctccaccgagtgcatgctcgcgttgccgccacggtaggcctcggtttccgtgaactcccggttccaggagtcgaagcacatgttggcttcgtgatcccagaattttgtgtccgctatccgcagggcctcgtcgagcagttcccgggctccggggcggttggccgcgacggcgctggcagcggcgaggagcacgaaggagtgctggtagccggacttggtgttattcaccggcccgttcgcgtcgatctcggcgtaccagccgccaaactcatcgtcgtggaaggccccgttgagcgctgcgatgccgtggtccacgagcgtcgcagcacccggccgccccatcagcgcggcgacagcgaaactgtggaccatccgggcggtgatccagagatgggttggcttgtcggtaaataccttgccgttgttgtccagccagccgaatcccgtgggcaccttcgaccctgcggcgaaattgatcagccggtcggtttctgcctcgagccatcgtgcgtgggcggcattgttcagccacgtcatgttgtttcctctttctgaagcgggtgcacgtctgaaactggtccagtcagcgggtgccgaagtcggtatctgtgtaggcgccggtgcgccgcgcagcgccgccacaactgcagtcgtttccaacgtcgagctggatgttcaccggagcgccggcatcaaccgtcagcgagatggtttcgccgttggtggtggacacgcgcaacgggcttttgtgcggagagatggcaggcatggccgccctttcgttagtggtgttagttggaatatgcagttattacccgacggcgtcgagcacgccgcggacaatggtggctgccgcgcccaggtaggccaggacaatcagcaggatctgggcagcgcgggcggggacaaaacgggcagcgacgtcgccgagcaccagccccaccaggcaggctccggcaaccgctccccacatgggcacgggaagtgaggggaatgtggcgggcgccgtcacggctttggaggccagggacagcgcgccgatggtgaaaaagtacggctgcatggtggcagcgaaggacttgtgctgccaccgggtggcgatggagtacatgctcaccgcgggtccgccgacgccggccgcggtgttcatgaaaccgctgaggccacctgcggtgagaagatagcggcgccgggccggcagcgtggcggacttcaaggccagcaggacggtcagtccgacggcaaggatcacgccgatggaaatctccaggaccgccggcgggatgagccggatcaggaaggccgccggcacgattcccagcaccgccgaggccgtgagggccgcgtaccgtttccagtcgatgtcccggacaacccggaagatgatggctccggcagtcactgcgccgcagacgttcaccaacaccacgccctccaccgggcccaggagcaggaccaggaagggggcggccaccagggcgaagcccatgccggtgatgcgctgcatcccggcacccatgacgacggcgcccagcaccaacccggtggtcagcatttagggccgccaggccacgtattggacctcctcgaactcctccaggcccaggcttgcgccctcccggcccaggcctgactgcttggcgccgcccatgggcgcgaaggccacggacggcagggggtcgttgacgcctactatgccggcttccagctgctccggaatgtcccagccccgctttgggctgctgctccagacgtaagcggccaggcccatctcggtggcgttggccttccggatggcgtcctcctccgaggaaaaggtcacgacgccggctgccggaccaaagacttcttcggtcaccaggggtgcgtcgtccggaacgtccgccaggagcgtgggtgccaggaatgagcctagggcgggcacatcggtccgctgcgtgacgcggcgggcgccgcgttccagggcgtcgtctaccagcgcctgcacggcggagacccgctcggcgtcgatcacggggccgaggtccgggacgggcgtgccgtcgtcgggaacgccgtggccgatgctcatagcgtcaaagcgcgcggccagcctggcggcgaactccccggcgatgctgtcctggaccaggaagcggttggcggccacgcaggactggcccgtgttgcgcagccggcccagcactgcgccctcgacggcggcgtccaggtcggcgtcctcgaagacgatgaagggcgcatttccgcccagttcaagcagcggccggaccacccggtccgaggcggatgccatgatctgcttgccaacacctgtggagccggtgaagctgacggcccggacggccgggtgcttgagcagggctgcggtgatctcccgcgagggtccgtggaccaggttgaccacgcccgccgggaatccggcgtcgtgcaggacctcgaagagtccggtggcggccagcggcgccttttcggagaccctgcccaccacggtgcagcctgcggcgagcatcgcggcgagtttgcgggcctggatggagaccgggaagttccatggggtgaggctgagggccacgccgatgggcttccgcaggctcaaatggcggcggccctgcagctcgggcgggctgacggtaccggtggtgcgccgtacttcctcggcgaaccagcggaagtattccaccgagaagtccacctcgccctgggcttcggggagccgcttgccggcctcgagcgcaagggtgtgggcgagttcatcgcggcgttcggcgaggaggtcggctgcgttgcggagcaggtcggcgcggttccgcaccgtggtgcgggaccaggacccaaaggcctcggcggcggcgtcggctgcctgggtggcgtccgcggcggtgccccaggcgacctctccgacggtgctgccgtttccggggtccgtcacgtgcttggagctgccggcggcgtgccaggtgccgttgacgaggtgttgggctgatttgaggttcacggatgatgcctttcgtggggcggggagaggaccgggacggcggggcgggcgcggacgcccgccgccgccgtcgtgatgctcatcccttgctggcgccggcggtgatgccggcaacgaagtaccgctgcaggaagacgtaggccaccaccacgggcagagaggccaggatgacgccggcgaacagcagcgggtagtcggtctggaactcgccctggaagctcagcagcgccagcggcagcgtgcggttgccgggggactggatgaacagcagtgggtacagcagttcgttccagtggataacgaacaggaagatggcagccgcggcgatggacggcgcggacagcggcagggcgatggagacgtacgtccgccaggggccggtgccgtcaatcgaggatgcttcgtagagttccttgggcagggtccgcatgaacccgcccaggatgaagacggcgatgggcagggtggacaccaggttcgccagcaccagcccggccaggctgtccagcagccccaaacggccaaagaggacatacagcggaaccatgttggcctgcgccgggatggccatgcccagcaccaggaagccgaagatggcccaggacatgaaccctttgagccgggagacggcgtagccggccaggctggccaggaacagcgtgagcgggacggaaatggcggtgacaatcacgctgttcatgaaggacgagccgaggtcctggccgccgatcacctcggcgtagttgccgggggagagggactgcggcaggctgaacggcccggcaaacagttcctgcgtggacttgaagctgccgaaccccaccacggtcagcggaacgatgatgatgaccgcgtagatcgcgaggattccgcggcgggttattgacgagagcatgctgtcattcccccttcggggtgaggcggagcagccggcgctggagccaggtgaccagggcgatcatggccatgaagatgatcgactgggcggcggcgtagccgaactccgagttggcgaaagtgctgtagatgcgggtggagaggatgtccagggactgcttgggcgggttgcccgcgatgcccaggatcaggtcgaaggccttgaacgactgcacggtggtgtaggccaccacaatggacgttgccggggccacgaacggccacgtgatggacttgaactgctgccacttgttggcgccgtccatttcggctgcctcgtagagttcccgcggaatagcctgcaggccggcgatgtagaccaccatcatctgcccggcgtggaaccacacctgcgtcacggccacccagtacaacgcctgggcgtcgttgccgaggtaggagctttggagtgcttccagtcccacgccgcccagcactgcattggccaggccgaagttgggatcgtagatgaacttccagatgaaggccactgacaccgaggacaggatggtggggaagaagaacagcgcgcggagcaggacgcttccccgcgagttcttggtcagcagcagcgccaggatcagcgagaagaacgtctgcgcgatgaccaccagcagcacgaacttgaggttgttcatgagggcgttcgtgaacagcgagtcgttggtgaaggcgcggacgaagttgtccacgccaacataattgaatgccgccgagaagccgttccagtccgtaagtgcatactggaaggcctgcagcgtgggcatcaccaggaagaaggcaatgacggcgacggcgggaagcgggaagaggtacagcgccggattcacccgcgtgggggagcggcggcgccctttattggcattcacatctggagggctgcctggtgccttccgcttcgcaggcagcccggtatgggtgctcatatccgttcatcaacaatcttctgggcggcctctgctgcctgttcgggactggtgcccgagatgacggcggtggcgctggcttccacggcgttgcggacatccaggttctggaactggaaccgcgcggccagtgctgtgttcttatccagccaggggctcaggcgcttcaggtccgggttggtgtagtccacgtccttcacggacacgtgctgcgccgtctcgttggcgtagtaggcggcgttctccggctcggagaggaaatcgatccacgcggccgctgcggcctggttcttgctggccgagttgacgcccaggatgaaggtggcgttgtacacgccctcatacttggcgttgccgtcggaggtgttggggaacaccagctcgatggggaactgggcgcccaggccgcggacggcggcaatgtggtacgagccggtggcaagcatggctgcctggccctgcgagaacaggttctgggccggctccacggcggtgccggtggcgttgggctgcaggtacgggaccaggtccttgtactggttgagcatcttgatgaaccagtcgtcggtgaccttcagcttgccctgttcgatctgggcgcacatgtcgtccacgggaccgttgttggcgatcatgcagttgaagagctggccgccgtttccaacgtcgccgccgggccaggagatggggataacgccggaggacgccagcttctcgcacatggccaggaacgagtcccagtccttgggggcgagttccgctccggccttgtcgaacaggtccacgttggccatgggcatggggaacaccacctggtacggcagtcccagctggctctcgccagatttgccggcggagagcagcccttcctggtagttcgagacggccttgctgtccttgagctcggtgtagatgccggcctcggtgaagttcttgaactgggcaccgcggaaggttgcaaaggcgtcgccaatggagccgccgcgaagcttctgcagggcttgggcgttgtagtcgttggacgtcgagatgtcctgggccacttcaacgccgtcgtgcagtgcagcaaaccgcttgaccagttcgtcgaataccaccttgtcttcgccgcgccagtgcgcgaaggacaccttgccggtgatgtcaccggtggcgggggcggcggggccggtggcaccgccgggcgccgtggatccgccgggaccggcgcatgctgctgcggtggcgccgaagcccaaggcccccaggagtgcgatggcctgcctgcgtgaaatctgactcacaataatctcctcgttgagtgttttgctgtgcctgttgttgactgcggaacggggttgccacggttctgacgctgtggccctccaggagtgcttatgcgttggtcctttgcgcggtgacgacgtcatccaccacggcgcagaggcgctgcagccgccggacggcgtcagtggacagggattggacgacgtcgggcgctccgatgcaggatgcccagacggcgcgtccggagaggaagccgctggcaccttccaggcaggcccaccgcacggcatccgggaagacgtcttcggggacgccggaggagagcaccacccaggggccgtcgatggcgttggtgagctcggcgcatgcggcccggacttcggcttcgggggcctggccgtggaaggggacctcggccttgtacaggtctgcccccaggctgcccagttccctggcggcggcgaggatgccggcgttccagtcgaagtctccgccggccaggggtttgcgggagacgggctcgatgatgctgatgagccctgcggaccggcaactttccacgaattcgcggaccatgtccaccctgccttcggcgggctcgtccgggcggtacagcaccaggagtttgagggccttgacgcccagggccttgtatttgtgcgggtccaccaggcggtcgatggttacctcgcccaccagctcgccgtgagcggattcgaagtggtccgccgaggcgatcagcccgcagttggggtccaccacgttgtccgcgatggcctggtccagggcgaactgccggtcaatgaggacgccggacgcgtagggggtgaggattttggcggcctgcagcttgaagtcctgcaggtcctggtccgtgacgggctggtcggtgtgttcggcgaacatgttgcgcatggcttcgcgctggtcgacggcgagcatcgcgaaggcgcctgacgggcgctggaggggtgagaggtctgtggggctcatgggctgcttctttcagctaggcggtgtggttggaagtaaggacaggtgtaatggtctggtgcgggatggcggagcggccgtccagcccttcgcaggatgcggaagcggtgcggccggcgaaggctgccgcgtcagccagggaaagtccggcggcgacagcggcgagcagggcgccgtggtagacgtcgccggcgcccagggtggagacgatggcggcgggtgttgcgggcacgtggagcgggtccgcggtcccgtccttgacccaggcaccgtcggagccggcggtggcgacgacggcggaggcgccgtcgtcgaccgcgtggcccaggagcgcctcgggggagtggtgcccgccgtactctgcctggagccgttcgatggtggggacgtagagggccacgccctgcgggctgaaggacgcgatggggttgccggcatccacgctgatgttcaggctgccggcgctgaaggcaggaagggatgcgacggcgttccagcccaggtggtccacgtggacccaggctgccgattccaccagttcatggaagcggctgccggccggaaagctgaccggcggcacgggccgggtgacaatcgcccggctttcggatgccttgctgaccacgatcacgctggcacccgttttgacgctgggatcgcggatcaccgcggaggtgtccacgccttcggcctgcaggccggcgatgatgcggtcgccttcctcgtcggtgccgaggacacctgcgaaagctgtgtttgctccggcgcgggccgctgccacggctgccgtggcggccgggccgccgcccgccgtcgcgaagtccgaagcgacggtacggctgtccgctgcggggtaatcctccaccaaagcgatggagtcaagcgtggcgcagcctacgaagagcagggttccagttgacggttggggcacgttccacctcgttgtagttccggctggtactgaagaaatatacacacgctatgttggaataacaacactttctgtatagttctgtttgggatgcaacgccgcggtccccccaaaactcaacgtagagaaacggagcagcacatgtcattgccttctgcggaaacggtccggaccatccgatacggcctcatcggcgccggccacatggcccgcgaacatgtccgtaaccttgccctgattcccggaagccggatcaccgccgtatctgatccccagccgtcatccctggaggagaccgttgccgagatcggctatgaggtgcagaccttcccctcgcaccaggaactgctctcttccggcctggtggacgcactggtgatcgccagccccaacgacacgcacctggccatcctcaaggacattttcgccagcggaaccaacctgcccgtgctcgtggagaagccggtgtgcaccaccgccgcgcaggcagatgaactcgagacgctggccgcggactacccggcacctgtgtgggttgccatggaataccgctacatgcctccggtccaggaagtcattcaggccgcgcacaacggcaagctcggcaacatctacatgctgtccatcgtggagcaccgtttcccgttcctgcacaaagtggatgcctggaaccgcttcgcggagcggaccggaggaaccctggtggagaaatgctgccacttcttcgacctgatgcggctgatcctgcaggatgagcccgtgcgtgtgtacgccagcggcggccacgacgtgaaccacatggatgaggagtacgacggccgggtttcggacatgatcgacaacgcctacgtgattgtggacttcaagggcggccgccgcgcgatgctggagctgtccatgttcgccgagggctccaagttccaggagcggatttcgatcgtgggggatgccgcgaaaattgagacgctcatccctgtggcggccaaccactggatcgaaggtgatgaagcggaagccacggtcgagttcagcccgcgttcgccgctcggaccggaaaagcatgaggttccggtggatgaagcagtgcttgctgcgggcgcccaccacggctccacctattacgagcatctgggctaccggaaggcgatcctgggtgaaggcccggttgaggtgacggtggcagatggcctgcagtcggtccggatggggctggcggccgagcgctcgatcgtggaaggacgccccgttgagcttacgaatgccggtgccggggtacgtcactaggtaagttggtgttggaaaagcaacacgccgcgggctgggggcctgcgggtggggcaggaagaaggggatatgagcaccgcacgtgaagaggcgccgctgacgccccgccagcgcaccatcctggaggaacttggccgacgcggctttatttccaccacggacctggccgagacctttgcagtatcggacatgaccgtgcgcagggacactcgggtactgtccaaactgggcctggtcagggtggtccacggcggggtcagcgccatccatggccaaggccagaacgcggacttcgccgcccgcgtgcgggaggattccgacgcgaaactccgggtggcccgggcctgcgtctccatgatcggggaacgggacgccatcatcctggacgccggcaccaccacgtaccagattgcccaggagctgcccagttcctttacgggcaccatcatcacgcactccgcgccggccatccagcgctgcctgcagttgaccgctgcccggaccatctgcctgggcggtgaactgctcctggacagccaggcgttcaatggccccatgactgtcagtgctgcggccggtctccgcgccaagacggccttcattggtgtgagcggaatccatgacgaggcgttttacattgagcgggacgtggagcgcgccactaagatcgccctcatgaactctgcggaacaggtggtagtggtagcaacacaccagaagatgctgcggtatgcgctggcacggctggcggccttcgacgctgccgacgtgctggtgacggatgcgcccccgccgcgggaaatcgagactgcgttgcgtgccgcggacgtgaagcttgtggtggccgcgtgagggcgccgctgcaggtttccctgcccgaccagaaactgctggacgcgctcgcgcctgcttccggcgtcgagtttcatgtgtgggacttttccggccctgcacccgctgaacggctggacattgtggtgccgccgtacatgcgcgggccggaggtgctggccgcgctggagtccgtggagatcggcctgatccaaagccagtcgatagggtacgacggcgtggcggacgtgctgcccgcgggttgcgttttcgccaacgcggcaggggtccatgaaacgtcgacggctgaactcgccctgggcatgatgatcgccagccagcgcggcatggacgacttcgcgcgcaaccaggccagcggcacgtgggacaacagccagcggcccagccttgcggaccggcgggtgctgctggtgggttacgggggagtgggcaaggccatcgaggcccggcttctgcccttcgaaacgcgagtgacccggatggcgagccgtgaacgcgaggattccagcgggaagatctttgggatcgactcgctgtatgagcagcttccgctgcacgacatcgtggtggtcagcgtgcccctcatcgagcagacccggcagttggtggatgagaagttcctggccgcgatgccggacggggcgctgctggtcaacgtggcccgcggggcggtggcggacacggatgcgctgctggccgagacgtccacgggccgtttgcgtgcagccctggacgtcacggatccggagccgctcccggcggaccatcccctgtggaccacgcccggcgtgctgatcaccccgcacgtgggcggggccagttcggcgatgttcccccgcatggtccggctggtccagcagcagattggattgatgctggagggcaaagcgccggtcaacgtggtgctgggcggggctgtcgagtaggggctcggcacgagtctgggcgttatccacataggagtctgggcagcctctgattgtcaggggtcgctggaagactgtggttatggaggcaggtgcggggaacccggttatgaaagcggcgccacacggcggcgttgctttcgcctgcgtcgctccggctgccggtgcttcatccgccgcggtctcgggcgccgcaattgtggcccaagcgccgtccggttccacggttgaggaattgattagcaaggtccggcgactgggggtgtcctctaacagtgccgcgttgattgaccagttgcggggcctggaggagctgaaggcggccattgcggctgcgcaggcgagggttggtgtggcgttcgatcttgcccagcgcgctgagcaggccgaggccgggataccggttgcggagcaggggcagggcgtggcggcgcaagttgcgttagcccggggtgagtcgccgtcccggggcgggtggctgctcgggctggccaaggcgctggtggcggagatgccgcgtaccctggctgcgctggatgctggcaggctgaatgagtggcgggccacgctggtggtcagggaaacggcgtgcctgagcgccgcggaccggtgcgctgttgatgaggagttggccgctgatacgggtacttttgccggggccggggaccgggcagttatcgccgcggcgagggcggcggcgtatcggcgggatccccgttcggtgacgcagcgggcggcgcatgctgccggggagcggtgcgtgagtctgcgtccggccccggacaccatggcgcgtctgaccgccctgctgccggtcgcggagggcgtggcggcgtatgcggcgctgagcgggcatgctgacactgtgcgcgccggcggtgatgagcgttcccgggggcagatcatggccgatgccctggtggagcggaccaccggcaccccgggcggtgtcagtggtgtggagatccaactcgtcatgaccgacaggactttgttccagggtgattctgaaccggcacgccttcccggttacgggattgtcccggccggctgggcccgcagcctgatcaccaacggagccaacggagccaacggtggctggggcaggactcggggatcagcggccagcgcccaccaccccgcagccggtgagcaggagcccgcagcaggcgagcaggatttcacggtgtggctccggcggctctacaccgccccgggggcgggggacctggtggggatggattcgcgggcgcggttgttcccggccgggttgcgccggtttatccaggcccgcgatgacacctgccgcacgccctactgcgatgcgccgatccggcatcacgaccacgtcgtgccctggcatgccggcgggaccacgagcctcggcaacgcggccgggctctgcgaggcctgcaaccacacgaaggaaaaccacggctggaaaaccatcccgcggccgggcccgaggcacaccatagaatgccggacgcccaccggccacacctaccactcaacagcacccccaccacccggaagcccggtagctggtctgttggtgcgtgccacgaagctggttcgaacttagctacccgggtgcgcgccacgcagcttttggctgctggccttgcggatggcgttggtgacgcgatcgagccgtggtgagtccaaggtccaggtctgccagtaaagcgccacgtcatggtgctcgcgctccttcaacaccgccagggagccgtcggcgaggtccgttcccagctgcagctcgggaatcattccccatccaaggcctgccctcaaacctgcaaggaacccctcggatgaagggatgaaatgtgttggcggcgcctgctgtacgccgcgggcctcgagctgcagctgctgcaggttgtccttggcattgaactggagcatgggcatgcgctgccagtccacgccgctgccggctttgaagcgcttgcgcaggcccggggtggaaacgggcaggtagcgcatatggccaagccgttccacccggcatccgttgaccggcgtggggtctgacgtgatcgctccgagaacgtctccgcggcgcaggaggtggctgctgtggtcctggtcttccacatgcaggtccagggtggtctcaacccacgtgctggcctcgtgaagcacgtccacaaaccatgtggccagggagtctgcattcacggcaatgggcgttacggcccgggacgaaacaccgtttcccagcgagtcccacgtttccgcctcaaggacctggacctggcgggacatgcgcagcaggatcgagccagcatcggttggggtgcacggcacgctgcggcgaacaacaacctgccccacggacttctccaagcccctgatgcgctggctgacggcggagggactgatgcccaggagatcggccgcggcctcgaaagttccctcgtccacgatcgctgccagggcccggagatgctcgaagttcatgaagatattctaatgcaaatgcacaatatatcgtttgtcttcatctgcggcaccgggctacggtcaaggcatgtggagcatttggagtaccgggctgatgacgggcctggcattgatcatcgccatcggcgcccagaatgcgtttgtgctccggcagggaatccgccgtgaacacgtcggcgtcgtggtagcgctctgcatgatcagtgatgcgttgctgatcctcggcggaacggtggggattggggctttggtttcccggttcccgctggcactggacgtgctgaggtggggcggagctgcctacctggcatggtgggcgctgcggtccttcaggtccgcatttaagccttcaaccctgacggctgaggcgccgcggtccaagggatcggtcatcgccaccacgctggcgttgacctacctgaatccccatgtgtacctggacaccgtggtgttgctgggcggcctggctaaccagcacggtccggacgcgcggtggatcttcgcggccggggccgtggtgggaagcgccctctggttctcggccttgggatatggcgcccgaaagctctccggagtgctcagcagcccgcggacgtggcggattgtggacctggcaatcggcgttgtgatgctggccctggccattaaactcgttctgggctgacacggtctccggcggggagtactaccgcctgaattcgatacggacggagttgtcgtccgggaggacgatgaccgttccgtcccggggcgtccagccgtcgtggaggaagaagaagcgcccgccgctgaggaccagcagacggaggccgtcgtaccggtagagtgctgcatccccggttcccacctggacctccgtgaccgcggccgagccgatgcccagcggcttgggcgagtagacctccgcccggggcatgtactggacgcccttttcgaagttcaacgccagccgacggcccaccgcctgggcgtagtcggccgtgccccagaagagcagcagcgtcacgatactgaggatcagcgtggtttccaccgcccgctgctcggagctgagggctgtcaatgtgcggtcccggccctgccggcgcaggcgcatgcaccaggtggccaccaggacgcccaaagccatcacgtacggggtgaaaagcgctgtccgggcgggttccacaaccgccaggaccaggctgatccccacgagcacgccgctgaacagggcggcgataccggcggccctgacaatgagggcccggccgcggtcctcttcgatgcggcggcgcagccagcggtccagggccagccagacgacgctggcggccaggatgcagacgagcggcaggaacagcgcgttgatgctgatcaggatgtagtcctgcactgcgtacccgaacaggctgacgttcaggcccatctgtgccgcctgtgcctccgcgcgggcccagccgaagtagaacaggagggccgttgccaccgtgaccggcgggccaatggccgagatcactccaagggcgcgggaccacgaggaacgctcgtccccgccggcctcggtcatggcgcggtgcctggcgcctgcgggcatgtgccctggtccgttgcgtactcgaaggaagcggatccggtcaccggccaatcggcgtcggcaatgctgaccccggccgtggctggctgccccggttcgaggggcggtgccaggaagtagaactcaagcggatggttattgtcgatgaagctttggcgctgcaggaccggcgccgtcgtggcaccaacgtaaaccgagcggacggtcccggtgggcaggccggtgatgtttccggacaggacaattgcctgcccgggacagaccaggaagggcggcgagttgccttcgctgtcctccaggcccgagagttccggcgggcatgcggttccgcggcgaggggcaagctccacggaggcgcccggattctgttgccggaccacagctatggtgcggaggatctcgatggcggtggcggaccagcagtcgccctcgaatggcggcggcatggtgtccagcgcagaggctcccgcatcccaggcagcctggtctcccgacaaacccaggcacagcgttttcgccgcttcttcgacggtgttgaaggggctggtgtactcgggaagggatccgcagtccatgcccctcaggttcctgtaccaaatggggtcgcccctgcccaccgggccgatcggcagccagtcgagcaccacgg

SEQ ID NO: 26 - DNA, 81028 bp, Arthrobacter sp. OY3WO11
ggctgcgttccccgctggcggtggagccgcctccagaaccgccgggctcggtgggctggttcgcttgcgacgtgctgctgggagccggctcgtcaccaccgccggtcgccacgcaggcaggcaggaacagcgacagggagaccgcccagatgaaggcaatcgggcggcgggtgcagatgtgcatctcgcaccatctctatctgtactgcctggggtccagccttgtatgggtccggccggccagggaaagcatcgaccgccgggaggtcattgcgtccaacggaattaaaccctgccggcgttactgcggcgttactgccggcggacggcgtacgacggcgggtggggccgccgaagcagccccaccttgggtgcctccctggcaaagttggcggcgccgccgtcctccgttgcctggatgtgctgacgctacacggcaggctcgcgacgccgccggaacaccatgcggaggttgtcccggaagctcaggctgctccgccggctcaccacaatcacggcagccacggccgccagcagcacgatgatccctccggccgccaccgaccagcgagcgccgaactccgagccgatccagcccatcaggggagcgcccacggcggttccgccctggaggacggcgaggtacagggccagcacccgcccgcggaactggggctccaccgagagttggatgctggtgttgcagctgttcaggaaggtgatggaggccaggcccaccgggatgaggactgctgcatacagccagaacgacggtgacacgctgcccaggagcgtgaacgcaccaagcccgagcgccccgcccagcaggaacctcagccggggaccggccctgcgcgcggcaaggagcgccccggccagggtgcccactgccatgatggatcccagcagcccgaattcgccggcgcccaccccgaactcggtggtggccatgagcgcgttgatgatggggaagttcatcccgaacgcgccgaggatgcccaccaggaccatgatcagcaccaggtccggccggttgcgcacgtagcggacaccttccgccacctggtgtttgcccctgctggccggagccgcgggagcaagttccgaggtccggatccggaacagtgagatgatgaccgcgccaaaactggcggcgttaagcaggaacaccggccccgtccccacccaggcgatcagcacgcctgcgatggccgggccggtaagcctggccgtgttgaaggacgcggagttcagcgccaccgcgttggagatgttgtcctggcccacgagttcggagacgaaggcctgccgtgaaggggcgtccacggcgctggcaattcccaggcacagggctgccagataagcgtgccagagttcggcggttccggtgaccaccagcagccccagcgccagcccggtcaggcccatggccacctgcgtccacagcaggattacccgtttgcggtagcggtccgccagcactccgccgtacggtccgaggagcagcatgggaaggaactgcaggcccgtggtgatgccgacggcggcgccggagtagttggtgaggacggtcagcaccagccagtcctgagctatccgctgcatccaggtgccgatgttggacaccagcgcgccgctggcccagatccggtagttccggttctccagggcccggaacatggcgctcatgtgccgctcatttcctgcatgatgtgcgcagcgcggctcaggatctgccggtcctcgtcgctcagcccggccacccgctgcgccagccacgccgtccgctggttccgggcctcggccagtacagcccggccggcgtcggtaatgtccacgcggacctggcgcccgtcgtcggggtttgccgccctggacacgaaaccctggtctgcgagcgcgttgacgatccgcgtcatggacggagcctgcacgtgctcgctttcggcaagggcgcggagggtactgggcccgttgccgttcaggagggccaggaccgtgtactgccccggggtgatggcgtccccggtggcctcgacgcggagccgccgcgaggtgcgcatcacggccgtgcggagatcgatggccaggctgtccgggccggtggtcctggggttctgggtgtcggtggtggtcacgccggctttgcgcctcctgaaaatacttagcactgctaattagtcctgctaataagtatgctcctgttctgggcgtccggcaaggaagtgtgctgggactaacagcctttcggcttattccgatagtttccatgatcatgcgaaaaggtcgggccgcagagttctccacggcaaataggggcgcgcaaaaagagaaactcccgcaccggctcgcgtacagcctgccattcgctgattctggccgtgccgcgggagcgcactttcacttcacagaaagctgttgttattgctgaaactttacgatagtttctacgtgtgatgcaggtcgcaacggtggggagccggcggccacttgcctaccgaaggacaatgatgaccagcgagcctcgcgccagcacccccgaaatgcgcctcaaacgcctgcacgagcggctgggcggcatagcgtacggcggggactacaacccggagcagtggccccgcgaggtgtgggaagaggatgtccgcctcatgaaggaggcaggcgtcaacctggttacgctggctgtcttttcctggagccggctggaaaccgcggacggcatctatgacttcggctggctggaccagatcatgggcctgctgcacgaaaacggcgtcggcgtggaccttgccactcctgacgccgtcccgccggcctggctcgttgcccagcacccggacatccttccggtcctggcggacggcaccaccttcggtttcgggtcccgccagcacttcgatgtctcccaccccgcctaccgcgcaaagtccctggccatggccgagaagatgggggagcgctacgccggccatcctgccctctgcatgtggcacgtcaacaacgaatacgggcccgtttcctacggaccccacgcggaccgggccttccgtgaatggctgcagcagaagtacagcagcctggacgatctcaacaccgcctggagtacggacgtctggggccaggtctactcggactgggcccaggtcaacgcccccgcgcagccccgcacctggtccaaccccacccggcgcctggactaccaccggttcacgtcggacagcatgctggcgcactacaaagccgaacgggacatcctgcgccggcacaccccggacctgcccatcgtcaccaacttcatgcgcttctacaagaacaacgactactgggcctgggccgcggaggaggacgccgccgcactggacatctacccggacccgcgcgaggaagacgcccacgtggccgccgccctcaacttcgacctgatgcgctcgctccgcaagggccagccctggctggtcatggaacaggccaccgccgcggtgagccagtggtccgtcaatgtctccaaactccccggcaagatgcgcctgggctcctaccaggcgatcgcgcagggcgcggattccatcctcttcttccagtggcgccaggccaagggcggcacggaacgcttccactccggcatggtcaaccatgcagggcccaacacccgtgtcttccgggaagtctgcgaactgggccgggaactgaaggaactgggcggcatcaccggcacacggtccgccgccaaggtggccgtggtcttcgactgggactgctggtgggccctggagctgggcaactcgccgcgctcggacctgaattacacccaggaagtcctccgcctctaccggcccttcttcgacgcgaacattccggtggacttcgtcaacaccgcctcagacctcagccagtacagcctggtggtcctgccggcgtcgtacctcctttccgacgatgccgtgcaaaggttcgagaactacgttgccggcggcggccgcctggtggccagctatctctccggcatcgtggacccggacaacaccatccgcctgggcggctacccgggcgccctccgcaacgtcctgggcgcctggagcgaggagatgcacccgctggccggcgagggtgaggaagtaaagatttcaacggccgacggcggcacggcctcggccaattactggactgagcacctgcacaccgaaaaagcggacgtcctggcgagctacgcgtcgggacggcttgccggctcacccgccgtcacccgcaacacgttcggcaagggaaccgccgtctacctgtcagcccgggtggacggcaccttcctggaggacctgctcgcggccgagcgcgctgctgcggggatccgcccggaactggacgctccgttgggagtgcaggtccgccgtcgtaccggcaacggacgcagctacctgctggtcctgaaccacaatgacgcccctgcccgcgtggacgtcaaagccggcggcgcggaccgcctcaccggcaacgccgtccggggaaccgtcgagctcgcagcccacggcgtcctggtgattgaagaacccacagaatccaaccccgcagaaaccgcccgataggaggccccaccatggccatgcgactggaagtacctcccgaggcggtcaccccggacccgcccggcaccacccggaaccgccgcaacaaacccggcagttgggggcttgccctgaaacgggactggcggctgtacacgctggtgctgctgccgctggcctacttcgccgtgttccgctacctgcccatggccggcaacgtgatcgccttccggcagttccagcccggcggcagcatcttcggcgagaaatggatggggctgaagtacgtcaccctgttcatcaacgatcccagcttctggcaggcgttccagaacaccatcatcctgggcgtgttgaccctgctgttctgcttcccgatgcccatcatcttcgccttgatgctgaacgagctgcgctcgcagaagttcaagaagttcgtccagaccgtggcgtacctgccgcacttcatgtccgtggtgatcatcgccggcatgatcctgcagaacttctccatgaccggcacggtcaaccagatcgccaatacgctgttcggcaccacggtgaacttcacccaggacgccggctggttccgccccatgtacatcagctccgaggtgtggcagaccatgggctggggcgccatcctctacctcgccgcgctgacccgcgtggacgaatctctgtacgaggccgccaggattgacggtgccaaccgctggcagcagacctggcacgtgacgctgccggccatcaggcccaccatcatcaccctcctgatcctgaacatcggcacgttcatggcagtgggcttcgaaaagatcctcctgatctacaacccgctcaactacgcaacgtccgatgtcatctccacctacctgtaccgggtgggcctggagtccagcaacttcagctacgccgcggccatcggaatgttcgaatccgtcatcggcctcacgctgatcctctcagccaacgccatctccaagcggctcgccggaacgagcctgtggtgaaagggccaaccatgaagggcgaaaccatgaaccaggccggcaccacgcaaggttccagcacgacaccaggcacggcgccgggcaccgcgggggaggaaactgccggcagcaggccagccggcgccaagccccgctcccgcgccgggcgcagcccgagggaaaccggggtcctggtcaaggacatgaaggtctcccgcggcatgcgggtgttcaggatgttcaacctggtcttcctgctggtggtggtgttcctgaccctctacccgttcctgaacatcattgcccagagcttctccagcgaagggttcatcaacgcgggccaggtcaacctgttccccatggggttcaacaccgaaacgtacaagctgatcctcgccgactccactttctggaacaactacggcaacacggtcctgtacaccgtggtggcaacggccatctccatggtcctgaccaccagcttcgcctacgccatcgccaagaaggacctgaaaggccgcagcctgttcatcggcatcgcggtgttcaccatgttcttcaacggcggcctcatccccaactacgtgctgatcagctcgctgggcatgcgggacaccctgtgggccgtggtgctgcccaatgccatcagcgtcttcaacctgctcatcatgaagtcgttcttcgagaacatgccccgcgaactggaggaagctgccgccattgacggtctgtcccagtacggcgtgctgttcaaggtggtccttcccctgagcaaggcgatcgtggccaccatggtgctcttctacgccgtggccaactggaactcctggttccaggccttcctttacctggacaacccggatctgttcccggtgaccatctacctccgcaacatgatcgccggggtaaccaccgcagactctgccggcggcacggcggagaacctcggccagatcgcggcgaacatccagtcggtcaccatcgtcctcaccgtcctccccattttgtgcatctacccctttgtccagaagtacttcttcacgggcgtcatgctcggttccgtcaaggaataaccccttatgaaaggaaaacccatgatccgcagacgagagttcctgggcctctccgccctcgccgcattcggcctggtggcggcaggctgtgactcagattcaggcaccaaggtggacacctccaaggcccgcaccggagccatggacagctttggggtgggggacacgttcaaggcgacggcgccggtgagcttcaccttcctgttcagcgaccagccctcgtacccgttcaaaaaggactggctgctgttcacccagatggccagcgccaacaacgtcacgcttgaacccaccatcgtgcccagcagcgattacgagcagaagcgcagcctgctgatcagctcgggcaacgcgccggaaatcatcgccaagacctacccgggccaggagagcgcgtacgtctcttccggggcggtccttccggtcagcgactacgtggacctgatgccgcacttccaggacaaggtgaagaagtggaagctcgagccggagatcgccggactcacgcaggaggacgggaagtactatgtgctgcccggcctgcatgaggagctgtggccggactacaccctggccttccgcaccgacatcctggagaaggaagggatcgcggatccaaaaacctgggacgagttccgcgaggtgctgcgcaacctgaagaaggcctacccggacgtagtgccgttctctgacaggttcaacggcaacagcgtgctgaacatcgccggcaacgcgttcggcacggtggcgggctggggcctggtggacgggctgaacttcgacgaggacaagaaggaattcgagttcgccgccggcacctccaggttcaaggaactggtcacctacttcaattccctggtgtccgagggcctgatggaccccgaaagcttcacccagacggacgattcagccatccagaagttcacctccggcaagtcgttcgtgatcagcgcgaactcgcagaacatcatcacctaccgcacgtccatggaacagtcgctgggcaagggcaacttcaccgtccgcaagatcaccgtccccggtggcccggcgggggacctcatcggcggctcgcggctggagaacggcatcatgctcaactcgtccgtgaaggacaaggacacgttcgtggcgctcatgcagtacattgactggctcttctacagcgacgccgggcaggagttctcgaaatggggcgtggaaggtaccacgttcaccaaggaaggcgggaagcgcgtccttgccaaggacatcaatttccagggactcaacccggccggcaccaaggacctgcgtgtggagtacgggttctccggcggcaacttcgcctacggcggcaccacggacctgctgcactccacgttcaatgaggaggagcttgcgttccaggaggccatgaagagcaagaccccgaagccggtgtccccgcccgtgccgttcagcgacgtggaccgcgagcaggccaccctggtgctcaccccgctgaaggaccacgtcaagcagaacaccctgaagttcatcacggggcagcggagcctgggcgagttcgacgcctacctcaaggaactggacagcaagggcatgtccaagtacgtagagttggcgaacaaggcgtacacgtcctaccaagccaacacggacaagaagtaggaagtacgacggcgctggccaccttggccggcaaccgagaggcagtgcgtggttcagaataaagcggaatacggtgccggccccctgttcagggcggccggcaccgtcgccggcgtgatgatgggccacgccctgctggtgcttgccaacgtgctgctggtggtaacgccgctgctgggcaactggctcctggtgctgctggcctgcgttccggttggcccgtccctggtggctgccatgtacgcgttcaaccggctgcttgccggccatgacaccggggtgttccgtgactttgagcggggctaccggatgaactttgtgcaggccctggtggtgtggctgccatacctgctggtgatggccgtggtcaccttgaacctggccggcctgccactcatccccggcgccggacccggcgcggaacccgccatccgggcggcgctgctggtcctggggctcctggtggcaacggcgtcactgaacgcgctgctgctgctgtcccggttcaccttcccggtgcgggacatctaccggctgtcgctgtacagcttcggtgcgcagaagagggtggcgctcggaaacgccggcatcctgtttgtggccgccttcctgctgctgatgaccaccacctacctgatgctggtggccgccggggcactggtgttcctggtgtgcctcaactcccggccgctgctgcggttcatcgaggacaggttcaccgcctaggaccgcgtcctcacgggctgcgatcgcagcagcaaatggcgtagctgaaggaaccgggactcagcgcctggtctcgtacctggtcaggaccacaccgtcggtaaacgtccgggtctccaccaggctcaggttcacccagttgtccagagctgtgaagaacggcgtgccgccgcccaccaggaccggatgggtgaccatcaggtactcgtcgatcagcccggcccgcatggccgccgcggcgagtgtggcaccgacgatgtccatgaaaccgccatcgtcggccttgagccgggtgatctcggtgaccgcgtcgccggtgaccaggcgggtgttccagtcgaccgtgctgatcgtcgaggagaacaccattttcggcatgtcccgccaccggcgggcgaactcgatctgcgccggtgtggcgccaggctgctggtcagcggtgggccaatgggagctcatcgtctcccacagtttgcgcccgtacagcgccaggcccgtcgcccccacccggtcggaccaccactggaacagctcatcgctcggcacgctccagccgaggtcatcgccgggcgcggcgatgtagccgtccaggctcacgttcatggcgaaggccagattgcgcatggtgtcagtctcccgtgcgtcggcattcgttgtacagaccagcggacgcgtcagctcgcgggcaaacctcgacgccggtgacagaagtgccctgcacgaaactgcattctgctcaatagtcctctgcaccaacaggcatcttttccgaatccgcctgcacaacctgcaggaactacttctttggtgcctggccgctcctgctgccgggacccatcggtagagggtgggtacggagactcctagcgtgtcggcgaccacccgcggcagtgttccttgtttgaggagattgcgggctgagcggatcttggtatctgtcatgatgcgtttgcggccgccgacgcgtccttgttggcgcgcctcgctacttcacgaatcaattaccgcccatgcgtggtgaaatccgcatgcagaactcctggccctgcggagtccttcaccgccgagcaggcgcgggatatgcgagactgtcccgcatgactgacgccatgcgcagctattgggacaaccaagctgcgaatttcgacgttgaagctgaccatggactggctgaccccgccgtccgacgagcatggagggaattgctgttgcctctgatgccgaagcccggcagcgacgtggcggaccttggctgcgggaccggcagtctttctctgctgctgggcagtgccggacaccaggtttggggtctggacttgtcagagaagatggtggacatggcctgggctaagacggcacacgctggggtatccgctgagttcgtggtgggagacgcctcatcgccgccccgcgctcccggctctatcgatgttgtgcttgcccgccacgttttgtgggctcttcctgatcctgacgccgcggtggcgcgctggaccgggctgctccgaggtaccggcaccatgattctcatcgaagggctgtggggaacaggtgcaggaattcccgcggaacgctgtctggagctagtccgctgtcaccgcaagaatgccaccgtgacaatgttgacggaccctgcgctctggggcaaagaaatcacggacgaacgctacgtgatagtcagcacgtcctagcggcgtaatccggccggacatgtgtatgtcatctattggtggcttccgctggacggctatttccgcccaccgggcacaatgaagtcgtcctggaggaccagcagagatcgaccccgaactgctcggctggagcaacgaaggatgtgcccgcaaccacgtccgagtctcgtaccggggcccataattatgcgcatttaattatgcgcattcggaaagaatcgggctctcctgtcgtttcagaagctggctgcacaaagttccccctgtatttcagggtttgtgcagacagcttgtgaccagtagctggcctgtacccctatgcacaaagctccctttcgatcgatactcctattcacaaatgcacagacatgtctggaaaccccagaatacgaggcatctcacgagtttgtccgaactcagctgcacgagcgggtcgtcctgttaggcggagctgcgctgaagaccacgggtctaaccacgtctggcggttctgcccttgtaggtttgggtcatacattagaaatactgttaccaacgtctttcggggcggagcggagtatgcgtgggtttggtgattgcagaattaaagaggggttatgtaactgacggtgaccggttgaacgtgattactcaaggattcgccgatggtgcgactggtcctaccagcggtcgtcgtgcgagcggcttgctaaccgggacggagaaggaatgacatataccggcagtgacgtagaaggcggggccgagaatcaaaaggcccctagatcaaaaatgaaatggtattggaagctggctggattactgttctttggctacaccatcttctatatgttgatgcccgttctgaactcagtagggattgagagcatccgatgtgagattagctcggcaaaatcgcatacaagttccggtggctctagaggctcggcttcgacagcaggcgttctggtcgagacgactaattgcgggaaagttcatgtgtccacaggggtgactttcgataatcaagacgaagtggctgcatccttcaaagctggcagcgaatacgagttcgaccttggttggttctccagagtgtggaccaaagacatcgggcaagggattccatcagtgaacgactatcggttggttgactgatggttccgctcgctggctggaactttggggccgacggatctgcacaaggccttactggaaggaatgtcccatgcgcgcggtaaaggcgtatataaggatcctcgcggccgcgacggccgtgctcatggtgggaatgccaataaccgcatgcgctgagaaggagccagggaacacaatgccagagaaggcgacgccagaacagacaatgactgcccgggagggacgggaccgggtggtcgaactcgtcatgaatactaccaagcagctcaaggtcaccgggtggtggccccgtaacggcgtggcgtgggcgcaggagtgctccctgggagagggagagggcgaggagggtgccagttatggctatgaccgctgggcaccccaaggaacagagcatattgaggacgcgaaacgcgtagccgagtactgggagtccctcggcatgaccgtacgtaccgtgaacccgacaacgcacccgaccgtcttcgccgagggcgggcccgtacttcgggccagcttcgatactgatgcatctgacaagtcgtacagcattggtgccactgccccgtgctcaccgggagaagcggttgccttgaacgacgaggacgaagcagagcggaatcaaggcaaagtactccccggagacgaaggcatcgtcgttcgcgaagacccgccgcaataactccacgatgtacatccaatcgggcagggtcatacggccgtaacccgttgcgcaccgggcgtgtgtgcaggcgtctcctttggacggtgcagccgatacgccttgtcagctacgccgacggttgcgggtagtgccgggttcggcggcggcgataccaggcctggctcatgaacgtgtcatcgagaagaattcgtcccatgctcagtccgaagatgcggtgcacctgcttcagcgcggctttgaaagcactgtgtcgatgctcgtctgggccgtagacatcgttgatgcttcccattccaccccgcaggaggctgccggtcatcaaatagattccgcgacgttcttcttttgatgcagcgacctcgagtctccgtgccgtagcgccaaatcccccggcccagtatcggccggtcgtgttttcaaacgcctccagcgaggcacacagcacatccagcgcgtggatacccgccgtttggtcatcagatttccagcctcgtcctcgtcccatacccctcaggctaaatcacagaatcgcggatttttcaccgcggacactgcacaaagctgctcaggccagttgcggagctaacacttggatgctgcatcgagagaggcaaggtcacttaccgcttggagtcacagccgctcaggcgctttcggcggaagggggcgcttcgtcaagagccgggatgcgcttgccttgaccgctggggagggcatgtcccgaataccttgtccgattagatggccgggaaggtgccccaacttcaacgctctgccgtctcgtaacccttgggtggcgagttcaggtggtgagtgcaacaccctgaactcgccgttgtacccaccgttagttatgagacacgttgggagcagctgcggctcagatgtgctgggtgatcctcaccggcgtcagcatttcgcggtcgaaacccaccacgcggcgctcgccgtgaaggatcacttcatgggtgtgcacatcctgcgtgctggaggtggccacgtgcagtttcactaggccgggcgtgaccacgcgcttcaggtccacgccggtgaaggacgtgcggtccgcgtgcacggtgaactcgaccgctgccgaggacccggccgcgagttccacccgggcaaatccgatcagctcccggaccggccggaccacctcgcctaccggatcctcgaggtaaagctgcactacctcggcgccgtcaacggccccggtgttggtgaccgtgcagctcacggtgaccgcttccgccgtcgacatcgcaggagcgccggccacgtggtccgagaacgcgaagcttgtataggaaagcccgtgaccgaagccgaatagcggcgacggatccagggcgctgacgccggacgggccggccagccggctgcgcaggtaggtgccgggctgcccgccgggggtgcgcggaacggacaccggcagtttgccggaaggattgacgacgccggtcagcacgtcccagagtgcctcgccgccctcctcgccgggaaagaagccctggatgatggcgctggcgcggtccacgaagtccccgagcgcgtagggccggccgctgaggaccaccacgacggtgcgcgtccccgcagcctcggcagcagccagtacgcggtcaagcatgcggtgctggtcacccgggagccggaggtctggggcgtcgtttccttccccggacgtgccgcggccgaagagtccggcgttgtcgcccacggcgatcacgcaggtgtccacctcggaagcgatagtgcacgcctcctcgatctgttcctccgtgatggtctcgcaggtgccggtggcggcactgcggacggacccgaaacgggaggcagcagcgtcagcgacggtggggatccggatgcccatcggcacgtcagggtgcgaggcacccacgtgggcgtcgaaggagtagcagcccagcatcgcgaacgggtcctgcgccagcggccccaccacgccgagtgcgctcaaggtgccgggcagcggcagcgcggggccgccgtcgtgcgtcctgttgctcagcagcaccagcgactgtgctgcgatctcccgcgccagctcgcggttcaccgccgggtcaaggttgatggttccggcggcaagtgccgggggagcggggttgaagtccgaggacagtagtccggcctcctgcttctgggtcagtacccgccgcagcgcggtgtccaccagtgcctcggcaactgcgcccccgcggacccgttcctgcagcggcatgccgaagcaattcaccgtgggcagttccacgtccaccccggccgtcagggcaagggcggcggcttcgccggaatcggcagccacgccgtgggtgacgttgaggaaggcgacaccgaagtagtcggccaccaccgtcccggcaaaaccccactcgtcccggagcagggacgtgaggagtgcacggttggcggccgccgggaggccgtctgtatcggtgtaggcatgcatcacggaccgggcaccgccgtacttgatggccagttcgaacggcggcagcatcacatccgccagctcccgcgggcccatggacaccggggcgtggttgcggccggcgcgggacgcggagtagccgacgaagtgcttgagggtggccacgatccctgccccctccaggccctccacgtaggagctggccagaattcccaccaggtacgggtcctcgccgatggtctcctccacccggccccagcgcagatcgcgcaccacgtccagcacaggggccaggccctggtggacgccgagctgccgcatctggtccccgatcagccctgccatgcgccggacaagggcggggttgaaggtagcgccccaggccaggggcaccgggaacgccgtggctttccaggcggccaggcccgcgaggcattcctcatggacctgcgcggggatgccgaatcgggacgcggccatgatctgttcctgcgcggccgccagccggcgtgcaccctccagcggctccacggggaccgtgccgtacatgcgggtgatctggcccaagccgttggaaatcacttcctcccaggaccggccgtcgccggccatctcgttctgcaggggagccacagagtcgccgtccgttgaggcattcacccagacgccggccagctgcgccagcttctcttccagcgtcatctcacggatcaggcgttcgacggcgtcgctgccgccgcccggaacgctgtcctggcttagtgcttgcttctcggcggcaccgctcgtcacgggcttctcctagggatcgtgattgcttctctgaaactatcagaaactcattacaagtttctaggcttaaaatccttgacgtgggatggatttgctccatacggttgattgcaggtgcggatagcagctcaaccttgtcttcgaaacttctgtattttcctagaaagtttcgaaacctttactgcaacgacggagagatcatgcggacgtacagagtggccatcgtgggaaccggcgggatcgcggcggtgcacgcggacaaccttgcccggacaggcgggagggcggagctcgttgccgcatgcgatgtggaccagggcaggctggacgccttcgccggccagcacggcgttgagggcaggtacctcacccttgccgacctgctggccggggccaaaccggacattgtgcacctctgcaccccgcccatgttccacatcgaccaggccatcgaatgcctggaggcgggcgtccacgtcctgtccgagaagccgccagcgcttagcctcgctgactttgaccggctggagaaggcgcaggcaaagggcggtgcccagttctcctgcgtcttccagcaccgctttggcgatgcgtcggcggctgccagggaactgatcggagccacggtattcggccgtcccctggtggcccgctgtgacacgctctggtaccggccggacagttactgggacctgccctggcgcggcacctggaacgcggaaggcggcggacccaccatgggccacggcatccaccagttcgatctgctcctccacctgctgggcccgtgggaggaagtcaccgccatcgccacccggcaggaccgcgccacgtccaccgaggacctctccgcggcactggtccggttcgagaacggcgcggtggccaccatcgtcaactcgctgctgtcgccccgggaaacctcggacatcaggatcgactgcgagttcgccaccgtggaactaagccacctctatggctacagcaccgataactggaccattactgccgcccccggccacgaagaacaggtcaacaacgcgtgggccgggcatccgctggagcgggggagcgggcactcggcgcagttcctggccatgtatgacgcgctcgacgccgggcgtccccttcccgccggcgccgactctgcacgccagacccttgaacttgccgccgccatctacgcctccgccttcaccggcaccccggtccggcgcggcgacatcgtccccggccaccccttctacgccggcatggacggcgagggactgggcgccgaagtgctggacgccaccgccctccgcgcccgcgcctgacaattcacactttccaaggagactttttatgaccacccccgcagccaccacaacccgccagctgagcgtccttgacgacggcgccgccctcagcttcaccgccaacggccggaccatcgccacctatacctacaaacccaccgacgaccagtacgaaagccccaggccgttcttccacccgctgaccaccctggacggcgacgaggtcaccatttcgcgtccgtgggaccacgtctggcacaagggactgtcctgggccctgcccaacgtgggaaagcacaacttttggggcggcgccacctacacccgcgccaccgagtacgccaacctggacaacaacggcgccatgacccaccaggcattcgcggcggtcaatgagactgaaaccgggatcacggcgtcggaatcccttacctggacctcccaggacggcgaaccggtcatcgcggagaaccgccgtttcagcatccagctcctggatgccgaaggcacggagggcgcctacgccatcctgttcgagtccgaaatgggcaacatttccggcgaggtcatcaccatcggaagccccaccaccgagggccgggacaacgccggctacggcgggctgttctggcgcggcccgcggtcctttaccggtggtgagttccgcagtccggagggaaccggcggggacgaattcatgggatcccgctcaccatggatcgccttcaccgggaagcatgacgacacctgcaggtcctccaccatcctcttcacggaggacagcgccaaccccggtgcccccacccaatggttcgccaggtcatcaatgttcgcgtgcctgggctcggctccgttcttcagccgggaggtgccgctggaggagggctcacccttgacctaccgctacgccgtggtgatcgccgacggcgccgtggacgaggcgcgtgccggggccctggccggggcggcgcagcaggcactggaaagctgggcatagccgtggcgtccactttccccggggccaccggactgtccgaggtcaccatctatgactggcccggcgcggacggctgcgccggcggttcgccgcacatgcacaccgcctccacggaagcgtatgtggtgctggaaggcacaggccggctggagaccctgaactcggacggattcacctccacgccgctggaaccgggagtggtgctgtggttcacccccggaacggtgcaccgcgccgtcaacgactcgggcgacctcaaggtcctggtggtgatgcagaacgccgggctgccggaaaacggggacgccgtcatgacgttcccgccggagcacctcgcggacgccgcatcgtacggaagggccgccgcgctggagatcaaggatgccgacgccggactggccgaaggggaagaggcggcccgccgtcgtcgtgacctggcgctggaagggtactttgcgctgaaggccgccgtgattgagtccgggcccgcggcactggcggacttccatgccgcggccgtccgattggtggctcccaggaccggagcctgggccgaggtgctggctggaggcgcagcggagcaggcggagactacccggcagcagctggcctctctggacgtggcggaaagtttctacctgggtaaggcgcggactaccatggggcaacggaagaatcgcaggacttacggcatgtgcggccgcatccagacgtgggaactttccgatagctgacccgggcgctgtcccggatgaaaggacggcttggtgagcaagcaggacacgggacgcgccacgatcagtgagattgcgcgcgaagccggggtctccgttcccactgtttccaaggtgctgaacgggcacgcccatgtggcggcggaaacccgggcgcgggtggaggagatcattgcccggcgcgactatgcccggcgcccggccaagcagcggaagaaggccgggctggtggacctggtgtttccgggaatgggctcggaatgggccctggaaatcatcgagggcgttgagcgcgtggcacagcttgccggctacggcacagtggtgagcagcctcagcctggacggctcgcgcatccggccgtggctggcgaacgtagcggagcggaagtcggacggcctgctgatggcggtttaccagctggacgccaagcagatccagcggatcaagtcgctgggcatcccggtggtgctgattgatccggtggggcagcccggcccggacctgatgacggtgggcgccgccaactgggacggcggatactcggccacgcagcacctgctgcagctggggcatcagcggatcggcatgatcggcggccgcgaggacctgcagtgcagcagcgcgcgcgaggacggctacagctctgcgctgcgccgggcggggataacggtggatcctgccctgatggttcccggcgacttctccatcgagtccggcgaggccgccacccgcaaactgctgcagctggaggaccggcccaccgcgatcttcacgggcaacgacgaccaggcgctgggtgcctaccgggcggcgcgcgccgccggactgagcatccccgaagacctgtcgatcgtgggtttcgatgacatccccgcggccgaatgggtggagcccgggctgaccaccgtccgccagccggtagtgcagatggccgagacagccatgcgcgccttgctccgccacctggacggggacgaggaactgccccagcggatcgagctgggaaccgagctggtggtgcgcggctccacggctcctccgcgcaagggctagccggccgcagccggctgttgcccgtggtccaacgcccatagggtggggccatggctgatacattcccgtccctgattgaagcattcaagaacattggcgtctccaaggcgtacggttccccggtccagctcggaggggaagaggtcattccagtggcgctggtgtccttcgggtttggcggaggcggcgaggccgggccggacggtgcgtccggcggcgggggaggcggaatggtgctgccgcttggtgtgtaccggaacgtcggcgggcaggtgtccttccggcccaataccgtggtggcactgttttgcctggtgccagtcatttcggtcgtcggggcggcggtgcgtaaggcgatcagggccgcgaaagcgtagcgggaaagcccggcggcaccgggctgcgaatcgatgccgggggtcagcgcgcagggactgcgcgggcgcgttgaccccgggtgttactgcgccgttctgcgagccgggaagtgccgtggcgctggtaccggccgtcccgccgtcgtacgcccgggtctagactgtccgcatgggtgacgtggacgatttccttggcgccatggctgagcctgaacgcggctgcctgcagcgcgttattgcggccgcgcggcgcattgtcccggacgccgaggaaggccgaagctacgggatgcctgccctgaagctggacggcaagccgctgatcggggtggtggcggcagccaggcacctgtccatcttcccgttctcacccgaggtggtggacgccgtcgcgcccaggctggagggcttctcactgtccaagggcaccgtccggttcacacctggccatcccgtcccggatgacgtggtggaggagatggtccggctgcggcgggcggagatccggaaatagccaggggcccatgcggctcttagggaacaatcgcaggaaggcaaccgtgaaaaccaacgaactgctgctggacgcctttggccggatccgcgagaccgtggaggccacccttgaagggctcgacggcgggacgcttgccctgcggccaggcggcaccggcaactcgatcgcctggctggtctggcacctgggacgcgtggaggatgcgcaggtggcggacgtcgccggccgcgagcaggtgtggacggcgcaggattttgtgggccgtttcggcctgccgttgtcccggaaagacaccgggtacggccattccagtgagcaggtggacgccgtgcgcgctgaggcgggactgctcctggactactacaacgccgtccaccggcagacgatggacttcctggagaccctcggtgacggcgaccttgaccgcgtcgtggacacccgctgggacccgccggtcacgctcggcgttcggcttgtcagcaccctcgcggactgcctccagcacgtgggacaggccgcctacgccaagggaatcaaaccgccgcagggccagtaaaaatccactatttccgtgggcgcaattcggttccataatggcctcgtaggcttcggggaccctggcgccattgatggctggcggggcacgcagagttccaggtggccgccccggcagtggcgcgaagggcggccatgcgctccgcaccggactgccccggggaagcgcagacgggggagagcaaccgccatcagcgcgaacaagtgcacaaaggaatcaccatgctcaaggattcagcaatcatggctgtccttcccgcgaaggacatcaacagggccaaggatttctaccgggacaagctggggctggaaccgtccgaaaccatcgaggacagcctgatgtaccgttgcggcaacggcaccagcttcctcatctaccagaccgacaacgccggcactgccaagaacacccagatgggctgggagacggacaacattgaacgcgacatggaggaactgcgcggccgcggcgtcactttcgaggactacgatttccccggcctgaagacggagaacggcgtgtccaccgattcattcggaaaaggcgcctggttcctggacagcgagggaaacatcctcaacatcgcccagcgcgcgtagtccagggggcggttcccgaaagaagattacgacggcggcgcgcgccgccgtcgtccgccgcactgtggtgcgcggagcttttatccgcagtgttacaccaaggatcaaggcgggatcaagacactatcaaagttgccccaggcttcccgcggtttccgcatttccgggtttcccgggaaataggctcctgaccataaccacttgtggctaagcaaaaggcccggcgtgctgccgggcctttgtttgttgggggaaagaatcaatgacgaaccatgggaccgggctggggcctgcccagcctgctccggggcccggaccggggccgggccggcggccacggcggaagtccggcgccatcgcactcggggtgtccctggcactcttcgttgccggtgctgcttcactgcccgctgctttctccggaggcctggcgccggtcgccgcgcagagcacagctacggccgccccctccatagccagcacggccccaacagccagccccgcgccgtcgtcagctccgccagtcctgcagacgggcgcgccgctggatcccgagaacactgccctggtggcgcagggtgccacggtggaaactccggggccgcagcccgccttcgccaccaaagcggcacacctgctggccactttgcccatcaagggccgcgcccccaagacgggctatgaccgcgccctgttcgggcaggcgtgggcggacgtggaccggaacggctgcgacacccggaatgacattctccagcgcgacctgacgggtatcacgttcacgaacggtgtgccctgcaaggtgcagtccgggacgctcgcggacccgtacacgggaacgtccatcagtttcctgcggggaagcgggaccagcagcaaggtccagatcgaccacgtggttgcgctcagcgacgcctggcagaagggtgcccagcagttgaccacggaacagcggacggcgttcgccaacgatccgctgaacctgcaggcgacggacgggcccaccaaccagaagaagggcgacggcgacgccgccacctggctgccgccgaacaaggggttccggtgcgattacgttgcccggcaggtttcggtcaaagcgacgtacggactgtgggtcacgctggccgagcacaacgcgatggccgccatcctggccagttgcgcggaccagttggcgcccacgaaccaggctccggccgctccggcgcccgcaccagccgttgaacctgcgcccctggttggggcacctgctcctgccgccccggtgcctgctcccgccccggctgctgtggcaccggcacccgtcgtgcccgcaccggtggtggcggctcctgcccctgctgccccggcacctgcggctgcctactacgccaactgcgccgctgcccgcgcagccggcgccgcgccactgttcgccggtcaggccggatatcgggccgggctggaccgcgattcggacggcgtggcctgcgaacgctgacccatcgacttggggtttacacgccccattgcatcaccatctcaaccatttcctagggggaaacaaacattgaagaagacactgtcattagttctactgaccggcctgatgctcactggatgcggcggcgagcaggcagcggtgcagccggcagaaacccccaccgcagttgcggcggttgaagaagccgtcacgcttccggacgtgatgggcctggccctggataaggccacggaccagctggaggatctcggatttgaggtcgaggacgtggataccgccgaggggaaatccatcatgctgacgaagaactggcaggtgacctcccaggaccccgcgggcggtgcaaaggtgtccaagggctccacggtcaaactcggcgtcacatccctcgaaaagctggctgctgagaaggctgcggcggaacaggttgctgcggagaagatagcggcggaaaaggcagctgctgagcaggccgctgccgcacacgccgcagcggagaaggcagcggcggacaaggctgcagccgaccaggccgccgctcagcaggctgccgcagagcaggccgcccaagcagcggctgagcaggcggcacgggatgcagctgcccgacagcctgcccccgttgcacccgctcccgcggccccggccccgtcgtcggtctactaccccaactgcgcagccgccaaggcggcaggcaccgctcctctgtaccggggacagccgggctaccgttccgggatggacggcgacaacgacggcgtagcctgcgagcgctagccaccagcgctgacaaaaaagaggccgtggataccttcttttgaaaggtatccacggcttttcattgcggcggcgcgtgagggtttgcttaccgggtgggaacgacggggctgcgcctgccgaggggtggcggtcagccgcggatgtaacccacgatgtccacgatcacatgcgacgtcccggcagacgtgttgcggatagcgatctttccgtcaggcccgatgggaaccacggagaagctggcccgggtctgagctgtttcgaagttcacgttcgacgttcccggcaggccaccaccgcttgggtaggccctcagatggccaaaggacgtcggctcggtcactgtcaggttgatgagcgcggctttcgctcctgccggaactccatgtgcgccgctaactgtcactgccaagtcctggttggcgcccacaggtgctgcagtggcgcgggtatcaaccaggcgtgcaggcagcagcgactcgtaggctccgggcgttgaacctgtacctttccggaagtagcccatcacgtcgacaacaattcccacggttccgggtgacgtgttcgcgatgctgatttttccgtccgcacccacaggtactacagcgaggttcggcgtatcaccggtcctccagtcataattcacgttggatgtggccggacggctggtgccgctggcgtaagccgtcaggtggccgtgacttgtggttgtgacgccgtacgaggctgccgttatgttcaccaccacggcacccacttccggaggcaggggtgcaagacccaccatctggatatcgaaagtctggccgccctgggttccttgcgtgccgcggctgtcggctgcacggaatggagttacaggctggtaggcgccgctgtctgtcgggatgcccccggtaaagtagcccgcgacgtcagcgatcaagtggacggtgccgtcgtacccggcattttccaaagtgatccttccgtcgcggacaggcactacgacggaattcgcaacggtctggcgttcacggaaattcacggtggaggtattcgtactcagtcgtccaaacggataagcggcaacaaaaccatacgacgtcggttcggtaacggtgaggttcaatgacaccgcgctcgcatcagcgggaataccggcccggccgctgacctgtaccacctggttggagttagccgggacaggaccggagagttcccgggtatccaggaggcgggtgggggggcacgggcacgaatttaccggcagttgttgagggtgtgaggccggctgtgtcgtaggaaagggtgcctgcatccagtgtttgtccgttccggatggaaatgacgtgcgcctgttcccggtcacggacgttgcccgaatagattcgtccgagcggaatgaggtagtgggcgtacgggtccacgtttgtttccaggatgtagtccccatcggccagcccgccgataacgaatcttccggtccgatccgtcctgacctgcttttcgtcaagtgagccgtcagaggaggctgctctgacactgtgggattccaaaggcttgccggtgccctcctggatgacgccgctgatggaaccgccccgggtcatggcggcattgatgccggacgtcgtttgtcccagcgccacgttaacgtcgccgccctttgcatagcccgcactctcgggtactcccggatagaactgggtcatgagggatgggccatattgccagggttcgctgaagcggactttgtaggttccggggccggcgttgccgatgagatagttcccggcggcatcagtggtggtgcccctgacgaagcgtccgagggaatcgtagaggttcgcgtggatgggagaacttgcgccggtgacggtgccggagactgccccggcaggtgccataaggagctccaggccggaccgtgtctccccctggttaaggttcagcctctcacccgccgcgaactgtccggcctgcggataccacatggtggcaaaggcgccgttggttgtgttgctgccgaaggagatccgggatgtcccggcggggacctgggggagagcgaaggctccgtcttcgccgaagcctgcagaggtgacaacattgcctgcgtccgagtaaacgcggacgaaacccggttcaggagagattccctgggggaaaaccgccctgccgctaaggctggcaggcttggttaggtcgaagttaatgcctgcagtgctgctttcggccgacagttgaacctgttttgccgctttcttgtccgcaccgctgccgtaccaggtttccatcagcccggtggtaccgggtgtcacccggatggtataggcatccgcccccaagccggtgatgctgtagcctccgtccggcgccacgggtgctgtgcgttccgtggccgtgcggaccatgcctccgggtgcagtgaacgtgctgctggccactaccgccaattgcgcggtgtcagtgccagtgggtgcggaaaccttgccggaaatggtggagccacgtgtcatggtgacgtccagacccttcaggttgcggcttcccaaggccacggtggttgcttcctcctgcctgctcacattgccgtaccaggtgtttgcaaggccggtgtcgcctgccacgacacgaaggttggcgtagtccagccagctgtacggcacccggaagcggccgtccgctgagacgggctcggctgtcctgaacatgtcgctctgggcttcggtgagctgaaccttcagctggtccagccgcgtgccgggcggggccgtgatgacaccctcaacgtagtagacgggattccagtcgtccgctgtggctgttacggtccccatccccaaggccgtcgcaagcaggaaagtaatcaatgcaacaaaacgtcgcgatgcggtgcgaagcacgcggccgccttccaatcaggcggccatggccgcgcccccaaatcgctgtctgagcacagcgaattcagtctagggacaaaacaccaagacgtcatcaatcgtgtggattaagtgcatggtgcacgaagaaagccgtgggtcctcctttcgaaggtatccacggcttcttgccggacactcggccagtaccatgtcagtgcgccgtcagttcgcgcatcagtccgagctgtgacaggaactccacctggtcgaagtagaagtggtgggatgtgatttcgcctccttcaacccgggcgatgtcgcagctccggaccctgacctgcttgcccgtagccggtattgtctctcccgtcggcagggtcagcggcccggtgttcgtccctacgacgaagccctcgtcaatggccacgttcccggcctcgtagctgtcagcgtgctcgtaccggacgtcgggcatcgactcccagaagtggaagagataggtggtgatagcgtcgcgcccggtcagttgcccttcatcgggggtgtaggcaacagcgttggcggcgtagcaccgggccagcgtctctttgtccttgttgtccatggccgtggtgagacggtccatgacttcgcgtgcgtgtcccattgcggacctccaatcaatatttgtgttcaaaacggcagcgtcaccagcgccagcagggccgggacggtggcgcccagggtgcccggaatactgtcgcccctcttcggatagtggcccagcatgtccgccaggaacatggccggagcggtcagcaccatgttcaggcagcagtagacaaccagggtgtagcccaccaccaggtagcccatgttcaccgcggccacccccgccaggactcccaggccgatcaccaggttccggaacccggtggggatggcccacatcatcacagccgtaacgttccgcggcggtgtgctcaggaacttctgcgcccacggccggtgcatcaggaagctttccagcgggaacaccgcgatgtacaccacggcggcgaggaccgcgaagatctgggatacggcgttcatgagggaagagtacgacgacggtgcgcaccttccccatcccctgccagggggttccggggtgctcggggaatccccactttgggggattgcggtgcggcccccggggcggatactggagctatgtgggaggagcgcgctgagcgtgcccggcgggacatcgccgccctggccaccagcggaatgaacctggcggacctctaccccgcggcgctcgccgtggtgcagcggacggtgccgttcgagcaggggtgctgggccggcgtcgacccccacaccctggtgatgacctccatcaccaactggaagccgtggccggttcgggacgaagagttcgtggagtactcggcccgcttcgcagagaccgagtacgcgggcaacgaaccgaacaccttcgcccagctgctgcgccgtccccgtcccatcgcacgcatgtccgacgccccgcaccgggaagtggtccgcagcgtccggatcaatgacctgctcaagccgcagggtctcgaacacgaactgcgggcggccttccgggtggacgacacctgctggggtgtcggcagcatcttccgcgacgccggacgggacttcacggaccgcgaggtggagttcctggctgcggtgacagccaccctcgcggcagccaccaggatcgccgtgcgggcagggcacccaacccgggcagccgccgtcggacctgtgattgtcatcgccggcccgcacggggaactgagggcggcaacccccgccgccgtttcctggctggccggggtggaggatgccttgccgggccgtttcagcatggtgctgtactcgctggcggcgcaggcctccgccgcagtgtccggtacggccagagccaggatgcgcgacgccgggaacaactgggtggtgctgcaggccagccgcctgatcaccggtgacgatcccgagcagatggtggtcaccgtggagcccgctaccacccacgacctggccaccctgctgctggccgcttatggcgtcacggcacgcgagcaggaggtctgcctggaggtgctgtcaggtaacccgacggcggagatcgcccggcacttgttcatctcaccgcacaccgtgcacgaccatgtgaagtcgctcttcgagaaagtgggtgtgggcagccgcggcgaactggtggccagactggtggcctgaaggcccggcggtgccctggaaacgccctcagacgcaagtactgtacggcccttccacgccggtgcgggcgcttgtatgctgtgggtcggagagccgggaagcctggtcggcccgcagtcaatgcctgcggaacgccttggcgccgccaggggcgttcgcgtgacgagccaaggagcggaccgccgatgaatgcagcagcacaacccgttatcgaagcccgcggcctggtcaaggacttcggcaaaacccgggcgctggacggcctcaacctgagcgtggcgcagggggcggtgcacggattgctgggccccaacggtgccggcaaatccaccaccctgcggattctcctgggcctgatccggcccacctcgggcacctccagggtctttgggctggacccgtgggccgagccggtagccgtgcaccgggacgttgcctacgttcccggtgacgtgagcctgtggccgaacctttccggcggcgaagtcatcgacctcctcaccggcctccgcggcggggccgacgaaaagctgcgccgcgacctcatcgaggagttcgagttcgatccccgcaaaaaagcccggacctattcgaagggcaaccggcagaaggttgccctgatagcggcgtttgcccgcccggcgcgcctgtacctcctggatgagccgagcgccggcctggacccggtgatggacgccgtgttccggcgccagattgcgcgggtcacccgggaaagcgccactattttgctgtccagccacatcctcagcgaagtggaacagctctgcgaccgggtgaccatcatccgctccgggacagccgtggaaacaggcaccctgggcgaactgcggcacctgcagcgcacccatttccgcgtcaccgggctggccgatccggcacggctggctgcgatgccgggcacccacagggtgagtatcgccggcagcgccgcggagttcgacgccgaccccggtgacctcggggctgtcctggccggcatcgcggaaccggggatcagcggcctgtcggtggctccgccgtcgctggagtccctgttcctgcgccactacggcgacggcaacgggggacagcggaccggcaacggcaaggacagcagcgagcgcacggacagcggggtgctgtgatgtccggggtgctgcggctgctcccgttccaggcccggcgggacagggtggcgctgcccgtctggatcctgggcatcaccctcctcagtttcgccacctccaccgcagtggccacccagttcggggatgaggcagcgcaggttgccatcctcaccctggccgcagcgaatccggcgttcctgttcctccgcggcctgccggacgggactggcgtgggcgcagtggtgttcttccagggctacgcgttcactgcagtcctggccggcctcatgagcaccttcctggtggtgcggcacacccgctcggatgaagaactgggacgggccgaactcctcggttcgatgcccatcccgcgggccgcgtccctggcggcaacgctgctgctgggaaccgccgcgaatgtggtgctggccgcctttgtggctggtgcctttattacggccggactgcccggcgccggctccgttgcggcgggtgccgccgtcgggggcgtgggcatcttcttcgtggcacttgccgccgtcaccgcacaggccctgccctcgggacggagcgtgaacggtgccgccgcgggactggtcggcgtggcctacctggtccgcggcatcggggacgtgctggggaccccgtcagcggacctgctgcacgtcacaagtgcctggctgtcgctcctttcgcccatcggctggggccagcgcacccggccgttcaccagcccggacctggcgtccctgctggtgccgctcgctgccgcggccgccctggcggcacttgcggtagtgatccgacgacggcgggacgtgggtgccagcctgctgcccgagcgtgtgggcaaagagcgtgggggagtgggcggccggtcctttgtgggcctggcctggcggctgcagcggtccacggtggccggctggtgcattgcggcagccgcgctgggtgccgtcgcgggagcccttggcccggcggtcaccgagaccgtgtccagcctaaggccggtgaaggagatgatcgagcggctggtgcccggcgggcaggcagggctgatcgacgtgttcgtcaccgcactgctgggcatggccggggtgtttgcggccgccgccgggatccaggcggtgctgcggatgcgtgccgaggaagcggaaggcagggcagagaccttgctgtcagcgccggtatcccgtgcccggtggctcggtgccaacctcttcattgccgcagtctccgccgccgtggtttccacgactgcgggagccgctgccgccgtcggcctggctgcctccgggacctccgacgggcctgcctggtcactggtgccggcggcgctggcgcacgtccctgcggccctggtgttcctggccgcagccgcggtcgccttcgcactggcaccgcgggtgagcatcctggtggcgtggggcgtgctggcggtggctattgtcctgggcgaattcggggagctgttcggcctgccggcgtggctgcaggacgcgagcccgttccggcactcatcggccatgccggtggaatccttcaacccaacgggggcagtgggcctgctcctggtcgcggcggccggggccgtgctggccgcctacgtcctgcgccggcgggacctcacagcctgatgcccgcacccaccatgagatggagcgcccagcgatgaaaatggtgctgctgaccgccgggacccgcggcgacgtggaacccttctttgccctggcccgggccgccgcggctcgggggcaccaggtccggattgccatcccggagaactccggcgccgacaccgccggcctggacaccgtcagcctgcgcatggactttgcccggctcgtcagtgaccagggggtgtctccccgggccgcggccaggaccttccggacaacgatccggcccgccgttggccagcttctctccgccgcagtggaacacatcgtggccttcgccccggatgtggtggtctaccacccgaaagtcctcagtgctccggccgcggcccagaggctggggatcccggcggtgctggtggaaaccgtgcccacgctgacccccacccgggagtttccgtcccccatcatctccacgggcagcctgggcccgctcaaccgtgccagctacgcaccggcgagggcggccaccctgatgttcaggcgggaactgcaggccgcgctggacctgctgccgccaggacgtacgccggcaacggaaacccgcgcaacactgatccccgccagttcccacctgcttccccgtccggctgactggccggcctcggtgcacctcacgggccactgggccgacaaacccgcggccacggagattgacgacgagctggcggccttcctggacggcggggatgttgtgtacgccgggttcggctccatgaaggccggcgacgccagggaacggggcacggcgatcattgaagcggcccggaggaacggcctgaggacactggtggcaaaggggtggggcggcatcgaggtgccgccggccgttatgggcggtgacgtccttgtcagggaatcggtggcccaccacatggtccttccacgcgccgcggccgccatccatcacggcggggcgggcacggtccatgccgtggcgcgggcaggggttccgtccgtggtggtgccgttcatcgctgaccagccgttctggggagcagtcctgcaccgtcgaggcctcggcccgcagccggtcccgtaccggaaactcaccgcggaccgcctggcccgggcccttagcgaggcccgaagctgccggaaccaggccgcgcacaccggtgagctgatgcgcgcagaggacgggacccccgtcgcgtttggtgtgctggaaaacctggcgggtacttaaggttccgcggcccggcggttaggcagcaccgggaacgcttgccggccggtgccgggcggggtcgaagttgtcaaaggacgaggctccaatgaggaagatgccccgctgcgggatccagaagccgcccagccgcgtctgcacccgcaggggctccaggctgccgaggtcctggccgttgagcgaagccgagctccgggaaacgaaccacacccggcggggtttcgcccggaagccctgcccgttggggacggcgcccgtcagccccagccggcccgcgcggagcaccggaccggaggcggcgcccatggccttcagcacagtctcgttctccagggccgcggcaggcagggccgacagcaccgccgtcattgcacgggtgacgggcgttgatgccagttcaaggtcccaggccaggtcaacgtctccgccaatgcggacgctgaacgccgagtcgcccgtccaggtgaccgtgatggggcattgcaccgcagcctccaaggcggcgccgaagtagcgggcgcaggacacggcgggcggtgcgtcggcgtagatggtccacgagccggagggccggcgcagccagacggacctgtatccgggccccacactggtcacggggaaacgccgcatggccaggacatggccggaactgaaggaaaggcccatcaccccgtaaccggaaaaccgctcatcatccccgggccccagggcggcactttgttcaacttcgaggacctgcgcccggatgctcttcatggcttcctgcctccaccgtcagcggtggcgtcagtctacgcccggctgttcttccgcgggagtcacccggatccgggagatgcgcagccggtccatcgccgtcacggtgagcacgtgggcggccacctccacgctgtcgcccacccgggggagccggcccagccggtcgatcatgtacccggccacggtctcgtagtggccctccggcagttcgatgccggacgctgtttcgaactcctgcaggatcagggcaccgtccacgtccaccgtcccgttggcccgggtgacgcggtcctcggcgtccacgccggtgtcgtactcgtcgtagatctcgcccaccagctcctccaccaggtcctccagggtgacgatgccgtccgtgccgccgtactcgtccaccaccagcgcgatgtgctggcccagccggcgcatccgggacagcgagggcagcaccttgttggtgcccggcagcggaaggatctcccgcacaatgccccgcaccgggccgtcgtcgtacgctccatcgcggggcataaggtcccggatgtggacgaagcccaggacgtcgtcgggcgttttgtccatgacgggatagcgcgagaacgggccgtcccgcaccatgctgcgtgcctcgccgatagtcatgctgccgttaatgaaggtcacctcggtgcgggggcgcatcacctcctgcagtgagcgctcgccggcgccgaacacgtcgttgaggatgctgcggctgtgttcctccagcatgtcgctctcggccaccatgtcccacagttcctcggagctgatgctctcctgcttggcgtgggggtcgccgccgaagagccgcaccaccgcgtccgtggagacggacagcagccagacggcgggccgcatgatttcggagaggacgcccagcggcggggccaggaccttggtgaagccgacggcgctctgcatggcaaggcgcttgggcaccagttcgccgagcaccagggaaaggtacgccaccaacagcgtcatgccgatgaaggcgacgggctcggcggcggagccgaaaccgatgccttccaggaggggctcgacgtccggtgcgatggtggacgcgccataggcggcggagaagaatccggacagggtgacgccgatctggacggtggacaggaaccggttggggttgcccgccagtgcggcgatccgggccccgcgcttcccggacttctccatgcggcggacctggctctcgcggagggacaccagcgccatctccgtgccggcgaacaccccgcccagcagcacaaagaagaggaccaacagaaagttgagcaaggtgtcgctgtccatgatcagacactaccgaatggcgccgcgcgggttacgctccggggctttgcggcgtatggtctgagggaccatgactgaacagcaaccctatgagctcgtgaggcgctacccgcacttcgagctgcgccgctatcccgcctacgttgtggcggaagtccaggtcaacgcgacctttgaccgtgccggaaacgctgctttccggcacctcttcaactacatcagcggcagcaacaccgcacggcagaagcttgccatgacggcgcccgtcatccaggcgccgggggtttcgcagaagctggcgatgaccgcccccgtgctccagagcggcccgctgcagggcggtgcacccactggttttgcggtggcttttgtgctgcccgcgggcctcactgcagagacggcgcccgtgccgcagaatcccgacgtggcaatccgtccggtccccggctcccttgccgcggttgtccggttttcgggcagcggttcggaggctgcgtttgcccggcacaacgaggggctgcaggcagcgttgaacctggtagggctgacgacggtgggaccgccccggtttgcccgctttgatccgccgttcaagccgtggttcctccgccacaacgaggtgctgcaggacgtcgcggacgcgtaaggaaaggacgacggcggacgccgcatgccgccgtcggacccgcccttcgtggttcatgccttagccaggagtgcgctggtcagggagcgtcgatcaggacgcccggtccttcgccaggaaccggcgcaggaccgtggccgtcagccaggtgaccaggctgcaggcagcggcgccccacaagatgtccgtcacggcgacgacggcggtgaagtccttgagcacggcgaacgcggtcagcgcccaggtggcgtaggtgaagaagccgaacagcgccgctcccgtgacccgctgccgcagggtggcgtgggcgtcgttgggccggacaccgtagtgcaccatcccggccacgaagatgaggtagaaggccaccgcgccggcagcgttgggcctgggggcgatcaggtggccgatctggctttggtagaggttgctcgccacgaagctgatccagacgaggtccagcacggcgaagatcgcggcggtgaccgcgtaggaaatcagccatctcttggtccgggtgttcatgcttggctccttgactcggcgtagaggttctccacgatgtggcgggcgcgttcggtgaacgcggtgcgtttgagtttcatggtgggagtgaccattccgttggcctcactgaggtctgccaggagcagcacgaatttgcgcacctgctcggagcgggccagcttcgcgttggcggcactgaccgccttgccgatggtgctgaggaggcgcgcgtcctcgatctggacggcaccgccgtcgtccgggatccgcagcccgtcgagatcggcgatgccctcgcgctcggcccacgccgtgacggactcggggtccagcagcaccagcccgcccaggtacggtttgccctcgcccaccatgacggcgtgggccaccaggggatcgccctccacgtagccttcccagatggccggggtgacggtcttgccgccggccgtgacaatcacgtccttgatccggcccttgagggtaagccgccccagcttatccagctcgccgaggtcccctgtgcggaagtatccgtccgtgaacgcgtcctggttgtccgctggcctgcggtagccggcgaacacgcccacgccgcgggccagcacctcgccccggtccgagatgcgcacggtggttccgggcgtcggaacgcccaccgttccggcgctgatggcgccgggcatgttcccggtcagcggcgcggtggtttccgtgaggccgtagccctcgatgacgggcaggcccaggccgcggaaaaacagggacagctcggcatccagcgcggcggcgccggagagcaggtagtccaggcggccgcccaccagcgcgcggagccgggcgtagaaaaggcggttgaacacggcgtgccgcgcacgcaggccgaacggggcgcggacggacgggtcggcgtcgtgcgcttccgcgaaccggccgtattcgacggcggtgcgctgcgccgctgcccacacccggcccaggtgtttctttgccgcggcggcggcagcggacgcctggatcttctgcagcacgcgggggaccaccaccaggaacgtgggcttcaggacgccgagggcgggcaccacgtccttggggtcggacaggtgggcgatgcgcatgccgttggccaggcagatcagctgcaggccgcgggccagcacgtgggccatgggcaggaagatcacggtgttgccgccttcgcggaccacgcccgtgtaggcggcgcccacgttcagcacctggcccataaagttgccgtgggtgatcagggcgcccttgggagcggcggtggtgccggaggtgtagacgatggtggccaccgagtcgaggtccggcagcaggcgccgctcctcaacggtgctgtccgggacggcggcgccgcgcttagtcagctcggcaagatccgcgccgggacgtgcgtccatggtccagacgcccaggcttgtccgcccggtctcttcaaagccctggtccagcaggagggcatgcccggcggtgccggcgatggccaggcggacggcggcgtcatccaggaccgcggccacctggggcagggcggaggtttcgtaaacggggaccacgacggcggcggcgaaccacgctgccatgtccgccactgcccattcgtaccgggtgggggacatgatggcgacggactcaccgggctgcaggccggcggcgatgaggcctttggccagggcgcgcacttcctcgacgaactgccgggtggtcacctggcgccacggatccgtgatggcgcctcccagggtccgcacctcgaacgcaacgtggtccggggacgtccggaaccgctgcatcagcagctccgtggcgttgcggtggctggacggctcaaccagcagcggggtggagaactctttcaagcggtgtcctttgtcgaaagggtgtgcaggtggtccttcatcaggagatgggcggcctggaggaaatcggccacggcgtcctgctgggcgccgggcagcgattcgatgtgccggttggtggcgtccatgaggggccgcatcaggtgcatgatgtcccgggaagcggcggcggtggcagtgacatggacatggcggcggtccccttcaccgcggaggcgttcggcgtagccgcgggtttgcagccggttgacgatcgcggtggtggtggcggccgtggtgcctagctccgcagcgaggtttcccaccgtcatgggcccggactgggacagggccgagagggcgcggtaatcggtgaggttcagcctcagcctgcctgccacttcgcgttcggtctcgttggccagtgccagcacagcccgaagcgcgacggcggccggatggtacttccgtgtgctcatgtacctcctctccttcgctagtctatatagtaattagataagcttgtaatcaaatcagtttgaataggcggttgcgccggtgccctgcgcggcttccggcccggcgtgggaaaggaacatcctcatgaaggattcggaccgtaaggcgctcatcatttttgtggtttcggtgctggtgggggcgctcgtcgccgttgccggcagccagggtggtgccaccgtgggcggtttcccgctctttgcactgggggtggcagcggcgttcctcatccagtggctggcctttatccccgcgttcaaggcgcagaccgagaagtactatgacctcaccggcgccctgacctacattggcatcaccgtcctcctggtcctgctgactccgggcgttgacgcgcgggggctgctgctggctgccatggtggtggtgtgggccctgcggctgggaagcttcctgttccgccgcgtcagcaagcacggcaaggacgaccgcttcgacgagatcaagccgtccttcttccgcttcctaaacacctggaccgtgcagggcctctgggttgtcctcaccgcggccgccgcctggatcgcgattacttccgctacccgggtgggcctggactggtgggcgctggcgggcttcctggtgtgggctgtgggtttcggcatcgaggcggtggcggacagccagaagggccgcttcaaggcggaccctgctaatgagggcaggttcatctccacgggcctgtggtccaagtcccgccaccccaactacttcggcgagattgtgctctggatcggcgtgctcctgattgccgtgccggtgctggagggctggcagtgggtggccctgctgtccccggtcttcgtggccttgctgctgatcaagggcagcggcgtgccgcttttggaagccaaggcggacaagaagtggggcggcgagcccgactatgaggcgtacaagaagaacacgccagtcctgattccgaagctctagctaacttctcgggggcccggctgctgataggggcgctgggccctagctctggctgtccgcggtgggtacggtgtccgcatgcagaagatatcgattgatgccctggcccgccagcagctcgaggcggcggtggcggctcccagcgggcgggcggcggacacggccttcggcggccatgaaaagaagctgcgccagacggtcatggccttccgtgccggcactcagctgagcgagcatcagaatcccggcgaggccacggtctacgtgatcaggggatcggtttggctgaaggctggcggtgaggcgtggcagggcaaggccggggacctcctgatcgtcccggacgggctgcacagcctggaggcggaggaggactcggcggtgctgttcaccgtggtcaagaccgaccggtagtttcggtgcggcgcagccgcgcgagcagccacaccgttcgcgggacggaccaggcgagggccagcccgagcaccggcaccagcgagacgccgacgtcggggaactgccggatgatgacggccaggtgggtgtcgaaccgggcaggggcgtaggcgaagcagagccagagggcgaagccgtccagggcgagcgcagccgtgcccagggccaagggcgtcagccggcggttggaagcggacggcccgcggagcaggaagcgcagcacaagccacaggctcagcagctccgccaacagcagagccaacgcaacggcccagctgtactgctgcagccagtcctcgtggatcacagcggccaccggttcctgcccgtgcaggatccgcaggatgttggtgtcgatggccttgagccgggacggtgcggcggtgtcattgccgttcaccaccagagcgacgcccaggccggaagccggaaccagggccaggtaagtatggctgttgccccattcgccctggtgctcaacgagcagcggcagctccgtgtccggaaccggtgcgcttgaggggtcgacggactccacgagcggccgggtgaaccagcccatggcgtaccccttggacccgtccaccctcacccgggattcaaacatcgccgccacactcgaaggcccaaggatccgggcatcaccgtaccggccgccgtcgagcagtgctgtcagcccgttgcccaggtcctcagcggaggcgtacagcgtgctggacggcatcccggcgatgggagcagggacgtcggtctggagccagaacgagctgaaccaccgggagtggcccgcggccatgttgtcttccagggcagcagcccgggtgggatggctgtggaccatgcttagcggcccgaacacgtgctcctccaaatagtccccgaagggctcgccggaaacggcctgcaccaggacgcccagaatgttgaagttggcgctcgcgtagtggaagaccctgcccggttcgcctgccaggggagcgtccgcaagggcgcggactgcttcctccagcgctttcgggtcctgtgagcgggaggcctcgaaagcggtgtcccgcgaactcatgccgctggcctgatggagcaagtgcctgacggtgatggcccccgaacgcgggtcatcaagcgtgaaccacggcaggtaggtctgcacgggttcatccaggcgcagccgcccggcctccacctgctgcatcacggcgatggcggtgaaggacttgctggtggaggccagcaggaccggcgtctgcgcggtcatgggccgtccggaatcgtcagcccggccaaacgcggctgagtgcacgcgggcattgtcacggacgaccgcgatggcggcgccaggaaggccgagcgtctccatctgttcccggaggaacgagtccacggcctggtattcctgcccatgccgggcggacggggcgtggacgacgccgggctcgagtggcgggggagcggcaccaccgagcgtggctgccggcaggaggcacgccaggaggcagcgccctaaccacgagatagtccgcatggctgcacctgcttcggcccgaccgtcctttcacggtagggcgtggcggaagtgaaaacaatgagggcgggcgccttggccgggctttcgctctacgtggtttcttcgggcgggtcaggccttccgccgggcccgtccggggttgtcgccgggagcagggaagccgccatgtagctggtgatgtaccgggcgaagcgtggcagggaccagccgcgcttcagcacgaggagctcgtaaagctcggccgagctgcagacccagagaacgtcggctgcctcagccgctgagacgccgtcgcggaggtagccgcgttccttgagataccgggcgtggtgccgcatcctcttgagacgatcactttcgatgtcctcgagaagggcagccatttcctggtcgttgacggcggccgcacgcatcagcagccggatcggggtgaccatcgaacccacctcggcggtgaggaggccccactcccgcaggaccgccgccggctcggattcacgttcacgcatggcatctgagcgctcatacgcggaaacagtgccggcgccggccagattccgctcgtagagggcacggaccaggcccgccttgccgccgaaggccttgtataccgtttccaccgaaacgccggcctcgccggccacggctgcaaccttggtgccggcgtaaccacccccattgagctgccgctcggctgcctggaggatggcggccctgttccgccgggcctgctcctgccgcccgctggcgttgtaccggcgcttacccttgacgtctgccattattcgttccatgctggagtatcagatacaggcgactgtatcaaatcattcgaggagtgggaatgatgggaacggcagctcccgcggaagaggtattgcagcgattgctcggtgccgtgaacgcccaccggctggacgatcttgcggcctgcttctccccggactacttcaatgaaacccccgcccacccgcagcgcggcttccgcggtcgggaccaggtccgcaagaaccgggtggagattttctcccaggttccggatattcgcgcgcgcgtccgcgggaccgccttacaggatgacaccctgtggaccgagtgggagatggccgggacacggcacgacggcgctcccttcctgatgcgcggcgtggtcattttcagcgtcaccaacgggctcgtttcgtccgcccggttctacctcgaaccggtggaggacgccagcggcgacgtcaacgcagcagtcagccgggtgctggggaacaccccggactccagggagcaggcaccatcatgattcttgtcgcgggggccaccggccagctgggtggcctgattgtccatacattgctcgccaaagggttccgggtgaggatcctggtccgtcaaggggcggcgcaggatgccctggtgatggccggcgccgagccagtcaccggtgatttgaaggaccctgcctccctcgcggtggcctgtgacggggtggacaccgtggtgaccacagccaattcctctgcccgcggcggcggggacaccgtggactccgtggaccgcctcggcaaccggaaccttattgaggcagccagcagtgccggcgtcggccgttttatctttgtgtccaacctcggcgccagccccgccagtccgaaccccttcatggccgccaaaggtgagaccgagctgctgctgcgcggcagcacgatgtcctggaccatcatccagcccaaccttttcatggataagctgccggtcctcgtggtggggataccggctctttccggccagccagtcacgctcgtgggggagggcaggcgtcagcattccctggtggccatgcaggatgtggcacagtacgcgctggccgcggtggaacacccggaatgggacggccgggtactggtcctcggcgggccggaggcggtgtcctggcgtgatgtggtggaggcttttgagcaggagctcaggcgcagtattccggtgcggacggttcccccgggtcagcccatccccggcatgccggacctgctggccgggttccttgcgctgctggagacctacgattcacggctggaggtggcagatctggccgcgcaatacggagtggtgcctacaagtctcaggtcctgggtgcaccgctttgtactggagtcttccggctctccggccggggcggttcataaggcatgaccgctactggttaggctggcgccatggactttcagcttcgtcaggccgcagccgaggacgcggaggcagtggtgctcatgcagacgctggcgcatgaggagtgctacccgcacctgctctcacccggtttcttccgcggacgcagggccagcatcccggaacgggtggaacggcgccggccgcacctggcagttcccgatccgcggatcatcgctgtggacgccaacaacgaactggtgggcttcgcggacgccgggccccgccgcgacgacgacggccccgaagcgctggagctgtactcgatctacaccctccgccggacgtacggaacagggctcggcgcagcactgatgcgtgccgccatcggcgacggcccggcctacctctgggtggtggaggacaatccgcgggcgctggccttctacgtcaagcagggctttcgtcccgacgggaaacgcaacacgctgccacccgagtgggagtcgctgcctgaattccgcatggtccgggacggcgcacgtcctgcaggccccggcatagactcgccagcatgagtgaaggccacacagccatcgactgggattccgcacgcgcgagcaacctggccaactgggaggaccgggtccccctgcacgaagaggcttacggcatcgatgccttggacgatccggaccacctgaccagcgtggtccgtacggacctggccgccctggcacccttcctcccggacggctcagtctcaggcctaaatgtgtgccaccttcagtgccacatcggaacggacacactgtccctggccagggcaggggcccgcgtcaccggtgtcgacttctccccgtccgccctggcgtccgcaaccaggctggccgcgcgtctcggcctggacgccacgtgggtggaggcggacgtcctcgacgcccgcgccgccgtcgggggctcttttgacctggtgtacaccagcatcggaaccatcacctggctgccggacctggaccgctgggcggcccaggtggcagggctcctgcgcgcgggaggaaccttctatatccgggacgggcatcccatcctgtacgcccttgatgagaatgccgaggggctgcagctccgctacccgtacttcggcaccggtgaggcgctgatgtgggacgacgaaagcacctacgcgggtgacggtagggtggcccacccgcggacttacgagtgggcgcatcccttgtccgaaatcatcaactcactcatacgagccggactgcagatcctttgggtcgacgaggggaaaacccttccgtggaagttctcgccccgcatggtggaggtgccggacggtttcgcctggcccgaagccgagcgagacctcgtgccctgcacctacaccatcgtcgcccgcaagacgggggaattgcctactccgtaactgccacgggagccggctcgccagtgcgggaggcgggagtgctgcggcggcgccagtaagcggccaggacggcgccggacacgttgtgccagacggagaaaatggcgccgggcagtgccgattcgggggtcaggtactgccgggccaggcctgctgccaggccggagttctgcatgcccacctcaatcgcggtggtgcgccgggcaggaacaggcagcttgaacaggcgggcggcgccgtatcccagggcgtagcccaggccgttgtgcaggatcacggccacaaggaccagcagcccggcggcgaagatggcctttgcactggcggaaaccacagcaaccaccacggccgtgatggccaggaccgaaatccagggaagggccggcagggccttggtgaccaggcgcggcaggaagagccggatgacaagccccagcaacacgggaagcagcacgatctggacgatggaccacgccatggacccggcatccaccggcatgtactggccggccagccacagcgccaggacgggggtcagcaggggagcgagcagcgtggagacggtggtcatcgccacggacagggcgacgtcgccccgggccaggtaggagaccacgttggaggctgttccgccggggcagcagcccaccaggatgacgccggcggccagcgcgggcggcaggcccagtgccgctgcgatcagccagcccaggagcggcatgatggcgtactgcgccaccacgccgatcaccacggggatgggtcgtttggcgatgacggcgaagtcagggggagtgagggtcagccccatgccgaacatgatgacccccagcagagggttgatccagggtgccagcccggtgaaggcggtgggggtggcaagcgccacggcacctccggccaggatcagcagggggaagagggtgacggcgatgcgggcgctgcgttcttcggcggctgatgccgtcgtcgaagattcgggtaaggaagacatacctaccggattatcacagcggaggttgtgttccagaatcagggcgccttgatgacaccttaatgacggcggggtgggaccgtgcgccgcgctaactgcgcggcgcacggttgagtgtgtactacgtgcggtgcgtactagacgcgggcggattccttctcgcgctcggccggcttgtaggactcccagaaggtggccccggtgattccgaggggccgggggtcgaagaccgggtcaaggccgagcttctgctgccgctcaaagtccttgagcgccttgaaagccggcttctgcagcaccaggatgcccacgatgttcagccacgccatgaggccgacgccgatatcgcccatcacccaggcgtcagcggccgtattcacgcagccgtacgcggcggcgacaaggatggccacctgcagggcgatggtggtggcgcggccgaggctggtgcggaggcccggaatcatcctgctcgacgagttgcccagcaggaagcgcaggttggtttcggccatgtagtagtaggcgatgacggtggtcaggcagaagaagaccagcgtgatggcgatgaacgcggcgcctacgccggggaaaacggagtcgaatccggcctgcacgtactgcggcccgacgacggcgctcgtcgacagcaggccgccctcggcgaggacctcgccggcttcgctgccgccggagaagacgcggtaggcgccggtggagaggatcaggaagccggtggccgagcagacgaacagcgtgtcgatgtacaccgcgaaggcctgaaccaggccctgcttggccgggtgggacacctcggcggcggcagcggcgtgcgggccggtgccctggcctgcctcattggagtagacgccgcgcttgacgccccacatcacggccaggccgatgatggcgccaagggccgagtccatgccgaaggcgctgcggaacaccagggagaggatttccgggagctgggcggcgttgatgaccacgacgatcagggcgaggatgatgtagccggcggccatgaacggcaccacgaacgccgcaacgctggcgatgcgcttcacgccgcccatgaccacgagggccaggaggatgacggagccgacagccacgacccaggacgggatggtccaggcgccgctgatcgcggtggccatggagttggtctggacgcccggcatcaggacgccgcaggccaggacggtcacggcggcgaagacgtagccgtagaccttgaagaaaccggcgcccttggtgtgggcaaacgcgcgggagaagtagtaggccggaccgccgcggtactcgccggtcagcgggtcgcgggtcttgtacatctggccgagggtggactcgacgaaggacgtggacgcgcccaggaaggcgacggtccacatccagaacagggcgcccggtccgccgaaggcgatcgcggtggcgacgccggcgacgttgccggtgccgacgcggcctgacagggacatggccagggcctggaacgaggagacgccggaggcggacttttcgccccggaacagctgctcgatcattcccttgacgtggcggacttgcaggaagcgtgtccggaccgagaagtagacgccggtggcgaggcagaggtagacaagccagtcgctccaaataacgctatttattgctgacaaaacaccgctcataagtgtgggttccctccatggaagagcgcgggtgatgcggttcggggtgcgcgctgttgggtgaacgaaagtggcgcacaccacaccaaaacctgtgaagtgtcgcacaaaagcccggccccagtccatttggccaccacccaagctgttccccgggtcacattggcgaatttgtggtagttgccgcgatgtgcgggagactggagtcctcccccaacgaaagcagttgttccttgatcactctccagcaggacgcagaaggcttcatccggatgaaccggcgctaccccgccagcgtccgcatcaggatcaatttccaggacggcagcaccggcgagttttcaggccaggccctcaacaacgcctacgacgccgcccttgcggagttccgggcgaagaacaacctcgacgcgcgggggtactcccggacgtccgcgggccgctcgaattccggcaacaggatcgactttgttccagtgcaccccgggatgggcgaggagtaggcgcacccgcgcccgaggagtaggcggaggtttgtcagcgggggttctcgagcgagatggtctccaggtgctccgggacgcggaccttccatccgagctggtgcttgatgcgtgcccggagggcatcggaagcgtccggctccccgtgtgtgatgtacgtcatggacggcgcctgaggggcagccttcatccattggatgatgccgttggagtcggcgtgcgcggacagtccctccatctggataacctccgcctcgatcctgacttcctggccgtaaatgcgcagcaacttttcgcctgctgccagggtggcgcccctggttcctcccgcctggtatccgctgaggatgaccgcgttccgccggtcgggtccgtagcttgccaggtgatggagaatcctgccgccggtgagcatgccgcttgccgagatgatgatcatgggcccgccgcggaggttgagcagcttggactcgtccgggctgcggacgggaacggccactttgtacatggcctcaaactcgtggtccttgagccggtgttcctcgcggtgccgctggtacatgccggaggcgtcgattgccatggggctgttcaggtagacggggatcggcgggatggcgcccttggccaggaggcgtgagaggtgcagcagcaccgtctcggcccggcccaccgcgaacgctgcgatcatgaccaccccctgccgcttggccacccgcgtgatgatcccgcccagttctgcttccgggtttcctgccgggtgttcccggttgccgtaggtggattcggtgaccagcacgttgaccggttccagcccccggggcgggtacatcagggggtcgttggcgcggccaagatcgccggtgaagtggacggtccggccgcccagtttgaggtgcacctgtgccgcgccgaggatgtggccggcgggcaggaacgttgcctcgatgcctccgggcagcgggaacggcgcatcgaagtcgcgggtgatgaaactgtcgagcgaccggacggcgtctgctgccgtatagaggggcacgggagggtggtgcgacgtggatcccgtgtggtctgcgtagcgggcatcctcttcctggaggtatccggaatccggaagcagcagcttacacagttcggtggtgccggccgtagcgtacacagggccgcggaaaccgtcccggaccagcgcggggatgtacccggtgtggtccaggtgtgcatgggtgaggacaacggcgtcgatgttcgcgggattgaccgggaaaggcacacggttgcggtcgcggaggcgtttgtaaccctggaagagcccgcagtccaccaggacctgccgtccctgcgaacggaccaggtagcgggagcccgtcaccgtgtccgtcgcccccaggaaacgcagcgtcgggggatgctgctccctcatgcccgctcctggtgctcgatggtgaccgtgccggcgtcgccatccacggtgacctgctggccggtggccagccgctgcgtggccgcgccggtgcccaggacggcggggattccgtactcgcgggccacgatggagctgtggctcagcgggccgcccacgtcagtcacgatggcggaggccatggcgaacagcggtgtccaggcaggcgtggtgatccgggcaaccaggacgtctccgggctccatccggccgaagtcccggggcccgctcagaacgcgggccggagcggtgacccgtcccgaactggcacccgcgcctttgatgacatcgccgcgctggcgttgggacgccgccggcatcatggacccgaaggccttctccatccacgggcgctccgggagcatctgcggggcggcggccctcgcctggccccgccacagcatcctgcgttcctcgacggcggcggcccggacggggtgtgccgctccggtgatagcggccggggccccgggggcggcaaggccgaaatcgacggcggtccgcacctcctggaagcgcagccagaacacgtcggcgggctccgtgatgacgccggaagccaccagccggcgcccgagttccagcagcatccgccgcagcagcggccaggcgagtccgacgtcggccagcgcgtcctcgcggattggcgcggtgtcctgggcccaccggagcagccggagaaaggcggcccggcggcgcggccccagccgggcggccacctgttcagtcagctcctcccggcgctcggtcaacagccgctgccgctcatgcgggtcggtgccctgcccccgcaggtagaacttcaccgtcgccaggagggtggacggatcatccgcggccaccggagtggcgaaatcaaggttgtagaccgcatggccgtagaggtccaggtgctcccggaaggcgaaacgccactcctgccacagggcatcgtccacccctgcgggcggcgatcctgtgcgctggcactcggcgagctccgccgtcggccgttccagcaacactgatgtcagcccggggtcactgcgggcccaggcagccaggtcccacaacgacttctctgcccggatgggttcgctgtcataccccaggaggaacgtctgggccggcggatccccggctcgccggaccagcttgtcgtagaaggtgcggaaggcgagctcgctgctggtggagagcggaatgatggactgcacggccgtgtagtagacggtgccggcatccagcagcgcctgcgcgcccgccagcagttccccgccggtgagctccgccgggggcttcgactgccagtccttgatggcctgttcgtagcgggggtgggagaacccgcgccagccggcgatccccatgtgcgccttgccgcgggccagcgcacccaccgccgtcagcagcttgcccatcatccgccacatgcccgagctgcggtaatagtagtaggcgtagccgttgacggtgggcagtccaacgtcgccgtcgcggatgacgttcttgcccagggcctccgccatcagggcctgcagcgactttgccacggagccgtccaccaggtcggcgaacagcggcgtgaggggatcgggcagctgctccacgatgctggcgcggaagtagagcccgttcgggtacggcacgggccaggcctccggggtgtcggccgtcggctcgggcagcgcggtgatggggcgggactgcaggatgaagaacctgccgccggcccgcgcccactcgatgtcctgcggtgcgccgaagtgcccggcggcccgctgtccgtggccggcaagttccgccgcctcccggtcatcaaggacgggttcacgacggcggtctgccgccaccggctgctcccgggtgccgttctccgcgtagacggtcatgacgtccttgtcggctgtccgccgcgacaccacggagccggtcccggcgtcgaccaccacgtcatcggtggtgaccgtcccgctgaccaccgactcacccaggccccaagcggcgctgatcaccgtctggtcccgccggccgttggcggggttggcggtgaacatgaccccggcggcctcggcctccaccatctgctggataacgacggcgaggcgcacttggccgggttctacgccttcgcgcgcgcggtatgacatggcgcgcgccgtccagagggaggcccagcagccgatcacagccgtggacagttccaccatgccgcggacgttcagggaggtttcctgctgccccgcgaaactggccgtggcgaggtcctcggccgtggcggaggaacggactgccacgggcgttccgctgccgaggcgcccgtagccggcaccgagttcggcggcgatcccggcgggcatggtgccggtggtgaacagggcgctgatccgccgggaggcttcctcgtacgcctggggctccgcctgcggtggcagggcggcgagttcctggatgcccgccgcgaggttgttttcctcgacgaaatgcgagtacgcgacggtggtgagcacgaacccgggcgggactggcagcccggcccagatgaggccgcccaggcccactgccttgccgcccgccgcggcaatatcgccgggtcccacttcgctgaggtccttgatatagctcatggccgcgcgtccttgctgcccggctggggcgcctgggggtgaacctgatgctcacatactggcactgccgggggcgggtggccatgggtctgtaagtctttacccggctgctctgtgagcggctggcagtctggtgctgtggccgggccgggtgtgactcacccatgggtttgcctccgaactgtgttttccggagtgcgctttcttggatatgtccgccctggccgggcccagcatcggttctgtctacagcgctggcctgattagaagcatgcccacttgagcaccaggtgtggcccattacagacctgccacgccgtaacccctaccgatgcgcttccattcccgtccctaaggaggaaagatgattgtggcagagcacttcggcttcgtcgtcggcattgatacgcatgccaaaacgcacaccctcgccatcatcgacacggcaagcggtggagaaatagcgaacgaaacattcccggccaccaccgccggaggaaaccgcgccctgtcatggatcctgcggcgcaccgacgcttcatctgagatggtcctgctctctatggaaggaacaggctcgtacggcgcgaagctcaggcaacaagcctcggacgccggctttcaagtcaccgaagcgcccatcccgaatcaacgcctgggcaggtatcagggcaaatccgattccatcgacgccgcccgtgccgcacgagctgtcttgggcatcccaatggaccgtctaccggaaccgcgctcgggccaaaaccacatggcacttcggatcctctctaatgcgcgccgctctatggcccgggaacgcaccgcggccatcaatgctctgacggctctcctgcgcatcgtggatctcggcgttgatgcccgaaagccgttgaccgtcagccagatcaacaccatcgcagcctggagggaacgggacgaggaatttggaactcgaacctgccgccgagaagccgtacggattgcgaagcagatcctgacccttcaggatcaattggccgaaaaccacgcagaactcgaggctctcgttcaggaagtccaaccggcccttctggaaatctatggcattggtccggtgcttgccgcaatcatcctcacggcctggtcgcatgccggaagagtgcgctccgaggcagcgttcgccgcccttgcgggcacctgcccggtcccggcctcctcaggtggtactacccgattccgcttgaatcggggaggcgaccgccagctcaacaaagcgatctacaccatcgccctcatcagaatgaacagggatccggtcactagagactacgtcgcaaaacgaacaagccaaggacgcaccaaaaaggaaatcatccgcagcctcaagacgtacatcacccgtcagatcttcagacacctcaacagcaaaggttccatgaacggaaaccttggagtagtacccgctaccggctgatcccgcgacatggtttagaaccaagcgcgctgccgcagctgtggtgatggttgcggccaatccgttggtggcgtcgaggatggcggttgctcccggcgcgggaaatggtgaggattaggccgctgttcgtcgcatcgcccgggaagatccagtcagcggtcccgggcacgccctgctgattgaagcaccagtcctccgcggcaagccaacaacggatctgctcgggatcgttctggccgcgggccagcatccgctcccagcgcacctgcggcgtggtcgacgcgaagacgatgacgtccagaaatgccccgcagcactgggctgcggcgtgcacgccgtccacgatgaccagcggggttcgcgggacgtctctgaccccataatcgctgcactgacgcatccagttccccatacattttttgggaagaagaaaaagtcaaaaagacttcatggcggacatgacgaaatatataagcttcattacgcgctatcggaaagaaaggtaattcataaaatgaatcgtctaatgtttgtcctaggcccgaaggcgcttcaggcctagctccgtttcatagccaccatgagcatgaacggatgcctaaccacatcttaatttttggggggattcatggaaactcttgttgattctttgaacaccgagggtcttaagacaatcggatttgttcacactaatcttgcagccgtttcatccgacgcgcttgatggcgactggcaggactttgcttcgagctggtccaacctgcggcccgatacttatatggcagacggtggaaaataccgcttccgccggtactcggagttctcggttgaggggacgacgggggcttcggaattgctcccccatgtgccctacaagcaggaaaaaacggtcaatcacctcaacggcggcattgaccggatgtatgacccctttgaggacagtgtcgtcgaaagctccagtcttgcgtccgttttccggaccgtctcccagtatctcgaggcagtgcgtccggggcgcacttggaaggcccagtgcttccagaaccgtatcctgacaagccaagacgaagttgggcagccggcacctgaaggtgtgcaccgcgatggagttgactacgttctgaccctgttcgtggaccgggtcggcgccgatggcggcgagagcagcgtctatctcgcgtccgaccgcagcatattggcctcgacgcagctcagcgaaccgggtgaatatcttttcgtcgacgaccacaagctgctgcacgacgtgactggtctatctctcaagcctggtcacgaccagggataccgcgatgttctcatcgcgatgttcaccgatacttcagcgtaaggaagcaccggaattgtcgcagctaattcgttccttcgcgcagctcgaaaacgcgattcttgaccccactgacccggtggttacactgttcagcggcggcctggacagcacctatctgctgtaccgccttcaaaaactggggatgcagaacatccacgcagtttccatcgatgtgggtgatgttgaatcgcacacaggaaaacgcgaaatcgccactcacctcggcgcgaccttccattctgtcgacgccaggaacgaattcatcagccaccacgtggcccccgccatcagggctcatgcggtgtacctagggacacacccaattagttcgtcgttgtcccggcctctgctcgcaaaagtcgccgtggagcttgcggagaaaacgggtgcacgcatgcttctgcatacggcgaaccgctcgcaaaactccttgcggcggctgaacggggcaatcagcgccctgaaattcaccggccgctacggaagtccgtacgacctcgatccggttgatcgctcaacgaaaatcgagcacctcgctgctgctggcctgaccaggatggcgcagcgcgtcgtcagcggtgactctaacctatggtgccgggaatacgaatccggattcttggacgacccggaaaaccacgcaatggaacaggacctgtaccagtggacggccaacaccggcagctaccccgaagagataatgagcatcggcttcgaaaacggactccccgtgaacgtggacggccgtgctttggagcttactgcgattattgaggagctcaatcatcgcgttgggaaattcggctatggacgctatagcggcctggaacatctcgaccgcggtgaaaaggtcctcgaggtacgtgagatgccggcggcctggatcctcctgaaaactttgcggcatctggaaacggcttgcctcagcgaacggctgatccgggaaaaaatggatatagaacagacctgggtgaccgaagctgtggaagggcgctggtttggcggactaaggtccgcggcccaggctttcattgagtcctcgaccagccgggttagcggcactgtcacgtggactatgaaccagcgttcagtggatacagtaagcattcacgcgccggacgccctgtaccttcgtgaccgcgaagcctgggaagcggaatccgtcaataacgaaaaggaaggctacgccatgcgttctgatggactgatcctggccgggctgaacagtgtctgatccaactcctctccgggccgcggccaggcgggcctcggttgtcgatgcgttgctgcttgccgtcgctgtggcctggggctcgacctactgggtcgccaaggaactggtcagccaggacaccgtgctggcggttcttggcgtcaggatgacactgaccgccgtcgcactcggcctgattctcgtcttgatgcgcaagcggctacagaagacggaggcagcgatcggctgcatccttggcctgctgctgtcgaccgtctttacgttcgaaaccttcggcattgccgcgaccagtgcgaccaacgccgggctcatcatcagcctcaccatcgtgatgaccccagtactggaaacggtcgtcggaaagcggaagctcagccgcctgttttacctggctgcggtaatcgcggttgctggggtctacttcctcgccacaggcggtgccgcagcatccttcgggttcggcgatttgctgatcctgctggccgccgtggcacgcgcggtccatgtgacggggatgcacaggctctcggcaggacgcagcatcgattcgctaaacctgaccttcgtccagatggccacctgcgcactggtgttcctaatcatgtccagcctctggggcacgccggttccgatctatacagcaggcatggattggtccgcggcactccagatggcgtacctcgtgatcgtatgcaccgttttcccgttctttattcaaatgtgggcagttcgcaagacttccccgaccagagtgagtctcttgctcggaaccgaaccggtctgggcggcagtcatcggcgttacactggccggcgacgtcctaggcccaatcggaatcttcggtgttgtgcttgtgctagctggcaccatgtgggggcagcgcctggaactcaaagctctacctactgcctccgttgccgcccgtgaatctgaagagatccgcactccgacgtcatagtggaaacaacctcaacgggacactgaatcagtagagaagcagcccgaccgggctctcaccggagggctgcctctctactggtagcgcagcacagaacaccgcgaacaactcgttcatgcctaccagcaagcagtggaccgtgcccgggaactcaacaggaacaagccatgaccgagcctccttcgctgtccgagctccccgtcatcggcaacttacctacaaagcatcctggcgaaggcgcggctctgagttgcatccagcgtcactggataacttcaatgccgggttgacggattatagaagcatccaaagtcaggtgccgccgtcataaattacgacggcggcacgcggccctgaccacgacgcctcgctgggcaggcgcccgttggctgtcccttggccgccgttcaccgcgcattccataccgctcggcgcacaaaagatacgtttgcttagcatctgcaccatgattgccggaggccgcggcggcatatgagggactttcgcctctggaggggtatgcgctgcggcagccacaggacactgacgtctttgacgagcaagggagcaccatgggctggctggaccgagaacgaaccgttgccccgccgggattcaaccgctggctggtgccgcccgcggcgctcgccgtccacctctgcatcggccaggcctacgccacgagcgtgtacaagacggcactggtcaagcatttcggcgccagcctgaccgagatcggcgtgatcttctccatcgccatcgtgatgctgggcctgtccgccgccattatgggcacctgggtggaccggaacggcccgcgcaaggccatgttcacctccgccatgttctgggcgggcggcttcctgatcggatcgctcggcatcttcacgcagcagctgtggctcgtgtacctcggctacggcgtggtgggcggcatcggcctgggcatcggctacatctcgccggtgtccaccctgatcaagtggttcccggaccgcccgggcctggccaccggcatggccatcatgggcttcggcggcggcgcgctgatcgccagccccgtgtccacggcgctgctcaaaatgtacgatcccaactccggcgccaaggactgggtggccagcggcgatgccgtgggcaaactcttcctgaccctcgccgtcgtctacctcgcctacatgctgttcggcgccttcaccatcaaggtccctgcggacggctggaggccggccgggttcgaccccgccaaggtcaaggccgccaagctggtcaccacggagaacgtctcggccaggaacgccgtcaagacccggcagttctggctggtgtggatcgcgctgttctgcaacgtgaccgcgggcatcggcatcctggagcaggccgcgccgatgatccaggacttcttccgccagtccgacggcgtctcactggtgagtgccgccgttgccgccggcttcgtggggcttctttccatcggcaacatggccggacgctttgcctggtccgccacctccgacgtcaccggccgcaagcgcatctacatggtgtacctgggcatcggcgccgtcctgtacacggtgctggcgctggccggctccaccaccaccgtcctctacgtggcactggcgttcgtcatcatctccttctacggcggcggttttgccaccgtcccggcctacctgcgggatctcttcgggacctaccaggtgggcgccatccacggccggctgctgaccgcctggtccgccgccggtgtggccgggccgctgatcgtcaacgcgttcctggacgcccagggcaagcccggccagctgaacgccgtgtcctaccagccggcgctgctgaccatggtggtgctgctggtgatcggcttcctggccaacctgatggtcaagccggtggacgcacgattccacgaaccccgcccggaccgcggacgggcacacgaacctgccatggaggcctgagatgagcaccgcacacaacaccggcgcgcaggcgcccgccaaagtatccaccgggaagctcgctgtcgcctgggcgctggtgggtgttccgctggcgtacgggatctatcagaccctgacccgggtggcggcgctgttcgggtaagggactctgctgtcagcgccgctggaacgcccgcactgcctcgctcaccgtcgggtagaagtgctcgggggagaagcgggcgcccatgccgtactgcagcagcctgtccttgaccggacccttgagttcggcgaataccaggtccacgccgtgccgttccagccattcgtcaagctgcaccagctcatccagtgcggtggtgtcgattccggtcacgggctctgccgccagcaccacgcgttcggtgccgggcggcgcctggtccagtttgttgcggacgaaggaccccagcagcgctccgttgccaaagaacagcggtgcgtcgaagcgcaggatcagcatgccggggacgcgttccccgtccggatggcggctcacgtcgtggtatccgggcactccgggcacgtccaccagttcagcgcggtaaggttcccaggcccgccgcaggaagtccaggattgccaggccaacggcaacgccgatgcccgtaagcactcccaggatggtgacccccaggaacgccgcgagcatcaccagcgactcactgcggctcatgcctatgagccgccgcacgcctgcaggatcggccagcgctgcggctgcggcgatgacaatggcggcaagggtggcggccggcaggaactcggtggtgccgggagccacgagcatgaagacgagcaccaggacggcgcccaccaccccggtgacctgggttttcgccccggactccacggccaccggcgtgcgggacgtgctggccgagatcgggaagccgcccagcagcccgctggcggcgttggccgcacccagggcagccatttcatggttgctggagaccctcttgtcctccgccgcggcgagggactgggacagggttccggtatcaacaaaaacgatgagggcgatggccgcggccgcgggcagcagcgccaggacgtcgggccagccgatgccgccgagcgccggtgcgggaagcccctgcggaagggcgcccgtcaccctgacgcgcccttggagttccagcagggccacggcgatgcaggacgcaaccactgcaatcagcacacccggtaccttccatttcagccagcggggaaccaagatgagcgccagcgaggccaggccaatcagcagcgccagcatattggtctcgccggacagcaccttcggcaccgcggcgatgagcctttcccagggcgtgccgccttccacggagatccccaggagggtgggaacctgggacacggccaccagcaaggcgatgccgttgagatagccgagccggatgggcttcgacaaaagtcccgtgacaattcccagccgcagggcggacccacacagcagaatgacgccgatcagtatggccaggaggcccgccagcgccacggatttctcatcgttggccgcggcgaggggaaccagggccgcaacgatcatcggggcaagcgaggaatccggccccagtaccagcacgcgcgacggtccgacagttgcgtagacaatcaggggtaccaccgtcgcgtagaggccggtcaccggtggcaggccggcggcctgggcgtacgccatgcccgcagggaccaggatggcgaaaagcgcagtgcctgccagcaggtcgtggcgcagccactccatcctgtaaccgcgcagggctggcggaacccaccaggaacggatgcccgaacgccgggtgaaccgcctcaccaggtcacggttccggcggcaccgtccaccgtgatgctctggccgtcgtgcagccgcgtggtggcgtcggcaacacccaccaccgcggggatgccgtactcgcgggccaccaccgcaccgtgcgagatcaccccgcccatctccatcaccaacgcgcctgcggtcatgaacagcggcgtccagccgggatccgtggacggggccaccaggatttccccgggttccaggtgggcgcccaccggatccatcaccactctgactttcccggtggcggtacccgcggaagccggcgtcccggccaggcggtccgcggcagctggttggggcagggcggcggccgcggccatcatggcggcttccacgtccgtgccgtccgaaagcagaaggcgcgggacgcgccgccggcggagttcgacgtcgtacagccgacggcgggcggcgacgatgcccttcagggccgcgccgcggaggcctacgcgcagttcgtcgaagtccaggaagaacacgtcaccggcgtcaccgatggtgccgttcttcaccagttccgcgcccacttccgtcagctgccggtgcatttccgcgagcaccagcactatgcagaatttgggcagttcccgcaggccggcaagctgccgtgtccggcgcaggcacagcgccacaaggcgcccccgcagccggctctttgtcccggcacgctccaccagctcgctgatccgggcctcggcgtgctcggcggccctggcgaactggcggtccggtgcctgttcgggatcctccacgcggagatagttggagaccattccgaggatgtgttccggttcctcggaccatctgggcatgcccaggtcgatctccgccacggcccggtggccgtactttgagaggaactcctgcagcccggactgggcgggggcgggcagcgtccccgccctgtagcgggcggcaagctcgccgagtttcagttccatgaatgcccggcggacctccggatcacggcccagggataccgccaggtgccacagctccaggtccatcatggtggtcacgttgtgggggagcccgcgcagcacagcctcaagctcacgcggcttggcaatcccgcgcagcagcctgcgggccgcggccagcgtcaggtagcccagggacgggcccggaagcgtggcctggatcagcccgttgatggaggtggccaggatgtcctcggtgtgctggagccgcctggctgcggtggccggcagggggaggaccagctgggctgccaaacggtcctggtaccgctgcgcccgccgcagttcccggtctggccgcagcagcgcccggaccatggcggggattagccccaggaccaggcccaggctttgggtgccttcgctgcctttggcctgcttccgggcaggggcggttttgcccttgcggccggttttcttgcggggaggccggacaacgctgaaccgcggatcctccaggagggcaggaaggacggcggctgaccgtccgtccacgaggggcagcatcttctccagcgcctggcggccggatttgttgcggaagatcggcgtcagctccacgtacatccgcaatccggggttcgcgtatttccaggggcccttgttgttgcccctcatgagtcccagcacgtgcaggcccatcggggtgatggggcgcgtgagcccctggagcagcgtgccgcacaggtacacgcgggtgtccgtgccgtccgtagcgtctggtgcggcctgcccgttgagcggatcgtcatccggcagcgggtacagcgtggtgatgggccgcgactgggtcagccaggccttgccgccgccgtcgatcgcccattccacgtcctgcggtgcgccgaaaagccgctgggcatcgtcgccgagggaggtcagttcgcgaagctgtgcgtccgtcaggacggacggtttgtcctgcggctgctgcaggatccggcccgacgccgtctccaccacgaaatggtccgggttcacggcgccggacaccacctgctgtcccgggccggcgctggcgtcgatgactgtctgggtccgggttccggtcatggggttggcggtgaacagcacgcctgccgtggcggcgtccaccatgcgttgaatcacgacggcgaggcccacttcgcggtggctgatcccgttcgtggtgcggtaggccacagcgcggtccgtccagagggaggcccagcagcgcctgactgcctggacgacgacgtcggcgccgtccacgtccatgaaggagtcctgctgtcctgcgaagctggcgaaggggaggtcttcggcggtggcggaggagcgcaccgccaccgggccgctgcccatcgcggcgtaggcgttgcggacggcggcgtcgacgccgggcggtacaggtgctgccagcactgcctcgcgggcctgccgcgcgagctggttccgttcttcgtccggaagtccgcggccgccgtcggaccttcctgtctcctcaaggcttcgcgccccgtccatgcttcccgccccagccccgtcgagcccgacgccgtccatgcgggcggcaatggcgtccagttccgcgggtacggccgcgcggtagcccgctgtggccaggcagaatccaggcggaacaggaaagtccgcagcggcaagccggccaaggttgagggccttgccgcccaccgtggccagcgacgctgacgccagccggctgagatcaacaaccagacctgggccgtcgccgccctgcccggcactttcagaaaccatgcctgctcctagccgtggtccgcaccgtctccggtgtcctcccacataacgtcaaggttgtggaagatcacgggcccgtcgcagagttttgccattgtggccgcgaactcggacgtttccggccggccggagttctccattgccgagtcaaaggaatcgaattcgacgatggtgaagtaggtcccggggtggtccctgtccgccgtggcaacaatgctgcggaacgtggccggagtgcttccctcggttcttgagggacggcccagctcttcgatctcctcgatgcgggaggtcctgaattcgatgatctgcacaaacccgggcatgacggctcctcgacggcggtggacgctgatgcggatcaggctagccgccgagtcggcaggtgcacaggggagaagtgccctactttgggggactacgtgttcagctcggcggcggcgaaggacacggcgaagcgggcgcaccagatgctgaccgaggtgtagtcgcccagtaccgttgcggccgggatgtcgtagttttgatcgcccttgttggctttgagcgcgcccagttccaggtaggcgccgtcatcgaagacgtgccagcctgccactccctcaatgacgggggcgtcgctcagccacaccttcaagtccggcccatcagaagtgtcaaggccttcgagccggaggatccggctcccgtcagcgagctcaagaatccgtaccgttccggagctggcatgttcgtggctgatgagctggcccgttgccagttctcgcggagcggcgggcgctgccggggcggtgggcgtggcggatgcagcgggcgcactggtctccgccgttgatacctggggcgggacggccagcggggcagcggctggaacgtcctcggtcacggtggaactggtgaagatcctccagggttggaacaggtacagccctacagccagtgaaattgcacccacgaacaatcccgccacgatggcagcgcgctttcccataacacctcaacgagcggattgttggcgccgttcctcggcgggcttgtcctgcgcactcctccatagcgccaccgccaggactgccacccacagcaggaacgccccgatgctgattcgctcgccgacgcccagcacgaggttaggccccggagctgccatgaacgccaccatgcccatgagcgcagaagcgacgagcgagaggatcgagtaccaccgcatccggccgtggaaccccgccgccacgaagcacatcgcggccaccatcagtgcgagctggatgttggtggcaaagatatgcatgggaatggacgcatcgtcccccagcgtcagcggatacagggcacccatgatgttccacagcccgtacgcgatcagcaggccgccggcgatgcgcagggcgcggttcccgtgcacggagttccacacgcctactccgaaagcgacgaacagggctgtgtaaagccacgtgaacgcgacgaggacgtcccggccgggggatcccaccgcgaacagttcgctcaccatctgctccgtgcggaggtacccgtcccatcgggatgccgccagcccgtcagtggcaaccacatagagcagcgaagacaccggcccggcagccaagaggacccgccggatggcgtttccccgtgtgctcctggtttgtgcggcccgcccgcggtgggggtgccgcccatttgcgatcggcatttcgaaggtcctcagagcctgcagtttggcaagggtttggtgcaggacctgcgggcgtgaggccctgatgcctatctgttcagtctgtgccgcgttgcaggatacgggtagggccaattggccttgcccgcctccgttagtcgatggcctcgatgccctgccgcttcagttcctccaggtggctgcgcatgtgctgcagcgcctcgggggagtgcggctgccaaccttttacttcattgagcacgtggaggggttcgcgggtgcggtaggaccgggtggggttgccggggaacttcttgtcggtcaggttggggtcgtcctggaacggcccggtgggctccacgcggtagatcctgccgggcccctcgcccgcgctgagttcggcgccccaggtggcggcgtccagggtggccgtgaagtagatgtggttcgcggcgttccgtcccccgtagttggaggcgtagccgggaaccaacaggtctccgggcggcaggctggccttggtgccgtgatagaagggcccggaatcgttggggttggccggggtgttctgaagagggtgcaggaacgccgcggcatccgacgccacccggtccgggcactcccacaggaccaggtgcccggcgtcgggatagacctttagcacggcacccggaatccgcgaggccaggacctcctggtcctgccgcggcagcaggtcatccttgccgccgtagaggatcagcgtgggcgtccggatggcgccggcttcggtgggcgggacggcggcggacagtcctgccaggatcttcttccacgcgtgcgcaggcatccggacgccgtcgcgcacccgctcctccaggtaccagtccggaacaggccggtgaagggtgaaccaggagagcgacgcccgcacccagtcctcatcaatggggtcggccagccggtccacctcctcggcgaaagccggccggccctgcaggctcagcggcgaccccaccaggaccagcccggtcacccgcccgggatgcactacagcgaactgctgggccacgtaaccgccgcttgaggagccgaggacgaacgcagtctccaccccggcagcgtccaggatggccgccgcgtccccggcctgttccgccagggagtagccgtcctccggtttgtccgcctcgccctggccacggaggtccggtgcgtagaccctgaagctggccagcccgggcagcagacggtcgaagcagcggcgggattcgccccatgcatgcagcaggagtaacggtgcagcgccagcgtcgccctggatcaggcacggcaccgtgatgccggtgcggagggtcaggttccggacctcggattccatggcttcagggtacgccgggcgctggaggaggagtacgacggcggtacaccccttaggcacgcaggccccggaaccagctggcaatccacggcctattgactgcctgcaggcggaggaatagtttctgcgatagcggggtcaaacaccccgtttccacggaatgaagggccggatctgggccgctcctgcaccgcaactacaggaggacaacatcatgccgaagtatctgttcgaagccacctacgtgggccagggaatcaaggggctcatgcaggaaggcggcaccaagcgccgtgacgccctgacggaggccctgaaatcggtgggagggacgctggagagtttctactacgctttcggctactacgacgtcctcggcgtttttgaggctccggacgatgcaagtgctgcagcattgtcgctgctgatcaattcgtcgggcaacgtcaacgtccgtctgaagccgctcctgacggtcgaggacctcgacgaggctgccaagaagacgccgacctaccgggcgccggggaagtaggggaagtaggggagcctggcagacgagccagcgggccgccgtcgtacatttacgacggcggctgccgcttggtagggggaacgcgggaggctgcctagggtgcggaggagcgtgtggccccggtatgcgggggcccgtccttcaagaggacagccgcggcgactacgccccctgctgcgaagagggccagcgggctttgcaggattgtgcccaggatggcgagccccgaatctgacacgggtctcgacgccgcgaacaggcaggcgacgtccatcgcgaaggcggccgcgtagccggcgccgaagcagagtagcagtgcaggcgtcctgtagtccttggtgaatgccctcacggctgcgtcgtaggcaaagtatttgaggccgatgatcgtgggggcgaaggtcagaacgaagaaaacgtccacatcctcggggaactccatgagcggaacgttcgcgtctccctgatagaccccggctgagtgaaaccacatgctgcccagctgggccgcgatcagcaggaccgagaccagggcgtacctcaccgcggttccaccccgggtcatccctaaagccatggctcagtatggcacttgggaccactggggagggaccgcttctctgtggtccctccccagcgtcggtccggcctagccagccgccaccaccgcctccgcagcctgcgaggccatcatcccctcactcagccacggtcccctagggggaggtcagcgtgaggatgagtttgggcctgttggtggtggtggtgttctcgctggaggcgaagtccagcccgtcgctgctggaggagtccaccgccagtgacagcttctggcccagttccgcctttagtagctccttgtcgagggtggcgctgtgggtggctgcgcttggactggtcacggtgcctacctgggttccgggtgccgggcgggtggtgtagcggatggcgctttcggtccaggtgtcgtccgggaccagcttgacccgctgggtgcctgtcgagccgttggttacctggagctggagcttggcctcggtgatcgtcttacccgcgtgggcccccaggtcgaacttcaggtagctgacctcggtggggctgctgtcgactcccagcgccgtggccgagccgtagtcggtggtgggggtagcgctggagacgtagctgtcctcgagcgcctcaacggtgatcgtctgggttgttccgccgccgccggcagcggcggtggtgaagctccatgtcttggctgtggccagtgcattcccgttggcgtccttcactccggtgctaatggacgcggtgtaggtcgtggcggcggccaggtccgcggtcgggttcagggtgaccacccggctggcggcgtcgtaggtcaccggggcggttacagcagccccggcagcgttcttcagcgtcacggttgtggcgttgatcgtggttgtgtccatcgcctcggagaaggtcccggtcacgttcgtggtcaccgcagccccggtcgccccgtcctccggtgacacagcggtcaccgttggcgccgtcgtatccccgccaccgcctgagccgtccccgctgagggtgaggatgagtttgggcctgttggtggtggtggtgttctcgctggaggcgaagtccagcccgtcgctgctggaggagtccaccgccagtgacagcttctggcccagttccgcctttagtagctccttgtcgagggtggcgctgtgggtggctgcgcttggactggtcacggtgcctacctgggttccgggcgccgggcgggtggtgtagcggatggcgctttcggtccaggtgtcgtccgcgacgagcttgacccgctgggtgcctgtcgagccgttggttacctggagctggagcttggcctcggtgatcgtcttacccgcgtgggcccccaggtcgaacttcaggtagctgacctcggtggggctgctgtcgactcccagcgccgtggccgagccgtagtcggtggtgggggtagcgctggagacgtagctgtcctcgagcgcctcaacggtgatcgtctgggttgttccgccgccgccggcagcggcggtggtgaagctccatgtcttggctgtggccagtgcattcccgttggcgtccttcactccggtgctaatggacgcggtgtaggtcgtgacggcggccaggtccgcggtcgggttcagggtgaccacccggctggcggcgtcgtaggtcaccggggcggttacagcagccccggcagcgttcttcagcgtcacggttgtggcgttgatcgtggttgtgtccatcgcctcggagaaggtcccggtcacgttcgtggtcaccgcagccccggtcgccccgtcctccggtgacacagcggtcaccgttggcgccgtcgtatccccgccacccggtgctttcagatctatgtgggcgtgccagtaccgggcgttgatgctcgcggctgtcaacaccaccaggccggtctggccgttgacgttttgcttcgttgatgtggggtcgttgatgtccgtgtcggtactgctgctgatgatgggcgtaccagcgccgggcgggaaggaaatgttgtcaatcggcgtctttttgtaatagagggtgccgccctgctccggtgcgaccgcgaacatccagacctgacggttctcctcgtcgatcatgaccatgggccgggtgtgctcgtcctcgacagcgccgaactgtgcgctggtccattgggccttgctatcgcgcaccaggagcgccgcaaacgtttgaccgacggtttgatgggctgtcttgatcgctgcatagaggcggccgctgccgtcgcttgtcagttgcctgaggtttagatggtcgttcgcgcatccgcccgtgcagttgttcccgccgccgtaggccacctctgtctgccacgagttctcgggctgaccatcctggtggacggccaggtaaaacttcctgtgctccgcccgctggttgctccacatgattcccaccttgtcgccctggaatgacgtgactgcggagatatcgtcgtggtgcacctgggcgtttgttgtcggcaggacgaacggagttccccacgccgtgtcgctcgtcgtcgagtggttgacgtagacacggttgctgttgtctgccgagacgacggtgtaagtgacccatagcttgccgacggagtctttggccagcgtgatggattccgagctcccgctgtgaagggtgacggggaatccagcgtcccgtgagtaggtcttcgtcgacgcgttgtagctgaagcggtgaagcgctgcggacccgcggttcacttcctcctgggatggtggcgagttccactcggagaccaaagcggtgcccgacacgacgtagagcttgccgtcctttgcgtcccagagcgcgtcaccgcgcgcactcacccgtgtgtcaacgaccattggggtctcctgccacgtctgcgttgcgacatcgagccggtgaatcttcgtcgcatttgcggacgcgctccacagcagcccccaccagctcccatcctggtaccagagcttgctctgggccttgtccgcagtcgggtttctcacgccgtcgcctgcataggatggcccaggctctccgagatcggccgcctgggccgggacggggagcgcgacagcgacggccgcggcgagtagcagggcgatgaataggcgtagcagacgcatagtggtgtcctcgggtgatgtcggcgacacggaggccgtttcttcacctcccggagggaacactttatgtctgcacgccacatcctgagccacaaaggagccagataggggaggccgaagggggcattaggtaggcaggtgccttaccttcccggtgggattcagagttcttccagcagtccggcacccggtcagccgggagcgccgtcgtacatcgacgacggcagcccgctggctcagaccagctgcagcgcgtccgccactacccggcccacaccttgcatgcccagcgccttggtgcgctccaggatcagctgggcgccgaaaaggcccagctggccgggttcgtgcaggtgccggtgcatgagggggggcactcggcccggctgactgcgccgccctgtatcccgtccaattcccgcaggccggaccggaggcgtggttcagagcgggaggctggccctgatctggatgagggtgaggtccagcaggggcgtcggaacgttgaggtcccgggccctgcgggcgagatcgcccaggatgtgctccgcctccgagggcaggccggcactgaggtcccggtacagggaggaggtgaaggctgatcccggttcggtgagcaggcctactgcctgtgcgtggccggcgccggaaacgggatgtccagccgcggccgccaccgcttcggtttcactgatggcatccaggatcctggcctctccgccggcgtcgatgatccggcccaccggcgcacggaacaggcagttgatgattcccgctgcagcgatgaacgcccatttttcccagagggcgcccgtgacgtcactgaccaccgaggagtcgacgccgggcacgtccagggcatcggccacatcggccgggacagtccttccgttgagcccgcccaccgtgagggacgtgaggggcacctgctggcgtaccgcatcgccgtcgagggtggcaacaatccgcgccaggccgccgagcacctgtcccggatacagctgctcaagccggtccacatgggccatgccgttgaggatcgggatgatggcggtgtcaggccccacgaacgcgccaatctcaccgagcacgccgtccagcgcagtggctttgacggtgaccaggatcagatcgaacggctcaggcttgtccgccgcagtgacggtttgcaccgggtgcgtccggtcagcggtgggggagatgaagcgcagcccgtcccggcggaggacctcctgcttgcgggggcgcaccagatacgtgacatcccgtcccgcttcctgcaggagcgtaccgaacgcaccgcctgtggctccggctccgacgacgagtatccgcatgggtgggtaccttccgggtggttctaagaatggcgaccgggcacagcagccagggaacagttgaggctttgtatccggtggtccaaggctagggggtttcagcgggacatcccacctgtggctcttgggccttccaattgggtgggggcgcgagaccgtagactcggtgtcatgtctcttggggggatgccggttcgccgcatcagagtgttcatggttggggtcgttgtggccatatcaatggcggggtgtgagtacagcggcccgcccgaacaatcggcaccctcatccccgccgcccgcaacgccgtcggccgcgtccttcgaggagaacgtcaacgaagtcacgcgtttgctcgatgcttcccctgcggacccgggcatgccgtccgaggctgaacccgccgggaagctgtcccttgacctggcgcccggagattatctggtcaccggcgcctgcgcaggggtttacggggccaagctcaccgttgtgaaagctgacggcgtcccggaggcggcgagctttgagtgcacctccacgctggaccgctttgtcaggcacgacggcggtcccctcaccatcagcgcggtgccgcccacgggcaggccggcagcaacgggcgtcaaggtgcaggccaaccctgaccgcaggctttcggagctcgaggacctctcggactgggccgcgcagcagctgcaaccccgcttgcccggcgagctgcggggcgccagcagcgggaacacaaccaccaccgccagcctgtcggccccaccgggccagtatgaactgcacctggtctgtgccggactgccgaaggctgagctctccgtctccacgtggaggggtgtggaagtcctcgcccccgtggaggtcccgtgcggcgggagcgtgttcatggcgtccgtggtgctgcccaccgagggggccgacctcacgatgggacccggtggcctgggcgcccggttcgcttaccggctcgtccccacaggccagccctgaattccatccggatgccgcggacccggctgggcgtagggtggaaggcggacgaaaggagcatttcatgaagaaaatcctcatggtactgaccagcgtttccgagattggcgatacgggagagaagaccggctacaacgtggccgaggctgcacatccctggaaggtgttcaaggattccgggcatttcgtcgactttgcgtccatccagggcggccagcccccgcgcgacgaggtggacacgaaggatcccatccaggtcgccttcacggaggacgagaccacgcgcgccggcctctacaacaccgcccgcgtcgacgtcgttgatccggaacagtacgacgccgtctatctcgtgggcggccacggcaccatgtgggacttcccggacagcgaaggcctgcagaacctcgtagccagcgtttacaacaacggcggcttggtgggcgcggtctgccatggaccggccggcctgctgaatgtggagctggagaacgggcttcgcctcgtcgagggccgcaaggtggccgccttcaccaatgacgaggaggtcgctgcaggcaaggacaaggtcattccgttcttcctggcagaccggctcgaggagcagggcgccacccacgtctccgcgggtgtctttgaggaaaaggttgttgttgacgaccggctggtgaccggccagaacccggcgtcagctgccggcgtggccaaggagatggagaagctgttcgcagcggtcatccaccaggaaaaggccgaggaacagcacgacgcggaggctctgcgcgccgagaaggacgccatcaaggctgctgccgccgcggaagcggagcagtaaccccaatacctactgaaactgacggccgcccggatgccggggtggccgtcagtttgcgtccgggcggcagtagccggggtccagctttaggcttggcctatgtctactgatgatgagaaggacccgcccgtccccgctgacgttgagggcaagatcccgagaaaggtccacgacaagccagtcacgaatgaccgtgaggcagcggccgacgaacccaaggactgataagcacgacggcggcccacgggagccctggcgcgacgtacctacgtgccagggcttttgtgtgtttgggcgcacgacggcggcacacgggttgggtgccaccggtacagtggcacagcggaccgggggctcagcagcggaaggctgtcacgtccggttgtccgctacgaagggtcggtgaactcgagtccgcgctctttcagcgcggcctcgaggagtcgaattgctctgggtcccacgccatgcagggcgagcagctcaccaggaccgtgcgacgccacctgcgccagcgtcgtgatgcctgcctgcagcagggcgctgttggccggccggcccaggggaggcaggtccccgatctgtgcaggggtgtctcgggtgctcatgagaaacagggtatcggcgccgggatcagcagcacgaaagagtcctgcattagcccttgaacggtggtcgctgaccgccctacagtgacagccaacgaccacttcaggagaggcgccatgtcccttgtccgcgtacataacttctcggtctccctcgatggcttcggcaccggcgaaggccagcagctggacgctcccttcggccacgcgggcacgcggctgcttgagtgggccttcgagacgcggaccttccgcgcgatgggcatccatggggagtcggaaggatctttcggcgtcgacgaggctttcgccagccagtggggacccggggtcggcgtcgaaatcatgggacgcaacaagttcggtccgcagcgcggtccctgggacaacgaggactggaaggggtggtggggcggtaaccctgtgttccacactcctgtggttgtcctgacacaccatccccggccggtcctcgaaatggaaggcggaacaaccttccattttgttgatgcggaccctctctccgtcctggaacaggcccgcgccctggcgcccggcacggacgtcaggatcggcggcggcgccagcacggtccggcagttccttgaagccgacctgatagaccacatgcatatcgtcctcgtgccggtccttctgggccggggtgaacggctctgggacggactcgagggcctcgaagaacgctttgacattgaagcgaccccctctccgcagggggttgtccacctggttttcacccgtcgcggggtcgactaaggctccgttccaaggaacggagccttagtcagccagctgcctgaatcacgaatcctggtctacggcaatcacgatcttgccgcgggtatgcccttccatgttggaacggaaggcatcagcggcttttccagcggaaagacctcggcagcctccacgcgcagtttccggctgtccgccaggtcggcgagttcctgcaggtcggctcccaccggatggacccacatccagtcgccgccgtgctcttccacttcactgttggcgatcgaggcatgccggcctccttcagccagcacggccagtgtcgcctcgaggttcccgcctacgaaatcggcaacgacgtccacgccgttgggacgcagcgcgcgaacgcgctccgcgagcccttccccgtaggctacgggctcggctccgagggagcggaggaattcgtggttcttctccgaggctgtggcgatgacactcgcgccgagggccatggcgatctggatgccaagggagcccacgcctccggaaccgccgtggatcaggacggtttcgcctgctttcaggcccagccggttgaggacctggtaggcggtcagtccggccaacggaacaagagacggcccggagctctgccacccgaaccggcttcgaccgcctgccttcacgcgctgccttcttgctgccaggcggcccttccctggtgttcgcgccatggtcaggaagggcaggtcacagcgacgtgtagggacatggacagcctgacaggcagacagtcagcacggcgaagccgaggctgtggcgctgaccgtggtctcggcgacaagtccctggtcagaggccctgctggaacgtccccgtcgccggcttgagcgcgcccgagaccctgcatgggcggccacggatacgatgccactgcatcattggaagctttcaagggggaagcatgtctaaaaccattcttcaggcaccgaaatggtctcgtgcctggatctggctcatcgtaatcggccccattctgagtgttgccggtctcatcctgggtttcgccagtgcaggatccatgtgcagaagcgccgttggtccgaacatggggttttttgagttgtacgggacgtttcagggcacggctggcgcggtaggcgcctgtgagaaaagtatcgccgctgtggccgcaccggcatggactttcatcgtgctgggactcgtcctgttcctcgccggaattgtcgtccgttccgtcattggaaagcgggcaaatgctgccggggaacagccgtttaaaaaacagggtgtaaagcggcggtctgttctccagggcgcggtggcgttcataacggcggcgctggccggggcggccccggcgtacgcgaatggaaacgttcggtacgtcagcgcgtcaggttcggatggtaatccgggaagcgtgacggcaccgtggcgcactcttgccaaggtacggtcggcaatggcttcgggcgaactgcaacgcggatccaccgtcctgttcaagcgcgggcacgaattttacgggtccatccatatgccgtccttgatcgggtctgcgggcagcctgactatcggcgcctacggtgagggggcacggcctcgtttgctggggtacaaggtgagtaatgcggcttggacgccgtacagcgggaacatttggaaactgaatatcgcggcgaacagtgggcagtattcgggcaatacctccgagccatccacgaacgtgggattcctaaaggccgctggcgttattcacggccggaaacgctgggccatttccgagttggcggcggactgggagtttttcagcgattccacaaacgtctacgtccggttgggggtgaacccgggggcgggggtggctatcgccgttcaaagggacattttgcggctggcctcccacaccacggtgcaggacctctacctcggcggtactggagcccacggtgtcgctaccggcggcaagaatgtcctcatccagcggaatgaaatcgagtggatcggcggttccgccctatcgggaactacgcggtacggcaacggggtggaactgtacgtaggcgcggcgagggtcatgatccgggagaacgtgatccggcagacgtacgacgtcgcgctgtcggcacagggcaccggcacggcgggctggaccgatattacgtgggattccaaccggattgagaactgcaacatgacactggaactgtggggcaaaggtggcggcaccggatttcttcggtgcaggtttgtcaataacacctgtatcgacgccgggtactcgtgggctgcgctcatccggtctgaccgggacggcaaggggacgcacctgttgacctactccatggaagtccctgtggacgtggaaattacgggcaacagcttccttggggcgcgggacaattacacccgcaacagcggcgacaggcagattcctgccgggatcgtcacccacggcaacactattaagctgggcgccggtaaaaaaattgcctatggagtcgaaaacccggagatcagcgaacaggccgcacaatggcaggcgcggaccggcagggaacaggcatccgtcttcgccgtcagttactgagaggctgacgtaacggagtcgctatcccatcagtgcacgtgctgccgccttcgccttgacgggttgcggcggcagcacggtgttcgaacgttgccgccgacagcaccccagtatgcgcatatgaggctgtggcagagcatctgctcaacgccgtcgcccagacccaggtcggaaacccggggccttcctgctgcccggatcctgcccggagcccccccgagtgacactacgctttgggcgcgtctggcgcacccccttccgtacacataaaacgcgaatggactcgtgatagaaagacccgcctgaaacagagtattttcgcccgcgttacccagctcgccgaggcccatatcaacgccctcctggactccgcggaagaccagcagaagatgctggaccagatggtcctggactactcggccaacatccgggaagcggaggccgccgtcgcgcagacgatcggcaacgtccgcatgggcgaagaggactatcgccgggccgtcaacggcgcccactcctggggcgacaaggccatcgccgcctcccggaaagccgacgagttccggtctgctcggaacagtgtggacgccgacaaggttgatgccttcgcaaggctcgctcttcagcggcagatgacctccgaaagcaccgccaaggcgtaggagccgggcgaggccctcacagaacgaagtggtcgacaagctcaagggcgggctcgaccagatgaagggcaagctgcacgagcttacggccaagcgcaacgaactggtggccaggtcccagaccgcggccgccccgtcacaggtccacgacgccctcaggtccctggacgctggagacccgacatcggccatcggccggtacgaggaacgtatccgccgctaggaagccaccgtccgcggccagcaggaaatcgccgcctcatcccttcaggcccagttggccaccctggaagacctcggcgagcggaccgaagtggaagcacccctgccgccctcaaatttatggaccctaaagccatcgactactagcacaacttcccccaaaggccctggcccctcaccggtccggggcctttggcgttgccgcacataggatgaggaggcttacagggctggcgcgccgggggattcggtctcgcggaggctgacaacgtaggcctcggcctcagcgagggtaaccatgaagaggacgaagacgccgtcgacgaggacggaggctgagttgccccggctactgatcacgactccctcaggcaatttagctacttccttccctgcggctggtcttcgttgttcaaccagagttcgttgtgcccccacccgttggatggcccgattgacggctccaaatggactaccagcgcgaggctgcgagtcctcaaaagttccgttgataggtccaacgactgccgcgcgggaatggtatccctagtgctggtcggttgttgctgtcgctaaggcgcgattttagctacccgccaccgcggccttcgccgcctgggaggccgccatccattcgctcagccacggggcgcggacgctggaggtgatgcggcagtcggccacgaaggtgcccttggcgccggcgtcgatccagtcctgcagggcggacaggtctgcaagtgagcggatgatcaccgactcggcacccaaagcccgggcgacaccgctgaagtccacctcggggatcagcatcggcttttcggtcaggccctgggagccgtactggtggatctcggctccgtaggcggcgtcgttgtagatcaccacgatcgcgctgcgagccgcaccgatgagcgattcgaggtccgccaggcccatcaggaaaccgccgtcgccggaggccagcaccagggtgcggccgtcctccagcgcacgggctgccccgacggcgctcgcaagtcccagcccgatggattggaaagcggtccccaccatcaccaggtcctgcggccgcgggatgttccagtacatgggtgcccagcccacgaagtgcccgccgtcctggaccaccgtgcggcgctccggcagaacggcatccagtgcggtggcaagggagcgcgggtccagccggccgtccggggtctcgtccgagcccgggtcgtgggccggtccttcagcaaggcgcctggacgcttccgcgcgccatccttccgcagcagcctcaccatcaagcaatgaaaggaggcgtcctgcggcggttttcgcgtccgcgctgacgaacaggtccacccgggggtgcgtcggctgcaggccggcgtcgatctggatcaccgtgctgtccgggccgagcaggtgcccgaaccgcatggtgaacgggctcaggctcgccccggccaccaggaccacgtccgcttcgcccataagcccggccgcggtggccgtcccgaaaccgcccgcgacgcccaggtacccctcgccattgaggaggtt

SEQ ID NO: 27 - DNA, 209634 bp, Arthrobacter sp. OY3WO11
cccccacgactatccgtcaccttcgcggcgagcggcgccggaagttcctcgtccgcagcttcgagtgaggcgaggtcgtaggggatggcaagcacgacggcggtgcgcctggtgagtgcgtattccaccgcctgctgcgtgatggagcccgcggcgtcgcgggtgacggtgaaggtggccgcgccgaggcccgcggcgatggccgcctggtccacgtcctgcggccgggcgccgctggtgggggcgtccccggtgaccaggacgacggggatctgcgcctggaccgcctcggcgagggaggtgagggcgttggtgtagccggggccgtaggtggtggtgccggcggcgaggcgtccggaggaccggtagtaggcgtcggcggcggcgatcgcggcgccctcgtgccggaccggggtgaagcggaggccgtgcttctccgcggcgtccaggaagtagacgttgccgttgcccatgacgccgaagacgtcgctgacatagctgctgagaacctgtgccacgcggccggagacggtgagagtagtcatgcaggaagcgtgtggcctgcatctcacatttgcaatagcggtggattgtgttgggacttttggcagcagggggcgtaagaagtgaaaaaaagcccaaacgtggcggccgtcacccgcgcttagtccgaggtgcgggattcctgctcggacaggcggctgatgaggccgtcgtagcggggcggcatgagttccatgaccgagatggcggtgctggtccgctggatcccgtcgatctccaggatctggttggtgatgcgatagaggtcggcggtgccgcgggccactaccttggccatgaggtccgcgtccccggtggtggcgtgcacctcgatgacctccgggatggcggcgagcccgctttccaccgagccgaaccgcgtctggctgatttccagcgagaggaaggccatcagttcgtagcccagtgcggcggggtccagccgccggctgaaggagcggagggcgccgctacgctccagccgtgccagccgggcgtggaccgtattgcgtgcgacgccgagtgtccgcgaaagtgccagggcgctggcttcggggtccttgtccagggcaaggatgatgcggccgtcgagtgaatcgagggtgcgagagttcgcgatggtcatattttcaccacaagtactagaagttgagcagaagtcccaatggctagagcgtatcttgcaatgtgggccgggtcacaacaagatcggacctcatgaccactgaacagctcctggccgcacccgcgctgcccacccttcgcggcgccgtggccggacttccgtcctacgtcccgggccggcgcagcgccggcgcggacatcgcagccctcgccagcaacgaaagccactacgaccccctgcccgcagccatcgctgcggtggccgacgcggcaggcaccatgaaccgctatccggacagtgccgccgtcgaactccgcgaacgtctcgcccgtcacctaggtgtcaccgcagacgaggtggccgtgggacccggcagcgtgggcgtcctccagcagatcatcaccggactgtgcgacgccggggacgaggtgatcttcgcgtggcgctccttcgaggcgtaccccatcctggtggagctggcaggcgcccggccggtccgcatcccgctggaccaggctgaaggccacgacctcgacgccatggccgcggccgtcaccgatagcaccaaagtcatcctgctttgcacccccaacaaccccaccggcgtgccgatcagccacgaccgcatcgaggccttcctgcaggccgtgccgtcgaatgtcctggtggtgatcgacgaggcctacgtggaatacgccgaagcaggcagcggacccgattccctggcgctctaccgccgctacccgaacgtctgcatcctgcgcaccttctccaaggcctacggcctcgccggcctgcgcgtggggtatgcaattacgacggcggccatcgccgaaggtttgcggcgcaccgcactgcccttcgccgtgagcgcgctggcgcagaaggcggccatcgcctcgctggacgcgggggaggagatggaagcgggggtttctttggtgaggcaggagcgcggccggatggccgctgagcttcaggcgcagggctggaagctgcagccgagccagggcaacttcctgtggattcgtgcggacgatgagctccgggcgaggctggtggacgcgttccacggcgccggcatcctggtccgggcgtaccagggtgacggcgtgcggatcacggttgccgaccctgcctccaacgaccgtgtgctccggctcctcgcagcccacgcagcctgacaactcactgaccctaaatccccaactcggttccacctaccaaccagaggaatctccatggaacaacagacaacgacgtctgcccgcgccctcggcgcggccctcaaaccccgccagctcaccatgatgggcctcggaagcgccatcggcgcgggcctgtttatcggctccggcgcaggaatccaggctgccggccctgccgtgctgatctcctacctcgtggctggcacgctgatcatcctggtgatgtgggcgctcggcgagatggccgcggccaacccggacagcggtgccttctccgtctacaccgccaaggcctacgggccggtggccggtgccactgtgggctggctgtggtggatccagctggtggtggtcatcgcggccgaagcgctgggtgcagctggcctgctggccaccatcttcccggcgctgccggtgtggttgatggccttcgtgttcattgtggtgctcaccgccgtgaacctgacgagcgtgaagaacttcggcgagttcgagttctggttcgcgctgctgaaggtggcggcaatcgtcgcgttcctggctgtgggcttcgcgctgctcttcggcttggtaccgggcgtgcagtcgccgggcctgtccaacttcatgggcgacggcttcgcgccgagcggcttcgccgggattgccacggccctgttcgtggtggcgttcgcgttcggcggcaccgaaattgtgtccgtggccgcagctgagacagctgagccggcccggagcgtaaagaaggcagtccggacagtgctgtggcgcatcctggtgttttacatcggtgcgatcttcatcatcgcggccgtggttcctgtgggttcggaggggctgaagagcccgttcgccgcggtgctggaggccgccggcatgcccggtgcggccacggccatcaccctggtggccgtcgcagcattgctctccgcgctcaacgccaacctctacggcgcctcccggatggcatactccctcgcggagcggggcgaagcacctcgcgtgcttgccgcggtgtccaaggcccgggtcccggtggtggcggtcctggccagcgtcgccttcggtgttgttacggtggtgctggagctggcgttccccgaaatggtccttggtgtcctgctcaacatcgtgggttcgacctgcctgctggtgtggacgtccgcgctcctggcccagctcgcgctgcgcctccgtgccgaccgcgacggaacggagcttcccctgcggatgcccggcttcccgtggctcacgtgctttggcctgctcatcctcgcggcgatcttcacggtgggcttcatcggcgaggactcccgtccccagctcctgagcaccttcgcgctcgtggcgctcctggcggtggccaactggctgaaccaccgtaagcgggacgctcagctgcctgtcggatctccagagggcgacaagcagcctgtgctcatcgactgagacaggtgccttcctggtaggcgctcagtactccgacaacacggcctgcgaagtagtgccaccgtgaagcggatacgggaaaccccggcgtgaaggagccggggtttcccgtacatcagaccagctgcaacgagccctgagccaccaggctcgccttcttaacatgcttcagtggtgtcctagctcagttcttcgcatacatcccgctgggtcccggatacctgctccatcggttcaagcagggtgtaattgctgtctgtcgtgaattcgaccaatcctgtatagaggacagtcgaagggccaccgacatcaaccctgtcaaaaagcagaaccagattggcgcccgaaagcgaaaaatcgatggttccggtctcaatgtcctgagcagttctcgtgacggagcccttcgtcccaaatgtcactgactcttcgccttcaacatttttcactgttatagtcgtgccgcggccagcaatgatggtgtaaataattccatcctttattcgtgtcattcgcacgtcctgggttccgccgctcgacgtgacagtcacgttgaaatctgagcacgcgggatagccctttgctggtttttccgcaaatgccgcttgcggtgtggttagcgccagcgccaccatcatgctcatgggcagcagtcggcacagaaatttcctcattacggttcctttgtttactgaaaaggcgcttgcgattgagtggcgcaccccgacatcggagggaggagaccgttcgccgtatctattcgggtcatgccctgtgtgctgcgcggatgcgcgctgcgtgttctggggcctagatgtggcctggtaagagcccatcttactcagcagccttagtttgggaagtataattcccgggcgatgggaattcgacatttgcccgcagaggggcgggatagcggggccaacggaacgctgccagagtacgtacgtataagtgcgtatacggaaagaagccccacgctccatgtcgttgatcgcagcaggcataggatcccaactatggtgctcccgctcacgcggtgttgcatagaagttgaatgatcgagtcggtccgggccgacacaactggacgcggcgcagcgggtggtaaaacataaattcttagttaccagacattttgcactccacccacgccaatcttattcagaaagcaaaaatagatgcaccagcaacttagggattgctgatgagtctgttccaatttttgatagtcaggtaaaccgtctgggctcagcattgggacgggtgccgttcttcggcgtcagtaaacccaattcgtatgccctctggacggccaggaggcggtcgccgacatccagtttgcggtaaatgtgttggaggtgtttttccactgtgcgcggcgagatgttgagccgcctcccgaggctctccgcggtcagtccttcactaagcagggataagatcgccctctcgcgtagcgtcaaaccttgcttcgagctctgcaagcaagccgcgggatccgccggcgcaaatctaaagtgcaaagcaagtccgctaagtatcggctgcagcagcttggccaatgcaagttcttgttcggtgaagtcgaggtccgggcgggagacgaggtaggacacttgttcgtctgggcctacttggagcggtatggacatttgctggttcacgttccacggccgggccaactcctcccaagcctgtttcagcctgttactggccagagcgtcaggaactcgattcagggtctgcggctccctttgtccggtcaacatgtaccaccgcagtaggggttgttccctatagtcgaagtcgccaggcggttcatcgggaatgtacctcgggggccagcaggcaaggatacgcgtgtcccatgtcggcgcaacaacgtttcgcgtagaacaagcaccgttgaacgactgattcagaagatctaagagttgctcctcgtatggcggacacatgccaagcggttcctggaggactgttcctaggaactccagccacgtcacgtactgcttatccatgcgggccaccctccgtatcttaggctcagaaaggacgcagcaacacaggggaagtgagactgctcctcagctggacagcaacgccattattcgaagtgtgtcctggctggtgctgggcgtggtggtcctcgtcctgatcacgcgggacttccaggcggcgccgccggagacgacagccacggaggaggcgacgggagagaccgccgcccaagttctggcagccttgaagtttggcccgttgggggacttacgctggaaaacaccctcgagctcgacctggtggccaatgccgcaaccgcgccaggcgagaccattcactccatgcccttcgaggtccgccctgccgatattgtctccgcactgaagtcaatcgaacgcttctcccgccgggtccgggaggaagcgggtcttcccgcgccggagctgtacaccgcccaccgacgccggcagtaaatgcaaggaacgccgacggcggtgctgccgccgtcggcctcatcacctgagggggccggatacggtggcccacattgcggaggctgacgcggtggtccctggtgctgtcgagacagggcgaacctcgtcgaaagggctggccgttccgcacgcggtgcggccagtaccgtggctaagccactgcatcagacaggctaatgagagaggcgggtcccagatgttcgcgacccgccttcgccgtcagcggttggcgcccagtgccgcccacgccttattccggcgctcagcaaaatcccggcgggcctccagggcgtcagcaaggctgacagctacgaaccgcgtttctgtaccgggggccgccctggcaaccacatccatgtcggcgctgatcacggtgcccaccatggcgtagccgccgccggaaacggcatcgcggtgcaggatgatgggctgggtgccgcccgggatctggatggaccccacggcgtaccctgcgtccacgatgttggaagggtccgagccggcgccgaaaggctgttcccgctctttccagctcactcccgggccggagtaacgcagacccatccggtcagctaccggagtcaccttccactccccgttcaggagattgcccaggccttcttcggtgaggcggtggtcgtacaatcccagcacgatccggacttcctgctctttggcgtaaacgggcctgaattcctccggaacggtctcggccggggggagctttccatcattgaggggagcgcccacggggaccacgtcgcccgcctcgagcttccggcccttgaacccgcctatgccgccgaggctgtacgtggagcggcttccgagcacctcggggacgtcgatgccgccctggacggcgatgtagtagcgggtgccgccctggatgacgccgaaggcgagctggtccccggccttcagcagcagccggctccactggggccgcggttccccgttgaccttcaccttcaccggagcacccgtaacggcgatgacggcgtcgctgtcggtggtcagcacggggcccaggtaggtgcattcaaggaccgcttcccgtgccgtattacccaccagggcatttccgagctcggcggagtactggtccatggacccgctttgcggaatgcccacgttgtagtggcccgtgcgtccctggtcctggacggtggtggccaggcccgggttgccaatttcaaatgccattgagggcctccatgagttcgcggttgtatccttcggggtcggccagcgcactggacagttcgaaggtcaccggcgcctgccggtagcggaaggtaccggctgagatctcggcctggattgcgttgtattccgcttcggtaacaggcttgaacttcacgatgtccccggggcggaagaacaccatgaaatccttgaagtccgccagggcctggtcgggatcaaagatgggggccgcagccacgccgaacatctgatagccgccggcgccgcgaacggaatagatgcagccgaagcatcctccgtgtcccacggtcagcttgggggtgtcggtccgcgggctcaggtacttggggacctccagctgcttgtcacggtccaccagctggaacaggaacggcagcccggccacgaagccaaccatggataccagccacggttgttcatggtggcgctggatgaactcggcggcgtccttaaggtggttgaccttggccgcatagtcgatgtcgctgccttcaggctcctggtggaatccttcgcggaaccgctgtgccacttccgcggtgaaggggtcctcgtaccagaccgggacttcaatgatccgggtttccaggggccgctcctgatggctcatcaggtcgcgctcgatctcccttactgccgtttccagctgttccggcggcaggatgtccggatcgaaccgcaccagcagggatgcgttggcggggcagatgtccacgatacccggaagccgggcctcggagagcctgcccgcgatggacatgaccttgaagttcgcgggcaggctcatggcctcggagacttccacgaacaggaactcgtccccgccccaggtgtagcgcgcaccggggaggacggcggcttcggtggtcattgtgcccccatcaggtcggctgcggtttcgatgaacttggagtggtggctgacgccggcaaactcaggccgtgccagcagcgccgtatggacggggacggtggtcttgactccttcaatgtgtgttgcctccagggccgccagggtagctgcgatggctgactcacggtccggggcatggacgatcagcttggccaggagggagtcgtagtaggggctcacaaccgagcccgcctccactccggtgtccacgcggattccctcacccgacggccattccagggaccggatgacccccgggctggggaagaaatgatggttggggtcttctgcgttgatgcggcattcgatggcatggcccgtgaaacgcacatcatcctgggaaatggacatggctccggtggaggcaatcagcagttgctcgcggaccaggtccacgccggtgatctgctcggtgacggggtgctccacctggatccgtgtgttcatctcaatgaatgcggcctcgtggttgacggggtcgtacaggaactccaccgtcccggctccgtggtagccgcattggcgggcaagggccacggaagactcacggatggtggtgcggaccgcctccggaaggtccggggccggggcttcctccagcaccttttgggaacggcgctgcatggaacagtcgcggtcgcccaggtggatgaagtttgtcccgtcaccgaggatttgcacctcaacgtggcgggcatgctccacgaaccgttccaggtagacggtggcgtcgccgaagacggcgctggcctcaccccgtgccatttcgatggttgccagaagctcgctttcgtcgtgcacgaagcggatgcccctgccgccgcctccggcggaagccttcaccaccagcgggtacccgatgccccgcgcaatgtccactgcgtccgccgccgggtccaggggcccgtccgacccccgcagcacgggaaccccggccttggctgccgactcccgggccagggacttgttgcccatcatggcgatggtgtccgcgttcgggccgacccaggtcaggccggcgtctgcgactttccgggcgaagtcggcattttccgagaggaagccgtagccagggtgcacggcgtcgcacccctggtcacgggctgcggcgaccagggcgtcctggttcaggtagctggccgctgcctgggcggggccaaccaccacgtagtggtccgctgaccgggctgccagtgactccgcgtcgggctcgctgacccccaggactgtctcgatacccatttcgcgggcggtcctggcgatccgcacggcgatctcgccacggtttgcgatgaacagtttcatgggctggctttatccttcccgaatggcggcgatggtgtcgccggggttgaccatgtcgccttcattgacttcaaagaattcaagggttccggcgacgtcggactggatctcggtgaactgcttcatgatttccacgatgccgatggtctggccgacttcgatggtgtcgccttcattggcgaaggggggtttgccggggccgggcttgcggtagaagactccgggaaggggcgaaacgatcgtggccatgtgctgctcgctttcaggagtgggtggatcgggatgagtcgagtgccttgcgcaccgcggaggcgacggcgacggcattgggagcgtccgaatggacgcagatgctctggaacgtgatgtccaacggagtgccatcgacggcgggcacgggcttgcctgccaccgcccggctgacgcgttctgcggccgcggccgggtccgtgggcgcgggccggcgctggatgaggagctcgccgcccgggccgtagttgaggtccacgtagagttccgcaacgaagtccacgcccatggcacggcacacggattcgtgggcggtgccggcgaggccgtaaaacggaacaccgaactgtttggctgtcccggccgcggcctgcatgagctcttcgtcgccggcgagcatgccgtacagggcgccgtggggcttgatgtggttgagggacaacccgttcttcgccaggaaagcggtgagggccccggtttggtaaaggatgatcgattcaacctcgtcgggggtaaggaccatgcggcggcggccgaaacccatgggatcggggagcccgggatgggctccgacggcaacgccatgttcagcggcaagggccaccgtccggttcatgacgtccgggtcccctgcgtggtagccgcaggcgacgttggcgacatcgatgatgtccatcagggcaacgtcgtttccgaactcgtgcaatccgaagccttcacccatgtctgagttcaggagcacccgggcaggcgtggtttccgtcacgtttttttgcatgcaggcaacggtacagagacggcgtccgtgccggaattgggcggatagccgaaaatggacgggcagactatgctttgtgcactacgtcggaggaactgccatgcgtgtcgccgagctactggcggatcgggcgctgaacatccgcctcgccgtgccgggcagtccggaacgcctcgcccggcccattgcatggtgcgcgcccacggagcacatggaccccacgcccttcctcagcgtcaacgcactgctgctgaccaacgggatgggcctcaatgtcaaggactaccgcatctgggatgcctacgttgagcgactgatgtccgtgcccgtgtcgggtctggttttcggcctgggcgctgcccaccgcgaactgccggccggcctggtgaaggcctgcgaagcctatggccttccgttgcttgagctgcctccggaggtgccgttcgtcctggtgatgaggcatgtagacaggatcatcgcggccgaacgctatgccgagctgcgcgccgggtgggagctggcggatgagtgcaccaggctggcggcgggcggccaatccctggcccaggtactggagcgggtggccgccacgatccgggcccgggtggcggtccttgaccacaacggctttgaacttatctcagcaggaacagcgggcggcggaacggcccggaccaccttgagcctgcccagcggtggaatcctccggttcaggctggccatcgaggggatcaagagcagcctggtgctgcagcctctgttggggcccgtggctgcggtcattgccatgcagctgagctacacccttggttcgcggtcgcccctgcactcgcgggaagccgcgcggttcatggaggcgctctatgaagccaggggaacgccgtcggcatccctgcggcgctacgcagtggagacggggttcgaacccgagggggagtggggtgtggtgctgatcggcggcgcaggggaggttgcgccggccaagctgaggaccatcgcctggcgggtgcgggtgggcctgcaggctgaatacagcaccgtgcggttcatggaggaggccggcctcaccacactgctggtgcagcgcggggaagccgggatggaactgatggacgccgtccggaagtctttcgacgacgcaccggaactgtccgccgtcgtctccgggtgcgggaccctggacgaactgccgctggtgctgcagctggcccgccgccgggtaggagagccggggctccaccgggcgccggttgcagaccttgccggcgtggtggagggcctgcccggtccgggactggcgggaatgtcccggcgcctgctggcgcctttgatgtccgacggcggcacggccttgcgcgaaacgcttgaggcgtacctgcggcacagcgggaatacccgcgagacctgcagggagctcttcatccaccgcaataccttggcgtacaggctgcgcaagatcgaggagcttctgcaggttgacctggatgacggcgaagtccgcgccacctgcctgctggcattgaagatcgtgggcggcggaagttagttggcggccacttccgccgccgccctggcagcgctgctttcccgcacgcacagcgtgggcttcaaccgagcaggttctggtttttcacccctgagcacggcctggatgagctgcactgccgtccgcccaatgtccgcgatgggggagtggaccgaggtcagcggaatgggaagttcggccgcgagggaggtgtcgttgtagcccaccacggccacgtcctcacctaccgtgaggccgtgggagcgaaaggctcccatcgctccaatggcggcgaaatcgttgacggcaaagatggcggtgggccgcggcctgcccctggcgaggatctcttccccggcctcccggccgccggccgtatcgaaccgtgaccacaccacgtcatcgtcggagatggtgccgcccagcgaccgccagcggtccaggaagccggcagtgcggtcgacggcggtgcttgcgtacggttcaccggcaatcaccgccacctgccggtggcccatctcccacaggtggctggccacgagttcgccgccgacgacgtcatcgcaggtggcagacgggtagccgggcacccggcggttcatcagcacgaacgggaccttccggtcggtcagttcctgcaggaggccgccgtcaaggtgggcgtcaccaatgatgagtccgtccacccggcgcgccagcatgaggtcgatcttccgccgttgttcctcgggatcatcgcgcgagttcatcacgaaggcggagtaccccacctcggctgaggcctcgtcgatgccctcgtacatgatggccaggaccaggtccgaaagccgggggacgatgacgccgaggagtttggtccgccgggtgcgaaggctggcggcctgcgggtcgggggagtaaccaagcttgcgggccagttcgcggacgcgctcggcggtggcagccgaggcggctcccttggccacatcggagccggaatgcagaaccctggagacggtcgacggatggacgcccagctcccgggccaaatccttcagcgtgaccgtccggccgccgtcggccttttctttcatgtccctctcctgcccaccggggtcactgtagcccaggtccggggccgtggctgctaaagcctgccggggcgactcttgacgtgacccgcttcacatcctatagtcattcctcgacgctacccaaacgtttgggtagagatttcccatactttctcctggcgccccaccgccggcgccgcccgccctgaacatgcaacaaccgttatccgcggaaggttacccaatcgattgggttgcggaccgcgcgcagcaaaccaccggagctgaaatgactgttaccgactcccacgtcgtgctgctggccactggaggcaccatctcgtcgcgttcttcccagggcggcggcgccgtcgcctccgataccggcgagcaggtgttccaagccctgggctcgcccgtctcccaccccgtccgggtgctggacgtgttccagaaagggtcctacctcctgacgttcgacgacatgctcaggatttgcgccaccatcgaggaggtcctcaaggaccccaaggtcctgggcgtggtggtgacccacgggacggacaccatggaggagaccgcctacctcgccgacctgacccacagggacgagcggccagtcgttttcaccggctcgcaacgggctgctgacgccgaagctcccgacgggccggacaacctggcccgggccatcgccgtcgcaggctcgaaagagggaaggggtaaaggcgtgatggtgcattttgcgggcaccatctttccggccgccggcgtccggaaaagccaaactcttcggctcaatgcttttgcgaaccccgattttggggtacttggccaagtatcagcccagggagaagttgccatggcgggcggcggcagcaggcttgaggccctgcccctgccccagccgggcggccgctcccctcgggtggacctcgttgccgcctaccccggcgccgactccaccctgatgcatgccgcccttgaagcaggagcggaaggcatcatcctgcaaggtaccggaagtggcaatgccaaccgcagcctctgctccgaggtcgccgccgcggtggcgtccggcgtcgtggtggtcaccagcacgcgcgtggacgccggccctgtggtccctatctatggggccggcgggggcggtgaagacctccgggccgccggggctatcggctccggccacctccggccgtcacagtcgctgatcctgctcagcctcctgctcaggatcaaccccgaccggaagcggatcaccgagatcttcacccaacgagggaggcctcctgaaccttccgcctgacaccccagaacaccccggtttgtacacagtgaaaggaaaatctcatggctaaggacattcaagtcgctttcggcgtggacgttgacgcagtggcgggcatgctcggctcctatggaggcgaggactccccgtgcgacatcagcaggggcctgttcagcggcgaagtggggggaccgcggctgatccggttgttccagaaatacaacctcccggcgacctggttcgtgccgggccactcgatcgagaccttccccgagctgacgcagatgatcgtcgacgccggacacgagatcggcgtgcacggatattcgcacgaaaacccgattgccatgacccgggaacaggagaccgccatcctggaccgctcgatcgaactgatcgagaaggtttccgggcgccggcccacgggctacgtggcgccgtggtgggagttctcacctgtcacgaacgaaatcctccttgaacggggcatcaaatacgaccactccctgatgcaccgtgacttcgagccgtactacgtccgcgtgggcgactcgtggaaaaagatcgactacaccaaggacgcccagacgtggatggagccgctggtgcgcgggcaggaaacggacctggtggagatcccggccaactggtacctcgatgacctcccgcccatgatgttcatcaaggcggcaccgaactcgcacgggttcgtcaacccccgcgacatcgaggaaatgtggcgggaccagttcgactgggtctaccgcgaaatggaccaggccgtcttcaccatgaccatccacccggacgtctccggccgcccgcaggtgctgctcatgcttgagcgcctgatcgagcacatcaactcgcacgagggcgtcacctggtgcacgttcgaccagatcgccgactccttccttgcccgcagcccccgaaaggaaaaccactcatgactacgcaacagaccgacgtcgatctgtcccagccgggaccgggtgaaaagcgcaggttcccggtcttttccaagcgtcataccaccactgctaccgtccttgccctgctggcctggactgtcgccgttttcgattacggactcttcggcacacttctgcccgccatgcaggaggagttcggctggactgaaccggaagcctatgcgatcaacacatggatcgccgtcggcacagccatcgtctgcttcggcatcggccctgtcatcgaccggctggggcggcgcaaaggcatgatggtcaccgtgggcggaaccgccgtcgtctccggtctgacggcactgatccccaccggcattccgatcctgagcaacaccctgctcgtcattgtccggtctttcggaggccttggattctccgaacaggccgttaatgccacctacatgaacgaggtctaccaggtcaccgaggtccgggacaagcgcaagcggcccggtttccactactccttcatccagggcggctggccgctgggcttcctgctcgccagtgccctcgccctcgtgctgctcccgtccctcggctggcgggccctgtacctcgttgcaacggttccggccgcggtcatcgtctggcttatcgccaagaagctcaaggagacgccccagttcgaactgcaccacaaactcactgaactcgagaagagcggcaaatcaggggaagcacacgccctcgcccatgcttacggcgtcgagcactcctcggctgccccgctgaagcgcatctgggaaccgcacctggcccgtaataccgtcgtcttctcgctggcctggatcttcaatttcttcggcatcatgatcttcagcgtcctgggaacctccgtgttgaaaaacgccaagggcgtggagctcgccgacgctttctggatgctgatcatcattaacctcttggcctacttcggctacgtcttccacggctggtttggcgacaagatcgggcgtaaacgcacgatcatcggcggctggatcctctccggcatttccttcgccatcatgctcagccccattgtcaccagccccttcatgatcattcttacctacggcgccgggctgttcttcctggtcggaccctacgccgcgatccagtacttcatggccgagtgctaccccgtgagctgccgcgctaccggcacggccttcatcggcgccatgagccagcccggcacaattctcggcggcgcgctgttcaccatagcggcagccagtgccggaaccggcgctgcagccctgtgggtcggagcggccggaacgctgttctccggactcctgatgatcgccgccaagccccccgctgaagcacttctggaggaccacccgcatgacgtcccttaacaaagttgccatcatcaccggtgccgcgagcggcatcggccgcgccctcgccgtccactacgcccgccagggagtggtgtcagtcatcggcaccttccccggcgacccccacgatccggaggagaccctccgactggtcaaggaggccaacggtgaggcggtgatccacgaagtggatgtccgcaccaccgcatccgtggacgcccttgcccagcgggccgtggacgagtacggacggctggactacgccatcgccaacgccggcatcctccgcaattccccgctgggggagatgactgacgagcgctggcacgacatgctcaacgttgacctcaccggcgtgctgcgcacgcttcgtgccggggcggagagaatgaccgacggcggtgcgctggttgcggtctcctccatcgccggcggggtgtacgggtgggaggaacacgcccactatgccgccgccaaggccggcgtcctgggcctggtccgcagtgtggccgtggaactcggcccccggcagatccgcgccaacgcggtgattccgggccttattgagaccccgcagtccctggacccggtgaattcgctggggcccgaagggctgcagcgggccgggaaggacatcccgtggggccgcgtgggaacgccggatgaggtggccagcgttatcgggttcctcacctccgatgagtcccgctacatcacggggcaggcgctggtggttgacggcggcctcaccgtgaagatgcgcgcctgacagccacccagaaggaaaggacaccatgaacacatcgacccatgctgccgatcagaccttcgggaaggcccacacggggaacgggcgaagggtggtggtcaccggcggttccagcggaatcggcaaggccatcgccgaggccttcctggccaacggcgaccgggtggccgtgctggaccgcgcaggaggggacggcaccatccgcgtggacgttgcggatgaagccagcgtgcgcgcggccttcgccgaggcccgggacaggctgggcggcatcgacgtcctggtcaacagcgcgggcctgctgacggagtccccgctggaggacatgtccctggccatgtggaacgagaccctcacggtggacctgaccggtgtgttcttgtgctgccgggaggtggtgggggagatgcggcagcggaagtggggccgcatcataaacatcgcctcccagctggcgatcaagggcggtgtggggctgacgcactacagtgcagccaaggccggcgtggttgggctttccaaggcccttgccctggaaacggcggcggacaatgtcctggtcaactgcatcgcgccggggccgattgagacgcccctggtggagggcatctcggaaagctggaaggccgcgaaacgggccgagctgccgctgcggcgcttcgggacgccagcggaagtggccccggccgccgtgctgctggccagcgatccgggcggaaacctctttgtgggacagacgctggggcccaactccggcgatgtcatgccgtaacgaaaggggaacgatatgtgtggtgcctgcgggaggacaaccgttgccgaccctgccctggggccggtgcggaccatgcgccagcacctgatcgtggcagccacggtcaacgccctctgcactggcctcccgggagccccgaaggtgactgcgctcaaggacggctggctgatgaccagtccttccggggcttccaggcagtgccagactctcgaagacctgtggtccgccgtgctcggctgctttactggcgcgtcggttgcggaccgcctgcgcaggcgtcggcaggcctacgcagctgatccagccaacgcgggcctgccggcgcgcgccgctggggtgctgccggacccggccgtcccctactactcccaaggagattttgaatgactgattacaccccgctctggtcacccatccagatcggttccacggaactggagaaccgggttgcgctggctcccatgacaaggatcagcgcaaccgaggacgggcacgccacggaaagaatggcttcctactaccggacgttcgcccgcgggggcttcgggctgctgatcacggaaggcatctatccggacaccgcccacagccagggctaccacttccagccgggcattgctacggaggaacaggcccggtcctgggccaaggtggtggacggcgtccacgcggcaggatcgaagatcttcgcccagctgatgcacgcgggggcgcaaagccaggggaaccggtttgtggcctcctccgtaggaccatccgcggtggcacccaagggagaacagctggggttctaccgcggcgcaggtccgtatcccgttccttccgagatcaccctgtcccagatgaaagaggtccgggagggcttcgtcacggctgcgctgcacgcgcagcaggccggcttcgacggcgtggagatccacggtgccaacgggtacctgctggaccagttcctcaccgactacctgaaccggcgcgacgaccactacggcggctcaccggaaaacagggtgcggctcgccgctgaaatctgccacgacgtccgcgaggccgttggcccgggcatgaccgtggggatccgcatctcccaggccaaggtcagcgacactgaccacaagtggagcgggggagtggaagaagccgcagtcattttcggcacgctgggcgctgcaggcatcgattttgtccacaccaccgagtaccgagccaccgagcccgcgttcgcggatgcagaggaaacactcgctgcgctggccaagaagtactcgggcgtgcccgtgattgccaacggcaagctcgacgatccggacaccgccgtgtccatgctggcagagggttcagcggacgtggttgccctcggcaaagctgccctggccaaccggaactggccgcaccttgtccgcaacaatctggagttcgaggaactcgacccctccgtcttcgctcctttcgcggacgtcaaggattgggaactggaggacccggcgtaggggagttgatgccactacgcctgccaccggcatggtgctggtggcgggcgtggtggaggggggcccgtgctgtggcgcattctggtcttctacatcggttcactcttcatgatccgcaggttgttcctgtcggttctgaggggctgaaaagcccgttagccacggtgccgaatgtggccggcatgtccggcgctaccaccgccatcaccttggtagctgttgcggcgctgctttccgcgctcaatgccaaccagtatggtgcctcacggatggcgttctccctggccgagcggttgaagcgctgcgcgtgcttgccttcgtgtccaaaggcccgggttccggtggctgcagtcctacctcgaacaatgtggcgcccacccggttggtagcaccgagcttggtgtagatgtgctccacgtggttgtggacggtcgtgcgggagagaaacaaactggcggatatctcggccggagccatgccgtggcacagcatgccgaggatttccacttccctgggagtgagcccgaccggaccggccgtctggcggtggggctgctggcctgccgctgagcactgcgtcagcagcctcgggcccgatccggtcggctgaaacttcccgccgtagccgggcagctgcgtccgccggcgtgagcgcggcccggtgcagacgcggctccagcgagcctgctaggagtccgctgccgccaggatccgctgcttgatccccatttcagttcgccaatcgcccgcgggcaaccggaccagtttttctgctgcgtattggccagataggccgcgaccagtcctttcagctgttcggccctcgggccgccgaggtccgggatgcgtcccttcgaccggcctcgaccgcgtccaccagggccgccgccacctccctagccgccaccggccgggtgacattctgggcttgaacaccagcgaattcacggacgccaccttggtggacatcgacacgaactcgcggaactgggcagaccggaagaaggaccagggaatgccaccgtgcctgacttcgtccttctgcgcacctgcctcgagattggctttaaccgtgggacgtactgaatccggtgcaggtaggtgctcgaatggatcttccaccggtcgtttgggagaaggcggccgtcgaggcagttgcctgaattttggtccgtctgtttcatagccgaagggccaagggaagcgactcttgtgaggattgctctggggcagctggagtgggacgccgacatccaagcgaacctcgcggccatcgcccgggtcgctgacggcgcaaggcgtgacggccccgcgctggtcgcctccccggagtacccgccgacgagaaggagaacgtggacgcgacatttcccgggatggccgagccgctggacgggccggtctgccgggagcttgccgctattgcccgccgacaccgcatcgcgctggtgccaggcgtggtggatacctcggaagaaccggtcagggcatacagcctccaggagttcccggttgtagccttcggggtcggccagcgtttgggccgggagcgtccttgccgtctaatgccggggctggctgtcggccgtgtcagcggcctgcatcttgcttgcgtctcgaccggcgtccgcttcctgcacgggtctcccttgacagttatgtgatccatgcctcaccatcaattgcatagtaattggagtaccgaataaaaattcaaagggcccatcggccgttgagacatgaggagacgatgatgacttcccacaagatgatccgttcgggttgtgccgtgctgacggctgccgtgatggcgctctcgcttgctgcatgcggaggtgccggcggcccggcggccggggaccagaagaaggtgattggtgtctcggtagctgatcagaaatcgctgttctacgtcgccgaggtcgcggggatcaaagacgaggccgaaaagcttggctatgaggtcaacatcacgtctgccaacaacgactcgtccgcacaggtcaagcaggtcaatgacctcctgaccaaggaaatcggtgcgctgattttcacgtcccaggactcgacggccgcggccgcgggtgtgcgggcggccaaccaggcagacgtcccggtggtcgcggtcgaccagcgtccggagtccggccaaggtgatcttgccacctacatcgcgacagacagcgtcaaagccgcctacgaactctgcacatggatgtttgagcaaattggcggcgcgggggagatagccatcctgcacggcgtgctcgggtccaccgccgagatacagcggacagagggatgccagaaggcactcaaggagacgccaagcatcaaagtcgtcgctgaggaaaccgccaactgggatgagaccgaggcctacaaggccacgcaaaacattctcacggcgaaccccaaccttaaggcggtgttcggcgagagcgacgcaatgtccctcggagcgtcgaaggcagccaaggcagccggcaagacgatcttctcggtgggcatcgacgggttcccgaccatgttcgatgcggttgcgagtggtctgacccaggcgacgatggcgcagcagccgtacatgatgggccagctcgccgtgcgcaacgccatcgcgctcatggagggcaagggccaggacattccgaaggagcagtaccaggacactgtgctgatcagtaaggacacggttgcccagcacaaggtcgaagatttctacgggccggacgcccagtccttcaagtgatcccgaccatgacgacacagccagtttctgcgggcctggagggcactggcctcatgaaggcctactccggagtgacggtcctgaaatcggtcgacttccgggtcgaaccgggcaccgtcgtcgggctcgtgggcgaaaacggtgcaggaaagtccacgctcagctccatcatcacgggcgtcgtgaagccggatggaggcgccatgcggctggacggggccgactacgccccgtccagccccgccgaagcactccggcagggtgtggcgctcatccaccaggagacgcgcctcatccaggacctctcggttgccgagaacattttcctcgggcgcctcccgagccggcgtggccgggtggactgggagcttgttcgccgcgaatcgaggaccgtcctggattcactcggggtggatcttgacgtccgccgcccggttcgcggcctctcgatggccatgcagcaggaaatcgagatcgccaaggccctcagccgccgtccccggtacgtcgtgttcgatgagccctcggcctccctcggagagtcggagaccgaacacgtcctcgaacggatccgctcgttgcgggccgccggcgccggcgtcgtctacatctcccaccggctcgacgaagtccgggaggtcgcagacgagatcgtgtgcctgcgtgacggctcgcgtgtccagtcctggaattcgggcgacgtggacaaggagaagatcatcaacgcgatggtcggacgcgagttcacctacgagcacgtcccgccacagccgagccgcgatgcgaccgtgcttgaagtccggggcctcggccgccgcggtgtgttcgcggacatcaacttcgagttggccgcaggcgaagtcctggggatcgccggcctcgtcggcgcggggcggaccgaggtggtccgggccatcgccggtgtggaccgccccgactcgggtgaggtcatccttgaagggcgcaagcttccatgcaccagcccgcaatcagcgatccgcgccgggatcgtcatggtcccggaagaccgcaagggccagggcctcaacctggaccgcacggcagaggaaaacgtgacgctcccgtgggagcgggagctcgcccgaaagggcctgctgacccgcaagctggtccgggaagtcgcgggggcccaggcccggcgcctcgacgtccgtggcagcatggcgctaccggtgaagtcgatgtccggcggaaaccagcagaaggtcctcatcggcaaatggctggtcaaggatccgaaggtcctcattatcgacgagccgacccggggcgttgacgttggcgccaagatggccatctacgagatcatccgttccctcgcggccgagggaatgtccgtcatcgtcgtctcatccgagcttgacgaggtcctgggactctcccaccgcatcctggtgatgtcgcggggccggcagagagggattctacgccggggagaagcaaccccggagaccgtcatgtcgctggccgtgcactcttcagaagcagcggcccccacccttatttcccagcagtagaaagagcagcagccatgcgaagcacaacggatcatgccattcaacagaaggctccaggacgcggaagccggaccccggaaggcgcggggacgggcaccggcccgggcgggggctccggccgcggcccggccggcatcgccgccaatgtgctccggcgggtccccgggccgctgatcggcctcattgcggtgatggtcgcactgtccatcatgtcgccgtacttcctgacctggcgcaacctctccaacgtgatcacgcaaaacgcggacatcggcatcatggcagtgggtgcggccctggtcatcctcatcggcggcatcgacctgtccgtagggtccacgctggccttgtcgctcatgaccagcgcgtggctctaccgtgccgcgggcctcccgttcgagctgtgcgtcgttctgggcctcgccgtaggggccgcggtgggtttcatcaacggcgtgctctcgacctacggccgcatccagcccttcgtggccaccctcgccaccatgtccgcggcggcgggactggcgctctacctgaccaacggcaacccgattaatgggtttccggaatggtacctggccatcaccagcaacgacatcctcgggctcccgctcgaggggctcatcatggtggccaccttccttatcgcggcgtactggctccggttccgtccttctggccgcgcactgtatgccatcggcgggaacgccgaggtggcgcggctctccggcctgaacgtgacgcgcatcaagatcggcgtgtacgtggtggcgggcttcctcgcagccctcgccggcgtcatcgtcggctcccggcttgactccgcacagcccacggcaggcacagccgacctcctgaatgtcatcgccgtcgtcgtgatcggcggcgcaagcctcgccggtggctccggcggcatgctgaacacgttcatcggcctcctgatcatcggcgtcctgaacaacggcatgtcgctcctgaatgtttccccgaacctccagccggtggtcatcggcgtcgcgatcatcgttgccgtcctgaccgaccgcgccagccggtcccgccaaggcgcctgacgccgcatccccgttccgagaggacaccatgaccaccgacacctacgtcgtcgagcccatcgaggagctgctcgccgaggccgatcccgaccagaccctcgctccctgcgggctccgtcagctcatcatcggcccaggcgccgtgggggcagtggccgacgcggtcacccggctcctgccggccgcgccgactgccaccgcgactacgcggccgcgggtctcactcctggtggaccgtacccggatcgcgcgttccggcgaggacgtcaaagacctcatccaggcccagctcgcagccaggttcactgtcgttcgcacagtgctcgacgacgggcacgctgaactccacgtcgtcgacagcgtcctcgatgaggccgctggagttgtccttggcgcggatgccgtcgtagctgtgggcggcggcaccatcagcgacatcgcgaaggtcgcggtccagcgcgcaggcgcaggaggcagcaccccggtcctggtttcggtccagacagccgcctccgtcgacgggtacaccgacgacgtatccgtggtcctgcgggacggggtgaaacgcaccataccctcatgctggcccgacgcagtcatctccgacacggacgtcatcgccgaagcgccggaagccatgaaccgtgccggcttcggcgagatgacgtccatgctggttgccccggcagactggcggctggcctccctggtcggcagcgacccgacgtacaagcccagtgccgtgcacctgctcggcatggtcggcaaggacctggagagctggagcgccggggtccgggaggcccaaccggaatcggtgggcgccttggcacgcgcccttgcactgcgcggaatcgtcaccggtgtggccgggacgacggccgtcctgtccggcgccgagcacctgatcagccacatgctggaccagtaccacggcgcccataatgaacccatcggcttccatggcgcccaggtaggggccggatccgtgattgccgccagcgcctgggacatgttgttcgagcggctggccgccgcgcccggcagccggccgcacctggcagcccttgaccacgggcccgccaggcggagggtcctcgctgccttcgaacgggtcgatccaagcctgcgcgtggccgacgaatgctggcgtgattactcggccaagctcgacgctgtcggaaggaatctgggccgggtcggagcgatgctcgagggctggacggacgtcagcggggaactccgggacctcgtccggccagcggagtcgatcgcctcggcgctcgcgggcgccggcgccgctgtcaccctcgccgagcttgagccttcggtggatgccgagctcgggcggtgggcggttgagaactgcatcctcatgcggaatcgcttcacggtcgtggacctgctcacgctcctcggctggtgggaaagcgcggacgtggacgaggtgctggagcgtgccgcccaggccgctgcgcctgcggacccgggaaggaagtgaagccatgctgcgtgactatgtgatcggcgtcgactgctccaccacggccgccaaggccgtcgtctggaacgcccgcggcgaggcgctctcccaggcgcgctgcgccttcggcctcagtcagccccgtccgggctggggggaacagaacgccgaggactggtggaccgcctccgctgaagcgatccggcgggcagcccagaccgtggacacctcccggatcggtgccatctgcatcacgcatcagcgcgagagcttcgtatgcctcgacgacgagggcatcccgctccggccggccatgctgtggctcgatacccgtgccactgaggaggtcgccaccttcggcacggaagacgtccaccgcctcaccggcaagccccccaacccgaccccggcctggtacaagcttcattggctccaggcccatgaaccggacacggtctcacgcatcggcaaggtggtggacgttcacgggttcctggtccaccgcctcaccggtgcctggctcacttcctgggcctcggcggatccgctcggcctggtggacatgtccaccttcgattacgacgacggactggtcgccgccgtgggccttgaccgcgggcaactcagcgaactccgggcgccaggcagcgtcctgggcaatctcacggacgacgccgccgcgcaccttggccttccgtcgggagtcgcagtcgtggccggcgcgggggacgggcaatgcgcgcagttgggtgccggggcaacctcgggcggccgggcctacctcaacctcggcagcgggatcgtgtcggggacgttctcggaccactattcctatgcacgcgaatacaggacgctctccgccgcggttcccggggcgtacaccctcgagaccttcatcggcggcggcaccatcaacctcggctggttcatcgaaaaattttccggaatcgacgcccacggcctcggcctgggcctgagccccgagcaggttcttgaaaccgccgcggcggctcttccccccggctcggagggcctgctggccctgccgtactggaccggtgccctcactccgtactgggaccacaacgcgcgcggtgccctgctgggtctgaccggcattcacggcaaggcgcacgtgtaccgggcactgcttgagggactcgctttcgaacagcggctcctcaccaccggggcggagaaagccctggcagagcccgtggccgaagtggtcgccctgggcggcggctcccgcagcccggtatggtgccagattatcgccgacgtcatgcagcgcagcgtctccgtggtgcgggacccggagagcacgtgccttggtgcggggatgctggccgcggccgccgcgggcatccatgattccgtggcctccgccgccaaagccatgagtggaacagggctgtcctacgagccccgacccgccgcggccgcaaagtacgagcgactctacgacgtctaccgcgatatttatccggccaaccgggccgttttcgccaagcttgcggaggcaacgcgatgaatgcaacaacggccctgacgtccaggcccgtgagagcctatgccggctatctcttcgacctcgacggcacgatttatctgggcgacgagctgctcccgggggctgcggatctggtgcgcgggctccgggaggccgggcgcgagacactgttcctctccaacaatcccaccaagaatccgcagatgtacgcggacaagctgacccggctgggcctgcagacccccgtcaaccggatcgtgaacccgctggtcaccatcgtcgcgtggctgcgcagggaagctccgggggcgggagtctttgtcatcggcgaagagccgctgcagcaggccatccgttcggccggtttccggttgaccgaggatccacgggacattgacgtggtggtcgcgagctatgaccgcggcttcgactaccgcaagctccagatcgcctttgacgccctttggcagcaccggcgggcgcgcctggtggcgacaaacccggatgcctactgtcccatgccgatgggccgcggggagccggacgccgcggctgtgatcgcagcgatcgaggcgtgcaccggagtccggtgcgaggccaacgtgggaaagcctgccggagtcatgctccagacggcgctggacgtcctggggctctccggatcggactgcgtcatggtgggggaccggctgcagacagatatcgccatggcggtggacgccggaatggattcggccctcgtcctcaccggggaggccaccgtggagatggcggggctgctgccccctgagcggcagccgacgttggtgctgccgcgcatcgatgccctgctggagcccttccgcgagtcctgaccggccgcaaccaaagctgcaccacacgaacggccgaagctcttgccagttcggttacccacgaatagaattagaattcatgccttgaatatttaatcagaaaggagccgtgatggatctttcatcgcagaatttgctggagatgcagcggcgcatgttgcgtatccgccggtttgacgagcgggcatccaaaatggtcaagcgcggccagatccctggcaccgtgcacaccagcatcgggcaggaggcccaggtggtcggggcctgcatggcgctcggggacggggactacatgtccggtaaccaccgcagccacggccacccgatcggcaagggctcccccctgggtccgcttatggccgagctcgtgggcaaggcgacgggcgtgtgccagggcaagggcgggtcgctgcacctggccgacttcgccgtcggaagcctgggggagtccggcattgtcggctcgtcgattccgatcgcgaccggtgctgccctttcgagcaaggtgctgggcaacggcaaggtttccctggcgttcttcggcgacggcgccgcgaaccagggatgcctgtacgaggccatgaacatctccggggtgtggaacctgccggtggtcttcctgtgcgagaacaaccagtacgcgctgtccaccccagcccacacggtcacttccggagtgatcgccgaccgtgccgcgggcttcggaatgcctggcgtccgggtggaggacggccaggacgtcctcgcagtgttcgaagcggtcacgaccgccgtcgaacgcgcccgccggggtgagggcccgtctctggtggaggtggtcacctaccggttcaacgagcactccgaagggctgcgcctgggcaccgactaccgcgacgccgaagaaaaagcggcatgggttgaacgggaccccattgtcctgttccgccggcacctcgagcgggaagggatcgccacggccgaggaactcgacgccctggaagcagaggtcctcgccgaggttgacgaagccgtccgcttcacggacgagagcccctaccccgaccccagcgtcgcattcaaagacctctacaccgagccgatcggagcaatcgcatgactgtcatgagctaccttggcgctatcggcgccgcccagcgcgaggccatggaggccgacgagcgggtcgtcattattggcgaggatgtcgaagccaacgtctacggcaccaccggcgccgggaagtcgcgcaaggacaagggcgatttccttgagatgttcggggctaaccgcatccgcaacacccccatttccgaggaagtcatcgtcggggccgcgatcggcgcggcgatgaccggcctgcgcccgatcgtcgacctgtcgtactcaagcttcctgtacatggcgatggaccagttcgtgaaccaggcagccaagaaccgctacatgttcggcggccaggcgtccatcccggtggtgttccgctcggccatgttctacgggctgaacaccggcgcgcaccactccgaccggccgtacccgatgttcatgaacgtgcccgggctgaagatcatcgtcccgtccaacccgtatgacgccaagggcctgctccgtaccgcagtggactccgatgaccccgtcctgaccttcgaagcgtgcctgctctggggcagcaagggcgaggtcccggaggaggaatacaagatccccttcggccaggccaacgtcgcccggaccggcgacgacgtgaccgtcgtcgcgatctccagcgccgtcccggaagccctcgcggctgccgagaccctcgccggggaaggcgtctcggtcgaggtcatcgacccgcgcaccctcgtaccgttcgacaccgaagcagtcatccggtctgtgcagcgcaccggccggctggtcatcgccgatccggcccaccgcacctgctccgccgcggcggagatttcagccatcgtggccgaggaagcctttgagtccctccgggccccgatcatgcgggtgaccaccccggatacccagatcccgttcagccccgccctcgagaagcagctctacccgaaccggacaaagatcgaggacgcggtccgccgggtcacgggcttgatggcgaacacccttaacaccgaactcacatcgcccgcaccgcgcatgtgacaccccctaaaaaacaccaaagcaaggagaaagaaaatggcacgagttgaggtcctgctgccccagtggggcatgggcatgagcgaaggcaccatcaccacctggctcaagagcgtcggcgacaccgtcaccgaggacgaaccgctggccgaggtcgaagccgagaaagtcgaggagaccctcgagtccccggcctccggcaccctggccgaaatcgtcgtccccgaaggcgaaacggtcgatgtccgaaccctgatcgcctacatcgagaccgcctgacggtccagggcaggaaagggaacggttatgccacaggtcgatccacgccagatcatcaaggacgcgtccgagggctcctacgctgtcggtgcgttcaatatgcacaacgaggagactactgaagcgctcgtcagggccgccgaacgtgccaagtctccggttttcctccaagtgggccgggcgatcgtcccccacatggggcttaaaaaggcctacgagatgacgcgccgcatcgccgaggagtccgacgcggagtatgttatccacctggaccacgggccgtgggaggaagtcttcgaggccatcaagctcgggttcacgtccatcatgtacgacggcgcccaccttccgttcgaggagaacatccgcaccacccggaaagtcgtcgaggtggcgcactccttcggcatccccgtggaggccgagctgggaaagatccccgacgccgaccagcaggtcgactggcagtcctactatacgaatgtcgccgaagccgagcgtttcgtcgcggagaccggagtggacttcctggccatttcggtgggaatcgtgcacggtgttccgctggcgacagcgcagcccctggacatccagagggtcaaggaaatcgaggcagccgtgaacatcccgctggtcctccacggcgcctccggcgtcccggatgacgagatccgggccgcgatggccgctggagtgcacaagttcaatgcggacacggacctgcgcctggcgttccgttcgggcatcgaggctgtctggtcgcagggtgaccgccagctcgaggacgccatggcggagggccgggaacggatgatccaggcgaccatcgagaagatggagctctacggctgcgccggaaaggcccggggcctggcccaggtagggcggtgacagctgtcgaggaggaggagaggacggtcgtcccgctcaagggaatcaggcgcactgccgcgcggcgcatggtggccgcgtgggaggcgcctgccttccaccttgctgttgaggcggacatgggcgctgcgcttcgggtgaaggagcgcagcgccggcgccacggtcacggatgcgatccttgccgcctgcgcggccgcgctgcgtgaccaccctggcctgaacgcgcactacgccgaggagacggtcaccaggtttgcgcgtgtcaacgtcggcatggctgtcgacactcctgcagggctggtggttcccgtcatcaaggacgctgcctcgcttgatcttggggggctggcagatgcgcgccgggatatcgtccagcgcgcccgcgagggcaagctcaccatggacgatgtgacggacggtacctttactgtctccaatctgggcatgatggggatcgacggtttcgatgccatactcaacgtcccccaggttgccatcctggcagtcggcaccacacgccagcagttcgtgccgaccgacgacgggcacggcacttggaggccccgcgctaggcttaccctcacttgtgaccaccgggccatcgacggcgccaccggggcccggttcctggccgctgtacgggataacctcgaatccagctgaccgtgaccacctgcggcaaaggaggcccggacaaccgaaaggatgtccgggcctcctttctagggttttaggacaaaacgtgggtaagtcgggtgtgtcaggagcgtcctgcccagcccctgcgtgccagaggccttcgtctggctgttcttcgcgtttcggtagtggctggttttgatgagtttgactgccggcaggggctgttgcggttggcggttgacccgatctgaaggcctgcgaactcggtgcgcaggtaggtgaacaatgtcccggcccggctgggccgttccaggagccagtagggcttacggagactgtcgtgggtgtaccacgcctgattcgcccgcacccagcccggcacgacggcgctgccggttcgataagtgcgggttttgaccagatggccgtagctttgatgccagtcgttctgaccgccaagccaggccgcggcttcggcatcgtggtggtcttggcaagcgcccggccgagccgcagcagacgccggcgggattttatagggcctggacacacgaggacgccccccggtcgtttgaccgtggggcgtcctcgctgcctggagcctgcgcgcgctcacttcaggcgggagactacctccttgacaaggggccacacgcgggtgacggaggtgtggttgacggtctccttgggggagtgaagatcatgcagctcggtgccgatggagatgatgtccagcccggggatcttctggctgaacatgcccagttcaaggctgcactgggacacgtggacgtctgcttcgtggcccatgacgtcgctgaacgcctcccgtgccgttttcagcagcggtgaatccggccggtacgggaattcggcggcgtccaggccgtactctcccactgtgacgccgccgcctgcgagcgctgccagcgcgcggacccggtcgaggatctcgtgcttgcgggaggtgaccgcggcggtgatcgtggccatgagccgggctgcctcgggcgtggtgcgcacggtgccgaggttgttcgagctctcaacgatgccgggaacggtgaggctccagctgaggaccccgttggggacgagggcggtgaggcgggcaaagcgcgcagcggcgtcaggggagaaaacctgttcgggcgtttcggcctgttccagttcgaggcgaaggccggggtcggccttccggtactcgttctgcagcgctgcctcgagttcggagatgaccgaccgtacaccctcggtgtcttccgggcgcaccagcaggatggcctgggcatccatggggatggcattgttttgggccccgccgtgcggctgcgagatccgcacatcgtagcgggtgagcagggcgttgagggcccgggcaaggaccaggaccgcgttggcgcgctcaagatggatgtcgaactcacagtggccgccggagagcccgcggaccttcagcagcagcgcctccgtgtgcgtgccgggtgcggcctcccattccgccggaatgtcaacggtgaaggtgatgtccccgctgcagccggcgaggatttccttgtccgtaatccagttgaagtcgatcatccgcttgccggacagcttcgacgtgtcgaaaccggcggctccgaccttgcccttttcctccatcgcggtcaggaccgcttcgaggggagggtgcggggtgttcgtggagtcaagcagggccaggatataggagacgccgatgccgttgtcggcgcccagggaggtgccgttggcggtgacgaagtcaccgtcgatgagcagttcaaccggatcccgctcgaagttgtgcaccacaccgtcttccttctcgcacaccatgtccaggtgcccgtggaggatgagcggcggtgcgtcttccagcccgagctggccgggcttgcggaccaggacgcagtgcagttcgtcttgggtggcctccagcccgcggtcccgcgcgaagctgaccacccagtcggcgacttccttttcgttgccggagccgcgggggatgccggcgagggtttcgaagaaggagaacacctcttgcggctggagtgatttcagaactgacatggggtgtgtgcctttcggaaagggtagggacgtccccgcggcgttgcgggggacgggagtattttcggatgccggtggtccgtgttatttgaccacttcgttgtggccgcggcccatggtaagcgccacagcggcgatgatcacaaggccatagaccaggctctgcgcctggggcgttatgccgacggcggcggcaccgatgggcaccagcgcaacggtcagggcgccgaagacgatgttgatcgggttggtgatgccaccggtgatggccgtgccgcccacaatggcggcggcgatgcccggcagcaggaggtcgcttcccaggccgaaggatgacgccgcaccggcttgcgcaatgacaaggatcccggcgacgccggcaaggaggccggaaagagcgaaggccaccactttgaaccagcgggtccgcaggcccgagaacagggcgcccgtctcattgagtcccacggcggtcatgccttcgccggcccgggtgaaccggaggaacgcccacagtcccactgccagcactacgccgacccagaaggccatgggcaggcccgcaagggctgtaccgaacaggggagcgagcagctggttgtttgccgtggcatagacggtggtggcgttgctgatcaccagtgaggcggcctgcaggatgccgagcgtgccgagcgtgagtgcaaaggacgggatctggccgaacgccaccaggaaaccgtttgcggctccgatgacggtaacgagggcgagcgtcacgatcggcgctatcccaccaaggggaccgagggtctgggcgaggatgatcgccgcgaagatcacgatcgctgcgttggacagatcgatcgagcccacgtggagcaccatggcctgccccagcgcgaccaggaggatcgttgcggcttggacggcaaggatcgccatgccgccaccggtcaggaacgccggccggaggatggcaacgagggcgaacagggcaaggaacaccgcgaatggcccgacggtgaaccacaggttccgtggccggcgccgcgcggacttcgtcttgccgtcggcggcggccggcagtgcggccggctgctcgaggagagctttctttgacatgggattcacaccatcttttcaagcaggtcgagtgaagtcgggctgtcgacggagaggtcgaagcgggccgtgatttcgccgtcacgcatcacgatgatctcgtccgccatctcgagggcttcctcgagtgtgtccggcagcaggatcacagctgcgccgtcgtcctgggccgcgcggatctggtcgttcaccgtctgcgaggcgcctggatcgaggccgcgaagcgggtggtcaaggatcaggacgctgagctcctccgcccgcagccatttggccatgaccactttctgctggttaccgccggaaaaacgcccaagcggaaggcgggggtcccggggccggacgtcgagccgctcgaaccaatcctccgcggctttcatccgggccttgcggcgcaggatggggcctttggctgcctcgcggggatgcaccagggtgaggttctcggcagcgctcaggccgccgaccatgccctcgaccttgcgttcggaggggatgtaggccagtccgtgccggacggcgcggcgcatcgaccagccctggacgggccggcccgcaacctccagggtgccggcgtcgaatgcctctgctccgaagagggcccggcaaacggattcgcgtccggaccctatggcgcccacgatggcaagggagcgtcccgcggggacggcgaaggaaacgtccttgaattgccctttcctgcctaggccctttgcctcgacagctgccacggcacccgccgcgctgccgcccttgcgaacccgtgcccgtgattcctgtccgatcatgaggcggaagagttcctcctcggtgacttcctcgcggcgcacgtccgcgacgacctcaccgtggcgcatcaccaccacgcggtcgcagatccggagcacttcgtccagacggtgggagacgaacagcaccgaaccgatgtcccgcagggaacggatctcgcgctcgaggatcgccgtctcgttgcgttccagcacggaggtcggctcgtccaggattaccagcggtgcggcgtggatggtctcatccacgcgcagcgcacgggcgatctccaccatttggcgatccacgaacgagaggtcgctgaccttggtgcgcgggtcgatggtggagccaacacgggcgaggatggcggccgcctcctggttcagccgcttccagcggtagaacccgtagctggtggccgcgtccttggaggacagggcgttcatggcgatgttctccgcgacggacaggttggacaggagcgactgctcctggtgcaccacgccgatgcctgcggcaaccgcgtcctgcggcttgcggaacttgacaggccggccgtctgtttcgatggttcccgagtcgggctggtagaggccggtcaggatcttcaggagggtggacttgccggcgccgttttcaccgatcagtccgaccacttcgtggcgcgggatcttgagcgagacattcttgacggcgtgggtcgagccgaaggatttcgagatgttggtcagccgaagtgccggagtctcaactccggtgcggggagccagggaagcgttggtcattttacgattctcagtctgctgcggtgcggccaggtagccacgaggacagccgcgatcaggacggttccggagaccgcggattggatgtttgggctgaccccgctgaggatgagcccgttgttgaggacggtcagcatgagcacaccgatcgcggtgcggaggatgccgcccttgcctcctccgagggaggtgccgccgatcaccactgcagcgatggtcaggaagagcgtccccacacccaccgtggccgatcctgcaccgagcttgagggctgccagtacgccggcagccgcgctgcacccaccggccacgatgaatacgtagagcttgtacctgagcacgggaattccgttgcccctggagatctcctcgctgtcgccgatcgcataggcaaagcggccgagcctggtgaagcgggccacgaacattccggccaggacaaacgcggcagccagcaggaaggagttcggcagtccgaaggtgagggtggacggccaggccttgatgccgccgtcgggcaagaagggaatggactggtcgccgaagagcaccgtagcgattccgaggcccacgaaccagacgccgagcgtgacgatgaacgagggcaccttgaggcgagtgtggaccaggccgctcaggaggccgaggccgacgcccactgcgagccccgcaacaatggcccacggaccaaagtccgcgctcccgcggctgttggcggtcagcaggacgaaggtcatgcctgcggcgcccatcacgccctcaacggagaggtcgatcgaaccggtcaaaatgaccagggttgcgccgacaccgatgatcaagggaagggacgcatggtccaggatggtccgcaggttctccggtgagaggaacgtcgcgggattcagagccgcgaaagcggcgatcagtccaatcagtgcaagcacttcgccgaggttcttgacgtcgaaccggcggcccgccctgaggggtggctgtgatggggagggtgccgcctcgaggaggccggtcccggtgtccttgtctgtcattactttcacctgtcgtggttcctgccgataaggcggctccgggtccgcatgcgcgttatccggagccgcccagcgtttgtgatccgttagggcaacttctccgggccaccggagaccagcggcacgggatcggtctcccaggggccgttttcgatgagatcgtccatccatccgtcgatgtcaccgtcgaacttggtgtattcggagaagttgtccggggtgacgcagctcagcttgaacaggctgttgcgcttctccttgggcagctccgagggcttgatctcaccggtggcggcgaggtaggaggtgtagagcccgatagcagcggccatgaatccacggtggaaggtctcgccggcgatggcgccgttgcccatgttgtccttcatcatgtcgacgaccggcgggtagaggccgtcagaggcgaacttgacgtcgtcgatgcggccggcgtccttcactgcctgaacggcgccgatgatcatgccgtcgtcggcggcccagatgccgtcaacctcttcgccgtacttggccaggaggttctgggtctccttgaggccgagctgcgggtcccagttggcagggcgggtgtcgaggagcttcacgtcagggtaggccttgagggcatccttcagaccggcgacgcgggtctggctggtggtgctgtccagcacgccggcgagggccacgatattgcccttgccgccgatgctttcggcaagcgcctttgcggtgcactggccgctctcaacgccggagtgcttctggaaggcaacgaagttgtcgccctggtcccacggctcgaagttgtccggcttgttccaccagaccgttgcgtaaccgcctgcagccttgacggcgttgatgatgggcggagcatccgagctcgccacggtgttgaccatcagggccaccttcttgccctgggccagaatggcctggatcttcgagatctcggtctgcgagcttccctcggagtcgacgatttcgagcggcacgtcaagcttcttggacaacgccttggcgccttcgatcatggaggccatgtaggggttggtggtgttgatgaccgacgcgacaaggacgatgtccttcttgtcgatcggctgctggctgccggccgtggtggaagagcaggccgtggtggccagcagaccggccaccagcccaaaagccgctacgcggcgggcgatggatttcctgaggtgcatcaaagactcctttgtgaaagacgacccgaagagctgaaagatatttattcagctactgcatttgcatgctatcgagtgtgcgttacctcacaggaactgtcaaggggttgcccaacacgggtatcgggggacggcttaaatggctgtggggaggctgcaaagcagcctccccacagtccagcgtgcaggcctagcggagcgtcctgaagaacgtccggacgtcgtcgacgtatgtatccggcacctcgagcggagcgaagtggccgccgtcgtcgtggatgcggtactgctggaggttgaagtacttctcggtccagttccgtggcggcttgtagatttcgcccggatagattccgacggcggtaggggcgcctaccaccgggaagcggtcgtgggatggtttccagggattgcccctgcattcccagtagtagcgcgaggacgtgccgccggtgttggtaaggaagtagacggcggcagtcgtgaccaggtcctccttcggccacacccgctcgaacgcttcagtgccgtggccgcgctcctccagtccccagaagtaccgcttctcggtgatccaggccagctgtgcggcaggggagtccgcgacgagtgcagccagggtctggggttttgtcagctggatctccccgtacccgctctccttttggacaaagagtttgccgcgttcgaaccagcccttttcctctgcgttgttgtactcactttcgtcggggagtccaaggaaaggatcgtatttcacgcccggaggggcatccggatgctcagcgaggtagtggctcatctgggcggggaagtgcgtgtagacgccgtagacatcgtcctcatatttgtggccgtgctgctgggcgataagggccccccagtcgccgccggcggtcgcatacttctcatagcccaggacgtccttcatgagggcgttttccaggtcggctgtccgccaccagttccagccgggctcggtcagcggcgaggagaagccgtagcccggcagggagatcaggaccacgtcgaaggagtcggccgggtcgcctccgtagctggcggggtcggaaagcgggccgatgactttgcggaggtcccagaaggtccagggccagccgtggtggatgagcagcggcatggggttcggccccttgcccttgacgtggatgaagtggagcggaacgcccatgagttccgttttgaagtgcggcagttcgttcatgcgccgctcgacgtcccgccaatcgtattcgttgatccaataatcgacgagctgtttgtggtagtcggtgttgtatccataccgccagtcatcgttggcgaaatccacgggatatcgggtgcggcggagccgctcgttcatatccttgaggtcctcatccgggatcgagatggtgaagggggtgaccccgccttcgttgtgcgcagccattgcgcctcctcgtgaaaaatagttggttgggtttgacgtgctcaggtgatgttgtacagagcccgcgcttcttcatgggttgcgatgggccggcctacctcccgcgcgatctcctgggcctgctgcaggagttcgaggttggtgggattgcgggcgggatcgtagaagagctcgaggccggtcttgatgtggccgccgagctcgatggcacggcggaggatggcggtgtcgtcgagggcgccctgtccccagatcgagatgtaccaggggtgcttgaccttggcttcctcgatcatggagaggtagtaatagaggctctcaaggctgggtttcatgccgttcgtgccgatcgggtccatggcggtgagcccgtagtcgccgatgaggtagaagtcccacatggagccctgcgtcgacaggccccggttgacgtagtgcatggcgtggcgcaggtggcccggctcgtacacgccgaacaccatggccaggtcccgttcgcggaacatctttacctggcttgccacgcgctggtagttgaacccgaactccggtccggagaggtagccttcctcgtcttcctcgacggcgaaaagcgtcaggccggtatcgacgcagccgatgcgtacgttgccgccctcgtacaggtgcggcacgtgctcgagcccgttttcgtggggcagcagccggaggttgttgcaggtggtgggataccacgtgatgtccgggtgcttctcgaggacccggtcccaggtgcgcatgtagtccttgtaggcgttctccccgagcaggtcgaagctggtgttgtgggcgtggattgccccggcacccgcctcccagcacctgatcgcgtcttccgcgatttcctcataggtgatgggcgtattcgggttcatctccttggtgcggatgccgttgatgtgggactcgattaccacggggtagtcccagttcggtttcatgtcggcgtacttgtcgagggcggtgggcacggtacctcctgcaggtggcgtggcgccgatccactggcagtcagccgctagggggtgaatcgttatgcgcacttctaatgaatatgccatcgatcatgggacgtacgtcacagcgttgtcaataggtgcccggtgtcgcgggcggttctaggctttcgaggcggtcgtccgccgccgcggagctgactgcgcgggcttcaggtccacggccgcctggcggtccgccgacgccgtttcgacaaggaagcgtgcagtggccgcgtcggtgaccagtgtgtccacccagccgccggccgctgctgccctgatggcccggtgcttgcgggcgcctccggctacggcccaccggtgccgtgcgttgcgcagctgctcccgggtgatgcctaccaccaggtcctcgagctccgagtcgatcgggttcccgtcggcgtcgaggaagtgcaggcagacttcccctactgccccgagctcacggacgcgggcgaactgctcgtccgtgaagaagttgtcgccagggcgcaggtccggatcgatctcgtcgccaccgatacccaccagtgccaggtccaccgagtcgagcatctgcagcgcctcccgcgcatgcggatcgccgctcagcaggagttccttcatctccaggctggctgcgacgccgggcgtccggaggaaaacgggctgcgccccggtgagggcggcgaactgctgggtggaccgcgccgtggcgtgctggagcgagggcggaccgaggtcgcccagcgtttcgatgacgtgcttgcaccgggtgcgcatgggcagcatgacgtcgatcatcgtccgcatcgtcttgctccaggacgtcaatgcgatcgtccgcacctcgaaggccacgtcctgcaggagcgtggacatcgtgtgcgccaggtccttgcccagctcttcctcgttatcgctgacggcgtcgatgatgtggacctcactgagtccatacaatgcctccacgcgttcttcaagctccgcatggacgtgcgggggaacagccaccacggtccgcacgatcgatgcatcctcggcctgggccagcagcctcgatacccgggactgggaaatttgcagccgtttggcgatatccgtctggcgcatctcgtgggtatggtaaaggcgcgccaccttgatcatcagtcgctgcgcgtcgacgtcgttcattaaactccttctttttctccgcccatcttatggcccccttgacacgtgacccggggcacataagacttgtaaatggaaatgcagcctataaatatttattctattgcttgtgtggccggaagggaagcgctatggaggagttcagcactccgttcgacgtcgtcgtcgtaggggcaggcatcaacggcctgggaatcgcgcgggatgcagcgctcagggggctgcgggttgccttgcttgaacaggatgacatctgcagcggcgtctctgcgtggtccggacggcttgtccacggaggactgcggtacctcgaacaccgcgacttcgcgctggtccgggaatcgctgcgtgagcgcgagctcctcttccggctggcgcctcacctggtcaaaccgctccggctcatcatgccgctgagctcgcacagccgccgtcccgcctggctgatccggatcggcatgttcctgtatgacgccctgtccttcgacaagaagacgcaggggcatgaggtcctgaaccgggacgccatcctccgccgattcccgggcatttcacccgagggcctccgaggggcagtggtgttcacggacggacaggttgagtacgcggagcggctctgcaccgaggtggcccttgccgcagccggcgcgggcgccgtgatccgcaccaagtcgcgggtcgaagaacccgtcatggaaggcgggcgcgtggtcggggtccgctaccggaacaccctgaccgatgagatgcatgaggtccgcgcgccggtcatccttaacgtggcaggcccgtggatcgaccggattttccgccggggtgcaccggagcagccgcggctcaacggcggaaccaagggcagccacctgattgtggaccccttccccggagcccccgacgacgtcgtctactacgagtccaaaaccgacggccgccttgtcctcgtaatcccgtggatgggccgctacctcatcggaacgacggacctccggttcgacgacgatcccggcgaggcccgttgcgacgctgacgagatggactacctgctgggcgaggtcaatgaactcatacccagcgcaagcctcacgcccgccgacgttctcttcacctattcgggggtccgcccgctgccgtacgcaccggatgtggaggagtgggagattccccggagccatgtcctccacgaccatgccccggacctgcccggcctcatcaccgtggtgggtgggaagctgaccacgtaccgtcagctcgccgaggacgcggtggacgacgtcttcaagcgactcgggcgcaagagcccgaagtgcgtgacggccagccttccgctccccggcgccgccggtgacttcaccgcagcccggacggccctcggcagggaaggcctggatgggcgtacggtcgaacggctgctggcgctgtacgggaccagggcactcgacgttatcgccgaagcggacgctgccggcgccggctatcccgtccttgactccgcaacgggcgcactcgaggcggagatcctcctcgcagtacggcacgagttcgcgcagaccctcaccgatgtcctggcacgccggatgctcctggccttcgagccgggtcacggcctcgatgtggtcgagcgggctgctgccgtcatgggcgccgaatgcggctgggatgctgaacggcaggcggcagagatccgcggctaccatgagtggctggaacgcctcgcggttccgtcccgtgccgcacaggacagggccgcagcggagggcactacgccatgaccgcgcgctacgtcctggcgctggacgagggatcgaccagcgcccgtgcggtcctggtctccctggacggaaagatcgtggcggaagcccgccacccggtcatcccccttttccccaaaccgcgctgggtggagctcaaccccaaggcgctctgggaggcccagcggagcagcatgcaggctgtcatggtcaaggtgggcgccactacggacgatctggccgccgtcggaatcaccacccaccgcgagtcctgcctcctgtgggaccgccggacaggcgagccggtccacaacgcgatcatgtggatgtccaagcagacggacgggattgtccagcgctggagtacggatggccttgaccaggagttccggcagcggaccgggctctttaacgattcgttcttcagtgccgccaaacttgcctgggtgctggagaacgtggccggtgtgagggaacgcgcccagcgcggggagctcgcggccggcacggtggacacctggctgctgtggcagctgaccggcggccgttcacatttcacggaccacagcgaggcgtcccggacggcgctgttctcccttgaaacacgcgactgggacgagaagctcctcgaggcctgcggtatcccggcccgcctgttgcccccggccctgccgtccgattcacacttcggcgacatgcggccggccgacgtcggactcccgggcacatcaagtgtccccatcatggccatcatgggagaccagcaggcggggatgttcggccaggcgtgttttgaaacagggtcggtcaagaacacctacggcaccgccggtgtcctgactgccaacagcggccctgcgcccgcgatcctggacggcctcaccgccagcgtcggctggaccgagggaggaacaaccgcctacgaaatcgaaggcgtcgtgttccactgtggccagacgctgcagtggatgcgggagcgcctggggatcctttccgaggacaccgaccttgaggaactggggcgcagggtccaggacaccgctggcgtctacatcgtcccggccttcgccggcctgtgcgcaccgcactggtcccgggacagcaaggcgagcatcgtggggctgacgctggagagcagcgccgagcatattgtccgggccggcatcgaggcgatggcctaccagacgcgggacaatatcgatgtccttgtcgccggcggcaacccggttcccgagcttaaggtcgacggcggtgcggcacgcagcaacctcctgtgccagttccaggcggatattctcggggtccccgtgcttcggcccactgaactggagcggacagctttgggcgtggcccaccttgccggcatgggcgccggactctggagccgcgaagacctggccaccggctggcagatcgaccgggtttttgaaccggcgatgccggcggaccggcgcgaggaactctacgccggctggtgcgacgccgtgcggaccgtgaccggacggaatccgggtcccggaacgctgtgaacgccgtccatccgccgttcggttccggcccggtccggctggtccacgatccgaaaccgcgctccggcccggaggacatggagttcgttgccggccggctccgcgcgctccctaccgccccggccggtgagctgaacttctcccggccgcttcctacggcggccttcagccgccgggattcgctccgccccggctacccggcggccaaaaacctgctggcagcgcgtggatacgaaccgatcatccggcctgtcgggggacatctggcgctgtacggtcccggcgacctggtggtccacctttgggcgccgcacccgcacgcgcgggcctccatcaaggaacgcttcgagtccttcggccaccacaccgccgcggccctccggggcctcggcgccgacgcgcgcgtcggcgctgtgccgggcgaatactgcaccggtgaattcagcgtcaacgacgccgggcgcgccaagctggccgggaccgggcagcgcctgaccaaggacggctacctgttcagcgccgtcgtcatggtcgaggacgcgggcccggcgcgggcggcccttgaagaggcgtacgcgctcctgagcctggatttccgccccgaatccgtcggctgcgtcgccgacgccgtgccgggcgccaccgtggacagtgtccgcgaagcgctggccggcaccctgatgcacctgcttcagccggccgcacgccccggtttcacgtccaccgcgtgccgcgccgcgcgtgccattgacccccattcgcaatacaccctctctggagccacccgtgtccactgaccactccgtccgttccactgtccaggcactccaaagccgcccacaggcccgcgtcctcatcatcggcggcggcatcaacggcgtcggcaccttccgtgacctcgcgctgcagggcatcgaggtggcactcgtggagcggggcgacttctgccagggtgcctccggcgcctcctcgcacatgatccacggcggaatccggtacctcgagaacggcgagttccgcctggtgcacgaatccgtggtcgagcggaaccggctgctgcgcatcgcaccgcactacgtcaagccgctgcagacgactatcccggtgttctcgacgttctccgggctgctgaacgcgccgctgcgcttcatcacgcaccgctccggcaaaccgcaggaacgcggggccctcctggtaaaggtgggcctgagcctctacgacgcgttctcgcgccgcggcggaacggtgccgcggcaccggttcgtgggccgcaaacgctccctggccgagttgcccgccctgcggtccgacgttaaatacacggccacctacttcgacgcctcggtccatgaccccgaaagacttacgctggacgccctccgggacggccttgaggccgggccccacgcccgcgccgccaactacgtttccttcgtcagaacgcacgacggcggcgcctgcctccgcgatgagctcaccggtgcggaattcaccttcgccgcggacgtcgtcgtgaacatgaccggcgcgtgggtggacgcgaccaacggcaccctggggtcgccgtcgcgctttatgggcgggaccaagggctcgcatatcgtcctggaccaccccggactgctggccgcgacgggcggccgtgaaattttcttcgagcacagcgatggccgcatcgtgctgatctacccgatcggtgaccgcgtgctggtgggcactaccgatatggacgcgggtgaggacctggagcccgtctgcactgacgccgagatccagtatttcttcgacctcatcaggcacgtgtttcctgcggtggcggttacccgcgaggacattgtctacaccttttccggcgtccggcccctgccgcggcatgacgacaccgccccggggttcgtgtcccgggactaccgcatcgaacgctcggtcctgcccggaaccgaccggcccgtcctgagcattgtcggaggcaagtggaccacgttccgggccctgtccgagcaggtgaccgacgaggtcctgggcatgctcgggcgggtccggtctgtggatacgcggaacctgcccattggcggagggcgggcttaccccgaggattggtccgccatcgaggcctgggtcgccgcccgcacccgtcccgcgaccggtgccgaccgcgcccggacgctgctggcccgttacggcagccgtgccgacgaagtgttggcgttcctggcagagggggacgacgctcccttgcggagcaccgttgagctgagcgcgcgggagctggcctggatggcgcgccacgagcaggtggcccacgtggctgacgtcctgatccgccggacgagcctggccttccggggcctggtcagcgcggagcttgcctatgaggtggccgcgcaactggcgccgcatcttggctgggacaccggcaaggtcggccaggaggcggaggcggcactttccctgctcgccgaacgccatggcctgggcacggcagccacgggggtgctgtcatgacactggcacctgaaggccggaagcttttgcgcgttgaacagcgcaattctgctgttccggtggagcgcaagccggagtggatcaaggccaaggtccagatgggcccggaatttgtccagctcaagaacctggtcaagaaagagggcctgcacacggtgtgtgaggaggccggctgccccaacatcttcgagtgctgggaggacaaggaagccacgttcctgatcggcgggtccgagtgcacccggcgctgtgatttctgccagatcgataccgggaagccttccccggtggacatgttcgaacccaccaaggtggcccggtccgtgcaggcgatgcagctgcgctacgccacggtcaccggcgtggcccgcgacgacctcgaggacgagggtgtgtggctgtacgccgagacggtccggaagatccatgaactgaaccccggcaccggggtggaactgctgatcccggatttctccggcaaacccgagcacatcgccgcgatctgcgattccaagccggaggtgttcgcgcacaacgtcgagaccgtgcccaggattttcaagcggatccgtccggcgttccggtacgagcggtccctggatgtgatcacgcagggccggcacctgggcatggtgaccaagtccaacctgatcctgggcatgggcgagacccgcgaggagatctccgaagccctgcgggatctgcatgaggccgggtgcgacctgatcaccatcacccagtacctgcgcccgagtgagcggcacctgccggtggaccggtgggtcaagccgcaggaattcgtggacctccaggacgaggccaccgagatcgggttcctcggcgtcatgtccgggccgctggtccgttcctcctaccgcgccggccggctctgggccaccgcgatgcggaagaagggccgcgacatcccggcagaactcgcccacatcgccgacggcatccaggactccggcagcacccgccaggaagccgccaccctcctggcccgctgaaacccggtaccttgcccggcagaaccgaaagaggaaatcatgagtgaccatgccacccagcctgcggccttggccgccgacgtgctggtccagctgaaaaactggccgggcaccccctccctcgctgtggtggggcccgaaggggtcttgggctgccacgacgaaggacgggtctatcggctcgcttcggtgaccaaactgctcaccgccctcaccctcctcgtcgccgtagaagaggatgccgcctcgctggacgctccggccggtccgccgggttccaccctgcgtcacctgctggcccacgcctcaggcattgggttcgaggaggaaaaggtacgggccacgcccggagccagaaggatctactcgaaccggggcatagacatggccgcggagtatctcagcgcccaaaccggcaatccctttgaaactgaattgagggaacgggtcctgaagccgctcgggatggaccggacatcgctggccggcccgccgtcgaagggaggcacggcccccatcggtgacatcgcccggcttgcccaggagctcctgcggccccgcaccctctccaactccgtggtggacgcattgtcctcagttgagtttcaggggctggccgggatgctgcccggattcggccgccatggggacaactcctggggcctcggtgctgaggtgcggggcaccaaggaaccccattggacgagtccgcagaactctgcggccacgttcgggcattttggcatggcagggagcttcctttgggtggaccgggaagcggacctggcctgtgcagcgctgtccaccgtcgatttcggaccctgggccgcgcgcatgtggccagagacatcttccgccgtcctgaggtgctaccgcgaggtgcagccacccaagcccgggcggccagccagaaccgaggccaaccaggtgtattgaccacggcccgtgaaagaatttcccgacaacatcacgaagaaaggcaccactcttgacaccccaggccaattcctctttccgagtagcgatcgttagcgcccaatggcatgccgacatcgtcgatcgcgccgtcgagagttttcacgcccgactcaaggagctgggcaccgccaaagttgacgcctatcaggtccccggcgccttcgaaattcccctggtagttcgaagactcgcagcttccggccaatacgacggcattgctacctctgccctagtggttgatggaggcatctaccgccatgagttcgtctcgcaaaccgtcgttgaagcccttatgagagtccagatggaaacggatgtgccggtcttttcgggcgtcctgactccgcatcattttcatgagcacgaagagcatcggaaccaattttccaatcatttcgtgacaaagggacgggagctggcagacgccctggcctcgacccttacgacgttagcctcgatctccgcaccgcgtgcgcccattgttcccgccgcgcccgggcttcctctgcagtaaccagtggaacgaaagctgtgcggtccctggtgaacgcttcgcactccaactctgtccagaatccgcgggccactccagcaagatgggcggctccaatggccgaaagttcggctacgttgttgcgcaggatctcctgctgggaaagatccgcctgaagctgggccagccagtcattctgggccggacctccgtcaaccaggacatcggtgacaggttttcccgccgcccgcgctacttcggccaatacgtcctcagtctggagggcaatggattcgaaggctgcccgggcgatctcggcctggctggttcccagcccgaagccactgatgatggccttggcctgaggatcccagtagggcgcaccgagtcctgagaaggcaggcaccaggtccaagcccgagttcgggggtgcgctggcggccagccggctcaacccgtatggatccgtgccgaagagctcggacaaccaaatcagtgtggaccccgtggaaaggatagttccctccagggcgtatgcggggctgccggtactccaggcgatggtctggacaagccctccgtccccaggtgccggagccgtcccgctcagcgcaatcaccgagctgccggtgccgtaggttgctttgacgcggcccggttccctgacaccgttggcgtacagggcggcatgggaatcaccgaggactgcatagattctcgtttcccgcggaagagacgaaagagccttgagaggtccggagacctggtcagaagccacaatctccggcaaagcctgctccgggatgccaaaccgctcggccaaaccggcgtcccactgcgcccgctccaggttcagcagctgggtgcggctggcattgcctatctcgatgcggtgttcgcccgtcagcgagaagagcagccaggagtcgacggtccccacagctatccggcccgaccggcagccggtacggtccggatcagcctggtcaaggagccagccaagcttcaaggccgagaacatcggatcaagggggagcccggtacgggagcggacctcgtgcccccacccttcttcataggcggcagtggcgcgttctgtagtccttcggtcctgccatccgagcatcgggcccaacggctcgccggtctgccggtcccagaccacggcggactcgcgctgattgctcagtccgattgccgtgacattcaacggccgttgatcgactagcgacgccatggcggtgaggacgctgtcccggatctccaaagcgtcctgttccacccacccggggcgggggtcgttccgcgagacggggaccgagctgcgggccactacccgtccgtgaaaatcgagtgctattgccttcgtcgaaccagtaccttggtccacggcgaccacgacgtcggtcgcctcatggtgggaagaagcgttcacgcggaattcctgttcagccattggtgccgggggctacggaagcggtctctgagcttctgtaaaagctgctcggcatatatatgcaaatttgagatatttatcctattgaagagtttgaacgtttcctgagagacatgtcaagggattagccggaaaccaccatcgcgggaaccagcaccagggtctggccgtctccagtgcgcaggctgcccccacgacgcccgcacgtcccagcccgatgaactggaaggctctccacgccattgccgcgggatccgcgcgagcaggtgtacgccggcgcgttggagtccacttgaaggatgtcttggctgttcaggagctgccccaagttaggtggcagctttggcgctgccttctgccagccccatgaacatggttcggtgcaggatgtccacgtgctttcgggaaacctcgactgcttcctcaaccttgccggcgcggagggcggctacgagcgcgatgtggtcctggttggacttgtgcagcttctcgatcgggtaggggatgaagtagtcgtagagctcggcgagagtctcgtggtaaacctcgacggcggagtccagacatgacgcagtacccaccagttggtggaactgctcgtccatccggtggtagaaggaccaatcggtggactcagccatctcacgcgtcagccgctccagctcatccagctgctccggcgtggcattcaccgccgcgtagtgcgtcacggcgcactcaaacagcagccgccggtccaccagccggttcaccgcctgcgactcggccggtgacgcggacaactccgccagaacatcgctaggcggggaatccgccacaaacgttccgccggcccggccccgccggcggaccaccacgccctgctcggccaggctcgccaaagcgcggcgggcggtgatcgggctgaccgacaggcccagcgcaacgtcctcctggtcgggcagccgctcgcccggcttgaggagccccagcgaaatcgccatcccgattcgcatccgcaccgcgtccatcgcgctgcggcgctccatcccgggcatcctgccggcgccgaggcgcgggggctcaacggtgtcctccagctgacgcgtcatatccgctactttacggcccactcctgccctcttccctttattggatcattctgatctaatataacccggatcacaccccacagcggagaaaaacccatgcaacgcatccttcccctcgtcgccgcccaggcaaggccccggctgatcggcgaacccgtctcggccttcgcggacgaggtcaaagcagccctcgaagcccagccgcacagcaagctcgtcgtcttccccgagctgcacctcttcggcgacgaaaacccggacctgcaaagaaccgagagcctccaagcgagtgccgagcccctggacgggccacgggtcaaagaactcaaacagctcgccaaagacctcaacatctggctcgtccctggcagcgtctgcgaacgcggcccggaaggccagctgttcaacacccagctggtcctgtccccggaaggggagctcgccggctactaccggaagatcttcccctggcgcccgttcgagccctacgaccccggcgacaggttcaccaccgtggacctgcccggcatcggcagggtgggcctgaacatctgctacgacgcctggtacccggaggtgtcccgccagctcgcctggatgggcgccgaagtgatcctcaacgtcgtcaaaaccaccaccccggaccgcaaacaggaactcatcctggccaaggccaacgccatcgtgaaccaggtcttcatggtcagcgtcaactgcgccggccccaccggccagggcaagagcatcatcgtggacccggagggcagcaccctcgccgaagcacaagacgatcagccgcagctgctcaccgcggaactggacctggccgctgtcgaccgcgtccgcacccacggcacggagaacctcaaccgcccctggtcgcagttccgcgagggggaacccgccgtcgaactttccgtctaccaaggccggatcaacccggccacctggacaccgccgtcctacaagccctaaggaaacaccgtgacaacaaccctcacccgcacgctgaagctgccctcgctggtcctgttcggcctggcgtacctgaccccgatcatcgtcctggggatcttcggcatcatcgccgaaaccaccggcggcgccgcgcccgccgcctacctcgtggcgctcgtggccatgctgttcaccgcgcacagctacggccggatggccgtcgcctaccccgtggccggctccgcctacacctacgtccgccggtccatcgattcccgggtcgggttcctggtcggctgggccgtgctgctcgactacctcttcctgcccatggtcatctggctcatcggcggctcctacttgagcgcccagttccccggcatccccatcggcgtctggatcgtgggcttcatcgtcatcaccacgctgctgaacatcctgggcatcaaggtggcggacaaggccaactacgtgctgatggcgttccagctgctggtcctcgtgttcttcgtggcgctggccatcggcagcgtggtgtccgccaacggcgccgggggactggccagcacccagccgttcttcaatgacaccgccagcttcgccaccatttccgccggcgcggcgatcgccgcgtactcgttcctggggttcgacgccgtcaccaccctcaccgaggaaaccatcaacccgcgccggaccgtgccgcgcgccatcatgctggtggcgcttatcggcggcggcatcttcgtggcggtgtcctacgtgacccagctggtccacccgggcggcgtgttcgaggactcggcgtccgcggccagctccatcgcgctgcagatcggcgggcagctgttcggcgccgtgttcctggccggcctggtggtggcgcagttcgcctccggcctcgccgcgcaggccagcgcgtcccgcctgctgtacgcgatgggccgggactcggtcctgcccaaggcggtgttcggacggctgagcgagaagttccacaccccggtggcgaacctggtggtcacgggcattgtgggcctgatcgcgatcttcctggacgtggccacgtcgacgtcgttcatcaactttggtgccttcaccgccttcacgctggtgaacgcctcggtggtgttccactatgtgcgccagcgccgggccgggcagcagctgaacccggtgtcctacgtggtggtcccggtggtcggcgcgatcatctgcgcctatctgctctcccggctggacagcaacgccattacgctgggggtgtcctggctggtgctgggcgtgctggtcctggccctgatcacccgcggcttcaaggcctcaccgccggagatgacggccacggagaaggcgacggtcgaggcggccgcctgagtctggcagttgtgatgtggcctgttggttgagggaaggaatttttgtgcggattgcgctgggccagctggagtcgggcgccgacatccgggccaacctcgccgcgatcgaccgcttcgccgccgaggcagcgcgcgacggcgccgcactggtggccttcccggagtacgccacctacgagaagaagaaggtggacgcgacgtttcctgcggtggccgagccgctggacgggcccgtctgccaggaattggcgtctatggcccgccgtcatcgcatcgcgctggtggcgggcgtggtggaaacgtcggaggagccgggcagggcgtacaacacgctggtggcgttcgggcccgacggcggccggctggctttctaccggaagatccaccttttcgacgcgcagggcttcggggagtcgacgttcatcaagccgggtgagtcccttgagccggtggtgttcgagcacgggggagtgcggttcgggctgatgacctgctacgacctgcggttcccggagctggccaggtcactggccgacgccggcgcgcaggttctgctggtctgctcgtcctgggtgccgggtgagcacaaaaccgagcagtggttggcgctgaacgccgcgcgggccattgagaacagcgtgtacgtggcgggtgtgtgccaggcgccgcccgtgtccgtcggccggagcgtgctggtggacccgatgggggttgttgaggcggaccttgggcttgccgctggtgttcgggcggtggaggtgtcgctgcagacggtcaaccgggtgcgggagtcgttcccgatgttccggcagcggcggttgtaggggcggagcccgggaatccgccacttcctcgtgcttgagcctaaggcagttcttctgactcggtgacattcacggaatcaaggggcgactcacaatcgacacctgtcataccgccgcctttgcagttcccgattcacagggggaggagcgacgtgccccggtgtcgcggggtccatcgggtgccgctagtcggtaactgaatatttcggcaagctcgtgcgcagggtggaaggcctcgcggagccaaattggctgaaggggcaatgtagaggtgctgtcaccgatgggagcaacccgaacaatgtccgtagcctcgacgcgaatttcacagtagcgcagcgaggaaatggacccgcttagtccacggggtactggcacatcaggaaggaaaactgcctagcgaggacatcttccagcaagaccttctcccgccggtaagtcatcccattgctaaaagattccgggagccatgggggttgcttacctagtgacagcgtcccatcatgtagcaatgtcagaactgaattggacggacgttgtcagcgctgtcagcgcagcggctaccccgataattgtcgcggtcttcggatggatgcttactcgccggcagtcacgcagcgatctactgctcaaggcccgaattgactactaccgagagattattcccgacctaaatcgactgatgacctacatgatgtttatcggtccatggcgggacataacccccctcgaggtaatctccctcaagagacgcttggacgtgtccttttacatcgctgcacccctgttcagccctcccgtcacctcggcttacgaggtgttcatgaagcagtgctttgtttccttcggccagtggggggctgatgctttgattaggagcagcccataccgacgccgtgtcagctggaaggctgctgatccttgggaccccgattgggggagactgttcgagttgcaagaagacgaagctgttgaagcagcggcacttaaagcaataaggacatcgtacgattcgttggtatcagcattggtgactgacctcaatatcaatcgggcgcgaggtgagtacacgaacgctcatgtactcgagaatgcacacggaccccttaaatccgtggaaggtgcctctgcttccccggcacgaaacgacaaagacgacactccactacgtccttcctgaaggaggtacccgtcagaggcggtatacgagggatgctggctcaggctttcgagttgcggaggatgaaccaggctgccgttacggctgctgccaccactgctctcgtcgggagggagccgttcgcgatcagcatatttttacggacacggttcatgccggagaaagccacaccggaaagggtgggcgccgcacatacgctgctcatatgcaaaacagacaacaagagcagcacatcgcagtgtttggcgaaagtggcagtggcaagaccgttatggtctcttcgttttacggggccacgcaggagcagcagtacctgcaaaagagcctgtttgacgtcgtggccgatagtactgagcagcaccgtcagttgcatcagacctatcttggcatgaagaattccgcgcaactacccgatgccactcgtttctcctcaacgtcatattctttctcagtcaagctaaaggaaaaggtcgatcccaaagcgaggaaggctaagcctttcgacgcccttcgcctcgtctggcacgactaccctggggagtggttcgagcaggacgtgtctggggcaacagaatcccaggacagagtcaacacattcagaaatttgcttggatctgatgttgctctcttgttggtagacggtcaacgtttgttggagcacagcggtgaagaagggaaatacctgaagtctttgctgaccagtttccgccggggactgctgtcgcttgagggcgagctgttggtagacggtagtcctcttcgtaagtttccgcgcatctgggtaatagcgctctcaaaatctgatctgttgcccaacctaaatgtgttcggatttagggacctactcatcgagaaagctcgtgacgagcttgatcaactgcatagggtgttagccgggtttgtggaggccagtgaggcgttgtcatttggtgaggactttgtgctcctttcctcagccaagttcgacgcagacaaaatcgaggtaaccgagcggattggtctggagctgattctgcctctggctgccatgcttcccctccagcgccacgctaggtgggctgagctgaagctaatccccggaaaagtgggtgaacagcttctgaccaaggccagagctctagccatggcggccgcgttgttgagcgataagggcaaactgccgggtcgaataggtctatggttgagtcgcattgatcccgaagtagtggattatgtggccaaactcgccggggacaaactcagggaggtcaactccgaagcgatcgcaaggcgagactatctggcggccacaatgacgggtttccagatggatttggaagacggagaagacaaacaaatcctttttaggagccgtcgatgacgctcgtctgggctactcgtgggcggacctggggctttcgctttctccgaagtggtggtctggcggatccgctccccatttatgagcttgtgttctcggggatcgatggtggtccggagatctgccgccgcgtcggtgagcggctggcgctgcgcttcccagatccttcgggccggaaggacagatcagggagagtcattccacacgattttgtcgttttcgcgccgttggcagaccacatcacctcattggaggacggtcgccatctagtttggcccttggttgcagatgaattcgctcgggtctggcagctgcccaaaccaccctcggatagctgactcgtcaaaccactcgctattaccggagactctaggaccagcccactaattgggttccagagccctgttcaacgaacacatcggtgacaagccgatccggatgccgttgccgttgattttccagatctggcccggaatgccgggtagcctcccgggtcgggaagctaccccgtcaccactgccgcctttgccgctcgggtcgcgttcatccattcgctcagccagggcgcacggacggtggatgtgatccggcagtccgcaacgaaggttcccttggcgccggcgtcgatccagtcctgcagcgcgcggccaggtctgacaacgagcggataacggcagactccgcacccaaagcccgggcaacaccgaaaacacaacatgcctccgcatctgcgtgacggccttgctaaatacgttaggggactaacgtgtttctgtactggatgccatggagataaccgcggagccgaaccggcggcggccgctgcatcttctggcacggggggaacaggcggtaggtgagctggccgcccaattcattgtgagccactgggcggtctcccagcacctcctgttgctggtatcacggtccgctacgggtggtgttgttgtatgtcagaacggcattgtctgctcacgaacgtgctgcatgaagactcctgttcccggatcccgccaaacggcaccgacatgatacgaagcaagaagatctaggaggtcgatgtgaggagccgcgggaagcagcaacgaaaagtgttgaactccgggcaggtaccgcctgtaatcgagaatttgcccgagccctagtctgacgttgttgcgggaagcctctgactttgcttcgtacagaatgcctgacgtctcgtcgtatacgtccgtgaacagtgggcgagtgctttccggaggcgtgatctgccaccggcagtaggcatgaccgcgcgtcgccaacacttcttggaaggcatcgaccagctgctgttcgcgcttttctgcgactgctggttctgagccggaagttgcgaaggtcgttgagttttgattttccaatggaacctgttgggcgcgtgcgtcacgcctaggcgccatgggcgccacgctcaggtcttcgtcacgacgaagcacatcccccacgggcttcaggtggaagacgtaaacagtccttagtacaccttccacatccttggcgtcctcgattgaataggggtgctcttcatctagcgaaaactccccaatgtatacccgatttttccctcctgtttcagccacctcttcgccgtccacgacaaaaagacggagagctcggccctgctccttgtgacgcaagatagctccgttgccgctcttcaatgtctgcggtccacggcgtccttcacccgtgtaggagtaggtcttgccgtcttctgaccagccgtcgaagttgtacccataagtaactcctacggcaggatcagagtagagcaatacgttcggtgttttcgcagagggttgtatgcctcccctcgttgagcctccgtagaggtcggagaaatcttgcttgctgccgtcatcccctggggaagtcacccacgtgccggaatggggcggtgcccccgcttgggcatcttgacgcagttcgagtttgtgaccaaatcgcgcgagagtgcgtaccacgacgtccgtgccaccgtatattttttcagacagatcacggccaaactggttcttataggctgctgcaaggagtgcctttgaatccacctccacgtccccgacacgaactatccatttggctgactggcggaaccttagcgaggcgctatctgtgtatctcgctgcaaaagcctgaccagatctcgccgcctctagcgcttcctcaactgctgccgccattgcggaagggctgtctagcttgtctagttgatgcactccatctccccggtttagtcctgcttgctgtacatcccgctcatcctaagcgaggaatcaggaaggattacgatgcgccatcgtgcgatggaaggtacggggccttggctgcggttaccggatcagcgttccgttgggattaaaagatgccgtcgacatctcatggcgtgccaccgcgtggttttagagtgcacagccaggttgatgacaggtagcagtgctgggtcctagtgctgcctgcatgagttcctctataaaggccgttccgaggcgatatgcgtttgccttctcgatgagaaacttcagcgcggcctctcgcatagcgcttgccgtccgggcgcttcgccagtcgcgtcgttcaaccagttccccagccagctccgcaaactgtgatgagaatatctgctcgtacttttggccaccctgccagcctcggtatagaccatccggaagccccaactggcaaccaggtcgtcacagatggtcaaggctattgactcgatcgcccggcgtttttgtactgatgcacctctgaattcacgcgaagcggccagctttgcttcgaacttgcgctattgctcgctctgtactttctgtgcctcttgcagctttttactggattcctgggaaacttctgttgtggccgcggggagcttgtcccacaactcgtcatgccaatctgcaccggcggccctttcgaaaatgagcccctgtcctggccactcaaagtcagcacctcgatgtcaccctcgtgaatactggttttggctatgacgaggtcgaccttgggcgcgatttcattactttattcgtctgtcataacggaacgaagcaactctgtatagatccgggtttcgccaagcgagacgaagggtggttgggcgcggctatggccagcgcagcatccagcgcgacggtggctgcactgagctttaggtcgatttcctattgattgagcatctgagacgaacagcaatcccgcgtccgctgctgcaaggggaatttgctcagccagggcggcgaactcagccgaagggtaagtagtcataatgccgacggaagtgcttctaggccctcgtgttccaccttcacctctaccactgtgtcgtaaagcccgaaccgtcgcagtccctgatgggactcgatgcccgtgtaggacagggatgcctcctcatagcgacggaaagcgaagactgcttggttcatatgagttgcgttgaagacaccgagtgagacaagcaggtggaagtcatcgacggtgaggccagtgacggctttgaacagctcgggctccaacttggtgatgacgtcgcggagggtgttctcgcggtagtcggtgaggtacataaatgctgggatccgtgttgcgaacttgatcagcttctcttgtatctgttttctcttggacttgtagtccttttcctcggcactgagctcctttttctcggtaggagtaagtgcgtcgccgtgctctttcttcgtgtttgtgaccgactcgctcttgttgacgactgtctcaaagattgaacttcctagagcgcggaagccttcaatattcataacggcttccatggctgcctggctactcatgatcttgcgaagtgtctcgttgtcgacgttcacgaggatcgcagactcccacttgcgtgccaatagtgtagctgacgtcccggccatggcgatgtcgaggatctctccggcatcgaccggtttcatgtcggaaccgtcgtaggccaatacgggcagaaagctgacgagttcggcgacagcatgttcagggttgatggcatccggagtcaatccgtaaccgtagtcggagatctggcgtagggcacgggtgggggcgaagtcgaagacgaaacaaactggtttcaggatgacttcttcgctggggttgtcaccatttgggttcttgatggaccatggtgactgcactcgaaatgctgcctgaaagtaggtctctggcgagttcaaattgcgtaacatgaggattgaggaccattgcttcaccgtgacgccggtggtcagcttgccgcacgagagtgtgatcgtcttagtagcgtgaccgtccccgatggcttcgcgaacaggtggaagtgctgccagaccgataccggcacgaggtcccgccactgaaagtacctcgtagtcgtgccaaaaaacattctggcgctcggccagaaggtttgccatcgcctcacaggcggcaacgttaggcaagaaccagaatgagtgctgaaggtacggcaacaggcgcacgtcggagtacgggaatggtggacgactacctaagtgcatggcatcgacctgagtgggcaagtacgagccgcggatgatgtcgagccacttctgcacgtcgctcttgtgcttgaactccgctgcggcgcccgatccctcagcttcgaaaaattcgtttaggttgaactcgtcaaactctccctgattcgcaacggcgatgatttcgtcaggcatctggtaggtaagcagacgcatctccggtaacgcaccgtaggggttccactctgtgggatgggcttcggcgtactcaaccttggcacgctgctcgtcggtatacgtccagttgaaaatctgttcctcgatgaactccccagtcgccagcgctttgaacggggtccccgagaggtagaggtaggcacgtgttgtgatcgggagaaagtcgtcttcggcgttgccaagctcatcgagttcctcgtcgaacgtagcaagcgcatccgcgcttagggctgcaagctccttcttggccaccgtggcgtcctcgccctcgaagagctcttttgcggtatctcgccaagcgccgaagtggtactcatcgaatattacaagatcccagttggtggtatgcagccactcgttcttagccttgatggcgccggttttattgtcgcgtcccaacaaatcctggaaggacccaaagtacaccagtggacggtctgagtccgccgattcgaagtcataagaggtagatgttgacaggtactgccagccgtcgaagtcggcatgggtttcgagatcagccttccaggcatccgccacggcaggcttgaaggtcagcacgagcacccgctgcgcctgaagcttttttgcgagctggtaggaggcaaaagttttgccgaaacgcatcttcgcgttccaaagaaaccgcggaacagtgtccgggttctctttccagatctcgcggtagtagctgcaggtcttttcgacggcactggtctgttcgggccgcatcgcgaaggtctcatgatgcatgccggtcacatgcgcgccggtgcgcagctcggagatagctgtcagcacgtcggcaggtgagcagcgcacccattcccgagaggaacccaaccggggattggcgaaccccttgtcgatgagacgctggcgtacgtcgctgtcgcggaaaagcgaaccatcctcgcgttcagcgagcacatcagcgtgcaacacgtaggggtgctgcatctgcccttgtgattcgcggatccgctcgttcacgtcagacttagtggtctggccgattttgatcagtccggtgtagtcagccggggggtggatgggcgaccacgtgtagatcctcagccgcgcggtgggtttcggcggcagcagctcgtcgatgctcttagtcatcgacgtcagcatccgcagctgcatcgaagaggtcgtcatcgtgcgcggcgacctgagactcgataaatgctatttcttcaaccgtgagcccgtagcgctcatagagcaacgcatcactccactcccgatccaacggaacatccggcacaaacgcatacacatttcttggcgcgtcctgcgtggacttccgcagcgacacaaggaaccgtacgaagcgagtccgcaagtacaaggcgtattggttcgcctcagtctccgacccaaagtgcccggcgacgaggtagctttcggtgcacgcggtgccaggtcccgcgacgatgggcttcgagaggaacttcgtctcgaccgcggcgctcgttccctgcactcgagtcatgaggaccttccactcatcgatccacccatcgttcaccgggatgtccgggcggtcgacccacgtgacctttcgtgatccaaagagctgaaccgggtccttaatgccctggcgcgtctcttgaccgtgtacgaatgtgcgcaacccaaacggcttttggcttgagacccgagcatcgagagtgggttcgtgcttggcctggattttctcgaggattgggacggcctcattgcggcgtactagcacatcgtaggcgtcgaggtcgcggacgacgggttcgccgatgggctggccgtcccacatggtctggatggtgcaggggccgtcgtggtcccggtcccagaggaagtaggacacgccaccgcggattttcacgccggggaaggcctcgtagagcttggggtagtccacgatgctccggattcggcggtcgcccagcatcttcttgcggtactcatcaaggcccttgccaccggcgaaccagcgggagggggtcacgaagactgcgaaacgcggatcaagctcgagggctttctcgacgaacatctggtaaatcggggctgccgaggagccgtggccgccgtcgctgagctggtagggcgggttgccgatgatcacatcgaactgcatgtcttctccgaacagctcggcggtgcgagccttaacgttgtttgtgtggatgagggcgtaggcgtgagtctccaactcggcgcctcgcccatactcttcctcattggctccgcagtaggtgcatttacgttgggtgtagatggcgatttcatcaccggttagcggatcgctccgaaattcgcgtttgccgccgccccaggtgtgctcggtgcgttggaaccagatgttgccggactcggtggtggaggacctcgctaccgagtgcgggccgttggcatgtttggagcagtagacgcttcgccgcgcgaggtagcccgtcagctccgtgatggctattccgtagatctgccgagtcaggacgtggtccacgcgctcgttgaggtctgggatagaaggggctaaaccatcaatcatgcgacgggcgatttcgcgaaggaagacgccggacttggtgaacgggtcgaggaaggtcgccgttgggtcggcccagagctcggcgccgccgttcgccttcgcccacgctgtcgcaaccgagtccagcatcctgtttgccatctccggcggcgtgaatacctcgtcgttggaaagattggcgatgcaggtgaggacatcggggttgtgggttcgcagtgccagacgccccatgctcacgcggtggcctggttggcgagttgacggacagtcatcgtcgggtgacttcgtgtcggcgtaaaaaggtcttcttcggcaacctcaccgaacagggtgccctcgaaagatgcacgctgggtcagatcggcatagcggaagtctctacgttggaactttcccttcccgagataaccccactctgggaaagtaatgggctggccatcgggaagagccatgctcaacgcatcgccctgaacgacgttggcggcgagcacccaccgggcggcgcgcgcccactcgctgtctgcgtcaacaccaagaaaactattgaagaccgccgaaagactgtccctacagtcctgtgcgttatcgggcaagagctcgattccataaatgcacatcaaggagaagagagcatggtggcgcttctcaaacgggcttttaccgtgcctgacttgcacggtaatgagcttatgcagcaggaccggtaccaggaagttacccgagccgcaggctggctctaagactctggcgtcgatccgcccggactcatcctttacgagccttagcatgtcctcgaccatccacgcaggagtgaatacctcgccgtggtcggcgacccgttgcttggacttgaccaagttctctgcctctttgaggctcattgccgctcctttatatggtgctcctgtctcctagattaggcgatctatcccagcgcaagatgattcgctgctgtcggtgggccggcttttcctgccgtgtggcctcccatagctggttgtgacgtgacgttgctgggaaggtcgtggtaaaggccttcaaatatcagacagattgggcccggtcccacgccgaggtcaacaccctaaagctgatcagaaccgccgccggacacctcctggcgcgctgccgcctggttcctcgtggtagaagagcgtggagcgggctcgccccgctaagcctatgaggacgtcgaaccggtgctaagcgttgggagcgatgacagcgcggacctttagccctgttcctcgtcccccagggcgtctacttattcaggaaggccacctctgtgcgcaggcgttcgttctcacggcgcagctgctatacctcagactcgggtatccggctgtcccggtatttgttttcggacggcctttcggcttaagcgcagtccgtcctcgccttcggtcccggtactaaagtggacacttctcgagcagcatcggagaggacagcccgagttctttcgcgaggacgactttgggctcctccgcgcggtacggctgcatagtatcgagcttgaactcgaacgaggacaccaggtcgtgctggcttcgccaccagcgtcgtacctccgcgtctgccatcgagcgaccatacaaacgtgatggcaccctctacctaatccacgtcgggtcgctaccgcccaagtacctcctccgggtcggcgggcctattgggtagcaggcttaacgttttgaattgagaatctgcagtgaagacgaacagactatagctttagcaaaacgcaggaggagggctattgggtcggcttaatcatcaagcacgttcgtcgctgtacgactttcagcaaaccgcggtgaaagccgtggagagctttctcgatcggaataccagtggcggtcgtagcttcatcgtctccatgcccacagggagcggaaagagcggcgtgatagcctacgttgcgcagaaccggctaggtgatgcaggtgacattttgctcctgtgcccttgggacgcacttgcgaagcagctcgctaatgatgtaggcgacaggttctggaagcacgcaggagtggacggctcctccatggcgaaaccagtcaggctttacccatcgaacgcacagagcgcgatcgacggtgcagatagtcctacgatctgggtcatgacgttggcagcacttgtgggactgaacccggagatccgtaaagctctggcatcacgcctacatatagtcatcgtggacgaggggcactatgagcccgctcctagttgggcgacagcggtgagaagtctcgataaatccactgtcctgtttaccgctacgcccttcagaaacgacgtcaagtattttgacgtcgcaaagggggatagtcaccactatcctgcacgcaccgcgattgcagaggctcgtctccgcacaccaaagttccagtccgtgccgataggtaccccacaactcttcgttgatcagctgacggcttttgatgattcggagctatccgataccgacaagatcattgtgcggtgttcgagccatcaggagatccgccatatcgttaggttgctccaggaacgtggccagctggcagtcggaatccacgaacgcttcaaagcagaggacaaggcaagtgggctgttaaaaggtgttccggcatcccatgaggcgcggtactgggttcaccagaacaagttgattgagggggtcgatcaccacgagttccgttgcgtcgcgttattccgggtgccgacgagcgatcgtgcacttattcagcagatcggtcgagtcctgcgtggcgtgaaacgcaatgccaatgcctgggtccttggcgcacaaggcgacaagttgcagaacgtatgggacgcctatctctcctacgatttccagaacgacgcatcggcgtccacagtccgggaagtcctcgatcttgcggctggccgccatttttacaccagcggatcttttcgggcgccgttagatgtcgacaacatcgacccgagcgagcttcgagtaccaaggtcttttgttgtttacgacgttccccccacatcgacgcaaccgctgaacgagctgttaacagcattggataaggcgttggacgatcgcgacggggagaaggttggcaatgcaattctcggtcattgggctcagcctgggcgaccggacctttcttgggctgctcaactgctgtacctgagtgaacaatctccaattttggcacgaagcagtttttatgactcgcgcttagccctagccttcttcgcggttactgagtcgcggctgtatgcccaacccgcgctccggctcgacctacgcggcgctggctttcaagctctatcgtccgacgtactcagatctgcctttgcccgctcgaccggaacattcacgagcgtctcccttaagaacacagatctctcctcaacagcggaaagatccaggacgcagactgctgagtcgctttcagctgtggcgccggatctcggcgactacttcaagtctcccagcacgatcactgggattgtgaacaattcggctccagacggagaggtgtatggagctcttcgctacgtcggatttgctaacagtcgcatacgggagcatggaaggattccggtcgtggaatgcctcgattggcttgcccaagtggagatggcgtttgcgaatcacgatgattccaaagttgacgagatcttttcgcgctacgccgaggttgtgacctgcgccaggccggtcgtaaagaattttcttttagaccttcctgcttcagaggtgggtgaatatgcggcgccagacggttcgtccctacgaatgaaagatatttgcgttgatgttgactcgaactcaaacttcaaacttgtcagtgcgtcggatgacacagagttcgagtgttcgcttacgtggttgggccgtcgctacgagtttcaaagcaaccaactcgacgcacgcttcacgcgggccaattcaacctacgcgtccttgtcctcggaaatatccgaacgacaggcatttcgtctaatagtccacgaacagggctctgacgaagacttagtgcagtacgtcgcagcgcagtttgtgcgacccaggagcacgcttgctctcagatcgaatggtaaaggggtagttctggacaatctcttggctgaactctctccggggaccgtgacctcagaaaagggtgacagcgttaagggcaggacttggaccgatggcagcatgttcaaaaagatctgtgacgaggtagaggcagggtcccttttcggtgagccggtagcacccgattctgtgatcatctgcgacgatgactcgggagaaacggcggacttctatgttgttgatgatctgaatcgcaggctgatcgtggtccatgcgaaggttaagagtggtaacggcggacgaggggcatctggtttatatgatgtagtggcgcaggcacagaagcacctcggcacgatacgacctgggggcgtcggattcgaccggacgcgcatgaggaagcgatgggaaaagaattggattctcgacgatagcgatgttcctagagttcagtcggggcagactgctgacgtcgctgccaagactgtttggaacgccctccgcaatcctgcgtatgagcgtctgataatgatcgcaacagcagggatccttaacaaatcggagttcttgacgcatgcgcgaaaaggaacgcctcaatcactgcaagccctttatctgatgcagagtgtttgggcggccgctggttcggttggtgctcggcttcgaatcgtcgtcgatgcctagctgtgacaggcgcttgcaagctagctgtatcggggggagcggagaatgggggtggtggcggcgtcaccctcacgtcccgcaatccacaggataggtaagctcgctgagatgaatgctactgcgccaatcccctgagagaaactctccgcggccgtcggatcaaggagacggattagcgctgcgaggtggcgggcggaaccccaacaaccggaaccgactcaaaatccgcgtaattgctgcaattgcaggtacctgtaccaagccttgccgaacgcattacctcaatgctcgactaggctgctccctgtagcgccgcttcaagccttacgatttggaaactcggcggcccgccctcgacgacggcaatgcgccgaacgcaatgccagtggtccagacagtctccggcccacggaaaccgttaccgtggcggcagcgcccccgttttgatcctgctgccccaaccgctcgcgggtaggtttcttgaggcgctgtccgtagtgccaggtcgtcatccccgcggcgctcttgaaagacggtgtgccctgatgacacgcggcagtggagcgacgagttgggcgcccgtgacggaactgagatcggtggcttgtgagccagggcataccgcaggtttacgagcgcctgaaatccctaggctgcccacaggtgtcgtaattccagtgactagagggagattgaagaccggcatttgagattgtaaggacgcggtctggtacgttgatccctggattcaagcagggttcagaagcgggggaacggcgtcggtgacagaaacacacgaaacagataacggcacgatacgccgcctgggtagagccgtcgtccgaatacatcaagcatctccgtactttcctgctggattcgcctctcgcattgagaggcttgttctcactggaaaatctatggactttatatcccgaatccatggatttaagggccggcttggtcccaaagcaatcgaaaactttgctactgagaccaatattgggctaatggaacttcaacatattgtgctcccgaagctgaaacaggctgacgtagcggactacgttctacaaggcgggcagatcgcctccgtaaacgactttttgggtctcagcggctcactcattgaccagacctacaagctactacaagcctacgatccgacgggcgaggagcttgcactcctgcactccgtggaggtagcggcgttcgcgccactcacaaagacccagcatctcgatcagttggtccgaagaggattcgactcccagcaggtggccaatgcgctgacgttgtcgctggccttgaacgtgaaccaacgggtaaaatcgactattctcaacgagcacgtgatcttcaacccctatgtttggggctcggggcaggtggagattgcaagtttcctcaaaacgctcggccccaacgagcgtgatgtcatgctcggcgtctgcgagcaggccgcccggtcacctggcctggccctagaaaacgttgccgatacgagtccgcggatcatgtccgcggcgcggaaggtgggcctcattcaggccaccaccgtgcgttcatcggggaactcagagcctcagacttacatattttctcccacgcttgaaatggaagacgacaaactccaaactactgaaacacttcatcaaaggaagctcttcgtggcgcatattctttacggccatgaaaaagccaagtctggcggtggaaggatttatgacccggcactactcgttcagcgcctcatcgagcgaggaaccgtggggccggcatcgaacatcggcacggactaccacttgctggaagcgcagggcatagtctctgtagacaagtcatctggtaaagccttcctgaacttggtcaaagaagaaattgccgtgggtggtctggcttggctggagcaaacgcttgattccgaatcgagttcctccacatctgtaaaactcagccgtgcgccaagtcgatttacaaccccggaatatgaccgttccgtgatccctgacgacgctgccgccaacgaggtagttcagtcggcagtccttcggcttcgagaggaggttcagcgtgcctcaagaagagaagtccccttcaaatgagccaacggatggcgacaaggttgaggcgagggttgctcaggtctggttctgggaggggttctactccaagagaggcatagacgtgcaagccgaatatggcggtgatctgacacaggttacagatttggacctcttggcattcgacttcaaccccgccctcaggatgcgcaagttcattggtgagtcgaaaagtggctcggggaagtcggcacccaaagctcttgaccgaatgatttggcagcgcggcctccgcgcctttgttggcgcagaggctgccgagctgaccatcaacagcaaggtcaccgagcagaaccgtaagtttgggcgagagcttggcgtaagcgttcagacgttgtcggacctctcccgtcgggaggaagccctcctcatggatgaagttgaggaaaccgggtcccatggagcagtcgctttcgctctggtcgagtgggtaagaagatatacgaaaggtgaaccagaactggaagttatcttccgattcttgagatccaaagtgtggttccttgatagctttactgccgtcaagcaaacgatcagcgtgattgaggccctgtcgaagcagtgggtagtcggacacgaagatgaccataagaaggccgtgagatggctcctggcagaggccgttagtgtcttcaccctcatgctggtggacatttgcagcgaagcccggcttcgaccgagatcggagttcgacgcgttcgtcgcagcaagactggccgatggagtggtacccagctctgaaatgaagcaactttccaaatcgattgacaaattcattgctgggcttctcgttgctgccaaagcaactcccgcggtccggactggagcgatgggggcattcgaaccagtgccgcctgcatacgctgactcgttcgcggaactggcgtggcgactttctaggtgggttcgggcctcggacttaccgagacaggtggatttccttgctcatgaacgcatcagcttgaatcgtccgattccggcaatagctgcataccgtgttcagttgtcgaatcgtaacttccggcattcggtgtcattggtgtgcgcatttctccgtggtcacgctgcattttcgccggaggctagtgaaacgctcttgacctgggcggttcaacctgaagagaccgcatcggatgctgacgtcccgcctgctcttgaagccacgtcggacgctacggccatatcgcatgctgagctcacctccgacgctgaggtagcttcagctccgctacctgcgttgaagcgcgctgaggccggctccgaagaattcattgggcaggactacctcgacttcaatgatcctgattgacgattcggcctgctcggcgggcctccggtcagaccggtgggggtcaattcgtagcggacctgaatgcttccatacgaacgtacaacctcgctctggctcacatccctgagcacctgcgccgcaggctcacctgactcaatcaggcggacggtgttcctaacttgactcttagtgaactgggctttacgtccgcctaagtccttgccggcggctcgccgctcgttcacgctgtcgttgatccgctcgagctcgatgtccagctccatctgccccagtgccgccaagacggtaaccgtcatgccgccatggcgtggtggtgtcaacgtctctaccgcacaaattggcacgcgaaggccagcgccctttcctttgatctggtcagccagcgctcagatgtgcacggtgaagcgccccaggcggtccagcgtgctagcaaggtactcagcgaggtttcccacttggagaacccgacgcttgaggaacgaggctagtaccaattagaaagtgactcaatctcaaggaactcagttgagcatttgatgattgccgaatctttctcgatcatgccgaaagatatcaggactgttcccgaacttcgactgccagcaagccagtggtgcttaccgtcccgattgccaaggcccggcgatagccgccctttaccgggctcttcggacatgtatcaaactggcattggacctctctgccgttgtgctggccaagtacgcgctcaaagacaaaggcgaagcgcaactccacctctcgggtgaaggcgaacggctaaagccactgacagatcccggaaccggccaggcgaacgatcccgtgcttgtcacatgggaggaggcattcaaacaggcaaaactgcctttcgatcctttcgcacgcctcagacaaagtgggcggcggcgtccagttcctcacctgagcttgtgaaaaatgagacgctgcagaagcaggcccagaacaactcacgcagccatttcgggagcagcccttatctcgagaaagcagtcagcgatccggtcaccaactccatggacagtcacaacaaattgagtctccaagcgtttggcgacaaaaccaagatgcacgcgctactcaagatactgcccgaactggattatgaggagctgcagggataaacggcatgtggcggtcctgcttgaagaaaatgccctacaagcagggcaccagaggtcacttttcctcctacgctcgccgcttggcctctgcgatcaatttcatgccttcggagcccttgcgaatcttcttctcaggatcttcgaggagaaagtcgtcctgggcatgaaagattaggcggtcggagtgatacatcgttcgagtgttgacgtgagcgacaatcgcatcagtcgcctcacaactgctgtcccgggcacctggataactcaccaaggcggcattgcggttcatggggaaggtaatctcctcaaaggggtttcgaaagacaaaatcacgacccggcagtgcttccagttgaccgaaggcaacaggactgtcggaagtgatgaagccaccgttggtcgtcgagtcggtaacgtgcagttcccagtgctgctggtgaagcgttttcatgagccattcttgtaactcggggatgattccgatcgctggagctatcggaccctgcggaaaccactcgcccttcagcagcccatccctggcatcgccatagtctggcacctcatcgggagtagcgccgtgccgtagttccgaagcgcgaagggattcccattgctcaggagttatctctccgcttctgagcttcttagcgatcgttgcccgagcattgtcttgaatcgtgcggcggccgcgacgattacgaactgcgatgacggcggctagagataaggcctctccgacagttcgcttgtgctccacccggccggcccccatctcacgggtggaagttgcgactttcccctcgtgccaggagagcagcttctccatggcgtttgggtctactcccggctgatccactcgaaaaaagtctgtctgccgacacgccatcttggggatggacttatagcggatggcctcacgctgatcgaatatccggagcattccggtctgcgaatccgtcatcgtgaagccagcgaggtagaaggccgggatgatgtgatgctttcttggctcggatccacccatggcccagagtctacccaaggcagcgggccggagctcatcaagccggcaaagcctgtggagaaatagacccgtgcggtgatactcgccggcaccattagcaaccccggcagctcaaccccatcgaggccgaaagcgacactttctaagaagcacgggaaaaccgctacgcgcttctggaagagggccaaaacctcatagcgatccgcgtggactgccggcccgtctgaagccgggccggcaggacgacgtccccaggtgatagctccggccggggccggagtatccgcaagggtgccggaaggatctcccggaccctgcagtgtccacggggttccttgtcccggttgaatttgtccatcgcagtgcctttcacaatggccggtcagggatgctcacccattggggggctgccgccatcgtgtacattcccggccttctctcgtcttcagaggtgtggaccgtccgatgattcgcagctcgccgtccaggatcagggcggcgacgacctcggagggttgggtgttcggcccgatcactgcgccgcacatgttgtcgagggtttccctgtgcttcagcttcaatctcatctgcaccaagcgggttgcactagagcgcgcctcacgtggctgttgtccagcacctttgaccgcgagaccttccaggctggcgtggtgcagttccacgaaccatctgagcgcttgggtgggggcgctggttacccgcgaaggccacaatggcggcggccattcagtggcagctattacagcagctctcggcgctgctcagtggagcacccctggtgtggtgcccggtgacagcgaagagatcgaaggcaacgatcgacgccgtttgttcccggacaagggccggcagtcccgcccttgaagccaccatccgccgctgcagggcgtcaaaattcagccggtcatgaccccaaatcacggcttcaccccttccaaataggcggccgcgttagcttgtgcgtcaaccggggggtgatgcagtgtgttccaacaccggcaaccaaccccgagtaggataggccggtgactgctgaaccaaaccagccccgtttcctcactatggcgcaagtcgcagatgagttgaacgtgaagcaaaatcttgtccagggcctcatcaggacaggggagttgcgggcttttcaggtcggtgggaggagcctgtggcgcatcggacgccaggacgtcgaggattacattgagcaggcgtaccggcgcaccgccgcgcggattgctgtcggcgagctcgaagacggcacggagaccggcgatcaggagtagccaatccggcacattgcgacgccgaacgttcaagttcgcgcgctggggttcgcttggagcggggctgaagacggtgaagaatgctcgatgctcacttatcccgttatttgtgattgctgcttttcggtcggctgtgccggcccctgtgcggtcgaccctgccgccagcccgggatgactgtgtcgagttcggcttctttagctgcggctagtttcccggcgcggtagtcgatgcgctgggtgtgcagccagacccccagaacgcgttcttcgcggtcctcggtcttgttgtgtcgtggccagtcgttgccggcggccaagtagccggccacttcgtttaggcgccgcttccagcgggctgcgtcagcgtcgcgtttgccagtgtagtcccgccagccagggatggtgtccaaggcctcgccgtaggcgggggagagggtacctgcggctgcctgctcgcggcgacgtgtcagccaccccgccagcgctgactcgcgggtggaccggccgtggacaggaaggcggccttccactccatagaacgccaggaggtcatccaggttccgctggccggcttgggtggtttggggatcgggtgccggaagggctcctttatgggtgtcccgcaggctcggatcctgcttggcagcgatcgctatgtggtacctgaccgtcgtctcggcagcgccggcgagcgccgcgatcttcggggtggggatacctttgcggtacatcagcacccactcgacatccggggcaggtcgccgcctggctggggtcactggctgttctgcttcgtcacctcgaacgcacctcgggccgtgcagcccgcttaagctcctcagtgcgcagccgcaggaagatggtggccaggactagggcggacaccgctaggacggctactgcgatcaaaaagaccgcgtttaggatgcccacgatgccgaaggctggactcaaactcattactacccccaatcgttcttgcccctaggctacgcgaggagcgcgtcgagtccttgccatcaccacatttttgcgctgagcatttcccgatctccttttcgtggcagtggtgaccatgctagttccggcccccgccgcaacgcctacacggccacggacggccgggtggctatctccgcagcctggtgcagcgcctgcaccatggaccgagaatcggtgatcgccttgccggcgatgtcgaacgcggtgccgtggtcgacggacgtgcagatctttgaagactttgtatcagaagcgctgcgagccagcctctcacggcacggaacaagtgttggactgcagtcttccgcatacctggaccgaggacgcgagctcatcatcaaacctgacatcttgttgcgctcgaacggcattgtccgggcagccattgatgccaagtacaaagcagagaagctgggtcgctatccaaatgcagacgtctaccagatgctggtctactgcataaagtttggactcttcgaggggcatctggtgtatgcccgaggtgacgcggatatcaggtcgtatgtcatcgattcgccgggcattactatttactgccgttccctcaacctggatcagcctcccgacgccctgatggcagaggttggacgcactggcggcccgcattgctgaacccattccggtcggaggggaaagcgaagttgaacaggccgcccgcgcccggttagccgctaacggaggacacctctggcgaagtcgagaggcttgacctccaccagttggagtgtgaacacccacaacagcacgtcctcgcccgggacgtaccagtcccgctccggcgcccggcgaaagcccagcgactcgtacagggcgtgggcgcgttccatgaacgtggcgctggtgatactgattgccttgatgccggacagttaccgggcgtgctccacgacctggcgcaccacggcccgccccacgccttcgccttggtgcgccgggtcgaccgccagcatccggaactccagctccccgtcctgcgcgatctcgttgtacggctggccggtgaacgtcagcgtcaccgcggccaccacattccctgcggtctccgccacccagacctgcgcgtgctcggcgcgttgctccacgtcctccagcacgctcatgtacggatggtcggcagggaagtgcccggcccgaaggtaggcctcgcgggtgatccgccggacttcggggaagtcggcgggtgccgcccgacgcagcgcgacagttgcaggcagtgccaccctcaaagcgcgtccgttggcgcgggtgacgcgttgttagcggaccttaccctcaatgacgtgcaggaatacgggcgaacggcttcccgtcatgatctgctgaaacggcgctggctaagctacgaggtggacccgcagaaacagtttgattttccggcaatgtcggatgcctcgctcccggcaacagcggccatgatccgggctgtgcgcgccgcggatcaggcgagaggcgcaggtaacccggctgactacaagcttgccgtcgacaaattttcccaggccttgcaggcagcggagaaggcggccggcgttcccgaagattccccggtttctcgcctgtcgggtgagggcgcgccagtgctgtccaccaggccgtcagtttcggctggttcagccagcgagagcgggggaggcccggaacgacagataccgggcatccccccgacccacccgccggcccagcgcttcgaccgcctcataatccccggcacccatatccgtggagagccaacgaaccaacagtccaacatccccgctggaccgcacccccgcaccaacagccagctccagctggtcccgcagcagttgcaccgccagaacgccggaccggctgagcaggggagcggtgtaagcctccagcgcctcggtcacgcgcccgtcccgcagcaaccgcagaacgcgcccagaatcagaacaccccacaagcccggcagccagccgatatgggttcgactccaccgcaccgcccagcatcgaccggacccggaacatctccgtccgaatggcctgtggtgtgccggcatcgccatgaagctcatacgctagttcctccgcgctccacccctgcgaccgggaatcgagcagcgccaggatttccgcccggcgcagcgtcagcggcacccggctcccatcggccagcaccgcggcaggcttgtcaccaagcaactccagggacgaaaccgcaacaccaggccgtcgcgcaccctgccgggacgcacgcggggaagaagacgcacccagggaggccccgccgtcggacgttcccagcagcgattccgccacccggaccgcgcaccgcaccatccgcagcgtgtccgcgctgatggtgtccagcggaccggagacgtccagcacgccaagcagcgcacccgtcaaagggtccgtgatgggcgccgccgtgcaggcccagtcgtggtgggtgcggaccaggtgctcggcggagaacagctgcacaggcccgccggtgaccagcgcctcgctgatggcgttggtgccgatccccgcctcggaccagtcggcgccctcggagaactccagccggtccgcccggcgcagcgcctccaggctgcccacccgccagaggatctcaccagtggcgtcggtgagcaccagcaggtgccggccggaacgggaatcgtcggccagcaggtcctgcagcgccggcatcacccgctgcagccggtgctcccgccgcagctgcagcacctcggacggatcgtgcaggtgccgcgggctgtgctggtccgggctgatgcccagcgccatggaccgccgccacgactccgccagcggcacggggatttccgggcgcgggacgccggagatgaccagctcgtgcgcgcggcgcagggcacgcgcgtactttgccgggtccgagaacctctggccgtagtccaccgtctcctcctcaccgccggcgtccttgccggcagtgcccgtgtaacgcgcttgttacccccgcggggttccaatagtgatgcagctcacgaccgccccagcataccgcagggaccccgcgggcgggggccgcccggaccacctgagggaccgcacacaaaggagtggagatgaccgaaacacccaccgccgccgcgcaggcctggctggccagcctggacggcgcgctgcagcgccgcgacgtggacgccgcgctggacctcttcgaggacgaaagctactggcgcgacttcgtggcgtttacctggaacctgaaaaccctggagggcaaggcggacatccgccgcatgctcgaggccacgctggaccacgtgcggccggccaactgggcgctcgccgaggacgccaccggcagcgccgccgccggcgggaccgtggaagcctggatcacattcgagaccggtgcggcccgcggctacggccacctccggctgcggaacggcaaatgctggacgctgctcaccaccatgcaggagctgaagggcttcgaggagaagaagggcccgcgccgcgagcagggcgtggcccacgaaatcatccgcggccgccgctcctggaaggagctcaaggaggagcaggaggcgcggctcggctacgaggagcagccctactgcgtgatcatcggcggcgggcagggcggcatcggcctcgcggcgcggctgcggcggctcggcgtgcccaccatcatcatcgagaagaaccagaacccgggcgactcctggcgcaaccgctacaagtccctgcacctgcacgaccccgtctggtacgaccacctgccctacctgaagttcccggacgactggcccgtcttcgccgccaaggacaagatcggcgactggctggagcactacacccgcatcatggaactgaactactggtccggcaccgagtgcgtgggcgcggagtacgacgacggcacccaggaatgggcggtcagcgtcctccgcaacgggtcgccagtgaccctgcggcccaagcagctggtcttcgccctgggcgtctccggctacccgaatatccccgcgttcgacggcgcgcagtccttcctgggggagcagcggcattcctcccagcaccccggcggcggtgactggacggggaagaaggccgtggtgatcggctcaaacaactccgcgcacgatatctgcgccgacctgtgggagcacggcgccgacgtcaccatggtccagcgctcctccacccacatcgcccgcagtgaatcgctgatggacctggcgctgggggacctgtactcggagcgggccctggctgccggggtgaccaccgagaaggcggacctgctctttgcatcgctgcccatgcgcatcctgccggaggcgcaggtgcccgtgtaccaggagatggccaagcgggacgccgagttctactcgcaactggaggccgccgggttcgatctggacttcggcgtggacgggtccgggctgttcctgaagtacctgcggcgcggctccggctactacatcgacgtcggcgcctcccagctgatcatcgacggccgggtgaagctgaagaacgggcaggtcgccaagatcaccggcaacgccgtggtgatgggcgacggcaccgagctggaggccgacctgattgtctacgccaccgggtacgggtccatgaacgggtggctggcggacctggtgtcgcccgagatcgcggaccgcgtgggcaagtgctggggctacggctcggacacgccaaaagaccctggtccgtgggagggggagctgcgcaatatgtggaaaccaaccaatgtccccaacctctggatccacggcggcaacctgcaccagagccggcactactcctcctacctggcgctgcagctcaaggcccggatggaggggctggaaacgccggtgtacgaactgcagcccagccaccacacccgctaaagaaagaacccatcatgaaggcagcacgtttccacgcccgcaaggacatccgcatcgaggacatcccggaaccggaactccgtgccggggcggtgaagatcgacgtcgcatggtgcggcatctgcggcaccgacctccacgagtacctggaagggcccatcttctgcccggcgcccggccacccgcacccgctctcgcacgaggaatccccggtgaccctggggcacgaattctccgggactgtctctgaagtcggcgaaggggtgacgggcctggccaagggggacaacgtcgtcgtcgaaccctattttgtggacggcacctgcgacatgtgccaggcgggcagctaccacctgtgccggcagatgggcttcatcgggttgtccggcggcgggggagggctgagcgagaagatcgtggtggacgcgcggtgggtgcaccccatcggcgacatcccgctggatgaggcggcgctgatcgagccgctgtctgtggcgcaccacgcggtggcgcgcagcggcgtcaaggccggcgacacggcgctggtgggcggctccgggccgatcgggctgctcaccgccgcggtcctgaagggcatgggcgtgaccacgatcatcagcgagctcacccaggcgcgcaaggagaaggccacctccagcggtgtggcggaccatgtgctggacccgagcaaggaggacgtccccgcgcgggtgcgggagctcaccggcggtgcgggggccgacgtcgcgttcgaatgcgccggcgtgaacgcggtgctggacaccatgctcgacgccgtccggccaggtgccgtggtggtcaacgtgtccatctggggagctcccgccaccgtggacatgcagaagatcgtgctcaaggaaatcgacctgcgcggcaccatcgcctacgtccgggaccaccccgccgtgatcaagatggtgcaggagggcaaggtggacctcaagccgttcatcaccggccggatcgcgctgcaggacctggtggagcagggcttcgacaccctgatcaaccacaaggacacggcggtgaaggtgctggtgcacccgtaggggctgtgggcgatcgtcagggcagcgggtgccgttcgcccacgctgacggaggacgacggcggcaggtactcccgccgtcgtcgttccatccgttgctgctggcccggtgacggaatcctggcacgcttggcacggttgcacctggcacaggctgcaacaaagttctgcaggctggtggaaccgcccttggaccacgggtaaaagtggtcgccatgctcggccggtcggccgcagcggcgcccgaagccgacttccagttcacacacaccgccagcccgggccatcccttcacgacgctgctggcgcgtgaaacggcgcaccggatcccggcgccggacatcccgaccggtgatgacagcggcggcaatgcccagaacgacggcggccacgccggggaatgcaaccgcggcgacgacgttctccaccatgccgcgcagaacccctgcggcggcggacggccccgctccggtggccggtgttgccttcgacatgagcgccgacatcaccgcgacggcgagccaaaccatcaccgccgagtacgccaggcgaagcccctgccgggtccaatagatacggccgagttccggcattgattacccccaattttcagttcgccggaagccgtggccccggatgactagggaatcctataggccggccgccgggcggtgtcccaggtttagctcagtttttgccgaggttccgcgtccactcttggctggaggagccgcacatggctcccgcccccagcatcgaggcccccagccggtcaccctgctgtccacctcccgtgtcgaatagacgcaggtcacaaacaggtgcaagggtggacgggtgaatgcggacatcaacttctatttcgacccggtctgccctttcgcctggatgaccagcaaatgggtgcggcaggtgcaggcgcagcgcgagtacaccgtggactggcggttcatttcgttgcgcctgatcaacgcccacgttgactacgacgcgcatttcccgcctgagtacgaggccggacacacggccgggctccggcttctgcgggtggcggcccgggcacgggcggagcatggccgcgagtccatcgcccggctgtacgaggcgttcgggacccacatcttcgaagctgccccggacacggaccagcgcactgaaagcgagatgcgggagcggcgcgggacgcgtgaattcgtggagccgatcctcgctgaggccggcctgcccctggagctcgcggaggccctcgacgacgactcctgggacagcgagatccggcaggagacggatgaggcgctggcgctgacgggcaaggatgtgggcacgcccatcatccactttgagccgcccgccggagtggccttcttcgggcccgtgatcagccggctgccggacgaacactctgccgccgaactctgggaccacgtggtggggctggcacgcttccctggtttcgcggagctcaagcgaagcctgcgtgagcagccgcagcttcctgccttcggagtcgccgcagataccgtcggccagcaggaggactggcacggcggcagccggcgtcagaagaagtgaacatttgtaaggatggatccattaaccagagcagtatccgccaataccaggagtccgtcacggtccaggcatcagccgagacgctctacgacttggtctccgacatcacccgcaccggtgagtggagcccggtctgtacgtcgtgctggtgggacgacgaggacagcgccggccagcccggtgcctggttcaccgggcgcaatgagctgccgcagcggacctgggagacccggtcccaggtggtggcagccgagcgcggccgcgagttcgcctgggtggtgggcggcaggtttgtccgctggggcttcaccttggccccggcagatgccgggaccacgctcaccgagtcgtgggaattcctgcaggacggaatagccatgttcggggaaaagtacggtgccgacgctgacgcccagatcgccgaccgcacccagcaggcgctcgacggcatcccgaaaacgctcgccgcgatcaaacggatcgccgaatccatcgctgcaacggaggaagccccgtcctaaagacgggaaccgctgcatcactgggaggtgcccggcgcgggcccgatggccttacgcctgtccattgccggtacgggaacgccatgcctcgagctgctcgattgtttccggatgctggtacgcaatcttctgcccgctgtccagcgagatggtgttgctgtgggtcctgatgccctccgggatctgccgccctgcgccgctggagcgcacgaagttgtccttggcgcccacaaaactgttccgggcaatctcgatgtcgcagggcagctccacgtcgtaggtcagcaggtgcgtgcccatgccggcctggtccggccggatgttggcagcccatgagaagccggcatcgcggcattcgttgtccgtaaacgagcaccggatgtgtcccgtccctgcagccggtgttccccgggaccagacctccaggctctggttgcagttctcaatggtgttgcccacgaaccggcagtccgtccacgcaacgttggatccctcggcactgccctgcatggtggtgcccgtgtcatacgtctgccggatcgtgttgccctggaccagcacgttcgcacagccaatccagatttccacgccgttcccgtaccgggtggtctttgatacccgcgaaccgccgatttcctcgatcaggcagtccgtgatctgcgcgttctgggtcccgtagattcctacgccgtggacaccgtggccaaggatgtgcaggtccgaggcgttggtgttggaggcgggacggaaaccctgctgcttcacggctatctccacgccggcacccggggagacgcccagcttcacatacacgtgggtatcgtcgctgtaaaaatcccagtcctgcgccaggtcagcgaggttccaccgcttccagccgtggatggtgccgccggccttcaggaacccgacgtccgttgaggtaccggccgtgttgccggtgaactccccggatccggccgtgaggttcagcttccacacgccggggctgtgcagcacccacgcgtccgcgctcatcttgtagccgctgatctgcggcagcgccccactgccgtaggagcccagggtaaaagcccccgttgtccccttcagcaccggaaccttaagggagccccaaaacacgtcaccgcgccgcaacaggaccgcgtcgccacgccccacttcgcccgtatcaagcgccgccctgaccctcgccagcgtctgccagggtgctgccttggtgcccgggttggcatcgtccccgccgctgctgacgaagcgagtgttcgcgtaggcaggggagggaacaacctccgcaggcggggcagtgagcgcactgggcaccccggcagttaccgccgcagccccaatccactccaggaaccgacggcgccccagcatcatgatttctcaccggccaggggctcggtacggctgcaggttaacgggcggtggaggggtttagaaaaaggcaccagaagattttactggtcctgggctgcccggcgcacatcggcaacgtacggtaacagtccatgcaacaatgacgccatgacccaccaaacgcacgcatccgccgcggcggaaccccgcgcttccgccggccccgcctttgaagctgcgtaccaggccgcccagaagagcctcgctgaaggcggcatccccatcggcgcggcgctcgcccatggggaagaggtcatcgccagcggacacaacgaacgggtccaaagcggtgatccgattgcgcacggtgaaatatccgcgctccgtgccgccggccggcagaaaacctaccgggacaccacgctctacaccaccctggccccgtgtgccatgtgcgccgggaccatcatccagttcaagatcccccgcgtggtggtgggggaagcgcggacgttcgacggcgaacttgagctcctgcgctcacgcggggttgaggtggtggtcctggatgaccagcgctgcgtggacatgatgcgcgccttccaggacaacgatccggacctgtgggctgaggacatcgccgagtaggccctcctacagcgtctcgggaaccgggcgtccggggaagagcgttgagtactgtttccggtacatcctgcgcccgatgagccggtagcccaggcgtaccggcgcggggatctccttgaacagttccttccggtccgcgggcgggttcgtcgccagcaccatccccagataggtgaccaggaatttcttgtcgaactgctcaatgctgtgctgccccagtccgttcatttcctcctcggtcatcaccctgtccgcgaccggcatcacttcggtaacctcgcggcgcaggtgcactttgaggacagcggacaggtcctcatagcgcgcggcgagttccgcgccctgctctttgtccgccgtcgccatccagcgcaggcggacgggctcgatgctctcgagccgctgtgtgacctgccggtgctgatggagcatctgccctacgtgcagcgcacaggccggcgctcgttgctccagctgcgggtacatgagcaggtcctcgccctcgtggtggatgtaaagcaccttgtcgaagttgccgagcacttcacccacgtaagcggcgcgggcggtgtccccggcaccgactgagcgcaccagtccgggcgcctcgtcataggcccagaggaagaagcggtggatgcgccgcatcccggccgtcccggtgcacaggacgggtcccggcggaaggggagcggcggtttcaccgggctgcatggtgaagaaatcagtcattggatgggcccctaacactcgtcattccaggaccaggacctctccccgggagcatcgtaccgttcggccaaatgccgcacaatggcttctgctggcgggccattcagccgcaggccgcagccatgggcgccgtcactggcggcctacaccggctccgccctcttgacccgttggatgaccatgcggcggctgccgtgggccgtgagcacctggttcttcctgcgaatctcgatgtgatccggcgacgtatctcaaccagcgggcagcaccgcggccacctcaacctgtaccccggcgtcccggaacttctgcacctgctgagggtcggcgccgtcgtccgtcaccagcgtccaaggcaaagccaaacgtgcccacgcgtggaacggccgcagccccagcttggaggagtccgccaaaacataaacggaacggccgcggcgggccatgagctccttgagccgggtctgggcatggtcggcttcgcagatgccgtcctcggcggtgacggcgtcggcgcccagaaacacccggtcaaaactcatccgctccagcgctgcctcggccagaggccccacaaaactctgcgacaggctccggagccggccgcccagacagtccacctcgataccctcggaatcagcgagttcctgcatggtgttgatgcccggggtcgtcacggacagcttttcgaacccgcgcagctcgtgcgccagggcacccacggtggagccggcgtcgagcaggatgttctcgccgggccggatcacggacgccgcccagcgggcgatcgcgtgtttctgctcgaatgcttcgccggtgcgctgccgcagcgacgcctccgggtgcgcgcccagggccatggcgccgccgtaggtgcgggccagccggccctggccgttcagcagcgccaggtcgcggcggatggtggaggccgtcacctcgaaccgggcggagagttcctccacggaggccaggccggtggtcacggcgaggtggtagatctcctcgcgccgcgcgtttgcgctgagcatttccggtctccttcccgtggcagtggtaaccatgctagttccggcccccgcccagtccccgcagcaacgcctacacggccacggcaggccgggtggccatctccgccgcctggtgcagcgcctccaccatggaccgggaatcggcgatcgccttgccggcgatatcgaacgcggtgccgtggtccacggacgtgcggatcaccggcaggcccaccgtgatgttcacgccggcctcgatgcccagcaccttcaccggcccgtgcccctggtcgtggtacatggccaccaccaggtcgtaatcgccccggccggccaggaagaacagcgtgtccgccggcagcgggcccacggcgttgatcccgtcagcctgggcggccttcacacccggctcgatcttctccgcttcctcgccctggccgaacaggccgttctcgccggcgtgcggattgatggcgcacacgccgatcttcgggttggggatgcccgcgcggaccagggcctcgtgaccgcggcggatggtgcgctccaccaggtccgggttgatcttgcggatggcatccatcagcccgatgtgggtggtcacgtggatcacccggatcttggggctggagagcatcatggacacttcctccgtgcccgtcaggtgcgccagcagttcggtgtgcccggggaagatgtgcccggccgcgtgcagcgcctccttgttcagcggcgcggtgcagatggcctgcaccttcccggccatcgctagctcactggccacccggatgtactcgtacgcggcatgcccggccacgggggagagctgcccccacggcaggtcctccgggagcagcgccaggtcgatcacgttcacccggcccggcgtgaacaccgcgtcctccacgttctcgatgctctggatgtccgcctggatacccaggacgtccgcggcctggcgcaggcgcagcgcgtcaccgatcaccacgggccggcactcggcgttgctctgcggatccagcacggcggccaccaccacctccggacccaccccggcgccgtcgcccatggtcacggcaacgtagggaagggcgttttgctgggtcttgcttgctgcggttgtcatgtctgctccagatcgttcggaagtcttgctgggaagggtggtggcgggagactgcgcggaccggccgcggcgctcccggatttcgtcgtaaagctgtaagagggccaggtcatcaccaaagctgccgggcttggtgcccaccaacgttccgtccccggcgcggctgagcacggccccgtgctgcacggccgcgagtggcaccagtcggtggaggccgacggcgtccaggacttccctggccgtctcaccgcccgtgaggatcaggtctgttggtgttgctttcgctgcctcggctgcgaacctggacagggcctgcacgatgcgggctgacccggacgggtccacttttgaagcggcaagggtgatggctacgcggtggcctgcccgcaaatccgctgaaacctgggccagctggggagcataggccccgatggctcctgcgtactgtgggtgcagcttgatcaccgtgaagccttgggcctcgagtttggccagctgcgcctgcgcggttccggatgcggatccgacgaccgcgagcaccggcctggcggctccctgcggttccgccgcggggcaggcatcagtttgtgctcccaattgcgcatttcgcgcaaggtgggttgcgagccgctgtgcaaggacgtcagccgttccgccggttcccaccagcacgatgcggcgaccgccggcctggaagtccagctccagcagggcgcccaccacctgctccaggtcctggacggtttcgccgtcggccaccagcagcccgggctggtccgagtccaacagcgtgtccagcacggcggacagcgaaccggaccgcacctcggccaggtccacggtctgcaccgaggccggatcctccgggcgcagcagcgaaggaatgcccgccggcggtgccgactgctcggcctgccacaggtccgtctccgccaggggaatcccggaaaccacagggcggccgtcaactacggaccgctgcagctgggggagtgcccccgcaacaacagcgtggaaaccaaggcccgccagggcggaaagttcggcgcggacgttgccgcgccacagggagtccatcttcttgaacatcacctgcgcgccagcggcctcggggccggtgaaggcttccttgaccatagcctcggcagcagattcaggaagcccgcgcgaatgcgtatcggcgaccacaacgtcggtgccgggctcgggtaaggaggtgccgccgtcatgcgttcccgggacagtatgcgtgcccagcaggacctgcgcgctcagcccgtgctgcacaaagcaggagccaacctcggcggcgccggagaaatcgtcggcctgcacaaatacggaagccacgttgctcctctcgtccgtagtcggctgaagtcccaaatgggttatctcgttctatatacaatttctcgccccatagagagcgggaagttccccatcatcatgacacgcttgcgcgaatcacgctagaggggttgcgcaattcgcgcaggagtggcaaagtgatggacacaacattcggcgcagccactccggccggcagccgtccccccgatctaccgagaggtcaacgatgaccgttcttcctcaaggaagtgagatttcccgccgccgcctgctgcagttcggcgcggccgcagggtttctgctgggcaccggcagcctcgctggctgtgctggccccaccggactcccgggccccagcaccctgaccttggccctcaaccggtccctggtcagcctggacaacaagctcaaccagttcgacgccgccgtcaccgtgcagcgcgccgtccgccagggcctcaccgccatcggccccgaaaccaagcccgtgctggtcctggccgaacgcttcgagatgaccggacccaccgaatggaccgtcaccctccgcgaaagcatccgctactcggacaacagccccgtgcaggtggaggacgtttccaccgccctgaagatgtaccagcaggtgcagggctcctttgtggccgggttcttccccgaattccccgaagtggttcccgtggatgaccgcaccttcaaaatggtctccaagaagcccatcccaatcctggactcgctcatgagcatgatcctgataaccccggccgcgcagaacaagccggaggaactgcaggagggcgtgggcaccggcccgtacgtggtcaccaagttcaaccgcggcgccggcacctacagcctggcccgcaacaagaactactggggcccggcgccgcaggtggacaacgtggaagtccggttcctccccgaggaatccagccgcgtcatcgccctgcgcagcggcgaggttgatgtcatcgactccatcacccccgactcccgcgaacagctcgccggccttcccggcgtcgaactccaggaagcgtccagcctccgcctcaaccagatcttcttcaacttccgcaagcccgccggccacccgctggccgatccccgcgtccgccaggcgctcagcatggcgatcaacggcgaggcgctggtgcgggacgtgctggtggactccgtcacccaggccgaaggcgtcacgccctccagcctcaccggctaccacaagaccggcgagtacgtttacgatcccgaaaaggccaaggccaccctcgcggaactgggtgtcaaggacctcaccctcaagatcatctgggaaaccggcgagttcgcctccgacacctccgtgatggaggccctggtggagatgttcggcaagatcggcgtgaaggccgagctgcagcagttcgaacctggcggcaacatccttgcctggcgccagggcaagcagggcgactgggacctgcttggcaacggctaccccagccccaccggtctggccatcaccatgctgcagggcatgtactccggcaccccggagaaggaagccacccgcgacacctaccagggctacgtgatccccgaggtcaccgccaagatccaggccgcctccgccgaagcggacccggcccgcaggaccgaactgctgaacgacgcacagcaggccgtgtgggacacctggccctgcgcctgggcgttcgtccccaaatccgtcctcgcccaccgggagcgggtgtccgggatcaacctggcacccaccaactcctacccccttgttgatgtccggctggaggcctaagccatgacgaactacatcctgaaacgcctgggacagggcctgctgaccgtgttcctcacggtgtccaccgtgttcatcctcatccgcatggccccgggtgatcccgccgtgtcctacgccgggccgctggccagcaacgaacagctcgccgcggtgcgggagcagttcgggctggaccggccggtgctggagcagtactggatcttcctgcagcagctgttcaccggcaacctgggccagtcctactccttccaggcccccgccatgcaggtggtggccgagcgcatgccgtacacgctgaccctcgccaccgccgcgatcctgctgaccgcagttgtggccatcccgctgggtgtgtggatgtcccgccgcccggataccggcaaggaactcggcgtcaacgtgctcaccatcgccgggcagtccatgccggacttttggaccggcatcatgctcctcaccggcttcgccgtgctggtccccatcttcccggcctccggcttcgccacctggggcgggctggtgctccccaccatcaccatcgccatcctgcagatcgcactgatctcccggatggtccggcgggaaatgaccaacaacctcgcagccccgttcctcacggtggcccgctcccgcggtgtccgcagctccgctctcacttggcgctacgccatgggcaactccgccatccccgtcttcacggccctgggcacccggttcgccgccatgctcaacggtgttgtggtggtggaggtggtgtttgcctggcccggcgtcggctccctgattgtgcgggccctcgaaacccgcgactaccccctcatccaggccacggtcctcctcaccgcgctgctcgcggtgggcgtgcagctcctcatcgacctcgcctacccgctccttgacccccgcgttcgtcttggaaaggcggcaacagcatgagcctcgacaccgcaacgcccgcccccggcggagccggaaagacagtccggcagcccagccccagcgccgtcaccaaggcggacatcgccaaggcaggcgccacccgccgtcgcaacgccgcaaagtggaagctcattgtgggcaccatctgcaccctgctggtgatcatcccgatcatcctggcccaggtgcttcccctcccggacgccaacttccaggacctcggggcacggcgcctgccgccgctcaccgacggccacctgttcggcaccgaccagctgggccgggacctcctgtcccgcgtgctgcacggcggccaggtctcgctgaccatcggcctgctggccgtgctggtgtccggcgccatcggcatcatccttggcgcggccgccggctactacggcggctgggtggacaccatcgtctcccgcgtcctcgaagcccagatgtccctgccattgctcatgatgctgctgctggtggtggccctgttcggcccctccatccccgtgatcaccttcgtgatcgccatcgcccaatggcctgaagttgcccgcctcacccgctccatggtgctggtggaacgcgaaaagccgtacgtctccgccgcccggatcctgggcctgcacaagatccagatcctcatccagcacatcatccccaacgtcatcaagcaggcaaccctggtggtcctgctcctgctggcccaggccgtgctgctggaatccgcgctcagcttcctgggtgccggaccgcagcgccccttcgccacctggggccgcatcatctccgacggccaggactacatcaccacctcctggtggatggtcaccctgcccggcctggtaatcgtgctcatggtggtgggcgtcaacctgctgggcgacggcctccgcgaccgtccccgccgcaagaagaagggggcctgacatgaccgcacagcctacttttacagagcagccgctgctggaggtccgcgacttccaggtggagctgatcaccgacgccggcattatccgcgccgttgactccgtcagcttcagcatccaccggggcgagacggtcaccatcatcggtgagtccggttccggcaagtcgacgacggcgatgggcatcctccgcttgctgcccgaggacctggcggtactgtccggcaccgtgctgattgacggcgtcgacatcaccgccgatcccaaggccatcgacaaggtgcgcggcaagaccctcgccctgatcccgcaggaccccatgacggcgctcagtccggtgcactcgatcggcagccagctgttcgaggccatccggatcgccggtgccgcctccgccaaggacaagggcgcgctgcaggcccgggccgtccggctgctggagcaggtgcacattcccacgcctgagaagcagctgaagaagtacccgcaccagctctccggcggcatgctgcagcgcgtgctgatcgccatcgcgctggccagcgagccgcagctgctggtggcggacgagccgacgtccgcccttgacgtgactgtccagggcggcatcctggacctgctgctggaactgcaggaacagcgcggcatcggcatcctgatgatcacgcacgatctcggcgtggcccggctgatctcggaccgcatccacgtgatgaaggacggctccttcgtggagtccggcgaggtccagcagatcgtggaccaccccgccaccgactacacccgggcgctcctggccgccgtgccggtgctggggccatgggacgagactcccgccgccgcccccggccgtcacgctgcgaacgccaccggatcctcagccacctctgaccccgcccttacccagaccggagcaaagccatgacgaagccgttcctcgccgtcgaaaacctcgtggtggactaccacgtgcccggcggcaccttccgcgccgtggacgacgtctccttctccgtggacaaaggcaggacgatcgccgtggtgggcgaatccggctgcggcaagtccaccatcgccaaggcgctgatgcggctggtgacccccaccagcgggcggatcgagctggatggcacggacatcgccgccatgagcgaggcgaagctgcggcccatgcgctccaaattccagatggtgttccaggacccgtacggctcgctggacccgcacatgaccgcgcaggaaatcgtggccgagccgctgaagctgcagggcgtccgctccaaggcggagcggcacaaggctgcagcgaagctgatcgaccaggtgggcctgcccgtccggtccctggacaagcacccggccgagttctccggcggccagcgccagcgcatcggcatcgcccgggcgctcgcctccaagcccgaactgctggtctgcgacgaggccaccagcgccctggatgtttcggtccaggcgcaggtgctgcggctgctgaagtccatccaggacgaaaccggcatcacctacgtgttcatctcgcacaaccttggcgtggtgcaggagatcagcgatagcgtcatggtgatgcagaagggcaggctggttgagcatggctccaccgcgtccgtcctgaccgcccccaaggaggactacacccgcaaactccgccgcgcggccctggacccctccaccatgaccggcctcaagccgcggcacctggtccgctccctggccctggccaaccaggcctgacccttacttttgaaccacgcaaccacgaggaatcaacgcatgagcaagcagcccgaaggcgcccaggtggacggcctgaaactccccatctcccggctggtcctgggaaccatgacgttcggcgacaccgttgacgaggccaccgcgggcaggatggtggaggaagcgctcgacgccggcatcaccaccatcgacaccgccaacgcctacgtgggcggcaccaccgaggagatgctcgcccggcttttgaagggaaagcgcgacggcgtcatcctggcttccaaggccggcatgccgcacgcggaccacggctccaattcgccgctctcgcccgccgggctgcgtgccagcgtggaggggagcctgcgccggctgggcacgaacagcatcgacctgttctacctgcaccagccggaccgggccacgcccctggccgacactctgcgtaccgttgccgagctggttgccgaggggaagatcggcgcgctgggcgtgtccaacttcgccgcctggcaaatcgccgacgtcatccacacggcgcgcgaagtcggcgcgccgcggcccgtcgtcgcgcagcagctgtacaacctggtggcccgacggctggaggaggagtacctcgagttcgcgtccacccacaacgtccacaccatggtctacaacccgctgggcggcgggctgctcaccggcaagcacagcttcgacgccaagcccaccgagggccgctacggggactccaagctcgccgccatgtacacgcagcgctactgggacaaacagctcttcgaggccatcggggaactgtcccggatcgctgacggtgccggcgtcacgctggccgaactgtcgctgcgctggctcgcataccgcaagggtgtgggctccatgctcctgggcgggtccaaggtggagcagctccgcgccaacatcgccgccgtggccaacgggccgctgccggccgacgtcgtggaagcctgcgacgccgtcggcacctcgctgcgggggcccatgcccgcctacaaccgctgacactttcttactgactgaaccgatactgactgaaggacactgatgacctccgaactggccctcgaattcgcccgcaagatccgcgcccgtgagcaggcggtgggctactgggcggtgctggacgcgccggtggccaccgaacgcatcggccggctgggctacgactacgtggccctggacgcccagcacggactgctcggctactcgggggtgctgaacgggctgatggccatcgacgccgggcacaccgccgtcggcatggtccgcgtggaggccaacgacttcaccgcgatcggcaaggcgctcgacgccggcgccgtgggagtcatcgtcccgctcatcaacaacgccgccgatgctgctgcggcggtggcggcagccaagtacccgccgctgggcggccgctcctatgggcccatgcgctcggccctgcggatcgggcctaagccggctgaagccaacgccaccaccatggtcttcgccatgatcgagacgccggaaggcctggccaacgtcaaggaaatctgcgccacacctggcctggacggcatctacgtggggccgtcggacctggcgatcgcggtgggcggggcattccccggggaccccgccgtcgacaccgaattcaacgccgcgctggagaccatcgccgaagccgccgcctccgccgggatcgccgccggcatccacacgcccgccggcaccgtagccaaccagcggctggcgcagggctacaccttcaccaccatcgcctcggacctgacgcacctggaacagatcgccaagtcccacctcgacgccgcccgcgccgctgccggaaccacaaaggactgaaccatgacaaacaccaccaccgccgcgtacagcaccatcaccccggacggcgccgtgaagcgggccgacggcgccgactacgcctacctgccggcccccaccgtgcagagccacgccgccaacctgctcaccctgccggacggccggctgggctgcgtctggttcggcggcacccaggaaggcgtgccggacatctccatctggttctccgcccttgagcccggcagcagccagtggtcttcgccggaacagctctcgaacgactccacccgctccgagcagaaccccatcctgttcacggcccctgaccagacattgtggctgctgtacaccgcgcagaaggcgggcaaccaggacaccgccgaggtccgccgtcgtatatccacggacagcggccgcacctggggcggggtggaaacgctgttccccgcgaaccagaccggcggcgtgtttgtccgccagcttccggtggtgctgccgtccggccgcctgattgtgccgatcttccgctgcatcaccacgccgggggagaagtgggtgggcaacagcgatgacagcgccgtgatgatctccgacgacgccggcgccacctggaccgagcacgtcctgccggggagcctgggctgcgtccacatgaacatccagcccgtggccgacggctcgctgctggccctgttccgcagccgctgggcggactcgatctacgaatcccgctccacggatagtggctccacctggagcgagccggtccccaccgagctgcccaacaacaactcctccatccaattcaccgcgctcgccgacggccgcctggccctggtctacaaccacgcgagggcgggggagggcaccgagcggcgcctgtccctctacgacgaaattgacgacgacggcctggccgaggagcaggggcaggtcgccgagccggacgctgcggccttctccgaggacgacggcgttaagcgcgccttctggggcactccgcgctcaccgatgacgctggcgatctccgaggattcgggccggtcgtggcccatccgccggaacctggatgtgggggacgggtactgcctgtccaacaactcccgcgacggcctcaaccgcgaatactcctacccgtccatccaccagggccgggacggttccttgaacatcgcgtacacgtacttccggcaggccatcaagttcgtccgggtggacccgcagtgggcgtaccagggcaccacaactcctggcggggacgcatgaccaagcacgctgtggtcaccggaaccagttcggggatcggcaaggccatagcccagtgcctgctggccgacgggtggcgggtgaccgggctgagccgcagcgagtcttcgctgggggagggcttccagtggcagcaggctgatctctcggagcccgaatcgttgggcagcgtggtcgaggccatcgggccagccgacgccctggtgcacgccgccgggttccagcggaccgcgcacctgggctcccttgacccgtccgcactggcggggatgttcgcggttcatgtggcggccgcatccgtgttggccaacgcgctggtgccgtccatgcccgacggcggccggattgtcctgctgggcagccgcacctccaccgggatgccgggcaagagccattacgccgccacgaaggctgccctgatggggctcggacggacgtgggcgcaggagctcgcgccaagggggatcaccgtgaacgtgctttcccccggccccaccgacacccccatgctgaacgaccccggccgcgccgccaccccggtgaagctgcccgcgctgggagccctggtggacccggaggacgtggccgccctggccgcgttcctcctgggcccccatggcaagtccatcaccggccaaaactacgtcatctgcggcggcgcctccctctagcaaccccccatcccccccaaaaaaacccaaccgcctgcgacgctctctcacttaacgcaggtttttggcgaccctctctcacttaacgcaggttttccagcaacgctctcgcagcggcggccaaacccgtctccatctcgcacccgccgccggcccacgccatccccgcgctgttggcgcgtgaagcggcatactggatcccgccgtcgaacgtcccgtgccttgataacggccgcggcaacgatgacgacgacggcagtggcgcctgggagcgtcactgcggcaattacatcgcaggcatattccgggcggacggcctgcccttgacagccggaccgggcctagggagcatcaaaggtgccggtgcgcctggctgtcttcgcaagcaggcactccggcttcttgaagggtaatcggatgcagccagctctcccgcggctcagaaccttgcggagtgtgaccgccaccgtcgcggccctcctggcggtctcggccgcgggttgcaccagccctcccgagccgcctgaccgtcccagcgagtccgcgtctcccgcgcgcgatattcgcatagcagccgtcggggacatgaacggcgtcaggacctatgcgcctgacagcccgtccggccgcaatgctgtggcgatcacccggctcgtgaagaacaacgagattgatgcgttcctgggtctcggagacttccagtacaacaccgcctactgcaatgactacgtgaactactggacgcggctgtggggcggcaccaagtccaagctgtactgggtctccggcccaaaccacgattggagacccggacgcaacgaagacctcgacaacttcatgaacggtgaatgcccgggggctccgcagaaggctgccagcaatcaggagcgcgggttcatcgggaacggggaaccgtattcaacggatttcgggaactggcatttcgcgttcctgtcctccgcgcaatggcgctacaacccggcgcgggcccgggagctgacaacctggctggacagggacctcgcagccgccaaggcggtgggcaaacacctggcagtggtgcaccacgaaccatatttcacgtcggacacggacgaacatgagcgggcttccgaccataaaccgtggatcaacgtcatgtggaagcaccgcgtccgcctcaccctgtccgggtcgcagcacaactacgaacggtcatgcccggtgaacaacgcagaccagtgcgtctatgacgggatgacggcgttccaggtctccacgggaggcatcggcctccgccccttcaccagcagcccgcccttcatcgtgcagcggttcagcgacacccacgggttcctccggctgacactgcgcgaaaacggatctttcgactgggaattcgttccaaccaccggctccagcacggacgttggcacccgccccgcaccgcagtaatccacacaatacgacggcggtgctgccgccggctattctggaccggccccctgactaatgccgcttggccccttgctgccgcgggagttagcctgcgcggcactggcgcggacaaccagcgtgggttcgatgggggtgcggtccacgtcccggccctccatggcaccaagaagcacctccatgctcatgagcgccaaggccgtgaaatcctggcgcacagtggtcaggggaggcaggaagtagtcggaaccttcgatgtcgtcaaaaccgaccacgctcacgtcgtccgggacgcggatcccgttttccgcgaaagcgcgaatcagccccagagccgtgtggtcgctggcggcgaagatggcctggggtactttttcttcccgcacgagctggagggcggtctcgtaagcccaccgggggctccaatcgccctcgaggcacagccctggtgtaagtccggcgtcgcgaagcgaggcctcccacccgcgtttgcgcacccgcccatcgaaccagtccatggagccggcgaagtgggcgatgtcggtgtggcccaggtcgatcaggtgctgggtggccagccgtgcgcccagctcctggttttccgagtacgtaaagacattgggagtcgatgacgctcccgccgcgatcatctccaccggtacacggcacgaggcattccatacggctgctgccatgtccactacaggcgcaatgacgatgattccccccacgccggtatcgtccagggtgtcgagggcggcctgcaccgactcttcgtagggctgttcgacgctgatgacagttgtggcgtagcccttcttgcgtgcaacgttttcgagggccatgagcgtccccaccgggccgaaccgtggggagccgtcggagagtattccgatggaagtggaccggctggtgaccagcgccgtggctgcccggttcctgcggtacccgatgtccttgatcacctgcagaacccgttgccgcgttgcagcgctcacgtccggtgcgtcattgagtacccgtgagactgtgccgaaggagacgccggcaatgctggccacgtcgttgatggtgggtttccggcgcagcggggcatccggcagcctctcgttggcctcgcggggaaccgtcatgcctgccactgtctctcctgtcgtgcacctcacggacacagcctcgcggttccgtgcctttcgatcttacgtccgcccggccctcgcgttcgatgaaactgcctgggatgtgatgcttgacacgttactccgtaaacgtttacgatggtgtccgtaaacgttcacggtggggtcgtaaacgcttacggaggaaacatgttagtgaggaaaggagcggggatgcccgaccacatcgtctacgcactcgcgctcgatcccaacgccgggcttcgggatgtcgaccaggtccagtgggcacatctggaggtgcttctgagggacacagcgcccggcgatcttgcagtcgccatacgcgcctttgtctctgcgggctcttgggcggtcatcggaatcttcgatgacaatctgctctgggcgagcctggtggtctccgtcgacgactcgggcaaacccgtgtcagtgtccacccttcagctggccgcggcagcgggcggcgacatggccaaggctgccggtgaggcagtggggtgggtaaaagcccaccgcggcccgtgttccctgggcttcttcgtcgacaaagctcatgcagaggcgctcctgagagcttcagacaaggccgctgccatccgcacagccgcggcctcaggaggactggtgctgtcgccggttccgcctgccctggctattgccctcgcctgatccatcccaggcgtccacccctatccatccactcaaagcactggagaacaatgatgatccgcaggcttcccattgtggcccttgccgcagccctgtcactttccgtcgcttcctgcagcagttcgacaacaggcacctcgaacgctcccgatgccggcgtgtccgagaaggcccagcaggcccttgacgagatcaagggacaggtcctcagcaaggggcccaacggcgagacgccctccccggcgtccgcagcagacctgacacctgaagagattgagaaggtcaaggcactcggtgccaaggcagccatcgtgatgcactacggcggcaacgactgggctaccgcccaggtcaatgggctgaagagcgaattcgaaaaactcggcatcaaggtcatcgccacaaccgacgcgaacttcaagccggacaagcaggtctcggatatcgagactgtcatgacccaggatcccgacatcatcgtctccatccccacggatcctgtggccaccgcctccgcctacaagaaggccgcggaagccggcaccaaaatcgtcttcatggacaacatcccccaggggctgaccgccgggcaggactacgtgtctgttgtttccgctgacaactatgggaacggcgtcgtctctgcccaccagatggccaaggcgcttggcggcaaggggaagatcgggctggtcttccaccaggccgacttcttcgtgaccaagcagcgctacgagggattcaaggaaaccattacgaaggaatacccggagatccaggtcgtcgaggaaaaggggatagccggtccggacttcgctggggacgcccaggctgctgccaacgcaatgctgagcaagtacccagacctgtccggcatctgggcggtctgggatgttcctgcagaaggtgtgatggccgcagcacgcgccgcgggccggcaggacctgaagatcgccaccgaggacctcggcaagaacgtcgcgattgccctcgccaaggacgaactcatcgtcggccttggagcacaggttccgttcgaccagggtgtcacggaagcccggctggccgcaggggcgctcatcggcaaggaagcgcccgcttatgtggcgctgagtgccctcccggttgaccactccaacgtcctcgaagcctggaagcaggtctaccacgaggacgctccgaaggacatccaggactcctacaagcagtagccaagaaccggcggtgcgggggttgcaccccgcaccgcgccgaaagggcaacgatgaacaccgcagacaatgtcgtcgagatgcgctcgatttccaagggcttcaacggcgttcccgtattgaaggacgtgagcttcgacgtccgcaagggcgaggtccacgcgctcgcaggcggtaacggcgcagggaagtccacgctcatgaagatcctccagggcgtttatcaggcagacgccggcgagatcctcattggcggcaaaccggccgccatcaaatccatccaggacgccaaggccgccggaatcggcatggtcttccaggaattcagcctggtaccgagcctgaccgttgcaaaaaacatcttccttgccgcggaaccgctcggcatgggcgggatgatcgacgaccgtgccgcggtgcgccgggccagggaagttttcactgagatggaggtcgacgtcgatccccgcgccgaggtctcacggctcggcactgcatattggcagctgaccgagatcgccaaggctctcgcacagaacgcccaggttctgatcatggacgagcccactgccagcctggcccggcatgagtccgaagcgctcttcgaactgattgaccgcctcaagcagcgtggcatttcaatcatctacatctcgcaccgcatggatgaggtgtacaggctggcggatcggatcaccatcctccgcgacggccgccacctcctcaccgcgccgctgacggacgtcactcccgaacaaatcgtggaaggcatcgtcggcaagaagatcgagggccagctttcctatcgtgcgcgtgatcacgcggcgcacgaaggggctccgctgctggaagtccgcgggctcaacgccgggccgcgggtccgggatgtttccttcgcgctccggcccggcgaaatcctcggcctggcagggctgatggggagcggacgaaccgagctcgcacgtgcactctttggcattgacaaggtggacagcggtgaaatcctcctgcggggcaaaaaggtcaaccttggctcgccgcagcaggccatcaacgcgggagtcgccctcatcccggaggaccgcagggcccagggcctcgtcctggagcactccgtccaggacaacctgctgcttcccctcctcggccagatccagcggggacccctcctggatggcgccaagggcaaggagttgtcctcgtccttgatcaagaggttcgcagtgaaggtggcccatccccaccgtccggtgcggctcctctcgggcggcaaccagcagaaggtggtcatcgccaagtggctgggcaccgatccggacatcctgatcctggacgagccaacggccggcgtcgacatcggcaccaagagcgaaatcctggacatgatccgtgagctggccagtgccggcaaggccgtcatcgtcatctcttccgagtacccggaactactcgcggtcagcgaccgcgtactcgtcctcaaggacggctccatcatccgcgatattccccgcagcgagatcgctgacgaggaatatctccaactcgcagtacagggagtctgaaagtgagcaaggcaaacaccatcgcaccccgggacaccgcggcgccccgtaatttcggcaccatcctcaaagaactcgactggcggcgctacgtcatctacatcggcttcgtcgttgtcttcctgtttttcgccgttctgctccgcgaccagggcttcctgtcgccaaacaatctgctgaacatcttccggcagaccgccaccatcaccgtcatcgccgtgggcatgacctacgtgatcgcgtgcgcggagatcgacctgagcgtcggatccgtggccggcctctccagtgtgtgcacggcgatggccctctcccagtggggcctggtccccggaatcctggccggcctcgccgtcgggcttgtggtcggctcggtcaacggtgccctggtcagcctccttggcatcccgtccttcctggtgaccctcggcatgctggggatagccgtcggcgtggcccagtggatcacggcgtcggcgccccagcccatcctgaacgacacgttcaacatgctgtttggatccggcaacttcggtccaattccgggcctggtggtctggagcgccatctttgtcgccatcggcgccgtcgtgctgaaccgcaccaagttcggccgccaggtcctggctaccggaggcaaccgcaacgccgcagagttcaccggcatcaacacgaagcgcatcaaattccaggtgctcctcatctcagccgtggcggcaagcgtcgccggcatgctctacgccggccgcctccagtccggacggttccagtggggatcgggagacgaactctcagccatcgcggccgtcatcctgggtggaaccagcctcttcggcgggttcggctccatcatcggcaccctcttcggcgccctgctgatcggcctgatcaacaacggattgatcctcgccggactcgacagcagccagcagcaagtggtccgcggcgcaatcatcatcctggccgtcgccctggcacggaagaagtagcttacatgactctcaactcttcttcggatcccgaaaggcagaagcaatgaaactcggttactgttccatcacctggggcggcgtcgtcggccacgcccaaggcgtgacgagcgtcaaagacctcttttacctgacccacggctccatgaaggacgccgtccgggacatcgcctccgtgggctacgaaggtgtggagatgttcgacggcaacctcgcggaatacgcggaaaagcccgacgagctcaaagaaatcctgagcagctccggagtttccctgacgagtgtgtataccggcgccaacttcatttacgccgacatccttcccgacgaaatgcaccggatccaccgggccgccgagctggccgcgaacttcggtgcggaacgactggtcgtcggaggcggcgcgcggcgcgcggcgggaaccacagaagaggactaccaccgcctcggaacggcgctggacagcgtcacggacatcgcggaaagcttcgggctgtcggcgagctaccatccgcacctgaccaccattgtggaaagcccggacgagctggacaagctcatgccgctcacccggatcggtttctgccccgacacggcccaccttgctgccggtggggcggacccggccgcggtcatccggaagtaccccgacaggatccggcatgtccacctcaaggaccttcggcgagagcctttttcgttcctgcccctgggcctgggtgaactcgacttcccggacatcctcgctgccatccgggagagcggctacgacagctggctcatggtcgagctcgacggctacgacggagatccccgggaagcagccgccatcagcaagaagtacctcgagaaactcctctgacccctttgaccatcagggaaagccaccgcaggcgctcccgcctttccggaaggaacacgatttacatgcagaacctcaacgtcggcctcatcggaggcggcttcatgggcaaagcccattccctggcgtacgccgccatgcccatgttcttctggccggcaccggctctcccggtccgcaaagtcattgctgaagccaccgaggaccttgcttcggaagcggcccgccgcttcggcttcgaaaagtccacctcggactggcgcagcatcatcgaagatcccgacattcacgttgtggacattgcaacgcccaatcacctccacgccgagattgccattgccgccgccgaagctggcaagcacatcatctgcgaaaagcccttggcccgtacgggggacgaatccaaagccatgtacgacgcggtcaaagacaaggacctcgtccacatggttgcgttcaactaccggcggacccctgccgttgccctggcaaaaaaatacatcgaggaaggcgccattggccggatcctcagcttccgtggcacctacctgcaggactggagcgccgatcctaactccccgctctcctggcgcttccagaaatccatcgcagggtccggcgccctcggcgacatcgcaacgcacgtcattgacatggcgcgctacctcgtcggcgagttcagcgccgtcaacgccctcctgtccacctggatccccgagcggccgctccaaaccagtggtgctgacgcgctcggcacagtacgtgggggagagggcccccgcggccaggttgacgtggacgatgaagtcatgaccatgatccgctttgccaatggcgccgtgggttccgtggaagcaacacgcaatgcccacggacggaacaactacatcaccttcgaaatccacggaacagaaggaagcatcgtgttcaactacgagcggcgcgacgaactgcaggtttgcttcgcgtccgacccaagtgaccgccggggattccgtaccgtctacaccgggcccgcccacccctacggcgaaggactttggccgatccctgccctcggcatcggatacggcgagacgaagatcatcgaggcctacgacttcttcaaggccatcgcagaaggcggcagcgtgagcccaagttttgctgacggttatcaggtggcgctcatcgacgacgcaatcgtcgaatccgctgcaaaggaatcgtgggtcgaggtgccgcagatcaatgcatgacccaacgggggggcggccgagccgcccctcccgcaggcacagaacacccaaggacgaaaaattgccacacgtaacggccggtcaggaagcaacgcaagtatggctaatgccagtgttcactgcaaagacggggcaggaagcaacgcttcgtgaagcactccttagtctgcaatccgtgagccgaaaagacgccggatgcctggaatacacggtcttcgctgacaaccaaaggccaggtacgttcgtcctctttgagggatgggcccggcacgaggaccttaaggcccacaacgaagaagcccatgtgaaggaattcgtaaacggtgtgcagtccctgctggccgtaccattctcagtaactcccatcactcctcttgcctaggcaggccacccggagctgtgcgcgatcagcacgtccaggcggcggatgtagtgagttccacttgggggcagttgctttccgttctgggctttccgatgtcagccgtgccagcgactgggctgtctccaggaaggcggcctgccgccggcttcctggagggttatcggggccaaccgtccccggctgttttgtcgccggccacgacccctacggccggtctacccccttttcaaggccagcctgcctgtccctcgcgtgatcttcggatcgctgccgcgggcgacatgaacggcgtcaggacctctgcccgtgacagcccctccggcaggaacggtgcggcgatcatgcggtcctctgcgaaggctgcgggcaagcacctggccgtggtgcacacgagccgtattccacgtccagcacaaaaacgcatgagcggaaccgggaccacaagccgtggatcgacattgcgcgacgacgccgccttcaactgggagttcgtgccgacgtcgggctcgagcacggacgcgggtaggcgttccgcgccccggcaatccagaacgtccgcggcggtgctgccgccggctctgtgcgggcggtgacgccagtcctgccggcatgggacacttcggccatgagcatcgaacagtggtggacgaagctgcaaccgtcaacgcgaacgtggctgatcaacaacaacggagaccaggtgccggcggcagtggtggccgagattgcggaggccggcggaccggcgagcgacgattcgtggtgggctggccaggatgaaaccccgggtcactacttccccgacgacgccatcgactgggtcgaggcgacagcgaacgaggaagagcccggctaggatcacgtcccgcatttcgggaccaacggcacgtcccgggcgccgcgcggtccatcagactggagacggcacgatcggaggttcagccatgactgttttagttgcctatgccagcgcgatgggctcgacgcaggagatcgcccaacatatagcggaccgcatggcgtcttcgctggacggcgtcgagtgccgttccgtggacgatgtggagtctgtttctggctacgacgctgttgtggttggcagcgccgtacacaatcagtcgtggctgcccgcggctgaacagttcttcgcggagcaggcgcccgagctggccaaacggcccgtctgggccttcaacgtgggaatggccgacgccttgccaaagccgttccgcaaaaagggcgcggcactccaacaggcacgcctggcaggagccctgcccccggacgttgcgcttcgcggccacagaatgttctccggcgtctacaaggcagaccagatgtcgtcagcgctgcgcatcctgttccgggtcaccggcggccgcttcggggactttcgggactggaccgccatcgacgcctggactgacgagatcgcggcccagctcgccacaccagcgtcgccagcctccccaggcaacgccaccgcttaacgacgccgggcagcgcaccgccgtcgtgccccttaggagtggtgacgtgcgcgcccgcctgaaaccgttttaggaaacctgcagtccaccgttgatgtcgtaggtggccgcggtgatgaagccggcgtcctcgcccatgaggaaggccatcaacgccgccatgtcagtcactgttcccacgcggcccaccaggatgtccttggacatctccttcttccgctcatcggtcagggtgccgcccatgatgtccgtgtccacgggccccggtgcgatgcagttgacggtgatcccgtgctcgcccatctcacgggccagggcgcgggtgaagccgatgatgccggcctttgcggagctgtacgccaccttggagtaggtgccaccgccgcgctgggcggagatggacgagatgctcaccacccggccaagcttccggtcaatcatgccgccaagcacgcgctgagtcaccaggaacgtcccggtcatgttgatcgcgaagacgcgctcccagccttccttggtttcctccatgaagggccgcggtgagctgatgccggcgatgttggccagcgccacgatgggaggcagttccgcctccactttgctgatggcggcatcaatggacgcctcgtccgacacatccgtctggaggcccagcgcctgcacgccgtgcttgtccccgatctccttggcggccagggcagcagcctcgccgtcgatgtccaggatggcgatgttccagccctcgcgggccagcctgtctgcagttgcgcggccaatgccgcgctccgaggcagcgccggtcaggacggccgtgcgtgcagcgggaaaagcggtggattcggtcattctggttcaactcctgtgttggattcctgggctttgatgaagcgtgcgtagtcgtcgtaggtctggttgatgtgctcgtccattgccttgcgggctgtttccggttctcccgtggcaatcgccgccagtaccagccggtggtgctccagggcatggcgctggacttcggggaacgccgaggtttcccggcgtgtggtgtacagcaggtggcccagctggcccagcagcgccgggaggaacgggttcgccgacgccctgaacaccacgttgtggaaggcaaggtctgccagggtcacggcgtccaggtcgccggcctggtgcgctgtttccaggtccgcaatcgccttctccatggcggcaaaatgttcggccgtggcgtgccgggcggcgagctcggccgccccggtttccatgatgcggcggacctcgaggagcttcagcgctgcctcgtcgatcccggtgccgcgggcggctgcgcggaggatggcctccagcccggtccattcctcgggcggattcacgaaggtccccaggccgcgccgcaccgtgacaatgttctgcgcctgcagggtcttcagtgcctcgcggaccgtcagcctgctgacatcggcaaccctggcgatctccgcttccgccggcagcgacgactggggcgggaggtcaccggagaggatgcgttccaggaggtcggcgaacacagagtccgccagcgttatgcggctcaccggtatccctcctccattggcttgtcagatgtcttatgtcccgatagtgtggcacccgtcactcgacggagtcaattccaaaaggcactggcgtccttcgaggagagccgggcagcgcgcccgggctcttgtccccaaggagtacatcaacgtggatatacaactgctacttgcgctggtactgggcatcgcgaccatcgtcgtgctcgtactgcgcacccggctcgacgcgttcgtcgcgctgctcatcgccgcccttgtgaccggcctcgtggccggccaaagccccctcgacatcgtcaaagccatcaccaccggcttcggcaacaccctcgcctcaatcggcatcgtgatcgggctcggcgtggccatcggcaagatccttgaagtctcgggcgccgccaacgcgctggccctggccttcctgcggctcttcggcaagggccgggagccctgggccatgggcaccgtcggcgccctggtgtctatcccggtcttctgcgattccggctacgtgatcatgaacccgctggcccgctccatcgcacgggtcaagcgcgccggctacgtaacgctggccctggcactgggcgccggcatgaccctgacgcaccacctggtcccgccgacccccggccccctggccgtcaccggcctgctgggcgcggacctgggcgcagtcatcctcaccggcctggtgttcaccgtcctgctccttccaattgttgtgacctacgccaagtggatgggacccaagctcgaaagcgctgttaccgaggaggtccgcgaggccgtctacggccgcgccgcactggtgggtgcctccgagggatcccaccacggcagcacgggaaccatcaccgccgacgacgcccctgccgaggaagacctgccggacgatcccgagctggacctgggcaccccgccggaaggcgccaagccgcaccgcgtcggcgcattcctcgcctccctgcccctcctggtcccgctgctgctgatcgtgctgaacacggtcacgggtgccatggaccagaacgcccagggcgttgtgggcggcaagtacgagccgtccgcctgggttgttcccttcgctttcatcggcaacccggtgatcgcgctgatcatcggcgtcctgctcgccgtctacgtcctgctgccgcggtggaccccgcgcagccgggtccagggctggtttgccgaggctgccgcttcggcggggctcatcctgctgatcaccggtgccggcggcgccctgggacaggtgctccgcagctcgggcgtgggtgacgcactggctgaagccattgccgccacggccctgcccgctttcctggtgccgttcctggtggccaccctggtccggctggcgcagggctcgggcacggtggcaatgatcaccgccgcctcggtcaccgccccgctggtgggcacgctgggcatcgatccgctggtggccgccatggcctgcaccgccggatccatgatcctgagctacttcaacgactcctacttctgggtggtcacccggttcaccgggctcgaaggcaccgcagcgctccgcggctggtccggcatcaccaccgccgtctgggccggctccatcccgctgctgttcatcctgaacctcatcctgggctgagccgcttcaccctagaggactggctggctaagagtcacgagggcctgggcccggttacgaaccgggtccaggccctcacgcgttcaggggcctttggactctggccgcgcggggggcagccggggcaaagtggagagcaacgctatcgggccagggaagaaggcaccatgccgcgcacagctgtcctcaccggcgctgcctcgggcatcgggaaggcaacgaaggagctgctcgagcagcggggcgaacgcgtcatcggagcggacatccacgacgccgaggtggtggtggatctttccacagctgaagggcgcacggccctggtggaggaagcaaggaggctcagcggcggttcggtcgatgccatctacgccgttgccggtctcgcaatccccgcccctgccactgtggccgtgaactatttcggcaccggcgccacgcttgaagggctccggcctctcctggccgggtcgacggctccacgggccgtcctcgtttcttcgatggcagccctcatggcaagcgacgatcagctcgtcgccctgcttgctgcggaagatgaggcggcagccatggcccgcgccgaggtcctcgcccaagagcccacgaccaccggccggctgatctacgcttcgaccaagctggcgctctcaagatgggtccggcgccaggccgcctcggcagcgtgggccggggaagggatcccgctgaacgcagtagcgcccggcatcatcgccactcctatgacagccgagctgatcgccaccccggcacggcgggaggcgctgctcggactggtccctatgccgctgaacggcattgccgagcccatcgtcgtcgcccggctgctggcgtggctcaacagcgaggagaacacgcacctgtgcgggcaggtcatctacgtcgacggcggcagcgacgtcgtcctgcggggagactcggtctggtgaccagctgcccggccacgcgaggctctgtacgcgtttgcgtaacttttggctgcgcgggtacacggaacccgcgcctactcttgggccagcagcagcagcgggctcaaaagtcacgcaattcggtaacgtccgcacccaagggagcatcatgaccaggcccaggctttcggcattcagcgttctcaccttcagcgccctgatcatcctcacaggctgcttcggcccgccggccccggcgcccacgagtaccgccaccgccccaacaacgacggcggcacccaccaccagcccggccgcaccaaccacgacggcgagccccaccgcgccgaccagcttgccggtgactccgccctccacagccaccgccccgccgtcgtccgcccccgcaagcccgccgcctacggaggagcctgccccggccggacttccggagcaggtggcgccgctgaccatctactacgtggccattgacgacaacggcgtctccgggcccctgatcggctgcggtgacagcctcgtcgccaccgccacggcgccggtccgcttcacggaccaggtgcgccccagtgtcgaaaccctgctcgcgaacaagagccgtgacgtcggactgtcggggctcgtgaacgtgctctaccagtcgagtctcacctatgccagcggcgagctgagcggcagcacgatcaccatctggttgacgggacagttcatgctgagcggcgtgtgcgatgtcccccgtgcgaaggcgcagctggagtacaccgccatggccgcatccggggcaacgagcgcccaggtgttcgtcaacggccgccccatcgacgacgtgctgagcctcaagtaacgcatgcctggacagccagcggcgggcggccagcagaaatgccggccgtcccgccgtcgtacttttgggataagttacccccgcatctgcagccccggaacacggtcctggatggcaaacgacgccttcgtggacaccggtgcacccggcgtcgtcacgtagtccagcgtgcggaagtccgcggtcatggcgtcccgggtgatcttcgtgttcacgtagccgcggttgtcgttgaagaacttcaggtgcgggttccacgccatcaccgggtccgtggtggaaccggtgccgttgccggtggaggtgatggacgtgcacaccagctctgaacccaccacgggcgaggccggatccttgtagtccaccttgaggtcgttggcccagttgcggtgcacatcgccggtgaggacgacggcgttgcgcaccttcgcgtccagccagccctgggtgatgcggcggcgggaggcggcgtatccgtcccagccgtccatggagacgtcgtcgatctccagcgcctgggcacggtcacgctcggcgaagaacacctgctggcccaggatgtcccagcgctgggtggagttccggaacccgtccagcagccacttctcctgctccgcgccggtgatggtccggttctccgccaggcgctcggccacgttcttcttccagccgtcaccggcgagctggtcgtcgcggtactgccgggtgtccatcatgtggaagttggccagctggccccactggatggtgcggtagatcttcatgtcgaacccggccggcacggaggacctccgcagcggcatgttctcgtagtacgcctggaacgcggcggcgcggcgctggcggaaccgctcggtggtgtcgttgagctggcccgcgtccctgttctccgggacctcgtccgcccagttgttgtccacctcgtggtcatcccacaccaccagccaaggcgccacagcgtgcgctgcctgcaggtcggcgtcggacttgtactgcgcgtgccgctggcggtagccctgcagcgtggtggtctccgggccctggtggtcgcgcggattgccgccgccgatcacgtagctgtccatcttgtactcgtacaggtagtcgcccaggtgcagcaccaggtccggctggtcctcggccaggcgcgtgtaggcggtgaagtagccgtgctcgtactgcgagcagctggcgaatgccatggccagcgccgccggcgtctcgtgcggcgcggggctggtgagcgtgcggcccacggcgctgatgtggcggccgctgcggaagcggtagaagtattcgcggccgggcttcaggccctggagctccacgtgcacggagtgggcggtttccatccgggcatgttcgacgccgcgggctactacggtgcgcatgcccgcgtcctcagccacttcccaggccacggggaccgggcgtgcgggcatgccgcccaggccgtcctcggccagggggtccagcgccaggcgcgtccagatcacgaagccgtccggccacggctcgcccgacgctatgccgagcatgaacggatcggtgcggaggccggcgtcgtccgctgttgaaacggcgccggcggcacccggcagggcggcgacgagcccggcacccaggccggcggaaatcagggatctgcgggagatgttgtccatgcgtacgaacctagggacgccggttggacaggtcctgaggggaatgtgaatgcacagtaaactgcgtgacaagagatgtctttttgtccggaatcgctcggctcagtcaccctccccgtaaaaggccctatccagccaaggctgcgaggagcaaaatgacgggatgaaacgactccttacggctggtttcgcggcggcggcgatggtgctaagcgggatcaccctggccacccccggtaccgcagccgaaccgtcccacatcgccgggcagatcatggtcaagttccgggaccacgccgcggcggccgccgtgctgcggggatacggactcagcgacggacctgagatcggcggcaccggcgcccgcctgatcaaggtaccggccgggaaggaactccagctcgttgaagcgctgggccgcaatcctgccgttgactacgcggagccggacgaagtggtcacgcccgcgtcaaatgaccagtactttggccgccagtacgccctgaacaacacaggccagtcattcacgaacaccgccggaacgctgaccgtcggcccgggcaaggcggacgccgacgtggatgcggtcgaagcgtggggcgtcaccaagggccttgacatccgggtggccgtgctcgactccggagttgccagcgacaacccggacatcgcaccgaaggttgtggcacggggcaacttcagtggtgccagtaccggcgaggacaactacggccacggcacacacgtgtccggtaccgttgccgcctccgaaggcaacaccatcggcgttgccggggtatgtccgggttgcagcatcctggacggcaaagtcctcaatgacagcggcgtgggttcgagctcaggccttgcgaacgggatcaactgggcggtcgccaacggggcgaaggtgatcaacatgagcctcggcgtgcgggcgtcacgcaccctcgaaacagccgtcaacaacgcctggaccaacggcgccgttctggtggctgctgccgggaacggcgggaaccagaccaagatctatcctgccgggtatcccaacgtcatcgccgtcgcagccaccgacaacaacgacgccaaggcctccttctccacctacggggcaagctgggtggacatcgccgcccccggcgtcaacgtctactccaccttcccgaaccacaagttctacctgggaacgcagaacaaccgctcgatgggttacgacgtgggcaacggcacctcaatgtccgcaccgattgttgctgccacggccgcactcgcctggagcgtcaaccccgaattggacaacaaggccatccgggagaaggtccaatcaaccgccgaccagatccccggcaccggcacctactgggccaacggccgtgtcaatgcgaacaatgcggtccagccgccgcagccagcaggctgaaagctataaccccgttgcccgcccgcggcggaggtttttcaggtggaggtaggccatcagcaccagcaggggagtgtggatggccggcaggttgtgcgcgaaccacctgggcaggtagatgtccgtgaccgagccggactctgcgccgtaccgcttggccaggccggtgagggggcagcggaacccgtttccggcgaagaccagggtttcggtggtgaccactgctgcggctagtccaacacgtttgtccgtgcgccctgccagcccggtgatgagcagataaacaacgcacgactcaatcgacagccacgccagggtgtggactgctttgatggccacaacggcagcgtggttggtctctgtcccgttgccggcagcctcatgttgccgcagccgggggctccggcggggtgtctcgctcacccctgcaacttcccatatgatccccgggtgcagaagtgccataagtcccgccgtcgcggcccctcatggcaatggccccggcagcagcggaaagctgcggccggggccattggctggcttctgatgcggcaggggtgccgccgaggaacatcttaggcgcgggccttgtgtcccttggtgaggaccagggccagggcaaccatgccaatgcccagcaccaggtgcaggatgttgtcaaagctgttcagcggcacgaagttgccggccgagtcctggggaaccaccaggccgtagacgaacaggaccaggtagatgatgccgccgtagaggaggaaggagcgggcgccgccggccgtcttcgccagggcgatgccggccacgccgaacagcaggtggacgatgttgtgcagggccgagacctggaacaggcccagcagcagggcctcggagtggtggccggcgaagtgcagctggtcgaagttggccgtgatcccgggaacgaagcccaggatgccgaccagcaggaacacggcgcctactgccagtgaagctttctggacgttggtgcgggtagccatcccggtgctggtgtgtgttgccacaatattctccttatgcgatatgcgtttatggattagccggtttatattcctgccagcccaaggggttatgcctgctattcgggcgttatcgcatgtcggatgggttttattgacaaaagaatttgcttcgcgagtgcttagggcgggctgcaccggcaggcgtggcggtcacggccgcgtccccgccgggtccctaggattgcacaccatggcgtacacaccggcaggcagcttcaccacccgccccaccctccagggcacgttcggcatgacggcctccacgcactggctggccacggcctcggcgcaggcggtgctggagcggggcgggaacgcgttcgacgccgccgtggccggtgcgttcgtcctgcatatggtggaaccccacctgaacggcccgggcggggacatgacgggtgtgttcgtcaccgccggcaatccctcggaacctgttgtgctgatggggcaggggcccgccccggccgcggcaacccgggagtattacctggccgaagggctggaactggtgcccggcgccggtgcgctcgccgccgccgtgcccgccgccgtcgacgcctggctgctgctgctccgcgaccacggcacctgggagctggcggacgtgctctccttcgccagtggctacgcccggaacgggcaccccgtcctggaccgcgtgggcagcaccatcgcctccgttgcggggctcttcagggagcactggcccacgtcggccgccctctggatgccggacggcaaagttcccgcagggggagacatcgttaagaacgtggcgtacgcagacgtgcttgagcggcttattgccgccggcacggatgtggcggacgacggcggcacggcagcgccgcggtcagcgcggatcgacgccgcgcggcaggagtggcgcgaggggttcgtggccaaagcggcggttgcgttccttgccacaccgcaccgccactcgtccggcacggaccatgccggcgtgatgacggaagcggacttcgcgggattctcggccggatacgagccggccgccaccctggagttccgcggccacaccatagccaagaccggtccgtgggggcaggggccggcgctgctgcagacgctcgcgatcctggacggcttcgacgacgagtacctggatccctccaccgccctcggcgcgcacaccatcctggaggcgcagaagctggccattgcggaccgtgaggcatattacggcgacgccgcggtgccgctggactacctgctgagcgcggagtacgcggcggagcgccggcagctgatcggggagaaggcctcgcacgccttccggcccggcgaagttcccggccacaagcccttcctcccgccgctgcgcacggagtacctcccgccgtcgctctctgcccgcggggaaggcgccttcgcgggcgtgggcgagccgacggtggcacccaccggggaaacccgcggcgacacctgccacatcgacgtggtggaccagtggggaaacatggtctcagcaaccccgtccggcggctggctgcagtcctcgccggccattcccgagcttggcttctgcctgggatcacgactgcagatgacgtggctggaggacggcgccccgtccaccctggcccccggcaagcggccgcgcaccactctgacgcccacgctggtgctccgggacggcctggcggtggcggccctcgggtcaccgggcggcgaccagcaggaccagtggcagctgctgtacctgctccgcaccatagtgggcgggtatgagccccagcaggccatcgacgcgcctgccttccacaccacatccatcccgggctccttctggccccgcacctggacgccgggcggcgcggttgtcgaggacaggctcggggatgatgtcatcgccgaacttgaggcgcgcggccacattgtgacccgggcgggggactggtccctggggcgcctgtcggcagtggtgcgctgtccggaaacgggtgtgctgaaggctgcagccaacccccggggcgggcagggttacgcggcagggcggtagatccttacggcagcaagcactttggatgcgcgccccggtcaccggacgtcaatcacgcccatcatgccctggtcctcatggtccaggatgtggcagtggtacacggagcggccggtgaaaccggtaaaactgacgcggactttcacctgcccgttcgcggggatgttgaccacgtcccgccacgtaaccgagtccgtggcggtccctgcctcctcgaccacctgcatcggccagacatgcagatggaaggggtggtccatggggctgggattgagcagcgtccactcttccaccgtccccgcagccacaacagtgttcgtccggtccggatcgaaagtccgcccgttgatggtgaattccatcattcccatgcccatccccctacccattcctgtggcgagggtcagttgcctgcgggctgccaccaccgccgtccgcaggtcctccggtgccggccgggcggacgtcggcggcgctggcggcgcggtggccgggtttccggacaccgagaacgtagcgagcaccaggtccccggcgcctccggcatcgcccctgcgggctgccggtcccatcatgcctgccatgcttccccggttgtaataggtggacctgagggcggacacaccctcgccggccgtgaccaggacatcggcgcggttgcccggcgccagcagcaattcgtccaccatctgcggtgcggggagacgtgcaaggtcaatgcccagcagttcccactgctttccctccagccgcagccgcagatagcgggcaacgcaggtgttcacgatccgccaccgctcgcgctcgcctggccgtgcggaaagctccgggttgctgtggccgttcaccaggaccagctggccttcgcgcccgagcatccggtccatcggcgtggcctccgccagggcgcctgttccgtccagggtgaggtctgaaattaccaggatgcgttcccggctgacagctggcgcgtcctcttcgtcgacgatgatggcgccgaacaggccggctgaaacctggtctgccaccatgccgtgatggtgggggtggtaccagtacgttccgggcgggtggtccgcggagaggcggtgctcatagctgaacgactggcccggccggaccgtcacaaaaacgttgtcgccatttccctggggcgacacatggaggccgtggacgtgcaggttggtggggacccccaggttgttgaccagctcgatctggagtgtgtctccgcctcgcacccgcagtgtggggccggggacgcttccgttgtagcccaggatggttgcctgcaggccgccgagcggcaccgacaccggagaggcctccagccggactttcagttgtccatcaatgctgcgcagcacctccggctcggtgaacccaccgccggcctcgggggagaagcgggacgtggccgtccaccagagcccggctccgccggccaccgtggccgccgcgcccaggcctcccagcagcagtgcccgccgccggctgatggcacgcatcagtggtcctcgccgaggaccctcagccgcgcgcggtattcctcctccgcgatttcaccccgggcaaagcgttcatcgaggatctgctgcgcccgggtccggccggcatcaggtcctagccgtccccgcggttcaggatgacgttctgacgtccttccggtgcctgacaatcgcacggcagccagcaccagcaacgcgatcccaacgagcaggaggacgccccagagccacatcatccagcccatgttcgtgccgtaaccccacatcatgactggcgccctttcgcccgtagaccattgatagggcgatactccgccggttactggccggccgccagagtccgaagtcctttcaggtcaatggtcaccgcgcagatcgtccaggatctcctctgtgctggattttagggtgacccggggcagggcgctgggaccggcacggtccgccagctggttcccctccccctgcttccagtgccgtaacagcatctccgccagccgttccggctcgatccggtgcggcgggtcgaagtggtggcgcttggggaagatctccaggtggaaatccgggaagaacaccctggacagccgcgcggcaacctccccgtagtcatccggattgctcaggccgcaaagcgcgaagaagaccggctggcggaacgacgctaactgctccctctccaggttgtagccctggaagtcgcgtatgaacgcccggaggcccgccggccggctggccatccacggcggcgggggatccggcggtggcggcaggacgacgtcgggcttgactcccagcctcatgaaggcgggcaggagctgctccggcgggagggcctccagttccccgtatttcttccagacctcggcgtaggcgctactccagtcccagctcccggcccaggcaggctcaagcagggcaaggctcagcagccgttcaggatgcttcgcggcgaaggccagcgcagcggcaccgccgccggagtatccgaccaggtggaacgtttcccatccaagggcatcagcctcgcgcagcacgccgtcgacctctgtatcaaggctccaaccgggcggaggctcacggtccgcgtaaagctccaggtccttggccacggcctggacatccggtcccagggcttcaaccagagcgccgtacgcttcctgtgcggggaggacagcgccaggaaggaggatggcccgaatcggttccatggaaagaaccctacgccgcggccggacgttggcaagggccaccaggctcagcgtcccgcgacatgctccgcgacgtaccttgcgtcatcgcccaccaacgccagcgtggctgagaggtgcctggtgagccatggcagcccgacggcgtacaggccgggaacgtctgtgacgccgcgggtgtgccgcggatagttccattcatccagcaccggcatgtccagcaggctgaagtccagcccgtacccggtggcccagatgacggaggtgatgttttccgcggccaggtccagccgtgcgccggactccccgggcagccaagggtcgtcggggcgcgcttcggccggcggcgcatctatgcccgctgcctcgatgtaggcgtccaccatcagtttcaggcgctggctgaacccggcctcaaccatggcgaggcgtccggggaggtcgtcgctgaagacgaggacgccgttgtccgttccttcaaagtggccgtgcagccgcaccccgcggcggccgagctcccgcaggtggatactgtgtccgccgtcgttgccggagaggagcgggttgcacatgaaccgggctgcgggggaggggagctgtgccgcctggagtccgttgatgccgtactcggtgccgtgcatgttgacctgcaggatccagtggaagatgtcccggccgcggtagcggcgcggcgcctccgggcaggcggacacggacaagtggaccacgcggccggcgtccagcaggtcctccgtgatctggcccccggactggccggtgcccaccaccaacacggcgccgtccgggagctggcgggggctgcggtagtggtggctgtgcagttgcaggacgttcccggggacttcggccgacgacggcgggacgcgggtgcgctggaacgcgccgttcgccagaaccacgttcgccgcggcgaacgttccgccggaggtttccacgcggaagcggccatctgccgccgcgatgcgggtggcttccgtgcccatctgtaccggggcggcgatccgggttgcgtaatcgcggaaaaggtcgatgacggcgtcgcgggggaggaacgcgtccggatcggggccgtcgtacgtcaggtccggcaggaggaatgagaagttgggcgtgttcaagtggaacgaatgccaccggtcctgccatgcgccgcccagggtatcccgcgcctccaacagcaggtgctccaccccgccctgggcgagccagtaacttgcggccagccccgcctgcccggcgccgatcaccagggtgttgacctcctgcggagctgtcttgcctgtgggtgccggcatctccatgattcttctcccgcggctcggggcggagttggacctgctggcaggatatgcctgccgcgggcctgcgtacaggggccgacggcggtgcccggcccgggtgcctgggcctgggctcggggcctaaaggtggcactggtaaatggtctccgcaatctcctgtacagtagatcctgttgttgtgtttatgcagttcgtagttcaggcagtacgcacggtcgaaagcccgtgttcttctgaagcagcggttttgagcaccccaaacaggaggacccgaaagtcgggacagttcctccaccttcacgaaggacaaaaataatggctactggtaccgtcaaatggtttaacgctgaaaagggcttcggcttcatttcccccgatgactcctcacaggacgttttcgcacactactctgcgatcgcttcctccggcttccgctcactcgaagagaaccagaaggtctccttcgaaaccgagcagggccccaagggtccccaggccgtaaacatccagtccctctaatttcttagagaaactggggccttagggtttcaaagtttgaaaagctgggccggtcactgaccggcccagcttttgtttaacccgctagtgccagcacaccgccaatgcggcggcgccggtaccgggagtgaacatttgtgcaaccgccatgaaccgccagccgggcccggggttgcttagtaattcagtgcgcggccggcaattcgctactgaccagtaacaacacgggctgggcgtgcttggcagtccaggtccccccgtagtggggtctgctgccaaagtggcgcacgtccgtgcacgttacgccgctgccgcgcccggcgtgcctagcataaaaaccgggcccgccgcctggcttccggccctgcacccgctgacacaaaacaaagaggtttccatgtcgctgcttaccagaaccctatccatcgccgcctccgctgtcctggccggatccctggccgtggcacccgcccaggcggacgtcgtcgaaatttcccctccaggcgccaacgactggtcctgcacgcccaccgccgaacacccctacccggtggtcctggtgcccgggaccttcgagagcatggtgaagaactggtccaccctctcgccctacctcaagagccagggctactgcgtgtttgcgctgaactacggcgagacgaacggcgtctacgccacggccccagtcgcggactccgcaaaagaactcggcccgttcgtcgacgcggtgctggctgccaccggagccaagaaggtgaacctggtgggccacagccagggcggcatgatgccccgttactacatgggtttcctgggcggcgccaagaacgtcaaccagctcatcggcatcgcgccctccaaccacggcaccgagggcgtgatcgtcccgccgccggaagtccttggagatcctgatttcacggccctcgggtgtgctgcttgcgccgaccagcaggccggctccgcattcatgcaggagctcaactccattggtgacaccgtggccgggccgacctataccgtcatctccacggtctacgacgaagtggtgattccctacaacagccagttcctggccggcccggcgcggcaggtcaccaacatcaccatccaggacaagtgcccgctggacgtcttcgagcatgaccagacgcccaacgatcccgtggtccaccagatcgtggcccacgctctgggtaggaactcgggacctgcggacccggcgtaccagccccgctgcatctagccttttcgttactcgtccgggcttgggctgcggacgtccttttggccgatgtcggctgcacccagtgctgccgctgcagggccgtgcgtggtgtcgtgctcccggacccggagctccgggtggtgcaggtccagcgccggccgctctgaacggatccggggcagggaggtgaagttgtgccgcggcggcgggcaggacgtggcccattccagcgaggcgccgaagccccacggatcgtccacggtgaccttcttccccgtccgccaggtgatgtagacgttccagaagaacgggagcagggaggcccccaggaggaaggacgacatggtggagaactggttcatccatgtgaagttgtcctccaccaggtagtcggcataccggcggggcatgcccatgacgcccagccagtgttggatcaggaaggtgccgtggaagcccaggaacagcatccagaaatggatctttcccaggcgttcgttgagcatggtgccggtgaatttgggccaccagaagtagaacccggcgaacatggcgaacaccacggtgccgaagaccacgtagtggaagtgggcaaccacgaagtaggtgtcggacacgtggaagtccagcggtggggaggccaggatgatgccggttaggccaccgaagaggaacgtaaccaggaagccgatgctccacagcatgggcgtctcgaaggtcagtgaaccgccccacatggtgccgatccagttgaagaacttcactccggtgggcaccgcgatcagcatggtcatgaacgcgaagaacggcagcagcaccgagccggtgacgtacatgtggtgcgcccagacggtcatggacagtgcggcaatggcaatggttgcgtagaccaggcccttgtatccgaagatcggcttgcggctgaagaccgggaagatctcggagacgatgccgaagaacggcagggcgatgatgtacacctcggggtggccgaagaaccagaacagatgctgccagaggactgcgccgccgttctccggatcgtagatatgggcaccgaagcgccggtccgcaccgagcgcgaacagggctgctgccagcggcgggaaggccatgatcaccaggatcgaggtgaccagggtgttccaggtgaagatcggcatccgccacatggtcagacccggggcgcgcatgcagatgatggtggtgatgaagttgacggcaccaaggatggttccgaagccggacagtgccaggccgaacacccacaggtcaccgccgattcccgggctgaaggtggtatccgagagcggcgcgtacgcgaaccagccgaaggacgcggcgccctgcggggtgatgaagccggagagcgcaatggtggagccgaagaggaagaaccagaaagccagcgcattgagccgcgggaaggccacgtccggagcaccgatctgcagcggcatgatgaagttggcgaacccggcgaaaagcggggtggcgaacatcagcagcatcgcaatgccgtgcatcgtgaagagctggttgtactgctccttggtctgcaggatctgcatgccgggctcgaaaagttcagcccggatgaggagggccatcaccccggccaggcagaagaaggcaaacgacgttatcaggtacatgtacccgatggttttgtggtcagtggtggtgatccagttgaccaccaggctgcctttgcggcgccgcgtgacagccggcgcggcggtggcggcgagcccttccgttgaatgttccgcagtggccatcttccacctcaccgaatcttccgtatggcgtggcaggtccttcatgggccctactttgaaggctactcaggatcaagtcctccgggaaggggtccttttatctgctgagtcgcatcgcttcccgcacggccctcctcttgcttaacgcggcagtgcctgtggcaacgggcccacccggtggcgctccgccaggaacgccgccaacgcgggattgtcgatctacctcgccagccagggaactgcctgggccgcagcgtcgtcacccaggacagcccggtgggactgcccccgcaccacaaattcccgcatcccgcttcggctcgccagctctaccagctgctccacgaacgcggcagcacggggagaccggccggcaatggaaacttccgccgccgcatccagcagccgggcggaataccagaggtaccacggcgtgggttcgaggccccggtctatccagtgctcggcagctgccagatctccgtgcaccatgaagagccgcgcctcggccccggcggccagggccatgtagcaatgatcgccggcaagctccgccatcacccgtgaccggtcaatcagcgccgcagcctcctccagttggccggcggcaaggtacgtctctccccggacgccggcaacaaacggttcaaacccgtccagtgttcctccgcaatccaagcttgcgcccggtccagggagtcagccgcctgctccagttccccgcggagcagccggaccctgcccagcagtgcctcgctgaaggcctgctgccggcggttccgcacggccttcgccaatcttccggactccgtcagcgccctcacagcggccccgtaacgtgcagtgtccgaggccagcatgccctggatggccaggattctcgcctgttcgtcggggaatcccacggccgccagcattgcccggtccagccacccggcagcccggtccggcacacccctctggacggacaggtagcccagctcgcggtaagctgcggcggcagtccgggaggcgccgtcgggcccttccgcctggagcgcgcggtggaggaagtccgccacctcggcaccgcggccgcccgcctgatggatcagggcgccggacagggtgaccaaggactcggcgatcaggtgagcaccgccaatgcgctgtgccagcaccaccgcaagccgcagctggtccagcccccggtccacagcacccgcccacaatgacgcgccgccggcgtcgaggtaggaacgcactgtcgccgcggtggccggcatttccgggtccgtctccggcgcagccccggacagcgcacgccggatttccgcgggcagcggcaaacccagctcctgccggtagagggcgccgcatgcggtgacgtgcctgcgggcccggcggtgctcacccaaagccaccagcgccttgaccaggacagcgttgcagtccgtatggaaggggtcccggtgcagagccagggtggccagctcagcggcctcgcctagagcacccgacgccaaggcagccagcgcggcctcgtacagcagggactggaccacgttgtccagccggaagcgctgatccgccagccaggaatcgaagacggggcaatcagcgaaggacagtccctccagcagctggccagtgaaaccgcgggggtccaggccgggcttggcggccttgcccaccacttcgagtgcgtcgcagcgccacggcggctgaagcaccagccgcaaaggatcgccggccaccgtgacgccgtcaagggtccgccgcagctcggaaaggttccagcgcagggcgccgagcgggtctgcggcatccggaaacaacagcgacgccgtgcgggaccggccggtgcccccggcctgcagcgcaaggtatgccagcaccgcccaggccttgcggcctctgggctgcaggggagttgcgtcgggggactcgaccgcaggcggaccaaggagccgaatcaaattctcggccatacggcccatggtacgccgccggaacaacggcgtctgcggccttcacacgcttgctcacacgcggcccgtacaccctgaaattacccaatccgcacaccatcacaagaggtgcaaaatcatggaactcctcggtatcctgctctttggaatctgggttcttattgtcactgcctgcgttgtcctgaccgacggccggggccacacgcccgagatccgctccacggacccgtggtcggcaggcaatcttcccagtgagccttacgcttcgctgcgcatgtaggttccgccgtcccagccaccgggacgaacgaccgcccctacaccactagggtgctcgccattcgcggtcctggtccgcttgcacggtgctggccagcaccgtctatgcgggccagggccgcctttgtgagccgcctttgtgggaagcccgcccggcacacgactgccaacgggcgcaacggccgggcagtgccagggcgccgagcctaacccaggcccattgcttcccgcacttcatccaggatgtggtgcatcgccgactccgccaccgccgtatccccgcgcgccaccgccgctgccacgtcctcgtgcgcctgcagtgcctcgtcccggggcttgaacggcatgagcccctgccgggtccggctggtcagcacttccgccaccatgccttccagcgcctggaacatctcgtttccgcagctccgcaggagcagctggtggaattcgatatcagcggccaggaagccctggaggtcgccggcttcacccagccgccgcagctcagccccgagggcaaccagttgcgcccgttccgcggcactggcacggcgggcggcgccggcggcggcaatgggttcgacggcgatgcgcagctcggtgaggctgctgtactggagctcgcgccggtctgaggccagacgccagcgcaccagcttcggatcaaagacgttccacagggaccggtcctgcaccacaatgcctacgcgccgccgcgagtagaccaggttcatggattccaggaccttcatggtgtccctggctacggtgcgggatatgccgtactcctgctgcagaccttcaagggtgagcctgctgccgggcggcaggttgccggaggcgatggcaacgccaaccacctccaggacgcgctcgtgcatcgcgggggaggccccgccgtcgtgcgcttcatccgcgccctcatctgtcgccgtcgacattctgtccgcctctcctgcgccgcagcgccctcccagaataccggcaaatttggcaaaggtatgacctgtaacacggaaagatagtatcttttcattcaaaaggtgataccttatggcgtggcccacttcttcacgggctcgcagtgagcttcttcgaaagccaaagacgtcttctccggaggtatgacatgcagtatccccccacgcaccttgtggtcatgggcgttgccgggtccggcaagaccacccttgcggcggccctgtcctcgcagctgggctgggcctgcgccgaagcggacgagttccaccccgaagccaacatcaccaagatgacgcagggtatcccgctccaggacgaggaccgctggccctggctgcaggaaatccgatcctggatgacagcgcaggcgcaggccggctgcagcacagtcctgacgtgttcggccctcaagaagagctaccgccagctcctctccgaagcggagggccgcgtcgttttcctccatctcgacggcggcgcggatctgatcagccagcgcatgcagggccgggaaggccacttcatgccgcccacgctgctgcccagccagctggccaccctcgagccgctcagccaggaagagctcgacgccggcagccttcgcctggacatttcgcagtcacctgaacagctggtcgccgccgtcgtgcaggctttggagcttcccgccggccaggcgccctgcgcgccctgaccaccccctagaccccaacaaatactgtttcaaaggagaaccatgaccatcgaaggatggacccaaacgctgggcgcaggacccctgctgctcatcgcgggagccgcgatcctcgtcctgctgttcctgatcatcaagctgcgcatgcatgccctgatcgccctgatcctcatcagcctcgccactgccttcgccacgggcattcctgccaaccaggtggtcccggtgctgatcaacggcttcggcaccaccctcggaacggtggcactcctggtcggtctgggcgccatgctcggccgcattgtggaaaccagcggcggcgccaaggtgcttgccgactacctcatcggcgtcttcggtgaaaagcgtgccccgtttgcgctgggcctggcctccctgatcttcggcttccccatcttcttcgacgccggcctggtggtcatgctgcccgtcgtcttcgccgtggcccaccgcctgggcgggggagtgctccgctacggcctgcccgcagccggtgcgttctccgtgatgcacatcttcctgccgccacacccgggccctgtctccgcgtccgcgttctttgacgcgaacatcggcctggtcaccgtcgccggccttctcgtcgccatccccacctggtacgtcaccgcctacctcttcggcctctacaccggcaagaagctggtccttcccgtgccggaaatcctcggccacgcctccgccgaagcggaatcacacccgccgcgcttccgcaccgtggtgggcctgctgctcctgccgctgctcctgatcttcatgaacaccggactgaacaccctggcctcctccggcgtcctcgccgaaggcgtcaaggacgagcagtggtaccaggtcctgcggacgctgggtgaaacccccgtggcgctgctgatctcggtgctggtggcccttttcgtgctgggcaccaagcgcggcaaggatgccggggccctcgagaagctgctcgaatcctcgctcggcccggtctgctccgtcatcctgattaccggcgccggcggcatgttcggcggcgtgctgcgcacctctggcatcggccaggcactcgccgacgtcctgggcgacctgggcatcccgctgatcctggccggcttcctgatctccagcatcctgcgcatcgcccagggatccgccaccgttgcactgaccaccaccgcgggcctgatcgccccggctgtagccctggccggactgaacggcatgcaggtggccgccatggtgattgccgtggccgccggctccgtggtggtctcccacgtgaacgactccggcttctggctggtgggccgcttcttcggaatggacgtcaagaccaccctgaagacctggaccgttatggaaaccctcatcggcgtgatgggcttcgctatcgcggccgtgatcttcctggtggccggagtggcgggctagcatccttcccagcaccggctgactggacaacagcggcggggcgggcagcagaaatgctggccgccccgccgtcgtcgtacccggagccgtttggcccagccgccctgagcgatgtggccgggcgaggtggcacggtgctaggtgcgggcgtcgatgtccttctggaccaccgcggccagtgtccgcagcacctgctggtccgacggggagaaggacctgggctgctggtcgatgacgcagagcgttccgatgttccagccccgtggcccgtgcaaggggtagccggcatagaagcggatgtagggcgcgcccgtgaccagcggattggaggcgaagcggtcatcggcaagggtgtcattgatgaccagcatcgcgttccgctccaccgtttccgtgcagagggcgatgatgcggggggtctcctcgcggagcggcccgacggcggacttgaagaactgggcgtcctcggcgatcagggacagcgaagcagcgccaacgccgaagaacttccaggcggcggcaacaacgcggtcgtagacttcctccgggccggtgtacagaaggtccgtctcgtgcagtgatttcaggcgttccgcctctgcccgttccggggaaagcaggcatttgccggcggcacccagggcggcaagcgcgtcttctttgtccggtttctggcgcgccggttgttggcccgccagttgctggcccgccggcgggcgtccggggccgaccctctccggcttcacgggccggaaccgccgctgtcctgccttgagttcctttactgcatcaggcccgcgttcgatcgccggcagggccagggcttcatgaaggtaggcgtccagttcgaacacggaacagggcgacctgccgaagtaggaaggccagagcttctggggatccaaaccgatcgtggcagcgagttcgagccaccgcttcacctctttgtcgattgcgtccacctcccagatgacgcgtttctggggtccgcgtactctgtagttgcaaaagccatgttgataagcttacttagtaatccggcccccggctaccagggaggtttgggggccttcggggtgccgccgccaaattgcggccacgccggccacaggccgccgcaaagccgcaggctgtggccgcgttgcagggctaccttccggcggtacgggtcgtgcttttgggttctttcggcggcatgcccgccacgtgctcataggctttgtggatccatgctttggctcgggcgtcgtcgccgtcgccttcctcgttccagatttccggcaggccggtgtactcgcgcatcggccggtccgccgggccgaacgggacggtccgctcgccgctttcaagctgctgcctgtgctccggggagagtttgatgccgatggtgcgcccgaaaagccctgcgaacatgttgccgttgacgaacgcgcccaggttgccgaacatcggcttcactgtgacgtccgggccgtccgggagcagggaccggaagcgctccttatctgcgtccgacgctttgggcatctccattgcttccccctgggctgtgctggctggttgcggtgccggctggtctgtgcaggatatgcccagcgcggtcgccggggaacaccctgccgcccgccgtcgttgtgccggtaggcagcgcgcccacgccgggcgccggacgttccccaaccaaaggacaccccttgacccctcgcaccatcgttatcaccggcgccagcgacggcatcggcgcagcagccgcgcgtaccctggctaaggcaggggaccaggtggtcgtcgtcggccgctccgaggaaaagacgcgggccatcgccaaggacctggacgcagactactttgtcagcgacttctccgagctcgcgcaggtccgcaccctggccgcgcagctggagtccgactacccgcgcatcgacgtccttgccaacaatgccggcggcatcatgggcaagcgcacccttaccgttgacggcaacgagtcaacgttccagatcaaccacctggcgccgttcctcctcaccacgctgctgattgagaccctcgttgccagcaatgccaaggtgatcaacacctccagcggagccaacagcttcggcaagctggacctgttcgacctcaaatccgagcacggctactccaccaaccgcgcctacggcaccggcaagctggccaacatcctcttcacgtccgagctgcaccgccgctttggcgaacagggaatcacgacggcggcgttccaccccggcgttgtgcgcaccaacttcgcggcggactccaccagcccgttccggcacgcgtacaagagcctgctgaaccgcttcatgctgaccccggaccagggtgccgacaccctgctgtggttgatcaacggcactgcgggcaaggactggatctccggggcgtactactacaagcgcgccctggccaaagccaacccccaggcctacgacgccgagctggcccgccgcctgtgggagcagagcgaggagctggtcaaggccgcctaggttctagccctcgtagccgatgacgtcacggagctgctgggggatgcaaactgggtagcgctaagtgtcgttatgagccgtcaaaacgacacttagcgctacctagttgggccgggggcgcgcctgctcgacgtcggccgaggcctccgactgaccacgcgcaaccaggcccgccaccacgccgtccacgtccgcttcgggccggttctggctcagcttggccttggcctcgatccgggtaatcaccagttccacgcccacgattgcccgcagctgcccggcaatgaaacgctccggtgcgtcgtccacgtcccaggggtggtcgaagccggactcgtgcatgccggtgagccgccggacctgccggtccagccaggccggatcatcatggatcaccagctgcccgtacacgtgcaccgtggtgtagttccaggtggggacaacgcgcccgtgctcggccttggacgcgtaccaagacggggagatataggcatccgcactctggatgatggcaagagcctccccgacggcgggtgcggaccactgcgtgttgttccgcgccaggtgcccctgcagcgcgccgaactccccggcgtcggggtcatagacaaacggcaggagtgtagccacgaggccctccggggtcatggtgaccaggttcgctgcacccggtctggtgagcaggtgccggacggtttcagggaccgcggcgaagtgcgctggaatgtacatggggctagtcctttactgtctgaagtggcgcggaatcgagttcgggtgacgaggccggggcgggcctgagccgtacccggacagccgccgcggcgcacaggatgacggccagcccgcccaggactgtggaccaggccagggcctcacccagcaggagcgccgcccagcagatggtgagtacgggctgggtaagctggatctggctgacccgggcaatgggaccgatggccaggccgcggtaccaggcgaaaaatcccaggaacatgctcaccaccgcgaggtacccgaaggctgcccactgcgcgggagtcgctgacggcggctgctggatggcggaggcggcggccaggaccagcatcagcggcgaagcgagaaccagcgcccacgagatggtctgccaggaacccagttcgcgcgccagcaagccgccttccgcatagccgagcgcggcggccaccacggaacccaggagcagcaggtccgcccagtgcaggacgccaaggccgccggactggacggaagcgaagacggtcaccgcaagggcacccacaccgctggcgagccagaatgccagtggcgggcgttcccgcccgcggatgacggcagcggtggccgtcgcggcagggagcagggcgatgacaacggcgccgtggcttgcggcggtgctggtcaaggcaaaggaggtgagtagcggaaagccaatgacgacgccggccgccacgacggccacacggaaccattgcgtgccgcgggggaggacctgccgggtgagtgccaatgcggcagccgccagaacagctgccactactgcccggcccgacccgataaagagcggcgccaggcctgcgaccgccactttggtgaacgggacggtgagcgagaatgccgcgactccaaggaagccgagccacaacccggctgagctggagtgggataacgctgggtgcgttcgaagagtagcgctactattgtctctcatgaacaacgatagcagctcgcggattgtggcgcacctgaaatcatggatggcaactgcggcgccgggagcgaaactgccctccacgcggtccctggtggccgactatcaggcaagtcccgtcacggtgcagaaggccctgcagaccctcacggcgcaggggctcatcgaaagccggccgggcgtcgggaccttcgtgcgggcagtccgcatggcacgcccgtcagattacggctggcagacagctgcccttcgctcaccgctggcggcactgccaccggcctcctccaccatgcgggaggtgccgcaggacgctatctccttccactcgggctaccctgccagggagctcctgcccgagcggctggtccgggcagcactcacccgagccgcccgcggagacgcggcgctgtcgcggcctcccgccgcgggaatgccggagctgcaatcgtggttcgcgcacgagctcgccgcgtccacgcccgctggaattaccccgcccaacccaagcgacgtcgtcgtactccctggcagccagagcgggctgagctccatcttcagtgccctggtgggcagggggcagccgctgctgatggagtcaccctcctactggggcgccatcttggccgccgcccaggcgggggtgcgggtggtgccggtgcccagcggaccggacgggccggaaccgggggagctggcccgcgcgttcgacgaatcaggcgcccgggtcttctacgcacagcccaactacgccaaccccacgggcgcgcagtggtctggggagacccgcgaccaggtccttgacgtgatccgtgccaagggagcgttccttgtggaggacgactgggcgcacgactttggcatcagctccaaccccgtgccggtcgcctcccgcgacgactccgggcatgtcgtgtacctgcgctcgctgaccaagagcgtttccacgtccatccgggtggccgcactgattgcgcgcggtccggcgcgggagcgcatcctcgctgacagggcagcggaatcaatgtacgtcagcgggcttctgcaggcggcagcgctcgacgtcgtcacgcagccagggtggcagacgcacctccgcagcctgcggcaccagctggagtcacgccgggacctgctggtcaccagcgtccgggaacatattccccaggcgcacattgaacaggtgccaaaaggcggacttaacctgtggctgcgcctgcccgacgcgacggacctgcaacggctggtccgggactgcgaaaacgccggcgtcatcatcgcccgcggggacgaatggtttccagcggaaccggcgggtccgtttatccggctcaacttttcgggcacgaatccgggcgccttcccggaaggcacccggatcattgggcagatgctggagcggaacctgggctagcagtcagtcggccagttctgcacagatgtcagttactgtgccactcccggagaacatgcctccgacttcccttcccttggcgtcgagcgtccagctgacggtgccggtagtgaagtagacccccacaggatggtcattcgccctagggacagtgatgaggttgggcccggtggctgtgacgaactggctcccatcgtccaggtattggatgtgggtcacgccggcagcgccgttgtaggtgacggattcccctgacctgtctgagacagtgacgctcaatccgggccagatgatcttttcgcggtcgccgggcagtgcgatgactcccaccttgccgtcagcggtgagcaccaccttgaaacctggacaggacagcgtgaacgatcccttgatcggaccgggcacggccgtggcaacagccgactgcgccggcgcaaccaaggctgctgcagccagggctgccggggccagtgtgcgcgcaattgtggatttcatcggatcttcctttcagatgtactcggtgtgagtggctcaagagtggccccgggggcttaatggagccttaatccaacggctaactctggatccggcactggcccgggagcatgatgggggtgatgtcgctcctcggggcgcgttaggacagggcgggcgctaggggccgctggtcgataaacgccgtgggaatgggcagagcccgctcccgtggccggtcagtgaggggtgctcaccgatgagcgcactgtggatcagggccttgggcccattacaggtgattgctgacggtgtcccggttccagtcagcagccacaacctgcgtattgtcctcgaatgcctggcgctgcgggcgaactcggtagtagcaaaagacttcctggctgaagtcatctgggacggccacccgcccgcgcatccgggcccgcagctgcaagtctatgtcgcgaacctgcggaacctgcttgagcccaaccgccgaaagggggttgcctcgcaccgcctggccagcaggccgggcggctacctcctggctgttgccgatgacgaactcgacctgctgcagttccgcgcgcaccttgccgccggcgagcgcgcagtagaagcgggcgaacttgccagcggcgcggtccgcctgcgccaggcactggacttgttcgtctgccctgcctttccggacctggccgacattgagcttctggtacctgacctcgaagaggtggaggaagcccggctggacacgtaccaggacctcttcgatgttgaactggcactgggccgccacgccaacgtggtgggggagttgcagcggctggtattgcagcatcccttccgggaacgtttgtgggcgtccctggtgctcgccctgtaccgctccgaccggcaggcagatgccctcgccgcatgccgtgcagcccggaagacctttgcggcggagctgggcattgatcccggggtgcgcctgcaggagctggaagcactggtgctgcgccaggatgcctcccttgggccgcccgccgtgaacgaaaaccgccgcgccaggcagcgtctcgacaacctgcctgccgcgctcacccccctggttggccgggatgctgaactggcggaggtatgttcgctctaccgctccgagggatgccggcttgttaccctcacaggggcgggcggggcaggcaagacccgcctcgcgatggcggcggccgcacgtttgggtgagcgcatgcccgacggcgcgggctgggttaatctgtccccgctcaccaaggttgagcaggtgcccggcgccattacggcggcactcgggctggaggcgccagcaggcgaagacccgctgaagatcgcgtcccgctttctgcaagcccgccgactgctgctggtcatggacaacttcgagcacctggcagacgcctggcccgtggtgctggacctgctcactgcagcccctgagctccgaatcctcaccactagccggagacggctggggttgcgtcccgagtacgaatttgaacttgcgccgctggagttgccaccgctcgacccgcccctgcctccccgccagctgcgggaggtgccggcaatgaagctgctcttgaaccggggccggacggtccgccccagcttttccgtagaccacggaaacgccgccgtactaacacgcctgtgccatcgcctggacgggttgccgttggccattgaactggccgcggcccagctccgacatcttagcgagcacgatctcctcgctgacctggaagccagcctggccgcgctgccggccgccttccgtgaccttcccgaccggcagcgcactctcacggccacgatggagtggagctaccagctgctggcggacccggaacggctgctcttcgtccaactcggtgttttcgtcaacgatccgaccacggcagcgatcgacgctgtgcgcggctcccttctccctggcgagccctccaccgaagaattgctgtccacgctcgccggccacagcctgctccggtgctacaccgaccaggcagggcgcaagagagtgtccctgctccagtccatccgcgagtttgcccgtgaccgcctggcgctgcttcctgagcaacacgaggtgcgccagcggcatgccgggcactatgttgccttggccgagtcattgggtccgcaactgtggggtggtggccaggtggatgcgtttctgacgcttcacgccgaagccctcgacctccgcgcagcactgctgtggggagcagggccggatggttctatggaactggcacttcgcctggtgggtgagctctggcattactgggaactcaccggagacgttaccgagcagcagcgaattgccgttgaactcgtggaggcaacaccggatgcggtgccgcagcttagagcaccagcgcttagcggagcagccactctgacatgggccctgggcaggtatgaccaggcggcccacctccaccgccgcgcccttgaagcgtttgaaaaggccggcaatagccagggcgtagcgtggaccatcctgtgtctggccgtgcaggcagcacaaagtggggatttccctactgccgagcggctcacagcggaggccttgtcctatccgggcgtcagccttcgggtcagaattggggcgctggttgtcctgtcccgccaggcttactgtgcgggggaccatctgcgggcactcgaactgtgcagggcgtgcgcggagctgacccgccggctgggggaccggtggctcctgggcattgtgctcaccaatcttgcagagagcaccgaacaggccggcgattacgacggtgccgagctcctgctcatcgaagctgtcagtgcctcactccagctcggggcggagggcaacctggctgcttaccttgactcattggcgggcgtctacgcgtcacaaaaccgctatgactttgccctccgcctcctctccgcggcggactcctaccgaacagaccgcggtatatcgctggatcagacagaacgatggcgggttgatgccattatcgacaaagcccgggctgaagccggtcccatccgctttggccttgcctgggcaggtggacgtaggctcaccgttcggcaggcagcaaacgaggtgctccagggcgggcgccatcggggactcttcggcaccttcgggggttcagcccgatcagcttctcccgccgtggaaagcgcagctgactcggccccctggacgacactcgcggcgacgcccgcctcaagccgtcgcgcccgtcgtaacagcgtgcaatataaacatgaccccatgtatttaatgactaaaaattcggtggccgtgctactttcaacactgccgccgcgcatttcttcgttgccagggaccggaaccaggggactgcgcgcgctcccattgcagagtccgacccttggagacgcccgtggaacccacaacagacgtgaagctggatgcccagccggccaggccccctgcagccgactccggactccgccgctccatgggcccgcgccacctggtgatgatcgccatgggcggcgtgatcggctccggcctgttccttagctccggctacaccatctcccaggccggcccgctcggcgcggtcatcgcgtacctcatcggcgccttcgtggtgtacctggtgatggcctgcctgggcgagcttgccatcgcctacccggtgtccggtgcattccacatctacgccgcccgctccatcggccccgccacgggattcgccaccgcctggctgtactggctctgctgggccgtggccatcggctccgagttcaccgcctccggcctgctcatgcagcgctggttcccggacgtggaggtctgggtctggtgcctaatcttcgcggccgtcctcttcggcttcaacgccgtgtcctccaagtttttcggcgagtccgagttctggttcgccatcgtgaaggtcgccgcgatcatcggcctgatcgtcctgggcggcgcggccctgttcggcttccggccgctcggcggcggtggcgagcaccccttcctgttcgagaacttcgccaccgagggcgggctgttccccaacggcttcaccggcgtcctggtcaccgtgctcgcggtcttctacgccttctccggctcggaacttatcggcgttgccgccggcgaaaccaaagacccggccaccagcatccccaaggccctgcgcaccaccgtgctccgcctgctcatcttcttcgtcggggccatcgccgtcatcgccgcaaccatcccgtacaacgaggtgggcctggacgagagcccgttcgtgacggtcttctcagcaaccggcctcccgttcgccgccgacatcatgaacttcgtcatcatcaccgcactgctctccgccggcaacagcggcctgttctcctgcgcccgcatgctctactccctggccgacgaaggccacgccccccgcgctttcaaaaagctgacgcgccgcggcattcccctcatcgcgctctcggtgagcatggtgggcggcgtcgcatcgctgatcagcagcgtggtggcccctgaaaccgtctacctggtgctggtgtccgtggccggcttcgccgtagtgggcgtctggatgtccatcaccgcctcgcacttcttccaccgccgcgcgttcgtccgcaacggcggcgacgtctccaccctcgcctacaaggccccgctgttcccgctggtgcccattctggcgttctcgctgtgcgtcatctcgctggtcggcatcgccctggaccccacccaggccgccgcgctctacttcggcattccctttgtggccgcctgctacgcctggttccacttccgctacggccgcaaggccgtgacagccaagtaattaggaagcaaggagcggacgacggcggctgccgggcaggtgcgtcgcgcaccttcccggacggtcgccgtcgttctttccggcatggtgcgtgacccgcccaaggagggcgcggcccatggaacaatggggcgtggtgaccggccgggaggggcagataagcgtggattcgtccgctgaggcgtcgtcaatggcgcaggggctccggattgtccggctggtggctgacagggagaagctgggacgccaactgctgggcgtttcgcagctggccgccgaactggacatggagcagagccgcgtctcccgcctggcgcaggaactgtgcgatctcggattgctggagcgcgtggaccgcgggccgttccggacgggtccgcgcttcttcagcctggccgcggcactgaacaccggctgggtccggaaggcaaaaaccgaacttgaggcgctggtcgcggcgctgggactgcgcgcccggctctctgtccgggacggctaccgcgtgatcctgctccgggcctccagcaatgacgccgtccccggcagcttcgtcaagccgggcatggtgactccggcctggtgtaccggcgccggccgggcgctgctgtgggaccttgaccggccggcactggatgccctgctgcaggacgtgaactacatcggcatcggggggccgggggccgcccattccaccgatggggtctgggacctcatggtccgcgaccgtggcgccgggttcatcaccgcagccgaggaattcgaacacgacgtgctggaactcgccgttcctgtccgcgacgccggcggcgccatccttgcctcgctgagtgtgctgggcagccgtgccgggatgggtcaggatgcggcagctgaggcggctgtgctcaccagcgccgcggaacggctcggatccagcgcgggtgtccgctagggttgcggccggtacccgagcttctgttcgagccacgctccctgggccacgagtgcgtccgcgcacgcttcccggcgcggttccaggcggtccctgattcccacgatctgcagcgcggccaccacgtcgcccttgaaatcccggacggggacggccagtgaatagaggcccggctcggcctcctcatccacgatcgagtaaccccggttccgggcagcttcacgccgcgccaggaaatcgtccacgtcgtcaggcgtgttggggccgtgccgcacaaaggccacatccgcgaagacggtccggacttccgcttccgacgcctcccacagcacggcctgcccggcgtcgctgcagtacgcggggtagggccgccccagccaggaacccaccaggttgctgctggccgggacactttcgccgatggtcaccgtgctgtccccgtgaaggacgcccaggaaacatgcctcgtccgtttcttccgccagcgtgtacaaggcggtgccgccgtcggactgtaaacggcgctcggtgagcagctgcgcgtcagtaaggacggaccagtccaggctgtaagtgcgctggctcgttttgcggaggaagccgtcctgttcagcgctgcggaggctgcgcgaaacctggctgcggtccttgccaagatcggcggcgatgtccgccaccgtgcccccgggatgtcccgcggcatggcgtgcacccacagcaaggagggccatgattccgcggcccatgctggaggtttttggcatggtgtcgagtctagtggaggggctttccccggccggctttccggggtgtttcaccgcgtgcgcgtccgagtcgccggaacagtgccgtgactccggaacgttccggcgaccgtgcacgtttccggcgacttcggtgcaggcccgcagcctcggctggggcagcagggggcgggggcacctgccctcgggctcagcagatggcaaacacccgcgccgggaaaccgctgccgcccaggggctttggccaggaggcgacgacggcggcacccgattccggcagtccgtccaggttggccatcagttcgatttgccagcggccctgttccaggacatacgtttccaggctgaagtcctgccgggaggttgccaggcccgggtccgtgtccgtctgctcgtggccgacggcggccacggcacgctgctcaaccaggaaggagagcacttcccgggaccagccgggcgtgtggctcaggccctcgctgtcccggttggccattgcctccgggctgggccaccggcggctccatccggtacggagggcaacaaaggaacccggcgggacggtgccgttctggttttcccagtcgtatacgtcctgcagggtgggggtggcgtccgggttaccggccacccgctggctgatgtccaggaccaccagcggaaggatcatctcctccaccggaatctggtccagcgtccggccgccgcgaatgaaatgcgagggcggatccacgtgggttccccactggcccacaattgtgtagcggtgggcggtgaagccgtcacccttgtccaggttgaagagggcttcgcgctgctcatccggaaaagcggggaagtggggctggcccggatggaaggcgtgcgtcaggtccacgaactgccggccggcgatcacagactgcaggccctcccagagcgacgcggtgctggcgtccgtcatcatgcggcggctccttctgccatcggtgcttctgcctttggtgcttctgtcaccggtgccagtgcggtgctggagacgctgatggggccggtcacttcaatgaccgggacttcccaagggtggatgtccacgaggcggcgcataaaacgctcgacggcggcgtcctccagtgaggcgtcgaaataggtggtgaaaacgaaggttggcgagagggtctgctcacccactcgccccagggtggggttggcgccctcggcagtggtgaacccctcgaaaccgaggctggactcaaacacgtgcttatagttgccgaagtcgccgagttcccggaattcggccagggcctgcagcaggtgcgcgattcccggatcatcttggaaggcgtccggctcgcccttggacagttgcccgaaggtggtgccgctgatgggccagtgcacgcgcagtttgcgtaccgggtgaagttgaacgtccaagaaccttgcctctttcctccgccgggtgacggctgtcagccatcgtggcagaaagaaataatcattacaagcatatgtaaatgcgtattatgactactatgccttcgacctcgcagctctcgtccttgctggaatccggcgaacacctcgtgaccgacggcgccctggccacggaactcgaggcccggggctgcaacctcgacgatcccctgtggtctgccaaggtcctgctggaaggcccgcacctgatcagggacgtccaccgcgactacttctccgccggggcccggattgccaccaccgccagctaccaggccacgccgcagggcttcgcacggcggggcatgagcgggcaggaggccctggagctggtggcgttgtcggtccggctggcggatgaggcccgccgcggccacctggctgccaccccgggcgcgggctcgctgctcatcgccgggtcggttggtccttatggcgcctacctggcagacggctccgaataccgcggcgactacacgctagggcaagaggagttcatggacttccaccggccccgggtggccgcgctcgttgatgcgggtgtggacttcctggcctgcgagacgctcccgtcgtttgccgaagccgaggcgctggcggcactcacggaagagttcggcgtcgaatcctggttctccttctccctgcgggacggcgctaatatcagcgacggcaccccgctcacggcagtggctgggctccttgacgcccaccccctggtggccgcggtcggcgtgaactgcgtgccgctgcacctggtcactcgagcgctcgccgccctccacagcgccacggacaaaccgctggtggcctaccccaactcaggcgaaacgtacgatccggtcaccaaaacgtggggtccgtccacagccttggcacagggcaggtacgccgagccagcagaccccgccggcggggccgccgcctggctggagcacggcgcccgcatcattggcggatgctgccgcacgacgccaggcgacatcgccgccgtcgggaaggccattgccgcgcagcgctgaaccaccgcgcaccgctgattctgaaggttctgggctgcccttgaactcagccgccgttttccgtgtccttttggttggtggcctcgtccggggtgtcctgttcctccgcgtgttcagccttctcccgggcttcctgctggtgctgctccagtttcgcttcggcgtccctgcgccgatacccgatggatcgggcctgctccggggtgggatgccggtgctcccgctcccaggcgtggtcattgacgccggtgccgggcacggcctcctcattaggatcagtaatgtcttcacccatatccaaaccctgtcacagtcgggggacggagagaagggccctacgccccaagccgaccgtaggtggtgatcacgttgcccttgctggtccgggactggtcaaggagtaccagccgggtggtggggtcgccgtcctggaagaggcgccggccgctccctgccaccaccggatgggtcatgagcgtcagggaatccagcaggccggcgaacagcagctgccgaaccaccgagatgctgccgcacactgcgatttcgccgccgtcgcgctcctttagagctgctacgaactcctccagcggcgcgtccatcaggcgtgagttttgccactcgagcggttccgccagggtccgcgaggccacaaacttctccaccgggttgatgaaggcggcaaagtcctcgtccacgggcgcggtgggccagtacgcggcccactcctggtagctgacccggcccagcaccaccgtgtccactgtttccatcatggtggtcaggccggctcccagttcgtcgtcaaagctgtcgaactggaacttatagggatcggacaccacgccgtccacggagtggaacaggccggcagtgactttgcgcatggggacctcctgcagggcatttcgaacggacacgcctcacgctagtgcgccccttgagccagcggaagatccctgcaaaagcggacgacggcggccacccccccagttacgttcatcactcgccgaggcgtcttgcacggtttggctgatcctgagccccatacttgtggtgagcggctgttgccgtgccccggccaggcaggaggaaagtgcatggacaccctgaaaaagatcgtgagcaaccagtattttccggccgctgcagtccttaccgccgtgctgctgttctgggccgtgggactcttgggcgggctgtccctcctgcacaacaaccagcccccgctgaccaccctgacctggatgctgtttgtctacacggcggcggtcctcaccccgctggccggcatcctggccgcggccgacctgctccgccgctggcgccgcaaccgcgacgccgacatggcctacgccgggcacacagaagaccagtattccgtggcccagcaggtagtggaagcagaaccaggggaagcgcagacggtggcccagcaggtagtgccggagcatgcagacgaagaaccggcagtccagcacgcagcgccgcccgcacccaaggcatcccggccgaagaaaaccccgaagcaggcaggacgcaagcaggccgcttagccggcctcccgccgtcgtgcgccctaccgttccttcagcgcggtgagggcttcctccgcctgctgcagtgcgttttccagccgccggcccggctgcggcagcgagaacaggtatccctgcagcgaatcgcactccagggccgccaggtaatccgcctgcgccgccgtttccacaccttccgccgtgacggtcaaacccaggctgtgggccatgttgatcatggagctgaggatgggcagccgctcggttccggtgcgcaccatggagatgaacgtcttgtcgatcttcaccgtgtccaccggcaggtcctgcaacctgcccagcgaggagtagccggtgccgaaatcgtccagggcaaccctggctccctcatcccggagcgtgctgagctgtttgatgaggctgcagtcggcgtcgaaaaacacgctttcggtgacctccaggaccagctggtaggcggcgacgccgctggcctccgcaagccggaggaccgtttgggcgaacatgggatcctgcagctggacccctgaaacgttcacggcaagcgaccgggatggatcctcgctcagccatggtgccagctgcaccatgcccagcgccatcacttcagcgccgatctcgttgatcagccccgagcgttcggccagcgggatgaagaccgacggcgggacgcgcccgccgtccctgtcccaccgggccagcgcctcgaacgtgaccacttggcccatgcggtgggaaacgatcggctggaaatcgacagtgatctcgccccgggccacggccagctgcaggccggcttccatatgggtccgctgcaccagggccgtcatcatgtccggatggaaccgcaggaagcggttcttgccggcggcctttgccgcgtacatcgagatgtccgcctgccggagcagctctgaggcgcccacgctgtcccggcccagggacgcgagtcccaggctgaggctgggccgcaggaccgtgccctggatagtaacggggacgtgcaggcaccggacgatgcattcggcgatcgtatccgcgtccggacaggcggtcaggagcaccacaaactcgtctccgcccagccgggccactacgtcggcagtgggggcgcagccacggagcctccgggccacttcaaccagcatgtcatcgccggcctggtggccaaggatgtcgttgacttccttgaagtcgtccaggtccaggagcaggacgtcaacggccttgagccgcggttcctgcaaggcattagccagcgcgtcattgaacacggcccggttggacagtcccgtcagggggtcctggaacgccatcgcccgcagtttctccgcctgcgccgccaggtccaacatggcttggtgggcctgctcctgggcctggcgccgcggcgtgacgtcccggaaactccatacccggccaacgatgttctcgcccacccgctgcggccgcgaatagcgctcaaaggtgcgcccgtccgcgaagtccaggacgtcgtggctttccgctgccgggtcttcctccagggcgctgatcctcgccaggaagcccgcgggatccgaaacctgggcgatgatgagctgcatgatgggctcttcggtgtcaccctccaggagcgccggggggataccccacatggtgaggaactggtcattgaaaccggccaccctgccctcagagctcatcaccaggatgccgtccgctgtcgattcaagtgtggcggtcagcagggacatcgcttcccgcaggtcggcatccgcggcctggcggtgggaagtaccccggaccgagagcagcagcagcggatgcgcggggccgccgtcgccgcttcccggcttcccgtccggagcttgccaagttccctcagcctttggaggtgcaggaacctccggagctgccgaaaggaaagccgctgccgcttcccacggcaataatgatcccgttgcctcggcggggaattccgttccggtgctgtgcagcccgtagatttcccgcggcggcggatggtccccgggcagggcgcggagccgggcgaaaagctggtccgcttcgctgcggaagccttcagcgaggagtgagcggtggtcccgcccggtgaggtcaccggccgcatagccgaacagccgcccggctgcggcgttggccagggctatcctgccgtccgcggctatcgccagcagcgcgtccgggctggcatcgagaacggtcccgaaagtttgtgctgccgtacttatgctgtggttccaggaatcagtcaagccaccacccccctcggacatcataaagcgcaggagcccaaatgtgaccagctgccgggaaccggttccgaatggactgctgcgggcctgttggccgtccttgcagtaccaaagcaaaagcgctgcccccgcatggaggacagcgctttttgggttgtatgactaaagggaccgctatgcccggcgggagctgcggttagtgaccgcgccataaatgagcagcacgatgattgaaccaagaattgccagcagccaggtgcggatatcgaagaattcggccaggccgccgccgaagatcagcgaaccgatccagccgcccaggagggcaccgacaacgccgaggaccagggtgaccacccagcctccgccttggcggccgggcaggatagcctttgcaatggctccggcgatcaggcccaaaatgagaaatccgagaatgcccatgttgtcactccttgtcagtaagatgtgccgggcccccatttccggttccataattcaatcagcgggcttactgctctgcaagagtttgattatcacgggatgactgtcagttttcccggctggaatacactactttcgctaattggcggtaaatccgcccgggcagccgggatgggcttcgataggattgactgtccccgcaacaaaccaaggagctttggcatgtgcagccagcagaccgtccggccacgtgccatcttcctcgacatcgacggcacctacgcggaccacggactggcgcctgccgcgcacgtcgacgcggtccggacagcacgccggctgggacacctggttttcgtctgcaccgggcggccgctgtccatggtcccaacccacatcctggaagccggcttcgacggcagcatcaccggcgccggcgcccgggtggagctcgggggagaagtcctgaaggacacccgcttcgatccggacctggcagccctcatcgtggaaacactggacgcacatgatgccgcctacatcctggaagcacctgaggcgctgcacggccggacaggtgtggaccagaggctgcgggaagtgctgggccccatcttcgccgggcgcccgcagcatgacggggtcctcagcaccgatgttgatcccctggaggacatcctggggcccatgcagtacagcgaggacctccgctccacgtcctacgccaaaatatcctgcttcgattccccggtgccgctgaagcaactggtggacgggctcgggccgcaggtgggcctgatccccagttccctctccgccctgggcgaccgcgccggcgagattttcatggccggaacacacaaggccgtgggcatccaggtggtggaggagcacctgggccttgaccgtgcggacatcgtggccatcggggacagcgccaacgacatcgagatgctggagtacgcaggcgtaggcatcgccgtggaaggcgggcaccctgcggtgctggcagtcgcggaccggaccacacccgggccggccggcaacggcgtggcactcgcctttgaacagctcggcctgctgggctgaccggcttcctggcgtgggacgtcaggaaggaagcggagctggtgcctgcacggcagggtgtgcagcagtgctgccggtgcccagaccgcgcaccgaccagcccgaggcctgccaggcagcggcgtccagcacgttgcgcgcgtccagcaccacccgccgtcgtacccgtgccccggcagcggcgggacagaggcggcggtactcatcccattcggtgagcagcagcaccagctcggcgccctcgagcgcccgctccgttgacgcttcgaaccgcaggcgcggatagcgccgccaagcgtggttgaccgctttgggatccgtgacggtcacgtgcgccccggccgcggcaaggcgatcggctacgtccaacgcgggggagtcccggatgtcgtcggtgtccggcttgaaggatgcacccaggaccgtgatggagcggccggcaacgctgccgccggtaaggtccgcggccagggcaacggtccgttcacgttggcccaggttgaccgaatccaccagccgcatccagtcgtcaagggccgtgacccctgcccggttggcctgtgtccggaagctgcggatgtccttggggaggcagccgccgccgaagcccaggccggcgtgcaggtaccgcccgccgatgcgcgggtccatgcccatggcctcggccagctccgccacgtccgctcccgacgcatcgcacagcccggccaccgcgttgatgaagctcactttggtggcaaggtaggcgttcgccgccgacttgatgagctccgccgtggcgaagttgcagaccaggcggggaatgccggcacggagaagcggttcgtagacggcgtccaacgccgcggtgacaccgagcggcgcgcccgtgcggggatggaacgcggctccacgcccgccgtccacgccgtacaccagccggtccggcaccagcgagtccttcactgcggtcccctggcggaggaactccgggttccaccccagcaacacgtccggccggcgggccaggacaccgcgcagcatctccaccgtgcccacgggcaccgtggattttcctacgacgacggcgcccgcggccaggtgcggcagcagcgtttcgatggcggagaccaggaaggtgaggtcggcggcgtcggacgttttgtcctgcggggtgcccacgcacaggaagtggacctgcgcgcccttcgcgccggcggcgtccgtggtgaaggtgagacggccggtgctccggccgtcccgcaggagttcgtccaggccgggttcgtggaacggggcggtgccgcgtgccagctgttccactttggcggggtcgacgtcgatccccaccacggtatggcccatggacgcgagggtggccgcgtggacggcgccaaggtagccgcagccgatcaccgagaccttcactgtccccacccgcgccctagcctcgcagcctcggccagggaacccggcgggcgtgaacccagcgcaaccaccggctcatcactgatcaccgagtggtaatgcccgaccagttggtcacagagcgcaggccacgtcctgtcctgcacggaagcatgggccgcagcagcgaacgcgcggcgtttggcgtcgtcgcccatcaggtcgagcacgtggccgcgcaagccggacaggtcgcccggttcgtagagccagccagtccgtgagttctccaccaggtccagcggcccgccccggcctgtggccaccaccggcacgcccgatgccatggcctcctggatggtctggcagaaggtctcgaactcacccggatgcacaaagaggtcgaaggatgcgacagcccgcgccagctcctcgccgcccagaaacccggtgaaaactgcgtcaggcaaggcgctttcgagggcagcccgctgcgggccgtcgccaacaaccaccagcctggtgttgggaatcccggccagggctgccaggtcctccacctgtttctccgcggccagccgtcccacgtagccgatgatccgctgtccgccgggagccacggaagcccgccatccgtcgtcgcgcttttccggcgagaaccgtgccgtgtccaccccccggcgccacatctgcacccggggaatgccgcggccgcgcaactggttcagcgcgaatgtggacggcaccagggtgcgggtggccagcagatggatgttgtcaacccggttccaggcccagttctccaggaacggcacgccgtatctcgccgcgtaactggggacttcggtctggtagatggccacgctgggaatccccagctggtgcgccgcctgcgccgcccgccagccaaggatgaacggcgaggcgaggtggacaacgtccggtgcgtagtcggcaaggattcgcttgacccggtaaacaccgcccatcgccaccctgacgtttgcatagccggccagcggcacagccggcagccggcggatttccgcgccccggacatggtccggggcctcctcgtccagcgtggaaggcgcgatcaccaggacgtcgtcgccccggttctcaaggtgttccagcacgcgcaggatggaatgcgttacgccgttcatcagcggcaggaatgattcagcaactattgcgatcctcacccctccacggtgtgcgggcggcgttgccgggcgggggagaaaacgttacccggagggaaaggctgcgtgaacagcaggacgccgaactgaaaaaaattactaagtaggctttgcatatgatgctaagcatgcttagtgtagaagggcagccaacgaagagcctcaagcaacggggtggaggccagcgccaggatctcccggtgccgggacatccatttcgttggctaagcccagcgcaacgacacatctaaggagacgtcatgctcaacagggaaaacattgaaaacctgctcaccaagggtggcaacgtcatcggttcagatggcgagaagatcggctccatcggccagctctacgcggacgacgacacgggcgagcccacatgggtcaccgtcaagacgggcctttttggcacctcgcagtccttcgttcccgtcgagggagcacacagccagggcgacgacctggtggttccgttcaccaaggaacacgtcaaggacgcaccccgggtggacgttgacgggcacctcaccccagaggaagaggatcgcctgtacacctactacgaacgtggtgcccgcacctactcggacacccggactgatgacgtggacacccggaatgacgtcgacttccagggcgatgcagacctgaacgccggcactcccaccgcgggtattggccgcgaccgggaccgggacgccaccgaccgccacacggttggccacgacacgtccggccccaccactgacgacgccatgacccgttccgaggaacggctccacgtcggcaccgagcgtgaagccaccggacgggcacggctgcggaagtacgtcaccacggaacacgtcaccaagaccgtccccgtgcagcgtgaagaggtccgcctggagcgcgagcccatcaccgatgccaaccgcggcgaggccctgagcggtccggacatcagcgaagaggagcacgaggtgatcctccatgaggagcgccccgtcgtggagaaggaaaccgttccggtggagcgcgtccgcctggacaaggacgtcgtccaggatgacgtcacggtcagcgaagaggtccgcaaggagcacattgacgcggacggcgtggaccgcgactcgcgccgctaagcttcaccgctaaagcgctgacgtttgagggcgccactgaggcgccgtcgaacgggccggcgcggaggcaagcgcacaccacacgacgccgggagtccacagggaactcccggcgtcgtcgtgcatgcggaactttcttgaacgctggtgcagtccccgcgcagggcggcaactgcaccagccagtaggacgaatatcttcagaacttagggttcttcttcattcgcggctcctgtttcccggtttacggattccgggctatgtcctgcgggccgacgtcctggagaacagccagccggcaacaatcattgcgacgcccagcaccaggtgtgcccagttgtccatcatgttcagggccaggaagtttgccgccgaatccactccgacgatgagcccgaagatggccaggacgatgtacagtccgcctgcccccaagaggaagttccttgctccgtgttcggtccgggacatggcccagccggtggcaccgatggccaactgcacgatgttaagcagcatggacacctggaacagccccaggaacatggcgtgcgacgccggtccgaggagcatcagttcgctgtattgggtggtgacgcccgggatgaagcccaggacaccgaccagcatcaaaagaattcccactcccatgccagcgttttggacgtctgcccggccaaaatgaacgccgtgtgcatgtggggatgcggtagtcatttcttccctccaatccactcgttgtggacagttaaattttacggcggaccgctccgaaaagctccggaacagcttgcgccggactttccgccgatctaacggatgagcctgtcgttcccggcccggacgcctgtgccgtgacaccatggggcacgatgaaaatgcgtgctgaccagaccggagaccgtggccttcccatgcccttgtggctgcagggtgccctcgaaacggcgcaggcagccatcatttccgcgctggtggtgactgccccggtcatcgccgtgtgggccactgccggcttccagaacagctccttcgacgtcctggcccggctggcggggcagtcctggctgctggtccacggagttccgcttgaactcagtgccgcgggttccgacgccgccggcaacggggagtttggcgttctgtcgctgattccgctgggccttaccctgctgcctttcctgcttgcgtggcgggccggacggcgccttgcccgcgcgtcctatacagaccagctgtggcaggcattgctcggctcgtgggttgtctacgccgccttcggaacggccaccggcttcgtctgccgtaccccggacgtgggtatcaatccctggtttgccatgctgattccgctcattccctatgcgctgggcatggtgatcggcgcccggcgtgaggccggttcctggagccgcctcatcggcgtcgacgccgtggactggattttccgcaccagccagcattcgcggtgggccggctcctaccttgcttccgccggcaaggccggttttgtggccaccgtttccgcgctgtccctggctgccgtgctgctggcggtggacctgttcatccactggaacctggtggttgccgtctatgaggcgctcgatgccggcgctgttggaggtgccgccctgaccatcgcccagctcggcttccttcccaatcttgcggtcttcgccttggcgtggacatccggggccggctttgccatgggggtcggttcgcaggtgggtcccctgggaaccgccgtcggaccgctgccttccattccggttctggccgccatcccttccgggccgctggactacgcctttgtggccctgatcgtcccggtgcttgcgggcgtgctggccggctggtggttcctgcgcgaaggtgaaaaccacttcgatgagtggctttccatcaagatccgtgcccgctggttcacggcaacagtctccaccctggtgctggggatcctggccgggctggcagccgggctgctggcgtttggcctggcttggctggcccgcggctcggcgggaatcggccgcctgacggacatcggtccggacccgctctggacgggtgtctggctggctgcggaagtggccgtcggcgtcgtcatcggttacgcggccgggccgtggctggaacgcgagcaggcggcgtcggacgaggaagcggaactggtttccagggcctaacttttgcagcgctgctgagttgccgctgcacggtttggggccggcggcggcgcggctggctaggggagctgccggggcagcgagttttccagctggaccctgcacgccgactgcgcctggtccgtgagcgcccgtcccatgcatgcctggtactggcgcacgtcatcgaagaatacggcggtcaccaggatcagcagcaccatgatggcggacaccaccaggcccgagatggtgccgatcaggaccagcctggattcttttagcctcgcggcccgtaccaggaggacaacgcccagggccacactagccgccgtgaggatcccggtcagccacaggtagttgacgtccagctggtagacgaagaaggcgccgagcaccgagatgacgaacatccggaacagggtgtgggtcttggccagcgaggctttggctgcctcgctgagcggcggcctggtccgctgctgcccagccggttgcggagaggtgttcatgttttccagcctacgcgagcgtgcccataagctagagccatgcgcatcgtagtcctcgtttccggtaccgggtccaacctccaggctgtcatcgacgcagtcaaggcgggggagctggaggtggaaatcgcggctgtgggtgccgaccgtccgggcacgttcggggtggaacggtcagcggccgcgggcatcccgacgttcgtggttgatttcaaggcctacccggaccgggctgcctggaatgcagcgctgacggacgccgtggcccgattcaagcccgatgtggtggtctcctcggggtttatgcgcatcgtcagcccggagttcatcgatgcctttaacggcaagtacctgaacacccacccggcactgcttccggcttttccgggagcccacggggtgcgggacgccatgacgtacggcgttaaggtgaccggctgcaccgtgcactgggcggacgccggggtggacaccggccccatcatcgcccaggaggccgtggccatcgatgattcggacacggaggagaccctgcacgagcgcatcaaggtagtggagcgccggctcctggtgtccacgctggcctccctcgccgccgaccaccgcgccagcgcctcgaacctccccacctgaccccctcccctcccaactaggtagcgctaagtgtcgttttcagccctcataacgacacttagcgctacctagttgggcacggggggcgggcctgtggataacctctgcggcattccgccccgcctgccacgatgggcggatgaaggttcccagacaactgcctgaccctctggcgtctttgcccttcaccttccaggaaggggtcgacgccgggatcagccgacgacgcctgcgtcaccatggcttgctctggccaagccggggagtccgggtgccggatgccagcgacgcatcacacctcgcccctcgcatccgtccgtacaccttggtcgctgagttcgcggccgcttcgcacgcctcggcctttctcctgtgggagtttccgggcttcctcccgggcagtgatgagccactgctgcacatctcgcggcctgacaccgttgccatcatgcgtcggcccggtgtgaagggacatcgcgggcagtttttcgccgacgagatcgtgacctacaacggcctgctaattacctctcgggtgaggacctggctggactgctcacgcaggatgagcatcgaagaactgaccgttgttgctgatcacctgctgcggattccgcggccggacttcgagggcaggtccgagccccatgcaatccgggaggatctcgaggaaatgctcgaccggcacaaggggacacccggtatcaggaaagcccgggttgcccttgaccgcgcccgggtgggatccgattccgccccggaaacccggctgcggctggcattggaagacgctggcctgcccgaaccttttctgaacgtgcccacggaactgggtgacggcgtcgttcgccagcctgacttgggctatccggaacagaaggtagcggtggagtacgacggcgagggccactccgaggcggtgcagatcgtccgcgatattgcccgcgaggaggactttgcccgtgcaggctggctcctcgtgaggatttcaaggaggcacatggagagagatgcccggccggctgtgaccaagatccgttcagcgctcctgatccggggctggttacccggcaaggaaaactaggtagcgctaagtgtcgtaacaagggttgaaaacgacacttagcgctacctagttgggggggggggggttattcgaggcggcgctgtttggtctcgggggagaagaacgccatccacagcacggccagtaccaccagcccgccggcgagggcgaaggacgtggccagccccagctcgggccagaagtagttggcgaaaatcagcggcccgaagccggcacccaaacgcgagaacgtggacgcccagccgaagccggtgccgcgcagctcggtggggtagagctcggacacataggcgtacagcaccgggatggccacctgcaccacgaatccgaataccagcagccagaacaccgccgccgtggggatgtccaccacaaaagccacgatcaccagggtcagcgcggacaacgggccggtgatggccaggatccatttgcgcccaacccgttccaccagcagggcggccacaacaacgcccaagagcccgacggcggccatggacgcggtggtgacgaacgccttgtactcggcgaagccggcgccgatcaggatcctgggcatccaggtcaatgacaggtagtagaccagcaggatcgagaagaacagggcccaggccgtggccgtgattttccagttgaactgccacaccagccgcagctggtgccaggcactgccggccgagagccgcggcacttccttggcatcgggcaggctgtaggcgcgtggttccgctccggtcgcggccaccagcccgtcgatcaccttggccgcctcctcacggcggcccttccggatcaggaacaatggggactccggaacgctgcgccggacccagaacaccagcagggcgggcaggaccatcaccagcatggtcagccgccagtcgccatacagggccacaaggccggcggatacaaagcctgccagggctgcccccacaggccaccagccgtccatcgccgtgaggaccttgccgcgctgcttgcggggggtgaactcacccactaacgcgtagtccaccgggatgcagccgcccaggccgaacccggccataaagcggaacacacagaaccagaggaagtcaggggagaaggcgcccaggacggtgaacagcgagaagatcagcagcgtggccgtgaaggccttcttgcgcccgatggtgtccgcgatggtgccccacacaaacgcgcccagggccatgccgatcaggttcgacgtacccacccacgccacctcgcccggggaaagggcccagtgggttgaaagcaaaggtatgaggatgccgttgagggtcacatcccaggcatcgaacatgaagccgaggccgccgatcaaaaagatcttgccctggactttccatcgccagggcagttcctggaccacctgttcgccgctcggcacagtggtgtaagtattcatcgcagcctcctgggaaaactttagccgggcgcactggggttcacactccggccgactcgcggggcaacctccgcttcgggataaactgggccgtatccccaccaaccgcggcatttgtccgcgagataagacggagacatttgtgagcttcacgcagcatgagcgcgtatccatcgaccgtgttcccatccgccgggcactgatctcggtttacgacaagaccggtctggaggagctcgcgcagggcctgcatgcagcgggagtgaagctcgtatccaccggctccacggccaagaagattgccgccgcaggcatccctgtccaggaagtcgaggaagtcacagggtccccggagatgctggacggccgggtcaagaccctgcacccgcgcgtgcacggcggcatcctggcggaccgccgcgtggcagcccacatggacacgctcacccagatggagatcgaacccttcgacctcgtggtggtgaacctctacccgttcgtggagaccgtcaagtccggggccgcccaggacgacgtcgtggaacagatcgacatcggaggccccgccatggtgcgctccgccgcgaaaaaccacgccgccgtcgccattgtggtggacccctccttctacggtcaggtggtcaccgccgccgctgaaggcggctttgatttgaagacacgacgccggctggccgccaaggcgttcgcccacaccgcctcctacgacaacgcagtggccacctggaccgcgagccagttcctggacgaggacggcgacggcgtcatcgactggcccgcctacgccggcctgtccctggagcgctccgaggtgctgcgctacggcgagaacccgcaccagcaggctgccctttatgtggacaaggctgccccggtgggcatcgcgcaggcagaccagctgcacggcaaggccatgagctacaacaacttcgtggatgccgacgccgccctccgcgccgcctacgacttcagcgagcccgccgtggccatcatcaagcatgccaacccctgtggcgtcgctgtaggttccgcgaatgccgcggacccgatcgccgacgcccacgccaaggcccacgcctgcgatcctgtctcggcgttcggtggcgtcatcgcatccaaccgcaccgtgacggcgggtatggccaacacggtcaaggacatcttcaccgaggttgtcatcgctccgggcttcgagccggaagccgttgagatcctgtccaagaagaagaacatccgcctgctcgccctgccggaagggtacggccgctaccccacggagttccgccaggtctccggcggcatgctggtccaggtcagcgacaaggtggatgccgacggcgacaaccccgccaactggaccttggccgccggtgaagccgcggacgagaagaccctcgccgacctcgccttcgcctggaccgcctgccgggccgccaagtccaacgccatcctcctcgcccaggacggtgccgccgtgggcatcggcatgggccaggtcaaccgcctggactcctgccgcctggccgtggagcgggccaacaccctcggcgtgacggtggagtccgacagcgccagtgggggcgatgcccccggcggtgcctcgaacaccagcggtgccgccgcgcctgcccgcgcccgcggagccgttgccgcctccgacgccttcttcccgttcgccgacggactgcagatcctgatcgacgccggggttcgcgccgtggtgcagcccggcggctcggtccgggacgaggaagtcatcgccgcggccaacgccgccggagtcaccatgtacttcaccggggcacgccacttcttccactaatccccaccggcaccctaacctcgctgcgctcggccagggaaccctgccggcgtgggcccatccaccggcaccctaacctcgctgcgtccgcaccggctccctgccctcgcaagctcggtccggggccctcgccggagcggctccacggccagggaaccctgccggcgtgggcccaccatccattgctccataggtgtcgttttcggacccgtaaacgaccatttcggagcaatcgacggtgagctaacgaacgacggcgcccgcccccatgcgaaggggacgggcgccgtcgtcgttgtgctggcttagtcctggtcgtcttcaccggtgccgggctccgggagccgcagctcccggggcttggcctccgccatccgttcctctgtccagtactcgaggatctcctcgtgcgtctggtccagctcggcgtggctgacggggtcctggccggacggggtgtctttaggaggctgctgcactggcgtaggtctgctggatgacggatccccagtacgggccgtacatcactgcggagcggttgtagccgtagctgttgacggagttctggacgcccgcggagctggtgccgatgaaccaggggccgcctgaggagccgccggtcatgtcgcaggggatgccctgggttccaaactgggggttgttgggatcgttcgtggccgttccggtgcagctcttgagggtttggccgttgaagggcgatgccgcggggtagccgaaggacttgtaggtgagtccgcgggcctcgttgaacgccacgccggatccgcctacaacgtcagtgagggtctggccgttcagcgggttcatgacggcaaagccggtgtcgtaggccatgtccccgttggcgctccactgggtgggggcgtggagggatttggcggtccacttgccgtagggctcggcgccgttctcgtaggccggcacgaaggcgaagttggtggcgaaggctcccggcccctcgttgaggcagtggcccgccgtggagacggtgctttcattggcggaggttacggcgttgccggagcagacgtagttcgagccagccagggtgaagaagaccttaccgatgtgcttcaccggcgcctcgctctgggcgatggtcggcttgcccttggtggccttcacctcggacttcttgcccttttccacgaccccggcgctggagcggttgccccgttccagcgctttgcccgcaaggacgtcacccgggatggcgccctgcatccggtcggccgtccagtagtcggccacgccggcggcatccaggacagtgctggtgacggaggggtttgccttgtcctccgccggagcagcggtggctccgccggcggaagtgagtgccagaacggcagcggctgagaggctcaggaagccggtagccagagacctggtgcgagtcattattgtcctgtctgaacggggaaatggccccggaaaggggcggagtgaccctgcgaatttatcgtcatatgacaactttgtaaatagtagtgacgtatcatgtatggccatcagttgcctgccgggaggccttggtgcggaaagcacgacgacgcgtgggcgcctcaggtgcgtgccggcgtcggccgttctccatcgctgtaatcctgcccgttccgggggtaacgctgcagtcccggtaggggtgaaatccctgcactcgggtaagttgtacatggtgaaatagaccgaattttcacaaccaagccgacccacagggagacgcccgcgcatgtccaagattatctacacccacaccgacgaagcgccgatgctggctacctattcgttcctgcccatcatcgaggcgttcgcctcgacagcaggtgtggaggtggagacccgcgacatttcgctcgccggccgcatcatcgccgtcttcggtgactacctgacccccgagcagcagatcggtgacgcccttgctgaactcggtgagctggcaaagacgccgcaagcgaacatcatcaagctgcccaacatcagcgcttccatcccgcagctgaaggccgccatcgcggaactgcaggaacagggctacgccctcccggactacccggacaacccctcctcggacgaggagacggccatccgctcgcgctacgacaagatcaagggctccgccgtgaacccggtcctgcgtgaaggcaactcggaccgccgcgcgccgctgtccgtgaagaactacgcacgccagaacccgcactccatgggtgcctggactgccgactcgaagaccaacgtggccaccatgggccaggacgacttccgttccaatgagaagtccgtggtcgtggagtccgaaggcaccatcgccatccagctggtccgcgaagacggctcggtcaaggtcctgaagaaggccttcccggtcctggctggtgaggtcatcgacggcaccgtgatgcgcgccgccgccctggacgaattcctgaaggcacaggttgcccgcgccaaggaagagggcgtgctgttctccgcccacctcaaggccaccatgatgaaggtctcggaccccatcatcttcggccacgtggtcaaggcctacttctccgaactgttcgagacctacggcaagcagctctccgccgccggcatcagccccaacaacggcctggccgccatcctgagcagcctcgaggacctgcccgaggatgtccgcgagggcgtgcagaacctcatcaagaagggactcaaagaaggtcccgcgctggccatggtggactcggacaagggcatcaccaccctgaacgtccccagcgacgtcatcgtggatgcctccatgcccgccatgatccgcagctccggccacatgtggggcccggacgggaaggaagcggacaccctggccgttctgccggacagctcctacgccggcatctaccaggtggtccttgatgactgccgtgccaacggcgcctacgaccccaccaccatgggtaccgtgccgaatgtcggcctcatggcgcaggccgcagaagaatacggcagccacgacaagaccttcgaaatccaggaagccggcaccgtccagatcgttgacggctccgggaacgtcctggttgaacaccaggtttccgagggcgacatctggcgcgcctgccagaccaaggacctgcccatccgcgactgggtgaagctggccgtgacccgcgcccgcgcctcccagactccggctgtgttctggctggatgaggaacgcgcccacgacgccaacctcatcgccaaggtcaacgagtacctgaaggagcacgacaccgagggcctggacatccagatcatgtccccggtcaaggcgattgccttcaccctggaccgcatccgcaagggcgaggacaccatctcggtgtccggcaacgtcctgcgcgactacctcacggacttgttccccatccttgagctgggcaccagcgccaaaatgctctccgttgttccgctgatgaacggcggcgggctgttcgaaaccggcgccggcgggtctgcccccaagcacgtccagcagctgctcaaggaaaaccacctgcgctgggacagcctgggcgagttcctggccctggccgtcagcttcgagcaccttgccaccaccaccaacaacgcccgtgcgcaggtcctggccgacaccctggaccgcgccactggcacgttcctgctggagaacaagtcgccgagccgccgtgccggcgagctggacaaccgcggcagccactacttcctggcccgctactgggcagaggagctggccaagcagacggacgacgccgatctggccgcctccttcagctccatcgccggagaacttgcttccaaggaagaggcgatcgtcggcgagctggctgaggtccagggctcgccggtggacatcggcggctactaccatccggatgacgccaaggcttctgccgtaatgcgtccttcggcaacactcaacaaggtcatcgcaaccctgagctaggcctgcagcagaagcggcgttccggatttccggaacgccgctttttctgttttcagaagaagcggcgttccggatttccggaacgccgctttttctgttttcagggtaggcgcagagcttgtggcggcaggaatcgttgctagggtactaagtacgcttagtatctcggtttgtgccgatgactgctgaggttgccgatcctgaggagaagaaaatcgtgccagacgacagcaacatccagatccccggcgtccccgccagcgaacctgccagcctccaggaacctaccacccctcgcgaaccgctgccgccgaagccggaccagcaggcacctgaggctgtgtcgccgacgggaagccctaccggcgctccggccactgcccgcgcccagtcgggccagtacctgaccacggcgcagggactccgcctcggcgatacggaccactcgctgaaggccggctcccgcggacccatcctgctgcaggaccaccatctgcgcgaaaagattacccactttgaccatgagcgcattcccgagcgcgtggtccacgcccgcggggcgggagcccacggtgtgttccgctcctacgggaccgcggcgaacatcacccgtgcgggcttcctggccaaggacgtggaaacgcccgtctttgtccgtttctcaaccgtgctgggctcccgcgggtccgccgacacggtccgcgatacccgcggtttctccaccaagttctacacggacgagggcacctatgacctggtgggcaacaacatccccgtcttcttcatccaggacggcatcaagttcccggacatcatccatgccggaaagccccacccggacagggaaatcccgcaggcccagagtgcccacgacacgttctgggacttcgtctcgctgcacaccgaggcgcaggcgcacaccatgtggaacatgtccgaccgcggcatcccgcgttcgttccggaccatggaagggttcggtgtccacaccttccgcttcatcaatgcagagggcaggacaaccctggtgaagttccactggaagcccaagcagggcgtccactcgctggtgtgggaggaagcccagatcatcaacggcatggacccggacttccaccgccgggacctggccgacgccatcgaggcaggtgccttccctgagtgggagcttggcgtccagaccttcccggacaccgaggaccagatgtttgaaggcatcgacctgctggatcccaccaagttcgtccctgaggaacttgccccggtccagcccatcggcgtcatgacgctcaacgccaaccccaccaactacttcgccgaaaccgagcaggtggccttccacccgggccatctggtgcccggcatcgatgtcacgaacgatccgctgctgcaggtgcgcctgttctcttacctggacacccagatctcccggctgggcgggccgaacttcgcccagctccccatcaaccggccgcaggctccggtgaacgacatgctgcgcgacggcatgcaccagcaggcagtccatggcggcgcggccccttaccggcccaactcgcttgacggcggctgcccgttcctggccggccaggatgtgggggccttcatcgacgtgccggaggagctggccgcatccatcaaggagcggaagaacccggcgtcctttgatgaccacttcagccaggcgcggctcttcttccgcagcctcagcccggtggagcgggaccacgtcatccaggcctacacgttcgaactgggcaagtgctacgagaagtccatccgcgaacgccagctcgcggccctggccaacgtggacgcggaactatgtgccgccgtcgctaaggggctgggtcttcccgcacccaaggcaacagaagaggtaccggactcagaccccagccccgcgctgtcccagataggcgggacctggccggtggccggcagggttgtgggcatccttgcggacgcggacagcgacctggcagccgtgaacgcggcacggaaggcgctggacgcggaaggcatcgtcccgctggtcatcgccccggcgggcggcttccttggacctgagaacgacggcggggtccccgtccagcggacctacctcaccgcacgttccacggagttcgacgccgtcatcgttgcggcgtccgccgcgccggctcccgacgccgcacccgggcgcgatgccaaggccggcggtcccggcggtgcctccgacccgagggcagtgctgctgctcacggaggcgtaccggcacgcgaaagcaatcggcacctgggattccggcgccgaagccctggccgcagcgggcatccctcaggacaccccgggcattgtgtccgcgggcgacgccgagtcactggtgtctgagctggcggcgctgttggccgcacacagggtctgggagcggttcccggccgcgccggcccagtcctgagcgggcccggccgctgacgaaacagccagccgacgcctcgtgggctgacccgggcgccacccggggaagccatttgccggaggggagcgccgtcgtcgtcatgacgggcgctcccttccgcatgtggcgtcagtcgttgcctttgcccttgccctcgttgtccttcttgtcgtcgtccttctcaccttccggcgctggcgcaggggctggcgcagggaccgggacctcgacggctggcgggggagcggccgctgcggcctgttcctcagcgatccgtgcctcttcggctgccttgtccgccgctgctttctccgccgccgctatcgcatcggtgagatccgcccggacggccgtggcgatcgtggtgatgctccggcggcgttcctcggaaatctcgcctttagactgtgccgcttccagttcggcttcaagcccctccaacgcccgcaaggcggcggcggggtcgttctccgacgacgcctgggtcacctcgaggacgcgtgcctgcagctgccgtgccgcctcgcgctcgaggccggcctccgtcgtggcgcagccgctcagtagtgcagccgccacgaaggcaccggaccatgcgagcacagacgcgcgtccggcgggggagggcagcctcacggttccacgctcttctggagttcctcaaggtgctcgcccaggactccagtcaccgtggggtaaggcacgacgtcgggcggcgactgggcggacagggtcatcagcgctgcagccaccgcggccgccaccaccacaagggccaggacagccgccagccagaaccgctttgtccgcttcttgctgtccttcgcccggtcctggttcagggcttcgtgcccggtttccggaacttgcccaacagcaagggaagcgtccgttcctgccgcttccctcagctcatccacagattcttcggcggtgatggacggcgggtgaaagggcatcgccggcagcacccttgtggtctccggggcaagttcacccggcgtggatgctggtgaaaccaacgcctgccgcaacgccgattcgatgtctgcggcggcgggccgctcaagtggttcgatggcagtcatggagcggatgaggtcagcccattcggcgggcaggtcctcggggagttccggtgcgcggtgcaggcgcgccaccgccgattccaccgcgctgcccgggtattccacggtgcctttgatgcattcgagcagcaccaggccgagcgagtagatgtcggtggaggggccgagtggcttgcccagcgcctgctccggactgagataggcagccgtgcccaccatggttcccgttgcggtcaacctggttgcgtctacgatcctggcgatgccaaagtcagtgagcttgggccgcagcggttcgccggggcggatctggaccagcaggatattgccgggtttgatgtcacggtggatgacgccgaggccgtggacgtaagccagggcgtcggcgatgccggcgccgatgaccgcaagttcctccagcggtacggtgctgtgccggatccgggcacggaggtcctggccttccacgagttccatggtcaggaagggccgtggctcgtcagggatgcgggtatcgatcccggcgtcgaacagcgtcaccaggccggggtggttcagggttgccagaagttggatctccgcttcctggcgcttaagttcatcggcgtccggggcttggggagcgaagagcttgagggctacgtcgcggcccagattttcgtcccgggcacagtagaccgacgacataccgccgcggccaatcacctcacccaaccggtaacgtccgccgagcacttcattcttgatggagctaggcgattccgccaccatgacccgttcctcccggtgcgctgcggcactgtcgtacctcaaattatacgggcggtggagtaaacggacgattcacccggggcccccgagctgccgcacgtcggtggtccggcggcaaaaggcgtgcctttcgcagccggaccacccgttaacaaggacatgtgtgctgaatacatgttgtgcgtggtcttggtgtggtctttgcgggcctcctttccttcagcccgccccgttgctgccgcttcaggcgcgtggggcgggcactgtcagcaggtggccggcgctacgacatcttccgcttccggagcatcaggagtcctgccgccagaagcaggagggcgaggggcgccagggaggcatccacacccgtatttgccagggcagtggccccttgtgccggagcgttacgggtaccgctgcttgcacgggtgtccataacaatggcaccgccaactgcagtggaaccggcggcaggtgctgtggagactccgccggtcaaggcgccagtgccacttccgttgcccgtggtgcccgtagtccccgtggttccgttgtcggcgccgggatccgtgtttcctgagtcaacggtgccgacgccgtccgtggtgccgttatccgggtcagtagtgccggggttctcggttcccggtgttccgttcccgggttctcagtaccagtggtgccgttgccgccgatggtgaggtcggcgttggcgtctaccagttcgccggtggtgccggtgctgttgccgccaatggtggcatcgatgttggcgtcgacgagttccccggtggtgctgttgccgccgatggtcaggtcaacgtcagcgtctaccagttcgctggtggtgccggtgctgttgccgccgatggtggcatcgatgttggcgtcgacgagttcgccggtggtggcggtgccgccgatggagaggccggcgttggcgtctaccagttcgctggtggtgccggtgctgttgccgccgatggtggcatcgatgttggcgtcgacgagttcgccggtggtggcggtgccgccgatggagaggccggcgttggcgtcgataagttcgcctctgccactgccgccgatggtggcgtcgatgttggtattgaccagttcgccgtcaccaccggtggtgccgagcgcaaggtcgacgacggccgctgcggcgaggccggcggcgtccgtcgtcgcgccggtggcgcctccaagtgcaacgtcggctacgacggcaacgtccgctgaaacggacggcgttgggtcacccagctggcccaacgacgtcgagtcaacggacgccgccgccgagatgagggcggatgcggaaaggtccgatccactggtggtgtccgcggcatttgccgcagtgcaactgagggctaggagcccgcctgcaaagagggtgccgagcagtcctcggcggaggttcgagttcatggtgatatctcctgaaagttgagtaaaggctgcttgtcagcaaccctgatggccgctttctgccgcaagggcaggcgggcatcaactagtcaggagatgaaccgggatcgaaagacaccggtgcgggggcatgctcggagaactcgccgacgaggacaacgccggtggttggaaggttgaggtcgaaggggttcagccatgccgccgcaccggaagacgcggcagaagttgtgctgcttcccgtgccggagccaggggcgggaggagcctgggcaggggcgggcgatgggtctgccgtgcccggctgctcctcggtgacaccaggttggaataccgcggtttgcagagtcacgtatgcggtagcgacgtccaccggacccgctgaaggggtgtcggtgcctgggccctcaaaaatgccggtcgcggctattttggccgtctccgcaggtaccgtcgccacagccacgctggttggagtaagagcgtttaccgcgtcagggacggctgcagacggcacatcaacgcccggtcccgcaagggggagctccgggagcgctggcgtggcggagataaggtcttcaacgggctgaaggacgggctcgaggaccggaagtacttcggtcacaggtgcaactacagcttccactgcttccgccgtcgctacgtccacagattcggcgatcggaacagctatgaccgacaccgttcccgcagggatgacgttgtttacgaccggtaccgacgaaacgatctgttccgcaagccccgaaacctctcccgccaggggctgcaacagccccgtcgacgagtccggcgccggtgctgaggtggcgggtgcaggatcaacaagactggccgcggaaaggggcagctcttccgccaccgaagataatggactggtggcgccccccaacagggaagttgcatcctgcagcgtgtctgccgaagcagctgacgccgaaaaggtcagccaggtgagggtggcggcgcctgcaaggaacgccggccgaagggcacgccacggtgagcgattaccagccatgcgtaccacccccagtactgatgcattcgacgagggctacagcctaagaccgaatgttgcaggaagtctagggtcggctcaaacaactcgacaaaactgaaaacttcacatctcaggaattacagagccatcggaactggtcatacgtgacgttggatcggagctttccgggtgcgaggctcagtgccggtcgttcggatagctgacaccgagctgcgcgcgaacgccgtcaaagagccgcatcgtattcagggtgtcctccagcggcatcaccgggctttccgtaagtccctgctggatgcagcgggttacttcgcgcagctcgtatacgtatccgcggcccaccggctcaaaggcttcagtcctgcgggagtcccagcctgtggataccgtcagttcaccaggattgttaatggagcccacgctttgaaggaagccaaggcttcccgccactgtggccgtccgcggaccatgcgccagcagcgaggaagtaagctgcacctgcgccccgtggttgtatcccaacgtcagcgcattctgggcgtccacgccgtcgtcattgatgaacccggtggcactcacggtctgtggaaagccgagggtgcccagcgcccacaggagcgggtagaccgaaaggtccagcagcgcgccgccgccgtccttcctggcccacagcctgacggtaggggagtagggggccgggaaaccaaggtctgccgtgacccaatggatgtcgccgagctcgccggacgcagcaatctcgaacgcccgctgcatgctcggcaggaaacggctccacactgcttccatgaggaacaggttgcggctcctggcgacgtcgatgagctctgacgcttcccgggcgttaatggtgaaggccttttcgcacaggacatgcttgccggcgttgagcgcggcgagaacgatttcgtggtgctgggcgtggggcgtcgcaacatacacgacgtctacctgctcgtccgcgagcagccgctggtagccgggcacaccgccgtcgtcaccgtaagccttagcgaagtcataggccaccgcaaaggcatccgccgtgtcctggccccgggaactgacggcatacagctcggcgtccgccagcagggcgaggtcctgcgacactgagcgggcgatcccgcccgtggcgatgatcccccagcgcaggggagaaccggtagcggaacggggatcctggtcggactggctggacagccacggctttgcgatgggggcactcatggtgaccatcctctcattgaggtgagcgagggttcggttatgacctgcaggaagtgcgagagcgtctggaagctcctgaaaatgccgggcagccggttgtgacaagcccttgacagcattgtcgcgggggacgtaaaaatagaggaccgtcgttagaaaccgttttcttgggcggctactactttcccagtgatccgcacccacctaggcatgtggtctgtttggcatgccggaaaaagggccaatgacgtccacaacacacaccagaccgacccctccagccgtccggagcagattccgcattggagcaggagtctccgcctccgcgcttgcgctcgcagcggggctggcagtagccgcacctgcaatcgccggtatggcacccgccagtccggcaccgaccggagggggcgttatccgggcggacgacgcggcacccacggggtgggccgccgtcgggagcggtaccagcggtggcgccggcgcacctgctgaaagccgctacgaagtcagcacgcttgctgggctcaaggctgcactggccaacaacggcgaacccaaggcgcccaagatcatctacgtcaatgggaccatcgatggcaaccagacgcccgatggccgaatcctgcgggagcaggactatgcgccggggtatgacatcgacaagtacatatcctgcttcgggccggaaggaaaggtctggagcgaccagacctatgaatactgcaagaagcagaggcagcttcggcagaccggcagcaataacatgaagcggcagatcgaagtaagcctgcccagcaacacgaccttgattggcctcggcaccgattcaggtttcgttggcgccaacatcgtgatcctcagcgccaccaacgtggtgatgcgcaacctcagcgtcgaggcaccggtggacttctttagcacctggtcccctgacgacggcgatggtgcctggaacgcgaggttcgatgcagtatcttccgttacctccgaccatctgtggatagaccacgtacggctgaccgatgggcggttccccgacaccgaggcccccctcggtcccgacggcaagccggccaaccggcacgacggcctcctggacctcaaggacggcaccgattacgtgaccatctccaacagcaagctctccaaccatgacaagaccatgctgctcgggtcaggtgacgaacatgtggacaaggacggcggaaaactgcgcgtcagctacatcggcaaccatctcgaaaatatccagcagcgcggtccgcgggtacggttcgggcaggtgcatgtgctgaacaactactttgtggccagcaccgaacaccctcagtaccccatgatcagcgagggccagggcggcagcagctacttcctgggtgcaggctacgagtcgcggatcttctccgagcgcaacgccttcgactacaccggacccggggctgacgaatcaatcatggtgagcagctacaacggccaccgtttcaaggacattgggtcctggttcaacggtgaggaagctgacctcaacgccgtggcgcgggcttccttcgagcaaaaccgcgcggaggccctggcggaggcggaactcaccggggagcctgctccggactggacgggctgggacttcagcaccgacgtcggctgggacccggcggatgcctacaggtacaaggcattcgcaacgccccaggcggtgcggaaccacgcgctgaacttcacgggtccgggcgtcctcagcgttaggcagtagaactgaggacagcgggcataaagaaacgcccggcccccaactgaactgctccccgaaagttggactgagaaatcagttcttactttcggggagcagttttatgcaggacagtagttcgttatctgaggaacagcgcgaagccgcgatagcgttgttcgagaatggttggggcgcgaaggcagcggcgacgagcctaggggtccgttcaaaacctgtcatccgcatccacaacctgtggagagttcgcggaggtacggcgctagtgaccaaatcaacccatcggcagttcacgttcgagttcaaactcgccgcggtccgccggttccaagccggagagagccaggtcgccctggcgaaggagcttgagctgtcctccccggatctggtcaagaagtgggcgcggatataccgcaacgagggcgcagatggcttgcgcccaaaaggacgtggccggccgatctcacctcccaaggcgccgacggagccagagtcggagctgcagcggttgcgccgcgagaacgagcacttgcgggcagaggtggccttcctgggaaaagtaaacgccttgagggacgaggaacagcgctgaaggtccgcgctgtcatcgctctcaaggccgaacaccggttggaagttcttctggacgtcgccgagctgccccggtccacgttcttctatcaccaagctcgactccttgcccctgacccgcaagccgacctcaaagccgcaatcacgggtatcttcaagaagagccaggcccgatacggccaccgccgcgtccacaccgaactggtcaagcaaggctggacgatcgcgaaaaagaccgtgctgaagctgatgcgtctactgcgcctggtctgcaaggtccggcggaagaatcgctacaactcctaccgaggcgagcagggcatcgtggccccaaacctgttgaaacgccagttcgaagcggatgcgccgaaccagaaatgggtgaccgatgtgaccgaattcagcgtcgatgacaggaaactctacctctcaccggtcatggaccttttcgaccggcagatcatctcctacgccattggaacctcgcccaacctggagctggccaactcctcattgcgcggcgccttcgccaccctggaggaagggcagaaaccactcgtgcactctgaccagggattccaataccagcacacctcatggcgcctactcctgcagaacgccggcgcggtccaatccatgtcccgcaaagccaactgctacgacaacgccgtcatagagaatttcttcggccacctcaaagaagagctcttcaaccgcgtccgattcctcaacaccgaagcactcacagccgcgctgcacgactacatccactggtacaacaccgaaagaatctccacaaagctcaggggtctgagccccgttcaataccgcgctaaggccctggtggcctaggtcgttgagcaaaactaccccgtgagtaattgccttggtctcccggagatcgcgggggcttggctttccgaaggcgaatcgttctgcattccatggccagtatcatgagcccatgcagacggctctgatacttataattactggcgtcttgcttgggatgccgacggccatatatgccttcaacaatccgcggcggaaaggtgaaccgctgggcgcgcagcggacagcgtttcttggcttaagtgcccttggactggcctgcctccttgtcggagccgctgttttcttatcagtccgtcagtaggaacacgtacacgacagcgtcagtcatcatgctcggcgaaagcgtcccttagtggtggctaggttcccactgagaaaggctccgtcccacttgggacggagcctttccgtgaagaggcgatcactgcccgctaaagtgaagatctcacaaattcgagagtccaactttcggggaccagttcaaacaggggaccgggcgttttgcttgctgaggcctacttggtgatcggttcgagaaccggatcgccttcgtaggcggtcttcacgttcgcagcggtgacgatgaccggctccaacaggtaggccggaacagtcttgacaccgttgttgtaggagttctcgtcgttgatttccagttccttgccggcctggagatccttcaccatggtgatggcgtgctcaacgagcttgcgggtgtccttgttgatggtggagtactgctcgcccgcgatgatggacttgacggactcaacctcggagtcctgcccggtgacgacgggaagttccttgcctgcggccttgacggaggtcaggactgcgcgggccagggtgtcgttcggggacaggacgccgtccagggactcgctggagtagctgccggtgagcagggtgtctgcgcggcgctgggcgttttcagccttccagccctgggtaacagcctgctcgaaggtggtctggccggagaggaccttgagcgtgccgtcgtcgatcttcggctgcaggacgctcatggcgccgtcgaagaagaccttggcgttggcatcgtccggggagcctgcgaagagttcgacgttgtacggaccttcgcccttcttctcttcgaggccttccagcagcgcctggccctggagttcgcccaccttgaagttgtcgtaggccacgtagtagtccacgttctcggtgttcagcagcaggcggtcgtaggcgatgatcgtggcgccggagtccttggcctgcttaagctgcgtgcccagttgggagccgtcaatggcaccaacgatgatgaccttggcgcccttggtgaccatggcgctgatctggttctgctgttcggacacgccgccgttggcgaactgtacgtcaggcttgaagccggcctcggtgaggccctcgttgaacagcttctcagcgaggacccagttttcactggtcttctgcggaagcgcgacgccaatggaggagtcctgctcaaagccgctggcgccctcggtgccgccgcctgtggaggtctccgaccgtccgcagcccgtcagcgccagtgctgcgatggcagcgaccgctgctgcctttcctgctttaccaatcattcgcattgttggttctctttctttgtggtggtgtaacgctagtcaggccgcaaggctcaggcttccctggcgatcgcttccttcgtggaggtggtttcgtccggctggttggggttggagggcccctgcttgcggttgaagttctgggtgagcatgccgatgatcgacttcttgccctggctcttgttgtagacgtcgaaggcgacggcgatcaggaggaccaggcccttgatgatctgggtgaggtcggcgccgacgccgaggagctggagtccgttgttcaacacggccatgaccaggccgccgatgatggagccgacgacggttcccacgccgccggtcactgcagcgccgccgatgaagaccgcggcgatggcgtccagttcccagccgaccccgtcaaagggtcccgatgcggtggagcgtcctacgaagatcatgccggcgaggccggcgaggatggacatgttcatcatgaccaggaagttgaccttcttggactggacgccggagagttcggccgcgtggcggttgccgccgactgcgtagacgtggcggcccaggacggtgcgggaggaaatgaagccgtagatcaggaccagcacggcgaggatcaggccggggatggggaacgaggtgccgggccggccggtggcgaacaggtaggtggcgtagaggatggcaccgcagatcaggaccagcttcagcgcggtgacccacatctcgggaacctcggcacccagtgccttggcccgggcgcgggaccggagctcgccgaccaccacgaatgccgcggccgcgatgcccagcagcagggtcaggttgttgaatcctgtgttgggtcccacttccgggaggtagccggaaccgaggtactggaagtcggcggggacggggatggtgttggacttgccgacgaactggttgaagccgcggaacaggagcatgccggcgagggtcacgatgaaggcgggtatccccacatacgcgacccaccagccttgccaggccccgatcagcgctccgagcgccaggcccaggagcacaccggcgtaccaggggatgccccagtcccggatggccagggcaacggtgacccccacgaaggcggcgatggagcccacggacaggtcaatgtgtcccgcgatgatgaccaggaccatgccgatggcgaggatcaggatgtaggagttgccgttgaagaggttgatgacgttgccgggggtgagggtccggccgtcggtggcgatctggaagaagacgatcagtgcaaccagggcgaagatcatgccgaattggcgggtgtttccgccaaacagctttttgagggcgttcatggtgtcagtccttgtgtccggaaggttctgggatgatccagagggtcaggcggcgtcggctttgcgggcggaggtcatcagtttcatcaggctttcctggctggcctcgtctttgttcaggacacctgtgatggcgccttcgaaaatcgtgtagatacggtcggacaggcccaggagttcggggagttccgaggagatgacaatgactcccttgccctggttggcaagctgctggatgattccgtagatctcgtacttggcaccaacatcaatgccgcgggtgggttcgtccaggatcagcaggtcgggatcggtgaacatccacttggcgaggaccaccttctgctggttgccgccggagagcttggccacgccttcctccacggacggggtcttggtgcgcagcgacttgcggtactgctccgccacagtgaattcctggttcaggtccaccaccgagttgtggctgatcttccgcaggttcgctgccaccgtggtggtcttgatgtcatcgagcaggttcagtcccagggacttgcggtcctcggtgacgtaacccagccccgcgtcgatggcctggcgcacggtcttgagggtggtctccttgccgtccttgtagatgtggccgctgatgaaacggccgtaggagcggccgaagaccgagcgtgccagttcggtgcggccagcgcccatgagcccggcgaagccgacgatctccccgcggcggacgaagaagctggagttcttgcataccagccggtccgcgacgttgggatggcccaccgtccagtccttgacttcgaagaacacctcgccgaccttgggcgtatgttccgggaaacgggactccagcgtgcgtcccaccatgcccttgatgatccggtcctcgtccacgccgtcagccttgacgttcagcgtttcgatggacttgccgtcacggatgatggtgatggaatcggcgatctgctcgatctcgttcagcttgtgggaaatgatgatggacgtgatgcccttggccttcaggccgagcatcaggtccagcaggtgctgggaatcggactcgttcagcgccgcggtgggctcgtccaggatcaggatctttacggacttgttcagggccttggcgatttccaccagctgctgcttgccgacgccgatttccttgatgggggtatcggggtcctcacgcaggcccaccctggccagcaggtccagcgagcggagccgggcttcggcccagttgatgacgccgcgcttggtgggctcgttgcccaggaagatgttctccatgatggacagctcggggatgagcgccagttcctggtggatgatcacgatgccggcgtgctcgctggcccggatgtccttgaactgctgcacctggccctggtagacgatgtcgccgtcgtagctgccgtacgggtagacgccggaaaggaccttcatcagggtggacttgcctgcaccgttctccccgcagatcgcgtggatctcggcggccttcacccgcaggctcacgttatccaacgctttaacgcccgggaattccttggtgatggacctcatctcaaggatgatcggttccgtttgcgtggtctgggacgtcatgaaccctaaccctccaatgcaatgacttctttgtccggccggcaaagcgcagggccgtctgatccaaaagtaaactggatcacgcctattgtcgtcaagtctttaacgcaatcggcgggtaacgaaacggtctaggtttttcgtatcccggcgtgctggaagaccaaagcggccgccccgagggcctcggcgcggtcgcccaaggaggacatggccagggtggtggtttcgccgatcaccggtaccgcgtgcctcaccaggccgcgcctgatggggtccagaaggatgtcgccaaggcccgcgagcggccctcccaccacaatgacttcggggttgatcaggttggcgacgttgcccagtgcccggccgactgagagcccggcatcgtccaccacccggagcgttgcggggtcccggttgagggctttcctgacaatatccgcgggcgtcaggggcctgtcctcaccccggctgaggagttcgatcatggtggttgtggaggcgatggtttccaggcatccacggttgccgcagcggcatacgaggccttgctcgtggatggtggcgtggcctatttcgccggtgattccgacgtttccgtagtagggggccccgttgaggatcaggcctgcgccgatgcccgatccgatcttcaggaacatcaggttgctgacgccggaatgttgcccccacgtgacttcggaccaggcgcccaggttggcatcgttatcaacgaacacggggatctgcagcgtctcctcgaggtgctggaggatgttgatccctacccactccgggaggattgcgccttgggccacggttccggtacgccggtctatagggccgggaattcctacgccggcacccaccacggcgctgcgctcgatgccgctctcccgcagcagtttttccagcagggccacggcggcccggatgccttcttcggcctggtggcccagcggaagcatcacggattcctcggcgatgacgtggtaactgagggaggccagcacgacccggaggtggcgccgcccgaagtcgattccgacggcgacggcgccgttgctgttgagcctgacgttcaatgcgcggcggccggagctggtgattggttctgccgaggcaaggccggagtccagcatgattttgacgatgttggaaacggtcgcagtggagaggccggtctgccgggcgagttcagcctgcgtggccggtccgcccatcagggtttcgatgatccgttgctggttcagctggcgcagcgcggactgagatcccggatttttttgcttgctcctcgttgagcgcggggttgcggacatgctaagaagattgccctatcgcagctcttgtagtcaagaagttaacgcaaggggcggtttcgggccggagtagggaagccgggacaatctgaccccgctgacgggcgcaggggtgcaaacagcccccggttgcgccgccggagcctcgctactctggaggaaggcctatcccgcggccgctccaacgaaggaaggtggtagcagtgctgctggcactcctgcaggaaaactctgtggtcctggacgtggacgccaattgccgcgcaattgccgctgccgcccggaccgcggcggcccgcggggcggccgtcctggtgacccccgagctttttcccgtgggctatgctccccgccgggtgcgttccgggctggatccttccctgctgccggaacttcaggagcggctggccggcatcgcgcgcagcaatggcatcgggctggtctatagtcttccgcgggttaccgggcagggtgactggcagatcagcgcgaccctcctggacgccagcggcgccaccctgctcagctatggcaaggtgcacctgttcggcgacgacgaacgggcggcgttcagccccgcccgggaggcccccgccgtcgtggacttcaacggcatccccacctccctggtgatctgttacgacgtcgagtttccggagtccgtccgcgccgctgccgtcaggggagcggaattgctgctggtccccaccgccctggcacacggcttcgacgacgtgccccaggtcctgctgcgggcgcgggcactggagagccagctgactattgcctacgcgaaccactccggggaagaggacggctgcaggttcctgggcagcagcgttgttgccgggcccgacggcggactgctggcccaggcgggcggggaaccgcagcttctctacgcggaggtggatccgggcgctgccgcccgcgagcggcagaacgtgccctacctggcagaacgccgccctgacctttaccggacctggggcctctaagcagggtccgccggcgcggcgtcatccacgtattgcagcgcaatccagagctcggcccttgcctgggcctgcccaagatcaatgcccagcagctctgccacaccgttgatctggcgtcggacactgttccggtgcagtcccaggtccttggcggttgcgtcccagctcccgtgcgcgcccagccaggaccggagcacgcggaggtgcgacgcccttcgctcggcgtccagctccagcaccggcgccagtagacgtgcggccagcagggcgccggcatcgccgcccagcaggccggttaccgaccacgtcagttcctcctcccgaaggcttttgtgggctgtggacacgcgggggcgcagcgcactggcgcgccggtaggcagcggccagcccaggcagctcggtggcttcacccaccaccaggcgccagcccagctgctccacttctgccagcagggtttcatccaccttgagccgggtcacggccgcgaaaccgtagtccgtcagctccaccatcttggtgtcaaagagcctgcgccactggagcagctcccggaccgggccatcgtccatagcggtggatggttccgcgcgcacgccctgcaccacccggaccggccctggcctggttcccgaaacgctctgggccagcaggtcctggaggctattgagctcgcggctgttgctcccggacaggctctccgggtgcagcagcagggcggttgccaactggcttggggccagggagccgctggtccgctgccggaccagcagctccagaagtcccaccaccgacgaaaccacgttgttctgcgccggggtgaggggcctttccgtccccagcaccaggcttccaagggtggcgtcccgggtgcttcgaagtgggtggccgaacaccagcgccggccctccggctgtttccagggtttccgtttccacgcgcgggccgctgccgccgagtagccttttaagcagcggctggagctgtgaaagtccgacggcgccgcccgcccgggcgcgtacccttccgtccgtacccaccagcaccgcccacacggggacgcgctggatcagcgccgccagcagttcatgttccggccgggcggagaggaccgcccgcatcaggtggcggttggtctccgccagctgccggaagacctgtgcgttgccggattcgagaagcttggaaaattcgagccccagcgcagcgaagggaacgctggccggaacctccaccagcgtgagcccgtgccgccggcaggcctccaccagatggtccggtacggcgtcgtaatacggttccaggccgaagcccagggccgcgaccccggccgctacgagccgccggacgtactggtccgccttcgccgcgctgctgccgccgccgcggaagggcaggccggccgtcaggacgaattcgccgtccatcaggtagggggtggggtcctccaactcgctgggctccacccagcgcagggggacttcggcagttccggcgtcgttcaccacggaaacttcaggaggaagcgcaccgaggaactgccccagcgtgacggcgtcgagctgatccggggtgccgtccttgactggtgcattgcgtctcatggatgaacactataggtcattctgcacaccgtgagatgccgctcacacccctacgctgggtgaggggaaaaccagaccaaccagccaacgacatgaacggacgtcaacgatgactgtgcctacacttaccggcccggcaacgggcgccccaggcggaaccccggcccgtcccgccctgggcgcgcaactattgcgccgcaagccgatcgcccagatggtcagcgaggccgaaaacaacggcggcggcccccgcctggtccggagtttcggtgtcctccagctgaccatgatctccgtgggcgccacgctggggaccggaatccttgtgatcctgggggagtccgttccactggccggcccggccatctggatctccttcgccatcgccggcctcgccgccctgctgtccgccgtctcctatgccgaaatggccggcatggtcccggtggccggctccagctactcctacacctacgccaccatgggagagggcatggcctggatctgcggctggtgcctggtactcgagtacgccgtctccgttgccgccgtcgccgtgggcgcgggccagtatgtcaacgagacccttgcggtgttcggttcggtcctcccggatgcggtgtcgcagccgcccggcgacggcggcgtggtcaacgtacccgccatggtgatcgtggtgctggccaccatcctgctggtgcgcggcgcgaaggaaagtgcctggatcaacacctccatcgtggtggtcaaggtgggcatcctcctgttcttctgcgccgtggcgttcaccgccttcaacgccggcaactttgagcccctgctgccgatgggcgccgcgggtgtctccgctgcagcctcccgcgtgttcttctcctacatcggtttcgatgccgcctccacggctggcgaggaagcccgcaaccccaagcgcgacctgccgcgcgccatcatgctatccatgttgatcgtcaccaccatctacgtcctggtggctgtcgccgcgatcggcgcacggccgtggggctggttcgacggcaccgaggctgcgctggtgaagatcctcgaggaaaccaccggccagccatggattgcgctggtgtttgcggtgggtgccgtcctggccatcgccagcatcgtcctcaccgtgctgtacgggcagacgcgtatcctgatgtcgatgtcccgcgacggcctcatccccaaaatcttcggccgcgtttcccgccgcaccggcacccctgttgccggcacgctcctggtgggaaccgccgtcgcgctcaccgccgggctggtgcccctcggcgcgctcgccgacgccaccagcatcggcaccctgtttgctttcgccctggtcaacgtggccgtcatctacctgcgccgcacccggccggagctggagcggaccttccgggtgccgctcttcccgctcacgcccatccttggggccgcgatgtgcgcctacctgatggccaacctcggcgctgacacctgggtggtgttcgccgtctggatgctggtgggcgtggccgcctatttcggctacggacgccggaactccagggtggctgccatgagcaacgaggaataccgtgagctgtccggtccccaacttccaaccacgcaagcccccgaaacgacgaaggcagaaatctcatgaccatcgccaccgaactgccggcctcagacccgtccagcacctccgcaggagcgccggcttccactgccgcggatggcgccgcagccgggcccatcaccatgctgaacccggattttccgttcagctacgaccattacctggcgcacccggacggactcggctctgtgccggcggaactgctgggaacggaagtcgccgttattggagctgggctctctggcctggtcacggcgtacgaacttatgaagctggggctgcggccggttgtttatgaagcggaccagatcggcggacgcctccgtacggcgtcgttccccgcggcgcctggagtggtggccgacctcggcggcatgaggttccctgtgtccggcaaggcgttctaccactacgtcgacctgctggggctggacacccaggagtttcccaacccgctgtccccggccacgtccagcaccgtgatcgaactggcgggcaagaagcactatgcggaaaagccgggcgacctcccgccgttcttccgtgaagttgcggacgcctggaaagctgccgtgaatgacggcgccaggttcgttgagatgcaggacgccatccggtccagggataccgccaggatcaaggaactgtggaacggactgctgcccctgatggacgagcagaccttttacggcttcatcgcggccagcgactcctttaagaaggcggggtttgcgcaccgggaagccttcggccaggtgggcttcggcacgggcgggtgggataccgacttcccgaactcgatcctggagatcctccgcgtggtgtacaccgacgccgatgaccagcaccggctcatcagcgggggagcgcagcggctgcccgaggcactctggcggcacgcgccgtcgggcatggcgcactggcccgacggaacgtccctggcctcgctgcactccggttcgccccgcggcgccgtcgggaaaatcagccgcgaccccgacggcaacctgcgcatccgcgaacgctgggggcgcgaggccagctatccggcagtggtcacaacgtgccagtcctggctgctctccacccggatccacacggaggaggcgctgttccccgcggagctgtggacggccatcgagcgctcgcactacatgcagtcgtccaagaccttcgtgatggtggaccggccgttctggaaggacaccgatccagacaccggcaacgaggtgctctccatgacgctcacggaccggctcaaccgtgccacctacctgctggacaacgggccggaccagcccgccgtcatcctgctctcctacacctggaacgacgacgcgctgaagtggctggccctggacgccgacgaacgggtggaactgatgctgcattcgctggaacagatctacccgggagtggacattgccagccacatcgtgggccagcccatcacggtgtcctgggaggccgatcccaacttcatgggcgccttcaaggccaacctgcccgggcactaccgctaccagcagcggctgttcacgcacttcaaacaggatgccctgcccgaatcgcagcggggcatcttcctggccggcgacgacgtctccttcaccgccggctgggccgaaggcgccgtgaccacgggcctgaacgcggtgtggggcgtggtgaaccacctgggcggttcctccgcgccgggcaacccggggccgggcgaactgctggacgccatcgggccgataagcctggactaggaggcgtgcaggtccctgtgggcggcggccagctcgcggtagcgagcggcgttggcacggacgccgtcgtactcctcctcggtgagttcccggcggaccttgcccgggacgccagccacgagtgagcggggcgggaccaccgttccctccagcaccacggcgccggcagcaaccagcgagccggcgccgatcaccgccccgttaaggacggtggcgcccatcccgatcaggcagtcgtcctccacggtgcagccatggacgacggcggcgtgccccacgctgacgcgctcgcccaccgtgcaggggaagccgggatccgcgtgcagcaccacgttgtcctgcaggttgctgccttcacccacggcgatggcagcggtatcggcccggacggagacgccgtagaaggcgctcgagtcccgggcgagggtagcgttgccgatgattgacgccgtcggggcaacaaagacggattcgtggacggccggggcgttcccggcgaaagggtacagaggagccatgcgccaagcctaggacatcaccgcgcgtacccaactaggtagcgccaagtgtcgttatggggcgtcaaaacgacactaagcgctacctagttgggttcaggggtgcgcaggaccaggaactggtagtgctgcgtccattggccgcgcccgggacccgactcggcgccggttccctccggccacgtctcgaagtgcgcgacttcgccgtgcctgccgaagatccgccggacggcgtcatcgctgcgcctgctgaagaaccggcggggctcttcaaggtcttcggggttcaggacttcttcatcattcccggaccagagtccgacggcgattggcgcgccgggtgcgcagacccgcaccagctcgctgacgacgtcgtggatcctgctgttgggaacgtgaaggagcgtactcattgtccatccggccgagaacgagccgtccgggaaaggcaggtttcgcccactggccacactgacgtcgaggcccttgccccgcgccagccggacgctctcaccggacaggtcaacgccgctgtaatgcaggccggcgcgcacgaattccaggccttcgacgccggtgcctcatccgagctcgaacagcgagtggcggtgctcgtccttcagcagccgaacgaaccactcgcggcactgggtgcggagcggcgtcagggcgcgcgtgctgccgacggctgcctcccggtcatagaacaccgcgaggtcggcctcgtggtcggtgtgctccggtctgccgtgcatcacgtcggcctccggccctgaaccggagctagttgaagaccacagtccggttgccgtccaggagcacgcggtgctctgcgtgccactgcacagcctggaccagggtgcggccttccacgtcccggcccatctggacgaactgctccggggtgcgggcgtggtccacgcggatgacttcctgctcgatgatggggccctcgtccagtgccgccgtcacgtagtgcgctgtggcaccgatcagtttcacgccccgcgcgtgggcctggtggtacggcttggcgcccttgaaggacggcaggaacgagtggtggatgttgatggccttgccggtaagttcggtgcagagctcgtcggacaggatctgcatgtagcgggccaggacggtcagttcgatgtcgtgctcggcgatgatggcgcggagcttgtcctcagcctggaccttcgtgtccttggtgaccgggatgtagtggaacgggatgccgtagaactcggccagcccggccaggtcctggtggttggagacgatggcggggatctcaatgggcagcgtgcccgagcgctgctggaacagcaggtcgttgaggcagtgggcggaggtgctggccatcaccagggtgcggaccttctgtcccaccgcgttcaggctccactgcatgccaaaggcgtcggcgaccggctccagagctgcccggagctctgacgcgggcgccgccgtcgtcacctccacccgcatgaagaagttgccggtggcggggctgccgtactgctgcgaatccgtaatattgcatcccgccaccagcagggcgccggccaccgcatggacgattcccgggcggtccgggcaggacagggttactacgtacgcttgcttcagctgctcttcactcacgcgtaatagcctacccgcgcagcagcccccggttttggtacgctgggatggtcgcaactggcgttgggtggctaaccaccagggagcggcaatcacgaagaccacggatcgtacgcctgggccgagggtcatgtcttgccggatgtggggctgcacctgcgttagtaccgcagcaccatgcccgcagcttccacgcgctgtcatcagtgcggcgtgaaggtgcgccagccggtagcctgaccttagcagtgcccgtacgcctagccaggagttctttcgtgactacagccacctccaccaccgccgtcagcaatcagccgctggccgagcttgaccccgaaatcgcagcagtccttgaccaggagctcggccgccagcgcggcaccctggaaatgattgcctccgagaacttcgccccccgcgccgtcatggaagcgcagggctccgtcctcaccaacaagtacgccgagggctacccgggccgccgctactacggcggctgcgaatacgttgacgtagcagagcaactggccatcgacagggtcaaggccctcttcgacgcggagtacgccaacgtccagccgcactccggtgcccaggccaacgccgctgcactctccgccatgatcacccccggcgacaagatcctgggcctgtccctggcccacggcggccacctgacacacggcatgaagctgaacttctccggcaagctctacaacgtggctgcctaccaggtggagcaggacaacttccgcgtcgacatggacaagctccgtgagcaggccattgccgagaagccgcaggtcatcattgccggctggtctgcctacccgcgccacctggacttcgccgccttccgctccatcgccgacgaggttggcgcgctgctctggaccgacatggcgcacttcgccggcctggttgccgccggactgcacccgagcccggtgccgcactccgacgtcgtcacctccaccgtgcacaagaccctcgccggcccgcgttccggtgtgatcctggccaagcaggagtgggccaagaagctcaactccaacgtcttcccgggccagcagggcggcccgctcatgcacgttatcgccgccaaggccgtggccttcaagatcgccggcaccgaggagttcaaggagcgccaggagcgcgtcctcgagggtgcgaagatcatcgccgaccgcctcaaccaggccgatgttgccgaagccggcgtttccgtcctcaccggcggcacggacgtccacttggtcctggttgacctccgcaactcgcagctggacggccagcaggccgaggacctcctgcactccgtgggcatcaccgtgaaccgcaacgccgttccgttcgatccccgcccgccgatggtcacctccggcctgcgcatcggcacccccgccctggcaacccgcggcttcggcgcggccgaattcaccgaggtggcggagatcatcgccaccgcgctgaaggccggcaacagcgccgacgtggagtccctgcaggcccgtgtggacaagctcgccgccgacttcccgctgtacccgcagcacgagcagtggtgacccatgactgagatgaccaagaccgcgaagatccttgacggcaaggccgcagctgcagccatcaagtccgaactgaccgaacgcgtggccgcgctcaaggccaggggcgtcactcccggcattgcaacagtgctcgtgggtgcagaccccgcttcgcagctgtatgtgtccatgaagcacaagcagtccgagcagatcgggatgaactcgatccagcgggagctgccggcggacgccacgcaggcacaggttgaggcccttattgacgagctcaatgcggaccccgcctgccacgggtacatcgtgcagctgccgctgccgaagcacctggacaccgacgccatccttgagcgcatcgaccccgccaaggatgcggacggactgcaccccaccaaccttggccggctggtgctcaacgtcaacggtgagatcacctcgccgctgccgtgcacgccccgcggcgtcatcgagctcttggagcgcaacggcttcagcctcgccggcaagcacgtggtggtggtgggccgcggtgtcacgatcggccgctcgatcggactgctgctgacgcggcgggccgtgaacgccacggtgaccctgacgcacacaggcaccgagaacctttccgaactgctgcggcaggctgacgtgattgtgggcgccgccggcgtcaagcacatcgtcaaggccgcggacgtgaagccgggtgcagccctgctggacgtcggtgtcacccgcgaaaccgaccccgagaccggcaagagcagggtctttggcgacatcgatcccgccgctgccgaggttgccgggtggatttcgccgaaccccgggggcgtcggtccaatgaccgtggcgctgctgatgaccaacgtggtggaagccgccgaacgccaagcggcacagaaaagcggcgcgtagtttcctttcatcgcccgacggcggtacggcaccttgttaaaaaaggtgcggtaccgccgtcgtactttaaaggtggaagtggaagtccccttccacctgcccgccggctctattagtctgcggagggtgcacaacaaagccaccatgtcctccggcagcgcaaccggcgccgtccagccagccgatgagccacccaccgaagcccacccgaccgtcatcacggcagaaaacctgaccaagacctacgacgatgttgccgccgtggacggcatttcgttcagcgtccccgcgggggagtccttcggcctattggggccaaacggcgccggcaagtccaccaccatgaagatgatcggcggagttaccaggcgcacctccggcgccctccacatcatgggcctcgaccccgactcgcacgggcccgaggtgcgggcccacctgggcgtggtgccgcagcaggacaacctggacgaggaactccgggtccgcgacaacctcctggtctacggccggtacttcggcctgcccatgagctacctgaagccgaaagccgatgaactgctggagttcgcccagctgacggacaaggcaaagtccaaggtggacgcgctgtccggcggcatgaagcggcggctgaccatcgcccgttcgctcatcaacgaaccgcggatcctgctgctggacgaacccaccaccgggctcgatccgcaggcgcggcacatcctgtgggaccgccttttccggctcaaggagcagggcgtcacgctgatcctgaccacgcactatatggacgaggccgagcagctgtgcgaccggctgatcgtggtggacaagggccggatcatggctgagggatcgcccgcgcagctgatccgcgagcactccacccgcgaggtggttgagctgcggttcggatccgagcggaacaccaccatcgccgcggagctgcagggcatcggggagcggctggaggtcctgccggaccgggtgctcatttacgcgcacgacggcgagtccgcccttgagcaggtggcgtcccgcggcctgcggccgctgacatcattggtgcggaggtcctcgctggaggacgtgttcctgcggctgacaggcagaagccttgttgactgagggccacgcgccgacggagggtcctgccacggaggccctgcgggcccacagccccgaaatagcggccgccagggcacggcgatggggcgcgttctattacgccgagcaggtgctgcgggtgatgaagggctacggctggtccatcatcatgtacagcgtgggccacccagtggcctatctgtttgccatgggggtgggcctggccacccttgttgacgcccagggcgctggagcattcgggggagtaggctatgtgaccttcgtggccccggcgctgctggtttccgcggccgttatgacggccgccaacgagttcacgtaccctgtgatggacggcttcaaatggcgccgcacctactacgggccgcacgcctcgccgctgactccgcagcagattgcggcgggccacatcatggcggtgaccctgcggctcctcctgcaatccgccgtctacttcgccgcggttgtcctgttcggtgccgcaccgggcggctggggctgggccaccgttgtggtggcgacggttgccggcctctcctttggcctgccgctgatggcgtactcggcatccatcaccgaggacaagggccagttcgccctggtgatgcgttttatcgtgatgccgctgttcctgttctcagggactttctttccgctggacaaccttccgctggcggtgcgctgggtgggctggatctcgcccatctggcatgccaccgaactggggcgggtgttcagctacgggtaccagcagccgccgctgctgactgtcctccacgcggtggtgcttgtgggcctggcggtgctgggctggttcctgacccggcggcagttcgcggtaaggatgggcaagtgagcgccgggctgccagtaaaaagcgcgccggaccaggcccgcagcaggacgttcggaccgctgtattcgcgcaacgccaaggcggtgatttcgcgcggactgctggccacccggagcaccaactggctggtgatgctctccgggttcttcgagccggtcctgttcctcatctccatgggggtggggctcggcgcaatcgtaggctccgtccagggccccggcggcggggagatcagctatgccgcgtacattgcccctgcactgctggcagtctcggcgatgaacggtgccgtctacgactccacctggaacgtgttcttcaagatgaacttcgcgaagctgtaccagggcatgctgtatacgtcgctgggaccgctggatgttgccctcggggagatcttcctggcactgctgcgcggcctgctctacgccatagggttcacggcggtgatgggggttatgggtttgattaccacaccatgggcgctcctgatggtgcctgcctccgtgctgatcgccttcgggttcgcgagtatcgggatggggatcaccagtttcctgaagaccttccagcagatggactgggtcaacttcgtgatgctgcccatgttcctgttcagcgccaccttctacccgctgaacgtctacccgcaagccatccagtggctgatccaggcaatgccgctctggcacggcgtcgagctgctgcgccagatcagcgtgggcacgttcaccgctgccacccccatccacatcggctactacctggtgatgaccgccgccggcatgctgctcacaactgtcaggctgcggcagctcttcctgaagtagcccccaactaggtagcgccaagtgtcgttttgggcgtccaaaacgacacttggcgctacccagttgctatatgttcgccgggggtggaagggggccggagcatactccggcatttgagagaatgggtgcatgcaatctctgggcagctccaagtcatcctccaaacccgccaggggcggattctccatgttccgcatcagcgggcccggactgatggtcctcgtcaccgccttcgttgtggccgtcatcttcgcggccaaccaaaacgacgtcgtgggctgggttgttgccatcatcgccgccttctggctggccctcgcctgctttgttgtcttcagcatccagaaggccgccaaaaaggcaggagcaaagctgacggaagcccagaacgccttcagtaccgctgcggggcggggcccgtacgcctcggccgaccagggcggaacccgggtggtcgccgagcgcagccaggcggacgaggtccgcgacctcaagctggaccactcgttcaagatcgtccaggtgcagatccgcgtggtggaggaggaacgcgccaagggcatcgctgccaaccaggacaccatcaaccgggccctggaaaccattgagatcacagccaccaatgcacgggacatgatcaagtcctccggcggcagtggagagccggtcaccggaaccatcatcgactagagtggagcgggtgatctcggcattgaagaaggaccaccttcgcatcgcgtccgttaatgtcaacggcctccgggctgcctacaaaaacggaatggcggcgtggctggagccgcgcggagtggacatcctctgcctgcaggaagtccgcgcccccgacgccatcgtccggcagctgctgggcgaaggctggcacatcatgcacgccgaggctgaagccaaaggccgcgccggcgtcgcaatcgcttcccgggacgaacccctggcaacccgtaacggcattggcgacgattactttgccaccgccggacgctgggtggaagccgatttccgtttcgccgatgccgccggacaccctgtccagctcactgttgcgagtgcctatgtccactccggtgaggtgggcacgcccaagcaggatgacaagttccggttcctggatgtcatgaccacacggctgccggaactgaccaagcacagcgaccacgccctggtggtgggtgacctcaatgtggcccacacaccactggacatccgcaactcgaaggccaacctcaagaaggcgggccacctgccggaggaacgcgcctactttgaccggttctttggcgaagagatcggctggcaggacgtacaccgcaacctggccggccaggtggacggtccctatacgtggtggtcccagcgcggaaaggcgttcgacaacgacaccggctggcgcatcgactaccacctggccaccccggccctggcggcggctgcaatctcggccgttgttgaccgggcgccctcgtgggacacccgcttctccgaccatgccccgctggtagtggactaccagctctgagccccgaaggtttcctccccaatgactagccagatctcccaggcaaccaagaagcgcatcctgtccggcgccaagcccacagccgactccctgcacctgggcaactacatcggcgccgtccgcaactgggttgacatgcaggcagagtatgacgccgtcttcttcattccggacctgcacgccatcacggtggacttcgatcccgccgaactggccaagcgcacccggattgtggccgcccagtacatcgccgcgggcatcgacccggacaagagcatcttctttgtccagtcccatgtgccggagcacgcgcagctcgcctgggcgctgaactgcatcaccggattcggcgaagcctcgcggatgacccagttcaaggacaaaacccagaagtccggcgccgacgccgccaccctgggcctgttcgcctaccccaccctgatggccgcggacatcctgctgtaccagactgacctggtgcccgtgggagaggaccagcgccagcacctggagctcacccgcaacctggcccagcgcttcaacacccggtttggccacacattcactgttcccgaggcgacgatcgtcaaggaaagcgccaagatctacgatcttcagaaccccagcgccaagatgtccaagacgggggagtcccccaacggggccatccagcttctggaagatccgaaggtcgcagccaagcggatcaaatcggcagtgaccgacgccggaaccgaaatccgcttcgacgccgaagaaaagccgggcatctcaaacctgctgaccatctactcgtccctgacgggcaaaaccatccctgagctcgaaaccgaataccagggcaagatgtacggccacctcaaggtggacctcgccgaggtgatggttgagttcgttacgcctttgcgggaccgcaccaatgagctgatgtccgatcctgccgagctggacaggctgctcgcacacggtgcggagcgcgcccgcgagatcgcctcggtcaccctcgcacaggtgtacgagcgcatgggcttccttccgtccctcagccttgccggagtccgctagcgccatgtcgtccagcaaagtcgcggcaagggaaggtgcccgtgccacccaccgggtggcggggacgcccggcggttcccacgcagaccctgcggatcaccgtgctgcggcagccagccccgtgtcccgcccggaggacatcagcgttggcgtcatcctggggttcccggccgacattgcggaggagctgcagcgctggcgggcgtccttcggcgatcccctggcggacgttgtgccggcccacatcacgctggtcaccaccaccacaacgcgggactgggagggcacgctggagcatgtccgcgaggtggcccgccagcaaagccctttcaaggtcaccatcgcaggcacggggacgttccggcctgtttccccggtagtcttcatcaacgtggaggacgggttcgaggactgcgttgacctccacgaaaaacttcagcagggccccctccaccgtgagctgccgttcgcgtaccacccgcacgtcaccatcgcgcacgacgtcgcaccggaaaacctcgatgaagccgaaacggtgctgaggaactacagggccaccttccccgtggttagcatgggactttacgagcacgatgccaacggcatctggcagctacgggaagagctggactttgggacccaaactgacgacgacggcaccagacccgcggattccgccccgggcacagccgaaacaggcgggacagcagccgcttcccactgaccaggcccacctgaagctggccgtcatccagaaacggatggaatggaacagggcacgcagggccggaagcgggcccgtggccagcctaatggccatgtcacagtggctgcttgcccgcctgaacgcgatccgccccatgcgcgccttccggcactacagcctccagcacggcccgctgatgagcgccggcatcgggttcaatatgtttttctcgatcaccggcctcctcgccaccggcttttccatcgccgggctggtcctgaggggacagcccgtactgctggagaccattatcggcagtgtggcccagagcgctccgggtctcttgaaagtcaacggcagtgagggattggttgacccccaggacctgctgaatccggacggactgggctggactgcggccatcgcggcagccgtaaccgtctatacgtcgctccggtggattgcgagcctgcgggacggtctccgtggcgtgctggaattgcccccgtcactggtcaaccccatcctcctgaaactgcgcgacgccggaaccctgctgctgctgggcgtggccctggtgatcagtgccggcgcgtccctcgtctttggcacggccgccggatgggtcgcggacttcctgcagctcgacgacgcactggccggccccctgaccacgtccatcaaaattggcgtacccctcgttttgaactgggttaccgcgctcatcatgttccggctggccggaagcttgaagctctcgcgccgcgcactgctggaaggcaccatcctggctgcactgggcaccacggtcctgcagattttcagtaccgagcttctcgccggtgccggccgcaatccgctccttgcaccctttgccatcatcatcggcctgttgatctggttcaacctggtgagccaggtgtacctcgtgtctgcgggctggtctgcagtccgcgaggctgaccacggcaccgcatcctccggccacgagaaaggaacctggggcgcccgccaggtccagccggggaaagtgccggtccagcctggcaaagtgccggcacaagcggaggccggcatgcagagcccggcccgtgccgcagccgcccggcgcagggcaacggc

SEQ ID NO: 28 - DNA, 90820 bp, Arthrobacter sp. OY3WO11
ggtgcagccaccagcccttcccacgccactgtccagccggcgggaaaccccggggcatgccggtccggtccgccgtcccagcccgctgccatcagggcagcagcggcgagcagtccgccgttgccggggagatacagcggcagcgaatcggtttggcggttgtgcccgttgggcagcactgtgttcttcccggcgtccagcaggagggcgttgacggcggcctccgggtcttcaaggcgcgcggcggtcatggccatcacgggatagtcccagccccaggtgctgccccaatcccagtcggcgaggacgctggcgagcgttgcccgcatgatgtccttttcgatcaagtcggtttctggcaggacgccgagtgcgcacagcatcgaggggtggtccgtccggatggtgaaaggctccacgtcaatggccgcgtagacgccgtcctgtacccgtggcttcaccaggtggccggccacctcctgccacgctggaacgggctcaagccccaaccggtcccgccacgcggatgcagcccgcagggaccactgccagtacgccagttcgaaggtggggttggtgacggacgcccggatggagccgtagctctcctgcgcgggaatcaggggcggaccaagctcaaagccccgcggcgtccggtgcgcgaagcttgccatgaacgcggcggattcgaacacgatctccgcaaactcctcgagcacctcccggctggggttggcgcggtaggcaagttccgccaggtggacgggatgcggctgctgccagaccaggaaggtgccgatagggctggggctctccctcccgtccggacctacctgcttgggccagcggacgccgtcgaacccctgcgccctggcggtctgccgcgatgcctccaggacggtggagtaccagcgcagcgacgggagcaggtgttccacccggttccagtgggcgaagtgcgcggcgtgccaccagtgcatttccaggtggaagcgcccccgccaggagttgcacaccagcccggtttcctggggaggcagggacccggagcagttgatggccgtcaggtactgcgagaggacgatcctgcgttcgagctccttcgcccgcgggtcatccgtcgcggcaagctcgatggcgccgccggacagccagaagccgggccagtacgcctcagaggcagctgccacgctgctgcccgctgcaggggcggccggtccggaaagcacgacggcgggcctggctgctgtgcccgtgtccggcctggctgcggccagggtagcgccggtttcaccgcgggggacgcagtcgccgtcccctgcggagacgaaagcaacagcgaggtccatcacgccctggccagcgctgccgaccgggttggggcttatccggagacggtgctgcccggtctgcgccacggtgagaccgcgtccagtgatcacaacctggtagcgggacttatccagctcgcggtaggcggtccaggcggtggatccggcatgcaggccggattcggccggttccccgagcctggtggtatgggagtccgggctggtccagtccgcggcgtcgtgccatgcctctgagccgtaagggaagtcgatggtgatggccaggcggtcctggaggcccggggactccacgcggatgccgagctcgtcgcgttcggggtggcacgccgtcgtgaccgtcaccgggtggccggccagcctgaagcggctcgtgaccgtcccggtccacaggtcgagcgtctgctcggcgtcggcaacgtccccttcggtgagggcgcgctcttctcccgcatccacaagactgaagccgacacgtcccagatccaggcggtgcgggttggcccgcagccacgtttcggcgagggacgtgccggtttcgcggtcgttgacgatgtcgcccaccatgtccacgtagggcacgggtccacgcggggagtcatagaggaccgtggagcctgagagttcgtaggcctgggcgggcggtgtggcatgccatccccactgggcctgcgtgccaaggagtgttcccggcggcagttcatcccttgcccccacgggataggcccctgggagtgactggaggccggtgaggtccatcgtgaaggcaaactcaccgttgcccacggacacggggctttgcgggtcgagtacctgctggaggacgttgtggcgccggacgagcgcgttcctgtcaatgggggcgcttgtgcgtatccccggtgacggtgaggccgcccgggaggtgctgttgggattgctcactgtaactgtcttcctggcgttgttcggctgttactgaagactgctgccggaggggcaagaaccacggtgtcctccagctccttgaggtgatggaaggaagcccgctcctgcggactgttgttcggctggtgcagggtgagaaagagttggccgtccaacgtgcgggcgatcatgccatggccgccgtcggtaccccacagcggctcatcctcctggatccatggacccaggaccgtaccggacacgctgcgcgcgatgcccatggcgtagccgtggtctccgaagctggaccacagcatgatgaggctgccgctgctgagccggtgcaggtaggggccgtcggtgacgtagaccgggaagtccagtgctcttgttgagggaacctcgagggggcgggaccagggtgcatcggaagcgctgaacaggaagacgggagtcccctcggctttccgaaggtccgggctcagccgctgggccatgacggtaccgtcgtggacctgcttccattcgtggcagaagaccatccacggcgcaccgtcaccatccacgtgaagcgtgccgtcgaggcactgccagttccggggagtgacggggccgtggctccagggcgtgtacggaccctccgggcggtttgctgaaagtatctgggtgccgcggaaatgtccgggcgccgtgaaggtggcaaacatgaagtagcggcccctgtaataatgcacttccggagcccaatattgctcgtggctccagaaccctggcggaggacggaaagcgggaacgggaccctcccagtggaccaggtccgaactgcggtagcagtcgaatccggtggcgggtccggaccagagattggggtcagtgcttccaaacagcaggtactcgttggactccggaagcggcaggacgaagggatcccgtatctgtatttcactcaactgcagtgccatgctgtccgatctctggtcctgcgggcgccccgccccgcggggtttgggagggctattgacccctcaacggcatcttgatacgtttcacgaaaccgttttctgacgccagaaggaagcatacccaatggagcgtagccttttccggatattccgtaaatcagttgcagccatcgcagctgtaagcctggtgagcctcaccgcagcctgctccagtacgccgtccaacgaagcgcaggacgggcccgttgaaatacgtttctcctggtggggcaatgaggggcgggcgcagttgaccaccaaggccatcgcggaattcgaggccgccaacccggacatcaaggtgaaacccgaatacggcgacatcagcggctactttgacaaacttgccacgcaggtggccgccaacgacgctcccgatgtcatcacgatgggcggggcctatcccgccgagtacgccaaccgcggcgcactgttggatctgtccaaggtcggcggggcgttggacctgtcctctatggacccgggcgcgctggagaacggccaggtccagggcacgcaatacggtgtttccaccggtgccaacgccctcgccatcgttatcaatcccgctgttttcgccgccgccggggtaccactgccggatgacagcacgtggggctgggacgacttcgcgaagaccgcggcggatattacggccaagagccccaagggcacctacggaacggcaacggtcctcacccacgattcactggatgcctttgcccgccagcgcggcgaatcgctctacacccaggacggccagctgggcctgggcaaggaaactgtgcaggactacttcgacttctccttgaaactgagcgaatccggggcggcgccaaacgcatccgaaacggtggagaagctgaacgtcagcaccgaacagaccctcatgggcatgggccaggccggcatgatgctcacctggagcaactcgctgtccgcactcagcaaggcctccggcgcgggcttgttgctgctcaagcttcccggcgaaaggccaaccgcgggcatctggctccagtcatcccagttctacacgatctcggcccgcagcaagcacaccgaagctgcggccaagctggtggatttcctggtcaacaacgagtccgccgccaagatcatccagagcgaccgcggcgtacccagcaattccggcatgcgcaccgccatccaggacctgctgacgccgcaggggaaggtggaggcggagtacatcgaccagatcggcaagatggacttcgccccgacctacataggacccaccggttcaaccgcagtctcggagatcactgcccgcatgaacaccgacgtcctgttcaagcggctctcgcccgagaaggccgccgagcagtggatcagcgaaagcaatgccgcaatcggcaagtaggcacctgttccgggcaggaggcggtcgacgccggccggctactgcccggcgtcgaggtactggtcggcccaggcggcgatgatccgggcagcccgcgccgcctggccctttccggtgaggagatggtcgcttccctcgagggaaacgaagttcctggggtggcgggccgtctggaaaatggtgctggcattctcgatccccacggtgttgtccgtgggggagtggagcaccatcagcggcttgtgcagctgcttgatgcaatccgtcaggtccgcattctccaggtcctccacgaagtgcttgcggatctccacccgtttcccgccaaggtccacttcggcgctgccctcactcaggatcttgtccagggctgcgtcgaagacgtgcgccacgtgcttaggcgagaagggggcgccaacggtagctacggcgtcgagctccgggatctcccgtgccgcagccaggacggccgcgccgccgaaggaatggcccaccagcagggagatctgcttcccctcggcgcgcatgaactcagcagccttgacggtgtccgccaccttgtggctgaatgatcccgcggaccactcaccagcggagccgcccaggcccagattgtcgaacctcagcatgcccacgccgctgtccgccagcgccttgcacatccgtgaggcggaagggctgtccttgccgagggtgaagccgtgcgaaaaaacgccccagcccttgactggtccttccgggacatcgatgatgccggacagcgtttcgccggtggagccttcgaaagtgactttttcggagcgggacacggcgtcccctttcgtttggtacgaatggctgtgggcccacgcccgccgggttccctggccgagcttgcgaggtcagggggcgggtggggagaaacaacgacggcgccgcatccccggtgtggggaggggcgccgtcgtccgctggatccgtgtggtcagatcttgcgggagagaatcgcctgcttgacttcggcgatggcctgggtcacctggatgccgcgcgggcatgcttcggagcagttgaaggtggtgcggcagcgccacacgccttccttgtcgttgaggatctccaggcgcatgtcgccggcgtcatcacgtgaatcaaagataaagcggtgggcgttgacgatcgcggcaggaccgaagtactggccgtcggtccagaacaccgggcaggaggacgtgcacgcggcgcagaggatgcacttggtggtgtcatcgaaacgctcacggtcctcggcggactgcaggcgttcccgggtgggctcgtggcccttgttgaccaggaagggcatgacctcgcgaaacgactggaagaacggttccatgtccacgatcaggtccttctccaccggcaggcccttgatcggctcgaccgtgatgggcttggacgtgtccaggtccttcaggagcgtcttgcaggcgaggcggttgcggccgttgatgcgcatggcatcggagccacagacgccgtgcgcacaggaccggcggaaggagagtgtgccgtccgtttcccacttgaccttgtgcagggcatccaggacacggtccgtgccgtacatggtcaggtggaagtcgtcccaggtggcttcctcggaaacctccgggttgtaccggcggacgcgcaggtgcacatcgaacgtggggatctcgccgccaccgccgacgccggcaggcagttcaatctttgaggctggctcagcaagttcagctgacatcttagtacttcctcaccatcggctcgtagcgggtaaagacgaccggtttggtggccaggcggatgccggcgattgactctgccgatccgtctgccggcgcgtggtcatccttgtacgccatggagtgcttcatgaatttttcgtcgttgcggtccgggaagtcctcgcggaagtgtccgccgcgggattcctcacggtagagggctgcaacggtcatcaccttggccagttccagcaggaagccgagctcaacggcttcgagcaggtcaaggttgaagcgcttgcccttgtcctggacgttgatccgcttgtaccgctcctcgaaggaggcgatgtcgcgcaggacctggtttagggtttccgccgtgcggaacacctgcatgttggcgtccatggtgtcctggagttccttgcggatcacggccaccttttcgtcgccggtgccgttgcgggcaatgtccagcagttcggtggtgtaggccagcgggttctccggcagttccacgaagtcggccgtcttggcgtattcggccgccgcgatacctgcgcgcttgccgaacacgttgatgtccagcagcgagttggtgcccaggcggttggagccgtgaaccgaaacgcaggccacttcgccggctgcatacagtccggggaccacggtgtcgttgtcctgcaggacctcggtggtgatgttggtggggatgccgcccatggcgtagtgagccgtcgggaacacgggaaccggctccgtgtagggctcgacgccgaggtaggtgcgggcgaactcggtgatgtccggcagcttggcatcgatgtgcgccggctccaggtgcgtcaggtccaggaggacgtagtccttgttcgggccgcagccgcggccttcgcggacctcgttggccatggagcgtgcaacgatgtcgcggggggccaggtccttgatggtgggggcgtaacgctccatgaagcgctcaccctccgagttgcggaggatggcaccctcgccacgggcagcttcggacagcaggatgcccagtccggcgaggcctgtcgggtggaactggaagaattccatgtcctccagggggatgccgcggcggaaggctatgcccatgccgtcaccggtgagggtgtgggcgttggaggtggtcttgaagaccttgcctgcgccgccggaggcgaagaccacggacttggcctggaagacgtgcagttcaccggaagcgaggtcgtaggacacgacgccggcaacacgcttctgcttatagggcgtgccgtcctcgcggacagcatcctcttcaaccgtcagcaggtccaggacgtagtactcgttgtagaactcgacgttgtgcttgacgcagttctggtacagggtctgcaggatcatgtggccggtgcggtccgcggcgtagcaggcacggcgcacgggggccttgccgtgatcgcgggtgtgcccgccgaagcggcgctggtcaatccggccttcgggcgtgcggttgaacggcaggcccatcttttccaggtccagcacggcgtcgatggcttccttcgccatgacctccgcggcgtcctggtcaaccaggtagtcgccgcccttgacggtgtcgaacgtgtgccactcccagttgtcttcctcgacgttggcgagtgctgcacacatgccaccctgcgcggcacctgtgtgcgagcgggtggggtagagcttggtcagtactgctgtgcgggcgcgctgaccggattcgatcgcggcgcgcatgccagcgccaccggcaccgacgatgacgacgtcgtacttatggacctgcataccagacgctctttctctcaaaattcgctataaaacaacggggcggcgttgccggccccgcacaacagggcccgcggtgattcccgcgggcccggagtggtgccggtgctaggcagggcagaaaccgccgggcaggggcacgccgtcaacgacggggcagggatcaaaggtgaagatcaccagggtgcccaggacgatgatgacgacggtggccgagtaaaggaccgtcttcagccagcggcgggttgagtctttttcggcgtagtcgttgatgatggtgcgcacgccgttggttccatgcagcatggccagccacagcattgcaaggtcccagaactgccagaacggatcggcccacttgccggctacgaagccgaagtcgatggcgtggatgccttcgcccaccataaggttcacgaagaggtgcccgaagatgagcaccaccaggaccacgccggagaggcgcatgaagagccatgcgaccatctcgaagttgcccttgctgccaccgtggcggcggtactggggtgcgatccgcccgctcatgtttccgctgcgcgggttttcgatggttgcactcatggctagtgacctccgagggcgagcgacaggtggcggatggagaaggcgaccatggtgaccagccagaggcccaggactgcccagagcatctgacgctggtacttggcgcccttcttccagaagtcaaccgcgatgatacgcaggccgttgaatgcgtggaaaacaatggcggcaacaaggccggtttcacccagggccataagggggttcttgtacgcaccgatcacggcggtgtaggcctcgggagacacacgcaccaaggaggtgtccaaaacgtggaccaacaagaagaaaaagatcactacaccggtaatgcggtgtcctacccaggaccacatgccttcacggccgcggtacaaggtgccagctggttttgtcggcactgataaacctccctgcaacacagcggcgctggcatgagatccacgcggggggaacgcctgctgcgagagcactcgtagctcgggcctaaatctaggctccgctaacagcttattcaatttaggagctccttggtgaccagcagtggcgcggatcttccaaaaaaatgagacaaaggacacactgcgcgccggtgggtgctccgtgcggggctgctggccggccggcatgagggtggtttggggattgaataagcggaaaactgcctacgaaggcggcgcgccggggttccgctaaagtaggcgttgatgagtacagacaaagtgacaagcccggcatccccccttgaccgcttcattgcggtgatcccggccggcggtgtggggacccgcctctggcccctgtcacgcgccgcagctcccaaattccttcacgacctcaccggctcgggcagtacgctcctgcgcgccacctatgaccggctgcacccgctggccggaagcaaggtgctggtggtcaccggaacggcccaccgggatgccgtgtgccggcagcttcccgaagtccaggattcggacctcgtcctcgaatccgagccgaaggactctgcggcggcgatcggccttgccgcggccatcctgcacgaacgcgaccccgacaccatcatgggttccttcgctgccgaccaggtgatcagcccggacaaccttttccagcaggccgtccgcgaggcaatttacacagccgcggccggcaagatcgtgaccatcggcatcaagcccacccacccctccacggggttcggctacattcgatccggccaggaactgcacatcgagggcgctcccagtgcccttgacgtggtggagttcgtggaaaagccggacgaggcagtggcccagcagtacgtggacagcggcaactacgtgtggaacgccgggatgttcgtggcaccggtcgccctgctgctcaagcacctggaagccaaccagccggaactgttccgcggcctgcaggaaatcgcccaggcgtgggacacccccgcccgcgacgaggtcaccgcccgggtatggcccaccctgcccaagatcgccatcgactacgcggtggccgagcctgccgccgaggccggggacgtcgccgtcgtgcccggttccttccgctgggacgacgtcggggacttcgcctccgtgggccggctcaacagcgccaaggaagtggacgacgtcacggtgcttggcgaaggcgcgcgtgtcttcacggaaaattccagcggtgtggtggttacggataccaagcgcgtcattgccctgatcggaatccaggacgtcgtcatcgttgacacgccggacgccctcctggtgaccaccatggcaaactcgcagcgggtgaaggccgccgttgatgccctcaaggccagcggggacaccgacgtcctttgatgtaacgcggcgaccgtgatggccggtaattacccgaccctcgctagagtgaaacagtgcgcaactacactactgaagccgagcccaccgacctggtggctccgtggctcgagccgctactgccggaacttatcgacttccggcgtgacctgcacgcgcatccggaactgtccttcaaggagttccgcaccacggacaagctggccgaacggctcgaggccgctggcctcacgccccgccgcctcgaaggaaccggtctcaccgtggacgtgggggaggggcccatcgccacggcgcttcgtggtgatattgacgccctgcccatcattgaggaaacagggctgcccttcgcctcgaagaaccacggtgtcacccacgcctgcggccatgacgtccacaccaccaccatgctgggcatcgccctggtgctgcaccggatgcacaaggaagagccgctgggggccaccgtccgcatcatcttccagcccgccgaggaaaccatgcccggcggcgcccacgcctgcatcgaacagggggtgctggagggcgttccgcggatcctggcactgcactgcgatccgcggatcgaggtgggcaagatcggtacccgcatcggcgccatcacctcagcttccgacaccatccgcatcgagctgtcagggcgcggcggacacacctcccgcccgcacctgaccgaagaactggtgttcgcgctggcgcagatcgcggtcaacgtgcctgctgtcctctcgcgccgggtggatgtccgcagcggagtctccgtggtctgggggcagatctccgcaggatccgcacccaacgcaattcccggcaccggctacatggcgggaaccatgcgctgcctggaccgcgacgcctggcacgaggccggcgaactcctggacgaggtggtccaccaggtggcggcaccttacggtgtggacgtccggctcgagcacaccaggggagtccctccggtggtcaactccgagcacgaaaccgccatcatcgaggcggccgcccgcgccgaaatcggcgaaagtgccgtggtcctgacgccgcagtccatgggcggggaggatttcgcgtggttcctcgccgaacttcccggcgccatgatgcgcctgggcaccaagacgcccggaggcgaggagtacgacctgcaccgcggtgattacatcgtggacgagcaggccctcggcctggggatccgggtcctgacggcggcggcgctgcgcaccatccgccaccgctaggcccgcgccgcccgccgtcgtcgggctttcgtcctcccattcaacttcttgcatcccgcacttaagttgtgcacaacttacttgtgtactatcgttttctccatgaccgatgcacccaggctggaccaccaggtctgctttgcgctctattccgcctcccgggccgccaccgcggtgtaccgcccggtcctcgaggagctgggcctgacctatccccagtacctcgtgatgctcgtgctgtgggaaaacgaaccccgcggcgtgaaggagatcggcgaagagctcggcctggactccggcaccctgtcgccgttgctgaagcggctggaggccctggggctgtgtgagcgccgccggtcgggcgaggatgagcgccgcgtcgccatccatctcacccccgcggggcgggagctgagcggcaaggccggtgccattccgcagcggcttgcgcaggccgcggggctcaccgcggaggagctggaccagctgcgccacacgcttggccgcctgacggccgcgctgcacgacgcgcactgacggcaacggatcagaacttttcatcccaccaacacgacggagataacccgtgaaacctctttacactgccgaggccctcgcttccggcgaaggacgcgacggcactgcgcggaccaacgacggcaaactgaatgtcaccctgtccagccccgtcgaactgggcggaagcggccaggggaccaaccctgagcagctcttcgccgccggatatgcggcctgtttccactctgccctccggctggtgggccgcaaggaacaggccgacctgaccgactccgccgtggccgcgaaggtccacctgggccaactcggggacgccggctttggacttgccgcggagctggagattgccctgcccgcgctggaccttgccacggccgaggcgctggtggccaaggcgcaccagatctgcccctactccaacgcaacccgcggcaatatttccgtcgacatcaagatcctggagttcgccgcatgagccttccttccgttacccgcgaaatccagctggcctcgcgcccggtgggccgtcccgtcccggagaatttccggctggccgagtctgcgctgcccgaacttggtgacggccagatcctggtccggaacctgttcatctcggttgatccctacatgcgcggccgcatgaatgacgtgaagtcctattccgctccgttcgccctggataaagcgctcgacggcggcgcggtgggcgaggtgctggcgtcccgttccagccagcacaaggagggcgacgtcgtcgtgcattcccttggctggcgggagtatgcggtggttgagggggatgcggccaccaccgccgacactgggctggcgccggcgtccgcgttcctgggcgccctgggcatgaccggactcacggcctacgcaggcctgctgaaagttgcggagttcgctccgggagatgcggtattcgtctccggtgcagccggagccgtgggctcgctggtgggccagatcgccaaggcaatgggcgcttcgcgcgtcatcggctcggcaggctcgcccgccaaggtggcccggctgctggagctcggctttgacgccgccttcgactaccacgacgggccggttcgggatcagctggaaaaggctgccggtcccaacggcatcgacgtgtacttcgacaacgtgggcggcgaacaccttgaagcggcgctgtccgtcctcaacgtgggcggacgcgtggccatgtgcggcgcgatagcccagtacaactccaccgaaccgactcccgcgccccgcaacctgatgctcgccatcggcaagcagctcaccctcaagggtttcctggtgggcggccagcggcagcacgccgcggagttcgccgggaagatggctggctggctggctgacggcactgtccgctacgacgagaccatcgttgagggactggacaacgctccgcaggccttcatggacctcctggacggcgccaacaccggaaaaatgctggtccggctctaaggcggaccggccccgcccaaccagcaggggtgccgctttcacccggcgcccctactggttggtaacaacttgtaaacaatcttcgggataccctgccgccgtgctacgggcacgtggcgcaggccactaaagttggtgccatcagtgcgctccggcgcagtgctgcgtgccctcagtgaaaacagaatttcagtgcagaaacggacactcattgaattcgagccgtagcgcctctctcttcatcctggaggaaaattgaagaactcactgcgtgcaagtttcaagcggggttcaatggccggcgtggctaccctcggtgcttcggcgcttctgttgaccgcctgcggcgcagcacccgaagccggaagcacctcaacggcggaagccagcgactacaccggctgcatcgtctccgactccggcgggttcgatgaccagtccttcaaccagtcctcctacgaaggactgaagaaggccgagaccgacctggggatcaaggtcaaccaggtcgagtccaaaaccaacaacgacttcgagccgaacctgcgcgccatggtcagcgccggctgcgacctcaccgtcacggtggggttcctgctgggcgacgccaccaaggcccaggccgaggccaacccggacagccacttcgcgattgtcgacttcggctacgagacccctatcgccaacgtcaagccgatcatctacgacaccgcccaggcagcgttcctcgccgggtacctcgcagccggcaccaccaagaccggcacggttgccacctttggcggcatcaagctgcccaccgtcacgatcttcatggacggctacgcggatggcgtcaagtactacaacgagcagaagggcaaggacgtcaagctccttggctggaacaaggaagcccaggacggcagcttcaccggcgacttcgagaagcaggacgtcggcaagcagctcacccagaacttcctggaccagggcgcagatatcgtcatgcccgtagcaggtccggtgggcaagggcgccggctccgcactcaaggaagccaaagctgccggcaaggacgtcaagctgatctgggttgactccgacggctacctgacggcacccgattacaaggacatcatgctgtcctccgtcatgaagacgatgggcgacgccgtggaagccgtagtgaaggatgacaaggaaggcaacttcgacaacaccccgtacgtgggcacgctggccaatgacggcgtccagctggcaccgttccacgacctcgactcccaggtccccgcagaactgaagtccgagcttgagcagatcaagaaggacatcatcgacgggaaactgaagatcgaatccgaggcaagcccgaaggcctgatccctgcctgagcgccacccccggccggttaccgactggccgggcggtggcgcttttttgctggctgccccgcaccggaccgcagcccgcgtatcccaggactgcacccactaggctggtgctgcagccacatatcccgtccggtcgatcactggacgcttcgagattggtcagagttttgaaacttgaactcagagggatcactaaacgcttcggcaccctgcttgccaacgaccacatcgacgtggtggttgagcccggacagatccactgtctcctgggtgaaaacggggccggcaagtccaccctcatgaatgtgctgtacggcctttatgaaccgtccgagggcgacatcctcgttgacggcaggcctgtttccttccgcgggcccggtgacgccatggaggcgggcatcggcatggtccaccagcacttcatgctggtccccgtcttcaccgtcgcggagaacgtggcgctgggcgccgagcccaccaaagccgccgggttcctcaacctggacgagacgcgccgccggatcaaggaaatctcggaccagtacgggttcgacgttgatcccgacgccctcgtggaggacctgcccgttggcgtccagcagcgcgttgaaatcatcaaggcgctggtccgcaacgccaaagtcctcatcctggacgaacccaccgccgtcctgacaccccaggaaaccgacgaactgctggacatcatgcggcagctcaagtccggcgggacgtccatcgtcttcatttcgcacaaactgcgggaagtcaaggcagtctcggacaccatcacggtgatccggcgcggcaaagtggtagggacggccgacccggccgcctccaccaccgaactggcatccatgatggttggccgcgccgtcagcctcaccctggacaaagccccggcacagcccaaggaaaagacgttcgaggtccggaaccttaccgtcatcgcccccaacggccagcacgttgtggacggcctcagcttcgacatcgcccgcggagagatccttgctgtagccggcgtgcagggcaacggccagacggaactgaccgaggcgatcctcggcctccaggaccgggtgcacggttccatcctgctggacggtcaggagctcctgggccgcagcgtcaaagaggtgctgaatgccggcgtaggcttcgtccccgaggaccgctccgttgacggcctgatcggcaccttttccatcgcggagaacctgatcctggaccggtacgatcaagcgcccttcgccaagggcatcagcatgagccctgccagggttctggagaacgccaagagccggatcgaggagttcgatgtccggacgccgtcgggtgcacttgctgctggaacgttgtccggcggcaaccagcagaaagtggtgatggcccgcgagctgtcccgcccgctgcgattattcattgcctcccagcccacccgcggcgtggacgtgggatccatcgagttcctgcacaagcggattgttgccgaacgggaccaaggcacgccggtgatgatcatctccaccgaactggacgaggtcatggaactggctgaccgcattgccgtgctctacaaaggcaagctcgtgggcgtggtccaggccggcaccagccgcgacgtcctgggcctcatgatggccggcatcccgcccgaggaacacgtccaggccggaaaggccgcggacaccaccagtaccagcacctccgacgccgagggaggcgaccatgtctgaaaagcacccaccccaacacgctggaggcgagcccgccggccgggcgcagcagcccacccccgcggccgaggaaaccgccgcgctcgtatccgttgataccgccggcggcgccatggaaccgtccgccgtccctgcaaccgcccagagcggccagctcccgggcggtcccgacaccctgctccggaaaatcttcaccggcagcggcatggtttcggtcctggcggtcctgctggccctcatcatcggcggactgctcatcgccagcacggacaaacaggttgccaccaccgccacctacctcttcgcgcggcccaccgatttcctggccgccgtctggaacgcggccacccggtcctacatcgccttgttccagggctcggtcttcaacccgcggggcaacggggtggcagcccagttcgcgccctttatggaaaccctcaccatcgccactccactcatcacggccggcctgggcgttgccctggcgttccgcgcgggtcttttcaacatcggcgcgcagggccagatcatcgtggccggcatcctggccgcctgggtagggtttgcgctcgacctgccgatgggcctgcacctgctcctggtcctggtggccggcatcatcggcggtgccttctggggcggactcgtgggcgtcctcaaggcccgcaccggcgcacatgaggtcatcctgaccatcatgttcaactacatcgcgctgtatttcctgcggtacctcctgaacactcccgccttccagcggccgggggagtcgaaccccatctcgcccatcctggaccccaccgccgtctatccgcagattttcggcagccagtaccggcttcaccttggcttcctcctggccatagctgccaccgtcctggtgtggtggctcctgaaccgctccacggtgggcttcgagttccgtgccgtgggggcgaaccccaaggcggcgcagactgcgggtatcaacgtgtcccgctccaccatcctggtcatggcccttgccggtggcctggccggcatgtccggcgtggcacaggtggcgggaacggagaaggtcctcaccgacggtgtggccgccacgtacggttttgacgccatcacggttgccctgctggggcgctcgacgccgtggggcactttcgcggcgggcctgctgttcggcgccttccgcgccggagcggtccagatgcagatccagaccgggacccccatcgacatcgtgctggtggtccagtccctgattgtcctgtttattgcggctccgccgctggtccgggccatctttggcctgaacccccgtcgccggaagcccgcccgcccggccaagtcccgcgaggcagcaaccaccggaggtgcagcatgagcacgacagtatcctcatccaggcccggcaacccgcagcccgggaacgccggcaaggatgctgccgccgccactgtctccgccaagccggtgggctggaagacgccggtgttcctggcggccttcgcgctgattgcgctggtgtttttcgggctgctcgcacctaaccagaccgcaagcttcgggatctccacaggcagcgacttcttccagctgccggccatccaggtgaacgccttcgcgggcggcctggtgctgtccatcctcctgctggggctggctgcctacgccatctacctcaagaccaggggcaagcccgccccgggctggctcaccgtggcgttcatcgtcctgttcgtggccgcgttcctcatctgggtggtgggcggcgcccggacccccagcatctccctggccgggctcatcgccggttccgtcaccctggccgttccgctggtgttcggatcactgtccggcgtcctctgcgaacgggtgggcgtggtgaacatcgccatcgaaggccagctgctgggcggagcgttcaccgccgcaatcgtggccagcatgacgcagaaccccttcatcgggctgctggccgccgccgtggcaggtgccgcggtttccatggtgctggcgctgttcagcatcaagtacctggtcaaccagatcatcgtcggcgtagtcctgaacgtgctggtctccggcgtgacaggattcctgttcagcaccgtgatgcaggccaacaaggctcagttcaactccccgccagggctggacatcatcgagattcccgtcctgtccagcatcccggtcatcggccccatcctgttccgccagtccctggtgggctacctgatgtatatcgccgtcctggtggtctgggtgggcctcttcaaaaccaggtggggactccgcgtgcgggctgttggcgagcacccgcaggccgcggacaccctgggcatcaacgtcaacgccacccggttctggaacgtcaccctcggcggggcagtggccggcatcggcgggtccttcttcaccctggtggccatcgacagcttcaccaaggagatctccggcggccgtggcttcattgcccttgcggccctgatcttcggccggtggaacccgatcggggctttcttcgccgcgctgctgttcggatttgcggacaacctgcagagcatcgtcaccattatcggcacgccggttcccagccagttcatggccatgctcccgtacctggtgacggtcctggcggtggcgggactggtgggcaagtccaggggacccgcggccagcggcattccgtatgtcaagggctgagggcgtggacggagcaggcggcgtgcgcggcattgcagaccttggcacggcccagccggttgactgggaggcattgaaggtagccgccgtggcggcgatgcaccgtgcctatgttccctattcgaagttcccggtgggggctgcggccctcaccggcgacggccggctggtcagcggctgcaacgtggagaacgccagctacggcctcaccctctgcgccgaatgcgcgctggtggggaacctgcacatgacaggcggcggactgctccgcgcgttctactgcgtggacgggagcggcaacatcctgatgccctgcgggcgctgccggcagttgctgtacgagttccgcgctccggacatggagctcatgaccacccaaggcatcaagacgatggaccaggtgttgcccgacgcctttggtccccaacacctggaggaaacaccgtgactgacaaggtggcacagacccacgcagcggacaacaacgccgaaccgttcgacgccgtcgacatcatccgcgtaaagcgggacaaaggggtcctcagcccggagcagatcgactggaccatcgacgcctacacccgcggtgcgatcgccgacgagcagatggcggccctgaacatggccatcctgctcaacggcatgaaccgcaaggagattgcccgctggacggcggcgatgatcgcctccggcgagcggatggatttctccagcctccgcaggcccgacggcggcctgaagtacacgtcggacaagcactcaacgggcggtgtgggggacaagatcaccctgccgctcgcgccccttgtggcggtcttcggggtggctgttccgcagctctcaggccgggggctcggccacaccggcggcacgctggacaagctggagtccatcccggggtggcgtgcttccctgagcaatgaagagatccttgcccagctccaggacgtgggcgccgtgatttgcgccgccggtgccggcctggcgcccgctgacaagaagctctacgcgctgcgggatgtcaccggcacggtggaggccatccccctgatcgcctcgtccatcatgagcaagaaaatcgccgaagggaccggctcgctggttttggacgtcaaggtgggcagcggcgcgttcatgaaggatgaagccagggcgcgggagcttgccgagaccatggtgtcgctgggcaaggacgcgggcgtgaacaccgtcgcgttgctcaccaacatggacaccccgctgggactgacggcgggcaacgccatcgaggttgaggagtccctggaggtgctggctggcggcggtcccgacgacgtcgtggagctgaccgtgcggctcgctgaggaaatgctcgcctgcgcgggagttaccgacgccgatcccgccgccgcgctcaaggacggacgtgccatggatgtctggaaccgcatgatcgaagcccagggcggcgacccgcgggccaagctgcccgttgcccgcgagtccgaggtggtgtacgccccggcggacggggtgctcgtggaactggacgccctcgccgtcggtgtcgcagcctggcgcctcggggccggacgtgcccggaaggaggacgcagtccaggcaggcgccggagtccggatgcatgccaagcccggggccctggtccgcgcgggggaaccgctgatgaccctgctcacggacaccccggagcggttcgcgcgggccaaggaagcgctggaacatgcagtcgtcattgcaccggagggatccaggccggcacagcggttgatcatcgaccgaatagcatagggatccatgcaggccatcaatgacttcatcctcgccgccgccggacagccctgggtgctgttcgtcgtccttgcgtgctgcatcattgacggcttctttccgcccattcccagcgaatcggtggtggtgggcctgtccgcagtcgccgccaccgccgacgttcccaacccctggctgctgatgctggtggccgcgctgggtgccttcgcgggtgacaacatcgcctacctgattggccgccgggtgggtacccggcgctggtcgtggatgcgcgggccgaggatgcagagcgccttccggtgggccggcagggaactgcgcaagcggccggcgtcgctgatcctggtggcgcggtttgtcccgatcggcagggtggcggtcaacctcaccgccggggtcacgcagtatccacacctgcgcttcgtggggctgaccattctttcggcaaccctctgggccgggtactcggtgggaatcggactgtttttcggccaatggttcgaggacaaccacctgctgggggcggtcatcgccattgtgtgcgcggtggcgctggggatcgtggtggacctggtcatcaaccgcgtcaggcggcagccgccgatggtggagcggatgaaggaacccgaagcgtaggtgaagcgttgttccagcaggcaggggcgtagcgaaggtgccccggccatgggacacttagaaacgatttccgcttggctgggccactgacggccaagccaaattgcataggagcaacacccgcgtggagtttattaatgaggcagtgctccatgcagcggggcagtggtggatctacccgctcctgctggtgttcttcttcgttgacggctttgccatggtggtccccagcgaaaccctgatcgtggccctggcggccttttcccggcacagtggtgaaccgaacctctggatcctgggcatcactgccctggtcggagccatcgccggggacaacatggccttcatgctcggcaggcgcatcggcctgaagcgctggaagtggatgcggcgccccaaagtccagaaggccttcagctgggcccgctacgagctggacaagcgcggcgcagtgctgatcttcaccgcccgctacatcccctggggccgggtggccgtcaactacgttgcaggaagtacgggattcccgcaccgccgcttcttcctgctcgacgctttcgcctgcatcacctgggtgggctactccatcggcatcgggctcctggccagttcattcccgtggctgcatcacaatccgctcctcagcgccggcatcgcggtggtcttcgccatcgtgctgggtgtgctcctggaccatgtgctccggctgtggcacaagcacctcgcccggaacgacgcgcaggaggttgacgggtggctcgacggcggcccgtccggcgcccgcggtccacagaacggcagcgcggcgcactttgcttccgccgccggggacggtgaaccggcagccaagtagcggctggctttgggctcctgcccaccctaaggtgggaacgtgactgagcccattgttgacgctgcccctgccatcgatttcgacctgaagaatttgcccaaggtctccctccacgaccacctggacggaggactgcgcccggccaccatcatcgagctggcggaagccgttgggcacacactgccttccaccgatcccgttgcgctgggcgagtggttccgcgagtccgccaactcgggttcgctggtccgctacctggaaacctttgaccacaccgtcgccgtcatgcagacccacgagggcctgttccgcgtggccaaggagttcgttgaggacctcgctgacgacggcgtggtgtacggcgaggtgcggtgggcgcccgagcagcatctccagaagggcctctcactggatgaggccgtcgaggccgtgcaggaaggccttgaagccggcgtcgaggcagtgggggagagcggccgcgaaatccaggtgggccagctcatcaccgccatgcgccacgcggaccgcggccaggagatcgccgaactcgccgtccgccaccgcaacaagggtgccgtcggtttcgacatcgccggagccgaggacggtttccttccctcccgcttccgggatgccttcacctaccttgcgcagcacaacttccccgccacggtccacgccggcgaggcagccgggctggagagcatccagtccgctctggtggacggccgcgccctccggctgggccacggcgtccggatcgccgaggacatcatggtggagttcgaggacgacgccgaggacacagttggcctggttacgctgggggacctttccagctggatccgggaccgcggcatcgccctggaaatctgcccgtcctccaacttgcagaccggtgcgattgccggcttcggtgagggcatcgaaagccaccccctggacatgctgtaccagctcggtttcaacgtcaccatcaacaccgacaacaggctgatgagcggcgttacgctgacggacgagttcgacctcctcgtggaaaccttcgactacgacctcgacgacctgctggaactgaccctcaacgccgccgaggcatccttcctgcccctggaagagaaggaagccctggtggagtacatcaacgactcctacgccaaccttggctaaccagccgcatgccctcacccccgcaggggagcttcaatacgtcgtcgcttccctgcgggagcattgcccgtggatgggggcgctcacccatgcatccctggtggagtacctcctcgaagaggcctttgaagtggccgaaacgatcgaggctgccgcgcccgccgaaggccggggcgccgtaacggcaaatgcgcagggaattgacgatgccgagctgctgggtgagctgggcgacgtcctcctgcaggtggtgctgcacgcccggctcgccgaggaacgcggcgctttcacgttcgacgacgtcgcacgcggcctgagtgccaaaatggtccgccggaacccccacgtcttccgtccggacggctcactgcaggagaccttccccgccaccgtccaggaaatcgtgcagaagtgggacgctgtgaagcgggccgagcggccggaacggcgggacccgttcgcggggattccccaagcactcccggcgctcgcccgggcacagaaatccatcgaccgggcagcacgggccggagttgccctgccgcctgcggttcccatccccggaacggaagaggagctcggggagctgctgctcgccgtcgtgcattccgcccggaccagcggattcgatgccgagcgtgccctgcgcggcgccgtccggcgctaccagcagagcgtcccccggcagcaccaccagggatagccgcgccatcatgacgtccgggcgctggataggtttccgtaacccggaccactctcgactacgctggtctgtgacgagtacgtcgaatctttctgttagatccccccgttaatcgcccataaggagcaaattcatggcgcttatcgatgccatccacgcccgcgagatcctcgattcccgcggcaacccgaccgtagaagttgaggtcctgctctccgacggccagatcggccgcgcagcagttccctccggtgcctccaccggcgagcacgaggccgttgaactgcgtgacggcgacaagggccgttacctcggcaagggtgtccagaaggccgttgacgcgatcatcgaccagatcgctccggccctgaccggcttcgacgccaccgaccagcgcagcatcgaccaggccatgctggacctggacggcaccccgaacaagggcaagctgggcgccaacgccatcctgggcgtgtccctggccgttgccaacgcggccgctgcctccgccgacctgccgctgtacaagtacctcggcggcccgaacgcccacgtcctgcccgtcccgctgatgaacatcctcaacggtggcagccacgccgattccgacgtcgacatccaggaattcatggttgtcccgctgggtgccgagaccttctccgagggcctccgctggggcgttgaggtctaccacgccctcaaggccgtcctcaaggaaaagggcctcgccaccggcctgggcgacgaaggcggcttcgcgccgaacctgccgtccaaccgtgcggcactggacctcatccaggaagccattaagaacgccggctacaccccgggcaaggacattgccctggccctggacgttgcctcctccgagttcttcaccgacggcgcctaccagttcgaaggcaagtccctgacctcggccgagatgagcgcctactacgccgagctcgtggccgactacccgctggtatccatcgaggatccgctggacgagaacgactgggacggctggaagaccctcaccgattccatcggcgacaaggtccagctggttggcgacgacctgttcgtcaccaaccccgccatcctgcagcgcggcatcgataccaagaccgccaactcgctgctggtcaaggtcaaccagatcggctcgttgaccgagacgctggacgccgtcagcctggcccagcgtgccggctacaccaccatcacctcgcaccgctccggcgaaaccgaggacaccaccatcgccgacatctcggtggccaccaacgcaggccagatcaagaccggcgctccggcccgctccgagcgcgtcgccaagtacaaccagctgctgcgcatcgaagaggaactcgacgacgccgcacgctacgccggccgcgctgccttcccgcgtttcaagggctagtagccgcgtaaaacaatcagcggtggctatggttgaaagaccatagccaccgttgctgtttcagcagcacgtgttttagcagtacgtgttccagccccgatagtggcggcccaggcaggctgcgtgtttcaggagtgtcatggctacccgccgtcccaaagtccccaaggttgccccagcccgttccgcaaaggacgcttccggcgacgcggaggtcatccgcgcagacttcggcccgggcacggacaccaactccgccggggcaccaccgaaatccgcgggtgcgccaaccacatcaccggcaggacgccgggagccgcacggccgcaaggacgccgggccggcaacccgccgcaaggggagcagcgccacgccaggcacggcacaccgtgccggcaccggagccgcagacgaagcagcagaagaccagcagcctgttccggccaaggcgttctccggacggatgctcgcactggccgtggtgatggttgccatcaccatcatgctcgcgccaacagtaaagatcttcttcgacaaaaaggccgagatcgacgcgctgaacgccgacatcgccgcccgtcaggccgagggcgacgcccttcggcagcaggtctcgcgctggcaggaccccaactacgtgaaacagcaggcacgcgaccgcattaacatggttatgccgggagaaaccggctactgggttttcggcagcgaccagccggccggagagaccagcagccagcccggtgcagcagcacaagaccccgccgatctgccgtgggtggattccctgtgggagtccatcacgcgcgcggctacagactgaaccgcaacaggaaggacggcccgccacagtggaacacaacacggcagccgcccgggacgaatcccgccagccatcagcacacgaccttgaagtactgagccgccagctgggacggccggtccgtgacgtggtggagattcctgcacgctgcatttgcggcaatccgctggtggccgccaccgctccccgcctcagcaacggaactccgttccccaccacgttctacctgacgcatccggtcatcacctcagcggtctcgcggctcgaagccgcgggcgtcatgaacgagatgaatgaccagctggccgcagacgacgacttgtctgccgcctaccgctcggcgcacgacgcctaccttgcagcccgcaccgccatcggcgaacgctcgggaatcggagccgtccccgagatcgacggcatctccgccgggggcatgcccacccgcgtcaaatgcctgcacgtcctggtgggccattcgctggccgcaggcccgggggtcaaccccctgggagatgaaggcctggaccggatcaaggaatggtggaccgctgacaggtgctactgcgggggagcctgggacacctccggtgaagccccctcgcgggacctcagccgccatggaccgcagggcctgccggacatcgtcggccggcccgcgcccgtccggaaatccaccgccactgcggaggccccggaatgacgcgcgttgcagccatcgactgcggcaccaactccatccgcctcctgatcgccgacattgagcgcagtaacggaaccacccaacttaccgatgtggtgcgtgaaatgcgcgtggtccggctgggccagggagtggatgcgacaggggaactcgcgccggaggcccttgaacgtaccttcgccgccaccgctgactatgcccggctgatccgggaccatggggcaacgaaggtccgcttcgtggcaacctccgccagccgggatgcacggaaccggcaggttttcgtagacggaatccggaacctgctcggcgtggaaccggaagtgatctccggcgacgaggaagcagttctgtccttcgccggggccagcagcgtcctccccatcctggatggccaggaagtgctggtggtggacctgggcggcggcagcaccgaattcgtgctgggtacggccgccggggtcacagcagcaaagtccgtggacatcggctgcgtccgccttaccgaacggcacctccgggacgatccgcccactgcccagcaggtagcagccgcggaagccgacgtcgacgcagccatcacccgtgcacgccaggacgttccgctggaacgtgccaccgccgtcgtcggtgttgctggctccatcaccacaattaccgcacatgcgctcgggctggccgagtactcgcccgatgcgatccacggcgccgaactgcccctggacactgttcgtgccgcctcgacgggcctcttggaaatgccccggtcccggcggtccgccctgccctacatgcaccccggccgggtggacgtcatcggcgctggaggactcgtgtggcggcgcatccttgaacagctgggtgagctcaccggcggccgcatcaccaccgccaccgccagcgagcacgacatcctcgacggcatcgccctgagcatcggctgaccggatgcacctcgccatttcacgcacggcccgcctgccgcgcgccgcagcctcagtactgcttgccctggtccttgcggcctcctgcctgggcttcggcctccactccgcccccgccgcgcaggcggatgagtggcgggacaagcagtactggcttgccgagtccggcatcaccaaggcctgggaggtttccaagggcgcaggcgtcaaggtggccgtcatcgacagcggcgtggacgcggagcacccggacctgttgggcgcagtggccgggggctatgacgcgtccggttcgggccggccggacggacaacagggcgtgggcatcaagccggaacacggcaccctcgtggccaccatgctggcaggacgcggccaccagccggccagccccagtcccagcgccagcgccagtccggcacccgccccctccggcgcggcgcccgatggcatcgtgggtgttgccccggaagccgagatcctctccgtttccacctggctgggttcggcgaatccctcgggcaagagcgaccaggaccagatacccgaggccgtccgctgggcagtggacaacggcgcaaaggtgatcaacatttccctgggcagcaccactccgcagtggccgcagagctgggacgcagcgttcctgtacgcggaacagaaggacgtggtcatcgttgccgctgccggaaaccgggtgggcggcaatatccaggtaggcgctccggccaccatcccgggcgtgctcaccgttgccgggctggaccggaaaggcgcagcaagcgttgacgcgtcctcccagggcatcagcatcggtgtggccgctccggcagagaacctgctcggcggcctgccgggcggcggctacgccgaatgggccggaacctccggcagcactccgattgttgccggcgtagctgcgctcatccgctccaagtggccgtccatgagcgcggagcaggtcatcaaccgcattgtttcaaccgccaaggacgccggcgcccccggcaaggacccgctgtacggctttggcgtgctgaacgccgaggcagccctgaaggacaccgtcccggaggctgccggcaacccgctgggctccatcgcggaatggatccgggtccaccgccgggggaacctcgctactcccgccccgctccccaccacggacgtccccagcgccgtccccacgctgcccgaagcaacggtgccggcagcggagccgccgtcccagcgtgacagcgcgattggcgcctccgtcgtcatcggttttggtgtgctgttcgtcgccattgccggggcggcagcggtccagttgcgccgggcggccaggaacccggcactgcccggggaggacgcggagaccggtgccacggagacggtggaaaccggccccaaaacctgaggtgcagccgcccgaaccagttagtgaagattttcacaaactgttgtatccttaaacccatggcaaccaccccagagctccaggaccgtcccagggtactcgtcgtcggcggcgggtacgtcggcctgtacgtagcactcaaactgcagaagaagatcgcgaatgccggtggcatcgtcaccctcgtggatccactgccctacatgacgtaccagcccttcctccccgaggtagcaggcggcaacatcgaggcccgccacgccgtggtatcccaccggcagcacctcaagcagaccgaactgatccagggccgcgtcacctcgatcgaccacgccaaccgcacggccgtcgtggcccccgctgacggcggcgcgcacttcgaggttccctacttcgacgtcgtgatggccgcaggtgccatcacccgcaccttccccatcaagggactcgcggacaagggcatcggcctgaagaccatcgaggaagccgttgcgctgcgcaacaaggtcctcgagcgcatcgaggtcgcctccaccatgaccgatgctcccgcccgtgcacgcgccctcaccttcgtggtggtgggcggcggcttcgccggcatcgagtgcatcaccgaaatggaagaccttgcccgggccgccgtccggaacaacccgcgcatcaagcaggaggaagtccgcttcgtcctggtcgaggccatgggccggatcatgccggaagttaccgcaaagcaggcggaatgggttgtggagcacctccgcagccgcggcatcgaggtactccttaacacgtccctggacaacgccgagggcagcctcaagctcatcaaccttccggacaagacccccgcgcaggagttcgaaacggacaccctcgtgtggaccgccggcgtgcaggccaaccccatggtccgctccaccgatttcccgctggagccgcgcggccgcgtccgcgtcctgccggacctccgggttgccggcgacgaaggcatcgtcgacaacgcctgggcagccggcgacgtcgccgcggttccggacctcaccggcaagggcctcccggacggcacctgcgtccccaacgcccagcacgcgctgcgccaggccaagcggctggccaagaacctgtgggcctcccgctgggacaagccgctgaaggactacaagcacaagaacctgggtgctgtggccggcttcggccagtggaagggcgttgccaacatcaatcttgtgggcagcatcggcctcaagggcgcactcgcctggctggcacaccgcggttaccacggcatggcgatgcctaccttcgagcgcaagttccgcgtcatcttcaactggatcatcagcttcttcaccggccgcgacaccacgcagctgatggacctggacaacccgcgcggcgcgttcgtcgcagcagccaccccggcccccaagccggctgccgctccggcgccggccccggtgggcagcgggtccggttcctcagcgacctccccggccgctgctgaggccaaggaaacggtctcggcaaaggccaagtaagggctgtcccgctcctgcgctgcatagtacgacggcggctgtcccctgtgcggggcagccgccgtttgcgtccccaggcgttggcatcttcagcgggaagcgtctccagcagagtgcgtccggccgcggggctacccgccaaggccgatcgacgccttctagactggcaccatgactggcgaaaagaacctcgaggcgctgctggccgcgatgcatccggtgcagcgaggcggcgaatacgtctatgccatgtggccggacggaaggccgctggtgcagggtgtcgaggcggcaatccgcgaagtcgaagggctgacggtggtgctgccccgggcggtggctgacagggaaggcctggcctatgactttgtgggtgcctggatcacgttggaggtccactccgccctggaagcggtgggcctgacggccgccgtcggcaaggcgcttgccgaggccaggatcagctgcaacgtgctcgccggatttcaccacgaccatctgctggttccggtcgctgacgcgccccgcgccctggaggtcctggccgggctgtccgcagacagcaggcaggtgccacggcccgcgctgctggtgcgcagcgaggcgcccgaggaccgtggggccatcctggccctggcagccgacgctttcgcggtctccccggccaccggcctgaaggtggagggcgaacctgtggaggtgagggtgctccgcggtctcttcgaatccagggactacctgcccgaattcagtctggtggccgtcctggacggcgaagtggtgggccacgtcatcagtacccgcggctgggtgggcgcccatggactgctggggctgggacccctcggcgtcacgcccaggcaccagcggcacggcatagggtcggcgctcatgaaggagaccatccagcgggcaaacgcggcgggggagagcggcatcgccctcctgggcagccccgggtattactcgcgctttggttttgtgcctgccgcctcgctgggggtacttccacctgacgacgcgtggggcgactacttccaactgctgcccctggccctctggcccggcggtgtccacggcaccttccggtatgccgaacccttcgcactcgcctgacgggataccattgaccgggcgccccagtagcccaattggcagaggcagcggacttaaaatccgcgtgttgtgggttcgagtcccacctggggtacacagcgtcctgcacaaggccaggaacggaagccgtccgcacagcgggcggcttctttcatttaattccacatatgcaactactgttataaggatgtgacctcagtcacttatcttcggctccgatttgcattagcttgaagctaaatcaggaacacctgatttttcgtgtcaaaggccgttcgcacctttagatcgaggagctcgtaaatgactttattcccccaggcgggaacccgtgttgccaagctgacagcgcttggcatcggcgtcgcctttatggcaacggcttgcggcggttcgtccacacccacggcaaccgaatcctctgcccccgcagcagcggcaggaattgcttgccccgcaactgagggcagtggaggcgctgccgccagccagcctgcggagaccccctcggtgccgccgtcaaccggctctactgaaaccccgctgcggattggttcgctccttcccaccaccggttcgctggcgttcctcggcccgcccgaaatcgcaggcgtcaaccttggcatcgacgaagtcaacaaggctggcggcgtcctgggcaagccggtcgaagtgatccaccgcgactccggcgacaccaagacggacatcgccacccagtccacgtccgcgttgctgggccagggcgtcagtgccatcatcggtgcagcgtcctcaggtgtatccaagacggtcatcaaccagatcaccggcgccggcgtcatccagttctcgcccgccaacacctccccggacttcaccacgtgggatgacaagggcctgtactggcgtacggcaccctccgacgtcctgcagggcaaggtgcttggcaactacatggccacctgcggcgcgcagaccgtgggcatgatcgtcctgaatgacgcgtacggcaccggcctggcatccaacatcaagtcggcctttgaggcggcaggcggccaggttgtggcggaggaactcttcaacgagggtgacacccagttcagcagccaggtggacaagatcattgcggccaagccggatgccattgccctgatcacctttgaccaggccaagagcattgtcccgctgatgaccggcaagggcgtcaaggccacccagatgttcttggtggacggcaacacctccgactacagcaaggacttccagccgggcaccctgaagggcgcacgaggcaccatcccgggcacgtttgcccaggaggacttcaagaagaagctgctggccatcgacccggccctcaaggactacagctacgccggcgagtcctacgacgccgtgaacctcatcgcgctggccgcagaggcggcacagagcaccaagggcgtggacattgcggccaagctcaaggaagtctctgagggcggcgagaagtgcacgtcctacggtgcctgcgtcacgttgatcagggaaggcaaggatgcggactacgacggccagtccggccccgtgaccttctccgaagccggtgacccgaccgaggcctacatcggcatctacgagtaccaggatgacaacaagtacaccgcagtgaaggaagagttcggcaagctgtaagcgccgtacctgaaacacaatgaagcccccgtccagccggacgggggcttcattgtgtttgccttggccttactcgacggtgtccgccagggtacccaggtaaagctggatgaccttggggtccttcatcagctcacggcccgtgccggtgtacgcgtcccggccctggtccaggacgtaggcgcggtcacagatctgcaggcagcgccgggcgttctgctcaaccatgatcacggagacgcctgcccggttgatctcgtggacgcgcaggaaggtctcatcctgtttgacgggggagaggcctgcggacggctcgtcgaggagcagcacggctggatccatcatcagcgccctgcccatggccaccatctggcgttcgccgcctgagagcgagccggcgcgctgcgcgcgccgcttgcccagttccgggaacagtccggccacgaagtcgaaccgttcggcgaaatccttgggcctctggaacatgcccatctgcaggttttcctcgatggtcagcgtggcgaacacattgttcgtttgcgggacgaaacccactccccgggacaccagcttgttcgctttcagtccggtgatgtcctggccgcggaccaccaccgtcccggagtgcactttgaccaaaccgaacatggccttcaggagggtcgacttaccggcaccattggggccgatgatgccgatcagctcgcccttgcgggcttcgatgctgcagccgttgaggatgttcactcccggcaggtagcccgccacgaggtcggtgaccttgaccaccgagtcaccgtcggtgactggctgtgcggccggcgccgcgctggtgctgctcattggctgtccttgtctgtggtgcctgtgtccgtgcttccgtggcggccatgcgggctctcgcccttgtgccggccgccgccccggcgttctggttccgcctctcccgccacaacgtccagcgagatgattccggcgttctcggtccccacaatcgattcctcgtccgccacgagttcggccgcgagctccttcaggccctcggagtctcccaggtcgacgtcgtggtgggcgcccaggtaggcgtcgatgaccgcagggttcttcatgacctcgcccggcgggccttccgccaccaccttgccttcagccatgaccaccacccagtcggcgatatgccggaccatgtgcatgtcgtgctcgacgaacagcaccgtcatgccctcggctttaaggttcttgatgtggtcgaggagggactgggtcagggcgggattgacgcccgccatgggttcgtccagcatgaccagtttgggccggaccatcagggaccgggccatctccaggagcttgcgctggccgcctgagagggacgccgcgtagtcgtccttcttggcgtcgagcttgaacttcgccagcaggacattagcctcatcggtgatctgtttctcccggccgccccacatgcccttgaaaagcgctttggacagccgctcgccgggctggtctgcagcgccgaggcgcatgttttccatgaccgtgagcttgcccatgacctttgtgagctggaaggtgcggaccattcccatccgcgccaccttgtacggggacactcctgcgaggctcttgccttcgaactgccacttgcccgtgttcggtgtgtcaaaaccggtcagcaggttgaagagggtggtcttccctgcgccgttggggccgatcagtgccgtgattttgtaccgggggatctcgaggtactccacgtcgacggcgttgataccgccgaaactgcgcgtcacgttctccgccacgacgatagggtcgcgcttcttgcagccgggtacggcctcgccctcggctatgggccgggtgtcggtcatgtagtccacgccaacctcgccgggggttgcgggtttttcgctgtgcatgctcatgcgaacgccagctccttcttgtttccaaagacgccctggggcctgaagatcatcagcagcatcagggcgacgccaaccaggatgtaacgcagctgcccggcctggaccgtattcagccacgtgatggttcccgactcgatcaggccgtacaggatgccctgggtcagggacaggacaacccagaagatcatggctccgatcaccggaccaagcacggtgcccaggccgccgagcaggaggcaggtatacaggaagaacgtcagttccgtaccgtagttggccggctgcaccgctccacgcggaagcgtgaagatcatgcccgcgagcgctccgagaacgccaccaataatgagggcctgcatcttgtaggcgtagacgttcttgcccagggaccggacggcgttctcatcctcgcggatgcctttaaggacacgcccccacgggctgcgcatcagcagccataccagggtgcagcagagggcgaccagcgcccaccccaccacgcggatgaagaaatcgcggttgttcatgccgaagtaggagccctcagggaaggggttcatgctgtagaacccgccctcgaaggctgccaggccgtttgccgaccccgtcacggacgtgagctggttggtggtcacgatgtagcggacaatttccgctgcggcgatggtcacgatagccaggtagtccgcgcggagccgcagggtgggtatgcccagcagcagggcgaagacggcagaggcaaggatagcgatcagcagccccacaaagaagggagcgccaaaggtgagggtggagatggcgaagccgtaggcccccaccgccatgaagccggcctgcccgaagttcagcaggccggagtagccgaagtgcacggcgaggccgagcgcggccagggcgtacgcggccgtggtcgggctgaaaatttcactggcagcgctggaaagaatgaatccaaagtccatggctgtctcctaacccacgcgctcgcgccggcccaggattccctggggccgaaacagaaggacaacgatcatgatgaacaaggcgcccacgtacttcaggtccgcggcgaggccgaacacggtggtcagctccacgaagatgcccacaatgatggaaccgatcagggcgccgaagactgtgccgaggccgcccagggtgacgccggcgaagatgagcagcaggatggcggagcccatgtcgaacgttacgccgggacggtagtaggcccacaggatgccgccgagggaggccagcatgccgcccgtgatccacacaatccggataacggagtcaacgtcgatgcccgaagccgctgccagggcggggttgtcggctaccgcgcgggtggccttgcccagcctggtcttcagcagcacgatgccgatcagggcgatcaccacggcactgatgcccagggaccaaaggttgttcggcgagatggagacaggtcccagctggatttcggggctctgcgcgtacggaagctgctgggtggcgccgccgaaatagaactggatgacgtagcggactgccagtgccaggccgatgctgacgatcatcatgggcaccagcccggtgccgcggcggcgcagcgggcgccacagccctctgtcctgggcgtacccgaagaggccgccgccaagcaaggccagcaggattgcgagccagaaggggagacccagggcgttgaaggcgaacaccagtacagcgcccagcgtcaccatctcgccgtgggcgaagttggtgaggccggtggtgccgaagatcagggacagccccaccgaggccagggccaggaggaggccgaagctcagtcctgcgacgagcctgttgagcaggttttgcccgaagtcctgctgctgcaccacgatgccctcgccgaacgcaaagatcaccgagaggtttgaggtctggctgaaggtgacgtcgcgggggttttcctgaccctcagccagggcgatgccctcaggcagggtggactcgtccagttccactgtgtaggtgccctgttcgggcaccccgatgttccaggctccgttcgcagaggacgtggccgtgccgatgaaatcatccttcgttgccgtgattgtcacgcccgccaagggggcccgggtgtcatcacgaaggaatccgctgatgttgttttggaaggtctggttcgacggggatggtgtcggtgacggggaagtggcctgggaagccggtgctgccacgagaaggattgccaggatggaagcgctgatggctcccagtattctcagcaaccctcgccgcgcgccggccggcgggccttggggtgtacttctcaaattggtaaacctccacttgggggcggtctcggctgcgccattgcagccgctgcgaacgggtacaggggtaggatggtgccatcaggccggcaccgccacatgtgtgagttccgtcaccctgcttggcttatgctacagcgcggaagtaccggtaaatgccgaggtccaggcgccgatggtagcgatcggataacaactccaggctcctgtttccgtcggggaactactgcgggtgcatttacgtgagaattggtagcgtaaaccttaaggttcacaacacatcccatatggaggaatcccgcaatggcacttggcggcaacccgatcttcaacggaaagagcttccgtggagccacccaggcaccgcctgttccgcaggctccctacggacagcagccctacggccaggccccgtacggccagcagccgtatgggcaggcaccttacggccaggccccttacggccagcaggcatacggccagccgcagaacatgacggacgagcagttgcggcagatgtacaaccagcccgctgcaggtcccgctgacactggccggatgacctacgacgacgtcatcgtcaagactgccgcctgcctggcggttctgctcgtcggtgccggcgtgacaatgttcgtcggcctgggcctggcctccatgctgatgatcgtcggtgcgctgggcggttttgtgctggcgctcgtgaacaccttcaagaagcagccgtcgccggcactgattctggcttatgcaggccttgagggtctcttcctcggtggcctcacccgggtcctggacaccatgtacccgggcgttgggctgcaggccgtcatcggcaccctgtccgtcttcaccgtgacactgctcctgttcaagagcggcaaggtgcgcgccactcccaaggccatgaagttcttcatgatcgctttggctggctacgccctcttctccatcgtgaacctcgtcatgatgctcaccggcctgacaacggaacccttcggactgcgcagcggcattattggtgtcgtcatcggcgtccttgcaatcggcctggccgcgttctccctggtcatggacttcaccagcatcgaggcaggcgtgcagagcggtgccccgcagcgcttctcctggacggcagcgttcggcctgacggtaacgctggtatggctctacgtggaaatcatccgcctgctggccatcctgcgcggggacgagtaacacccacgccggttcccgccgtcggaccttcttaacaggtaagggccccacctcacggtggggcccttacctgttaaccgcaacctgggaacgtctacgcgatccgcagggctcctgctgccggggagaccgtgaagatatccggcgccttgtagcccgcttccgcaaatgccttgacgacggcgtcgcgcaccctctgttccagcgccgccggtgtgagcgcgatggccgcaccgccaaaaccgccgccggtcatgcgggccccaattgcgccgctggcgcgcgcggtgtcgacggccaggtcaagctccgggcaggagatctcgaagtcgtcccgcatcgaagcatggctggcgtctagcagggatccaatggcgccaggtccctcgcttgccaggagctccacggtctggaggacgcggtcgttttcggtcaccacgtgccggacgcgccggaaggtgacgtcatccaggaggccgctggcttcctccaggtcacccacctccacatcccgaagcgccccgaccccaagcacctcggcgcccagttcgcaggatgcccgccgggatgcgtagccgccgtcggcatgggaatgcgagaccttggtatcaatcaccagcaacaccagatccgcaggctgggtctcgaacggaaccaggcgggcgttctggtcccggcagtccaggaagactgcgtggccttccgagccccggagcgacgccgactggtccatgatgcctgtaggggcaccgacgaactcgttctccgcccgctgcgtggccaggaccatctcctcggcgtcgagcccggccccggtcagctcgttcaacgccgagatgaccgcacactcaatggcatgggatgacgagagcccggctccgaggggaacgttggaatcgagcagcaggtccacgcccggaacctcaatgccgcgctgctgcagcgcccacatcacgccgagggggtacttggtccagcctttggcggaacccggccgcagggaatccaacgtggtggacacgacgccctggtccccataggtggagagcaggcgtacggcggagtcggggcggacccggacggccacccgtgctgtccggtcaatggcgaaaggaaggacgaaaccctcgttgtagtccgtgtgctcgccgatcaggtttacccgtcccggcgcctgccagatgccgtccggtgccccgccaaactccttcgcgaaccgtgcggccaggtcctttgttcctggctgcccgcgggtggccaggggttcgggtgcggcgttcaagcgtgggctccttcgggcgtggccgccaggacggcggggcttgtggcgggggaggggagagtgacggcccggaggcgctccgccacactctccggggtggtgtcgttgatgaaggcgcccattgcggcctccgatcctgccaggtacttcagcttatcggcagcccgccgcggggaagtcaactggaggtgaaggtatccggcgggccgcaggaccgggtccaggggagcctggtgccaggccgagatgtagggcgtgggcgtggggtagagggcgtcaacccgctggagaaggttgaggtagacggacgcgagctcatccttctcctcgccgctcagcgccgccaggtccgggacctggcggtggggcaccaggtggatttccagcggccagcgggcagcaaagggaacataggcgctgaagttttcgccttccaggaccatcctgctgccgtcttcccgttcggaccgcaagagggacccggtgagtgtttcccggccgtcgtgcgcgtcatggaacctgcgggccgcggcccccaggactcccgcgcggggcgtgacgtaggggtaggcgtaaatttgcccgtgggggtggtggagcgtcacgccgatgtcggcaccgcggttctcgaacggaaagacctgtttgattccggggagggcactcaaagcctccgtgcggtgtgcccatgcttcgatgacggtgcgcgcccgggcttcccccagttcactgaacgaaccggtgtgggacggggtgaacgccactacctcgcagcggccgaacgcgggtcccttcgtaccccacgatgtttcctccggaaccgggcccagtgccggcccgagcgacgggaaccggttctcaaacaccaccacgtcgtagtcggacgcaggaatctcggaaggattgccggcggtggtagggcatatcgggcactggtccgccggggggaggtgggtgcgggtttggcggtgcgcggccacggcaacccactcgtcggtcagcgcatcgtagcggacctcgccgggctcacccctcgggggcaggccccgctggtcagtggtgagttcggcggtgcgcgacttgggcgctgcagcgtcgtcgaaatagatcagctcccggccgtcggagagtctggtgctcgtgatacctgtcatgaaaaaagtgtggcatattcgatcaaaaaagaatagttaacaacaaaaactcacaaagggggtgctgcgtgccggtgccgccgcggggtacggtattgctcatgacttcacgttcaccccacgaatccgtaccggcactgcagggctatgccaccggcaggcagtatgaactccgccgcggcgacgccacggccgtggttacggagctggccgcgggcctccgttccttcagcaggggaggaaccctcctgacggagacgtacggcgacgacgagattgcccccggtgccgccggcatcacgctggcgccctgggccaaccgcgtggaggacgggatctggttcttgaatggcaaaaaacagcagctggacatcaccgaggttgccaggaacaacgccagccacggcctgctccgcaattccgcctacgcgctggtggatgagtccgagcactccgtgacgctggaggccaccatcttcccgcagcacgggtttcccttcctggcccggcaccgggtgcagtacgaaatcgacgggggcctggggctggtggtccgccaaaccctgctgaacgacgccaaggagcccgcgccattcgtcctgggtgcccacccctacctgaggctcggcgatgtgcccattgaggaactggtcctgacggtagcggccgacacacgcctggtggccgatgaccgcctgatcccacgcagctccgccccggtgcagggcgattcggacttcagggcagggctgaacatcgctgcgctggacgtggacgtggccctgacggacctgcgttacgaggcaggaaaggcccgccacacactgtcggcgccggacggcaggcaggtaagcctgtggcaggacgaaacctgccgctacgtccacgtctttgtcagtacccagtatccgggccgcagccgggctgtggccgttgagcccatgaccgggccggccaacgccttcaactccggtgacggcctgcgctggctaagccccggcgggtccttcaccatcgagtggggcattgactacaccccgggggccggcgggtagcggtttccgaataagcttccgctggggaagtattaggctatgacgccagcagaggatgccgatacctccaccagcactactccaggcccgcaacaacggcctgactccagccagcccgtccgtgtcctcgcggaccgtgaactggaccgggacataccctacggcgtacgcatcgcagcctcctgggcctggcgcgtggggctgatcctcctggtgggcggtgcgctggtctggctgctgagccggatcagcttcctcatcatcccagtcatggtggctgccctcctcgccgggctcctcagcccggtggtgcggtggctcaggcgctacaggctgccttccggagcggccgttgccgtcaccgtcgtgggcttcatcggcctgatcggcgggtcgctggcgctggtgggaaggcagctggtttcaggcttcggcgaactctggtcggaggcgctggccggggtcaaacagatccaggactggctgtccgacgggccgctgcacctgactgccgcccaaatggaccaatacctgcaggaagcaaccacggccctgcaggacaacaccagcagcatcgtcagcggggcgctgtcctttggcagcactgccgggcactttgccgccggactcatcctggcgctgttcatcctcatcttcttcctgctggaaggggaacggatctggactttcctggtccggctgcttccccggaaagccagggcggcagccttcggcgccggacgcaagggctggacctccatggtcagctacgcgcgcatccagatgttcgtagccttcgtggacgcagtgggaatcggcgcgggcgccgccatcatcggggtgcccctggcgctgccgctcagcgtgctcgtgttcatcggttcgtttatcccgattgttggcgcccttgtcacgggtgccatcgcggtcctgctggcgctggtggcgaacggccccatcaacgccctgatcatgctgggcatcgtgctcctcgtccagcagctggaaagccacatcctgcaaccgctgatcatgggcaaggcagtcgccctgcatccggtggcggtgattctttcggtggccgcaggatcctacctggcagggatccccggtgctctgttctcggtgcccatcctcgccgtcgcaaattcctccattcgctacatcgccgccagaacgtgggaacatgaacaggtgccggctttagccggaggatccacgacggcgggcgccggaccggacaacaccatccggtacgtccggccgccgtcggcactcaaacgcggcaagggcgccgccgccggcaccacagcagaactacctgatgcccctcccactgcggaaccgggcgcaggggccgaatccagaggagaatagtccgtgaacatccttgaaacccttcccgtcacgctggacgatgtcctggaggcgcagaagctgctcgacgggattattgcgcgtacaccggtggaatcgtcccgcgccctcgggaaaatggccggcggggatgtctacttcaagtgcgaaaacctccagcgggccggatccttcaaggtgcgcggcgcctacgtccgcatggcgaagctttcccccgaggagaaaaagcgcggcgtggtggcagcctccgcaggcaaccacgcccagggtgtagccgtggccgccaagagcctgggcatcaaagcccgcatctacatgccgctgggcgttgcactgcccaaactggccgccacccgcagccacggtgcggaggtcatcctgcacggccataacgttgacgaggcgcttgccgaagctcagcggtacagcaacgagacgggaaccgtctttgtgcaccccttcgacaacgtagacgttgtagcgggccagggaaccctggggctcgagatccttgaacaggtacccactgtggacaccatcctcatgggcgtgggaggcggcgggctcctggcgggggtcgccgtcgccatcaaagcccgggccaaagagttgggccgggagatccgcatcatcggggtccaggctgagaacgctgctgcctacccgccgtcgctggccgccgatgcgctggtacccctgaagaaggtgtccaccatggcggacggcatcgccgtcggccgtcccggacagctcccgttcagcatcatccgcgaactcgtggatgatgttgtgacggtcagcgaagactcgctggcccgtgcgctgatcttcctgctggagcgggccaagatggtggtggagccggccggcgcggttggcgtggcggcgctgatggacggcaagatcgaaaacccgggaaccacggtggtggtcctttccggcggcaatatcgaccccatgctgatgctcaaggtcatccagcgcggcctctccgcggctggacgctacatgacggtccgcatgatgctcgatgaccgccccggctcactggccaccatcgccaggatcatcgcggagaacgatgccaacgtcaccggcctggaccatacccgcgtgggcggctccatcagcatgggcgacgtgtccatcaccgtgaacctggaaacaaagggccacgagcacggggaacaggtgctcagcgccctccgtgcggaaggcttccagccgatcgtggtgcattaggaaaagccatggctccactgacgggaaacggaagcttcgggcagcgcaggaccgtagcagcccgggccaagggcggcctgctggtgctgggcaccttcgtggttctcctctttgtcatcgagctgttcaacatggtgatgctgcgctcgctcaacgcgacgttcgggctccggcccaggagcgctgacgggctgctggacatcttcactttcccgctcctgcacgcgaacctgaaccatctgctgtccaacagcctgccgctgatcatctttggtttcctggtgttcctttcgggcctccgggtgttcctgaccgccttggcgttcagctggctggggtccgggctcacggtctggctgattggcgacgtcggcgtcacagtgggcgcttcgggcctggttttcgggctgttttccttcctgctggtccgcgggttcatcaaccggagctggcgccagatcctcctggcggttgtcctcttcatgggctacgggagcatcctgctgggtgtcctgcccatcgcagccggctacatttcctggcaggcccatctgggcggcgcagccgggggagtggtggccgccctgctgctgcgtagccgcagccgcgtccccggcacggcgctgtaggtatctgtcccttaacgcgaaacgctggccgccccttccggggcggccagcgttttgtgtgtgccactgcgggctggaagctgtcaggcggcgtacggcttggcggaaaggatctccaccttgatgtccttgccgttgggagccacgtagctcagggagtcaccttccttgtgcccaaggatggccgcacccagcggagacttctcgctgaagacgtccaggtccgagtcgccggcaatttcacgggaaccgagcaggaaggtctcttcgtcgccggcgatcctggccacgacgagcataccgggctccacgattccgtcgtctgccggagcctcgcccacgtgggcgtcgcggagcagtgctgtgagctggcggatgcgggcctcgatcttgccctgctcctccttggctgcgtggtagccaccgttctccttgaggtcgccctcctgccgggctgcttcaatcttctggacgatctctgcccggccagcgccggaaaggtggtccagctctgccttcaggcggtcaaaagcttcctgggtgagccaggctgcagctgcgctgttggtggtagacacggacttctcctctggtggtcctacatgcaaaagaccccgccacggtggccacttgtggaacagtaaccagctcagcggggtaaaggtattgctccattgtagtcaatcccttggacttaacccaacaggcaagcggcgcacgtcacaggccgtggcctgtttccaggcccgcgcttccggtgctaggtgccctcagcccagcagctgtccaccacgccggataccggcagtgattcggtgcgcacggccacgcgctgggcaaccgtgcggccgccgtcggctgcttccgtggcctctgcgggaggaatgtccacaaccttccatcccaccaccgcaaacttggagtccagtgccttgaccgcgcatttgacggcggttcccggctcgcgggtgacctggaagtccacctccgccagcgtggcatccgtggtgctgtagccaatgtccttgaacgtcacgtcggacaaggactgggatgtggaaacccaggccaggaatccgattcccgcggccagggccgtcccggcaatgacgcgtttggctttcggcgtaagcgtgcgctttttagccccataccgattggctaggctagtgtctgcgggcgcgggttgggccggctggtccggggaagtcacctcaccagtttagtgccctttccgggggcggcttttcagcagccccgccaggcgtccgcccgctcaagccatccgatcagcagccacaggcagcagaagaataaggagccgtccttcgatgacagcgtccagcaccaccccggcgccgctacggctgctcgcagtccatgcccatccggacgacgagtccagcaagggcgctgcgacaatggcgaagtatgctgccgccggcgtcgacgtcctggtggccacgtgcaccgacggctccaggggagatatccagaacccggctgttgagggggaaccgcaccccaagcgggatatggccggcgccaggcgcctggagatggaacgggcggcggccaccctcggcgtcagccagcgatggctggggtttgtggattcgggcctgcccgaaggtgatccgcttcctccccttcccgcgggatcattcgccaccctgcccctgcagcgcgctgccgcgcccctggtgcggctggtccggtccttcaagccgcacgtcatccttagctatgacgagaacggcggctacccccatccggaccacatcatggcgcaccgcgttgccgtggaggccttcgagtccgccggggacggttcgcgctatccggacgccggggagccgtgggaacccagcaagctctactacgacagggcattcagcccggagcgtttccgggcgctccatttcgcgctggaggaagccggactccagtccccgtacgccgagcggctcgccgcctggctcgaggcggacgccgagggccacacgccgccgcccgccacgcatcccaccaccacgcaggttgactgcggcgacttcttcgaggtgcgcgacgacgcgctccgggcccaccgcacgcaggtggaccccctggggttcttttttgccgtgtctcccgagatgcagcgccgggcctggccgtgggaggactactccctcatccgctcccgcgttccttccgaactcccggagcgcgatctgttcgcggggctaagatagaagtgccggcaatttctatgtcgcgtagaagttagggtctggcgctttcgccgtcccgtccgcggcccctgccatccgctccacagaaggtatataaccgtgcatcacctgctcctcagtttggccaccaccccgacgcccctgccgacgccaacgctgcgtgaggggatttccgaggaccaggtgacgccgggcctgctgggcttcatcatgacggcgttcttcgtggttgccaccgctctgctgatcgtggacatggtgcggcgcatcaggcgcgtgcgctaccgggcgcaggtggaggaggaccgcatggctgccgccgctgcggcggatgttgcggcagcggaggctgctgatgcgggggcgcccggccagcaggcccgcggtggcgccgtacaaggaacggccgacggcgggacggaccccgtgcagggtgaccagcggcactgacgcattgacgtcgtccgacatgtgcggctgcgctaactgaggacgcccgggtcgtgcggtcccgtcagctgaggacggccgtggcgatagccgtgaaatgcgcggcgaaagccaccacggtcagggcatggaacagttcgtggaacccgaagtggtggtagctgaaattgggtttcttgagggcgtagaagactgccccggtgatgtagaggacgccgcccacgcagatcaggaccgccgccaggacgctggcctggaagaactgcggcaggtagaagagggcgccgcagcccagggcgatgtagatcggtacgtagagccagcggggggcgtccgtccacagcagccggaacagtaccccgaggatggccccggaccagatgacccagagcagcaggactgcctggggcctttccaggagggtccatgccagtggagtgtagctgccggcgatcaccagcatgatgttggtgtggtccagccgtttgaggacgatcttgaccccgggtgaccagttgccccggtgatagacggcgctgactccaaagagcaggacgcccgtggccgcgtagatggctgacgtgattttgcggtccgcggtgggcgcaaggaccaccaggacgatcccggccgcgagggcaaggggtgctgtgacggtgtggatccagccccgccacttcggcttgatcatcaggagttcggcgagccggaccgcggcgccgtccatggcgttgtttgctgcgccgcttcccgcgccggcactgtccttcggctgcggcgtccggggggcctccggggtgtcgctgttcatggtcccagaataacttacggatcggtaagttaccgaagagtaggttttgggtgatctctgttcagagcgggtggagcgggccctcgacgcttctgacggtagcctaggatgtgcaagtacgtacagcgaggaagtcaggtgagtggacgcgtggagttgcccgggttcctctatggcttctacgagcgcaggctgctgaaggacctcgcccgcgaccgcattccccgccacatcggcgtgatggtggacgggaaccgccgctgggccaagcagttcaacgcgcccaccagccagggccaccaggccggcgccgacaagatccacgagttccttggctggtgccaggagctgggggtcaaagtggtcaccctctacatgctctccacggacaacatgaacaggtccagcgaggaactggacctgctgatgggcatcatcgccaacaccctggaccgcctggacgaggacgccaacatctccgtccacgcgatgggtgctcccgaacttcttccggactacctcgccgagcgcctcaacaagctgactgcacgtaccccggtccgggagaaaatccatgtcaatgtggcggtggggtacggcggccgccgggagatcgtggacgcggtgcgcgagctcctccatgacgccgtagccaaaggcgaggacatcggccagcttgcggacgaactctgcgtggatgacatctcccgcttcctgtacacccgcggccagccggacccggacctggtgatccggacgtcgggagagcagcgcctctccggtttcctgatgtggcagagcgcctacagcgagttctatttctgcgaggcactgtggcccgcgttccggaaagtggacttcctgcgggccctccgcgactacgcgggaaggcagcggcgcttcggctcctgacaactccggttcaccacaagttcacaccactgcaacaggaatcgccgcgtaatggttgcggaaattacttggggtggatttacgttatatccatcagctggcaaaaccgccggctgatcggggaggccagtacatggagcgaaacatcgcaccggttgtatgggaggccggacccggcctcctggccgagccgcctcaccaataacaattccgggctggtgcccggggctggagtcgatgtggctacttctgaacaactgcccgaggtcgtttttgaccagggagagaaagctacctctcgcgccacgcgagccacctcacaaaccggttcagcagcggatgctgcggccggttttgctgtctccggaagggaagcggccattaacaccttcgtcatcgacacctccgtcctgctgtcagacccccgcgccctgctgcgctttgcggaacacgaggtcatcgttccggtcgtggtgatcaccgaactggaatccaaacgacacgaccccgagcttggctatttcgcccggaaagcgctgcggctcctcgacgacctccgggtcaaacacggcgggctgaaccagcccattcccatcggggacgacggcggctccctcatggtggagctcaaccacatctcctcggaagtgctgccgctcggcttccggagcggggacaacgacagccgcatcctcgccgtcgccaagaacctcgccaacgagggcaggaacgtcaccgtggtgtccaaggacctgcccatgcgggtcaaggcctcggccatggggctcaccgccgacgaataccgcaacgagctggtgaaggactccggctggaccggtgttgccgaggtcgaagccaacgagcaggagatctcaaccctctacggccacgagccggtgtttatcccggcggcagctgaaatgccggtcaacaccggcctggtcctgctctccaaccgggggtccgccctgggccgggtgggcccggacaagcaggtccgcctggtcaaaggcgaccgtgacgtgttcggcctgcacgggcgctccgccgagcagcggcttgccatcgacatgctgatggatcccgccgtcggcatcgtgtccatcggcggccgggccggcaccggcaagtcggccctggcgctgtgcgccggcctggaagccgtcctggaacggcgcgagcaccgcaaggtcatcgtgttccggcccctctacgctgtgggcggccaggaactcggctatctccccggctccgagtccgaaaaaatgaacccttgggcgcaggcagtcttcgacacactcggcgccctggtcagccaggaagtggtggaggaagtcatggaccgcggcatgctcgaggtcatgcccctcacccacatccgcggacggtccctccacgacgccttcgtgatcgttgacgaggcccagtcgctcgagaaaaacgtcctgctgaccgtcatgagcaggatcggccagaactcgaagatcgtcctcacccacgacgtcgcccagcgcgacaacctccgcgtgggccgccacgacgggatcgccgccgtcgtcgaaaccctgaaaggacacccgcttttcggccacatcaccctgacccgctcggaacgctcgcccatcgccgcactggtgacagaactgctcgaaggctagctgtattgaccacggacgttagtgatgttcggcgtggtttggtgacatgaagaagacctccgggtggagtggggcttgtctagagtccaattccacgcacggaggtcttcatgtcccaccctaacgctcttctgacgccccgggggcggctgcagctcgcgcaatgtgtcgttgatcagtgctggaacctgcgccgggctgcagagcggtttcaggtctccgtgccaactgctgctcgctgggcacagcgctaccgcgagcacggcccggctgggatggaggaccgctccagccgcccgcattgttcgccccggcgcacggcaacacgtacggagcggcggatcatcgccgtgcgtgtgaaccgccgctggggaccggcaagaatcggttatctgctgggcatccacccctccaccgtgcaccgggtcctgtcccgctaccggctggcgaaactgacctggctggaccgtggcaccggacgagtgatccgccgctacgaacacgacaggcccggggacctgatccatgtcgacatcaagaaactcggccggatccccgacggcggcggccaccgcgcgttcggcagggccgccggctggcgtaacagaaccggtaccgcggccaaccgcagacccggataccactacctccacaacgccgtcgatgaccgctccagactcgcatacaccgagctcctggccgatgaaaagaaagaaacggcagccggtttctgggcacgcgccaacgcctacttcgaatcccacggcatcaccgtcaagcgggtgctaacagacaacggctcctgctaccgctcccacgccttcacagacgcgctgggcccggacatcaagcacaaacgcacccgcccgtaccgcccccagaccaacggcaaagtagagcgctacaaccgcaccatgctcgacgaatgggcctacgcccgcccctacaaatcagaggccgagcgtgttaacgctttccccgactggctccatcactacaatcatcatcgaggccacacctcactcaggggtcagccaccggccagccgtgtcaccaacctgccgggacagtacagctcgctgggtgtgcgcgggtgccccttcctctgcgtgctggctcgttcctcgcctctgacgcacgctgccggaaggcacacccacgcgcacggccggtcccagtgattcgcgtaggagcgcatcgcgacgcatcggccgccagaggtcgctcagcgactgacggcggccctatgcggtgtgtctaagcgacggcgaagctccgggacggacggaccccgccaggactcagctgacgcggaggaacttcgctgctgcttcgtggccctcgactcggagggtccagtcggggcgtttgaaggtctccggggtgaggcggacgtgctggactgtttcgatctgggtgccccaggccttgcgggtgatgccgttcagttcgtagccgagggcgcgggagacgcccagggaggactcgttccagctggcggcttcggactcggctactgctgcgccgagccagtcgaacgcgtagagcgcgacggcggcgcgcatctccttgcccaggccgcggccctgcacggactgcttgagccaggatcccgtgctgaccgtcttgagggtggcgaagttcttggccccgacgtcctggcagccgatgaactcaccgttgtgccaaatgcccaggagaagcgtccaggattcgggcgtgcactcggcccggcagcgccagtgccagcgggccatgttcggtccaagctcttcggccggaagttcagtccagggagtgctgaacgggttcctgccgggctcgtggatacccgtgcgggcggctgcaactgccgccggaatctcatggtcctggatggggcgcagctccagccggggagtggccagcgaaagattgaagagcggccacacggcgttcagtgaagtcatccgcgaagcctagcggatgggcgccggttccggcctgtcacatcaggcgggcacatcccagctgatgtgccggcggacgtcggtgaggttcatggattccgccaggaaaaggtcgtccagcatgtattcgtccacggcaataatgcgcagccagtggccgtactggtccgtttcaggttcaagtgagcggctggatacacagacaccggtaccgaggtccatcctgatccgtgaacggcccggcatgcacagcggagcggcgggatccacgggatggtaggtggcggtcggggccaccacagcctcaagcgccggccggccttcatgctcaacccggcggacctcctgcacctccaccgggttgctgccgggaaactcgaggggcacgggggcgttgcctgcgagctccaccggatccagcgccgcggagaagcgcccattgccgaagccaggctccccgtaggccgcctcggggcgtcgcttcaccaggccgaggtcgtcataaacgggcgtcaccaggtggggcggcaggagccaggatttccgcgtggagcttgtgtaaagcccgtccctggaatcgttgatgcccgtggtgctgtggaggaccagtccctccgggctttccagccgcagggctccagggcgccgcagccaggcgcggaccaggggagcggcagggctgggagcttccacgaagggttcatcccagtactcgaagcgcagcgactgccatttccagggcgaggaccggcacaggttccggaacatggctgaaaggtccgtgggggcagctccactgtccggatccggccggtgccggaaatcccacgtcgccatatccacagtttacgcgcgggcggtgcgtgggcgcgtggaaatccagtagcatccgagggtgatccatcgactgggcgaactatggcagcacactccgcaggccttctggctggtgcttgccgcgtgcgcctatttcgcggtgatggccgtccggctcaccgtgatcgatgtccggcaccacctgctgccgaacaggatcgttttcccgtcctatgccgtggccggcgtcctgctcctcgcggcggcagcctttgccgggactggcgcagaccaaggttctgctggtcccctcgcgggcctggcatcccagccggtgctccgcgtcgtggccggggccgccatcctgtggctcttctacttcatcctccggctggcgtacccgccgggtatgggcttcggggatgtgaaactcgccggggtcctgggaatgtacctcggctacctcgggtgggggcatctgtttgccggcactttcctggccttccttttgggcggcctctggtccatcgcactcctggctgcccgccgggggacgctcaaatcgtccatccccttcggcccgttcatgctcgccggaaccgcagccgcgatgctgcttccggcctgacccgcagccgcgggaccctggcgggcgggcagccaacgcaggtggacggttcggtaggctggcacaatgcctgcgcctgactacgtcctgaagcttcgcaagaaaatcggcaacgatcccctatgggtccctggagtgcgcggcatggtggtggacgccgagggccgagtgctgctggcccaacgggcagacaacaggcagtgggccctggtgagcggcatgctcgagcccggcgagcagccggcccgcggactggtgcgggaaatctttgaggaaacggcggtggtagccgaaccggagcgtgtggtgtccgtgggggccgtgggtcccttcacgtatcccaacggtgatgtgtgcgagttcctggacgtcgtgttcctctgccgctacgtctcggggactgcgcgggtgaatgacgacgagtccctggccgtcggttggttcggactcgatgaactgcccgaactcatggcgggacacctcaccagcatccaccgtgcccttgcatccgccgaggccgcgcacttcgagccctgaccgcgcagcaggggcgccgcaacccccaggattgcggcgcccctgctctcctggccgtcagccgtgccgcgtgatgacggcagtacgacggcggtcagttgcgctggaagaccagctcgccgtcgtcgtccttgacgctgtccgcagccccagcctccggtgctttgtccgcacctgctgccactggtgccggcccgggcagtccggcggccagccgctcggcttcctcgccgcccactgcctcgcctcgggccaccatgccggctgtgtccgagagcgggatctgcttcagcgtgatggccaggaccaaagccgccgcgatgaaggggatcaggtaccagaacaccggggccagggactcggcgtaggcgttgacgatggcgtcgcgcagctgctccggaagctggctcagggcctgcggatccagtgtgctggtggactgggccgcctggtccgccgacgcgcctgcgccggtaaaggcactggtgagggactccgagagccggttggtgaagatcgcgccgaagacggccacgcccatggccgcgcccacttcgcggaagtagttgttggtgctggtcgcggtgccgatctggtcggcagggacggagttctgcaccaccaggaccactacctgcatgatcaggcccaggccggcgccgaagatgaacagctggaggcagatgacccagatgggggtgctggcggcgagggtggtcatccagagcatggcggccatggtgagcgccgcgccgaggatggggaacatcttgtacttgccggtcttggagatccggatgccggagtagatggatgtgcccatcagcccggccatcatgggcagcatcagcaggccggactcggccgcggaggtgcctgaggacatctgcaggaaggtggggacgaacgcaatcgcggagaacatgcccagcccaagggtaaagccgatggccgtggcgttgacgaagatgcggttgcggaacaggctcaggggaatgatgggatcttcggcccggcgttcaaccatcacaaaggcggccgcggaaaggaccatgcctgcgccaaaggcccacgtgaggggcgagtcccagccttcgtccttcttaccgccgaagtccgtgaagaagatgaggcacgtcgtggcggcggacagcaggacgacgcccaggatgtcgatccgcttgtctgccttcttgttcggcagcgtcagggtgaaccacgcaatggcgaacgctgcgatgccgatggggatgttgatgtagaaggcccattcccaggtcagatggtccacgaagaagccgccgagcagcgggccggccacggcggagaggccgaagaccgcgcccagcgggcccatgtatttgccgcggtcctttgccggcacgatgtcggcgatgatggcctgcgagaggatcatgagcccgccgccgcccaggccctggatggcacggaagatgacgaagccccaaaaatcggtggccagggcacagcccacagaggccagggtgaagagggcgatggctgtcaggaacaggttgcgccggcccagcaagtcaccgaatttgccgtagatgggcatcacgatggtggtggccagcaggtatgcggtggtgatccaggcctggtgttccacgccgcccagcttgcccacgatggttggcatggcggtggagacgatggtctggtccaggctggagagcagcattcccgcaatgagtgcggagaagatgatccagatgcgtttctgcgtcagcagcagtgggccggctgcggccctgggactggcggtggtgctcataaatgtccttctgcgggaaccgggagttcgaatggctgtgaaaagagctggctggcggcagagatgttctccatcagcagctcggcgtaagggcgggtgttgccgtcggagaagtaggccatgctgcttttccgggcgatggtccccagcaggaccacagccatctggaccacggggtggtcaggtgccacgccttcgcgaagagcaacatcccgggcgaactgggcctcccgctgctcggtcactccgatgattcggaggatcagctgcggctccttcttgacgacgccgatcagctggcgggtttcctcttccgaggcggccatgtgctcggacagcttcagggaaagccggaccaggtcctggaacagcgtgggggagatgtccccggcgggcgatgcgtgcccgcccgcgataaattcctccaggacgtctgcgggaatgtcatcgtcgatgtggccgaggacggcgtcttctttggtggggaagtagttgaagaacgtccggcgggaaatgtcggcctgctcgcagacctcctccacggtgtaaccgttgaggccgcgctcggcagtcagcttccgggtaatcgaggtgatcgcggcgcgggttgctgcccgtttgcgctcgcggaggccgccctcaattgctgcactttcattcacaaagtgaagttttgcactcatcatgaaagagtgcaactttttagggtggagtgatggagtttttgtccacgtatgcagggttgaggggcggtgaagcctgcatatctggacaaaaactccaaagcacgacggcggccgcccgccttcgctgggaaggtgagcggccgccgtcgtgctttggcagggcctccgccgggcgggccggcggggaaggggcctaagccttgtgggccggagccgtcatggtggtgacatcaagtgccttgtccaggtccgcttcggagacctggccctcgccgtcaccgacgaagcccagcttctcggtggcctggcggacggtcaggccctcggccacagccgtcttggcaatcttggccgcgttctcgtagccgatgtacttgttcagcggggtcacgatcgacggggatgcctcggccaggaagcgggcacgctccacgttcgcggtgatgccgtcgatcattttgtctgccatgacccggctggtgttggcgaggaggcggatggattcgagcaggttggacgccatgaccgggatgccgacgttgagctcaaaggcaccgttggtgccggaccaggcaatggcggtgtcgttgccgatgacctgggcggcgaccatgatggaggcttcgcagatgaccgggttgaccttgccgggcatgatggacgagccgggctgcaggtccgggatggcaatctcgccaaggcccgtgttggggccggagcccatccagcggaggtcgttgttgatcttcatgaaggagatggcgatgttgcgcagctggctggacgcctcgatcaggccgtcgcggttggcctgggcttcgaagtggtcgcgtgcctcggtcagcggcaggccggtgtccgtggccagcagctcgatgacgcgctccgggaacccggccggggtgttgatgccggtgcccacagccgtgccgccaagcggaacttcggcgacgcgggggagggacgcgttgatgcgctcgatgccgtagcggacctgggctgcgtagccgccgaactcctggccaagggtcaccggggtggcatccatgaggtgggtgcggccggacttgaccacgtccttgaattcaacagccttgcgttccagcgattcggccaggtagccgagggcggggatgaggtcgttgatcagggcggaggtggcagcaacgtgcaccgacgtggggaaaacgtcgttggaggactgcgaggcgttgacgtggtcgttcgggtggacgaccttgtcgctgccggccgccttgagggcgcgggtggccagctcggcgatcacctcgttggtgttcatgttggaggacgtgccggagccggtctggaagacgtcgatggggaagtcgccgtcgtacgttccggttgcgacctggtccgcggcctctgcaatggctttggccagctcgccgtcgagcacacccagttcagcgttggcctgggcggcagccttcttcacccgggccagcgcttcaatgtgcgcaggttccagggtcttgccggaaatagggaagttctccactgcccgctgcgtctgcgcgcggtacagtgcgttcacggggacgcggacttcgcccatcgtgtcatgttcaatgcggaactcttcagtggaagtcatggggctagcttaggacgcccgggcgccgcaccgaaaaccgtgaacggcttgctacacgctgccgccgaagccgttccggaaagccccttagagctcgccgattccggaaacaaggttcgcgcggccctcggccaggctgtacgaaaggccgatcacggcagccttgcctgacccaattgcgtcggaaatcacacgggagctgtccaccagccgttccgacgtctgcttgacgtgctccaccaccatgtcgttgacatcggtctggtcgttgcgcagcgatgtcaggacggagggcgtgatccgttccacgaggtcccggatgaagcctgccggcatctggccggtttccacggccgactttgtggcgctcacggcaccgcagctgtcgtgtccgaggatcacgatcagcggcacccccagcacaccgatgctgtattcgagggaccccaggacggcgtcatcgatcacctggcctgcggtcctgacgacgaagacgtcgcccaggccgacgtcgaaaatgatttcagcggcgagccgggaatcggagcagccgaagatcacggcgaacgggtgctggttttccaccagggaggaccggcgggacgcatcctggttggggtgcgaggtctcaccgttgacaaaacgttcattgccttcgcgcagccggcgccaggcgagtgcgggagtcaggtaggtagtcacgcgcctaccttacggcgctgcggcgggggagggtgaaactgtgacagccgggttgctgtccagggatttcacgacggcgtccgcgagggcggcgaactcgtccagttgggcctccccggacaaaacgacggtagtcccgcggtagtccagcaccagggacttctcacccttgccggtgtcccgaagctcccattcctgcccgccggcgttccgggagccggtgacgggagcgttgcgcgtctgctgcagcagccaggtggggttcgcgttcctggtctggaccagcccgatgaaggactcattgggcgtcaggtagccaacttcccaggtgggcacgccgttgccggttccggcttcccaccgggcgtagttagggcggaagctgttgccggtgtcaggcgcgacgggtgtgaatcctgccacatccgtggcattccgcgagaccgccgcaacgtcgatgttcggccggtagccatcactcttgggcagcggattcatgaggatgatgggaaggaacgcggcaatgctcaccaccagggcgatgatcattccgatgaccgaggcgttggcgcgtttggcggcagcagccggaatgacaggctttaccggcccgtttcctgccgcagcgctggatccgccgctgccctcggatccggccggctcggggctgggactggtcttttcctgcatgtcattcacccctctatagtcgcccatgccggcagccaacttccatttgggcgccgccggtccctgggcgccgtcgccggtacattgcgcgggcgcgtcatccgccgcccgctcgagcggctcgcgactatgatcggtagcagaggaaccaccgcgctgctgcaccggcggggcgggttttatgatcgccactcgaagaagaggttcacgtgtcaccagcgtccatgacccagaagtactccacgatctccccgtcgcttgccgtaggcattgacgagccggaccgcaaccttgccctcgagctggtccgcgtgactgaagccgcagccatcgccggcggccactgggtgggctttggcgacaagaacaaggccgacggcgcagcggtcgacgccatgcgctcgttcctccagaccgtccacttcaacggcgttgtggttatcggtgagggcgagaaggacgaggcccccatgctcttcaacggggagcgcgtcggtgacggcaccggccccgagtgcgacgtcgccgtcgaccccatcgacggaacccgcctgactgccctgggcatcaacaacgccctggccgtcctggccgtggcggagcgcggctccatgttcgatccttccgccgtgttctacatggagaagctcgtaaccggtcccgaagccgcggacatggtggacctccgcctcccggtcaagcagaacctgcacctgatcgccaaggccaagggcgtcaaggtcaaccagctcaacgtcatgatccttgaccgcgaccgccacaagccgctggtggaggaaatccgcgaggcaggcgcacgcaccaagttcatcatggacggcgacgtagccggcgcaatcgccgctgcccgctcgggcaccggcgttgacgcgctgatgggcatcggcggcacccccgaaggcatcgtggcggcatgcgccatcaagtccctcggcggcgtgatccagggacgtctctggcccaccagcgacgaggagaagcagaaggccatcgacgccggccacgacctggagcgggtcctctccaccaacgacctcgtctcgagcgacaactgctacttcgcggccaccggcatcaccgacggcgacctcctcaagggcgtgcggtactccaaggacaaggtcctcacccagtccatcgtgatgcgttccaagtccggcaccatccgttttgtggacggcgagcaccaggccagcaagtgggaaggctacgcccgcaagagctgacgcggggcgcgcttgaacgccaggcccccggagtgcgcaccgcgcttccgggggccctggcgttttaagcgcttggtatagggttgaagccatgattcctgctgttgtgccctgtactgaccgcgccctctgggacgaccacgttgaccggttccagggacatccgcaacagttgtggggctggggcgaaaccaaggccatgcatggctggtccgttgaccgcgtgctcatcaacgacgccggcaacaccatcggctgtgcccagctgctggtccgccgccttccgcttcccttccgggccctggtctacattccgcgggggcccatgtgcgccccggagaacacgcaggccgtcctgaaccggctcgccgagcatgcggccgtgcgccaccgtggagttgccctgagcattgaacccgactgggaccaggactctgtttttgcaggagccgtggctgccgcaggattccgtccgtccgccaacacggtgctgatcccgcgcacgctgatccttgacctcaccaggaacgacgacgagctcatggcggacatgtccaagtccacgcgtgccaacatccgcaaggcgatgcgcagcgacgtggagttccgcaaggtgaagaacgacgccgaacttgagcaggtgctcgcgatctaccacgagacggctgagcgcgccgggttcgggatccacgaggaccagtactaccgggacattttccggaacatgggggacggctcacccattattggcgcgttcgacggcgagcagctcctggcgttcgtctggcttgccaggagcgggtccactgcctttgagctctacggcggcgtgtctgccgaggggcagaaacagcgcgtcaactacggcgtgaagtgggcggccctgcaggcgatgcgggaggacggctgccgccggtacgacttcaacggactcctgaatgacggcatttccgacttcaagaagcagttcgccaagcacgaaaacatgctcctgggaacctgggaaaagccgctctcgccgctgtatcccgcctatgcccaggccatgcccctggcgcgcaggggactgcagacgggacggcgcgtcctgaaggctgctgccggccgggtgcgccccgtgctccagcggcttcgcccgggcagctagctgcacccaccagctgtgctcggcaaagggcgacggcggcaccccgcccgggtgccgccgtcgccctttgccgtcgctgcctgaagcgccgcgggctgctagaggccggtggtcacggcaaaggccagcgcctgctccgtgctgccggccacggggtggacgttaaccggagcttcggcggcagccaggaaggcgctgccgcccctcgaaagctgcaggtcgcccttgggcgaatccaggtagatctctcctgccacgacgatgaccacggccgctccggactgcgccagcgggaccggggccgcgcccggcgcgagctcgatgcgctggagctggaactcctcgaacggcgggcggaacacttcctggtcgaggaccgtccgctcggcggccagcatgggcaccgcaacaggttggaaatcaacggtgcggagcagttcgggcacatccacgaacttcggggtcaggccgccgcgcaggacgttgtccgaggaagccatgacttccacgccgaggccgtgcaggtaggcatggacatttccggccggcaggtacaccgcttcgcccggcgccagtgacacgcggttcagcagcagggaaatcaggacacctggatcgccggggtacttctcattcaggctgatgacggttttcagctcggactcatacggggcgagggtggctccggacaggagtgcagccaccaccagtgcggtatcgtcggccacggaccggcctccggtgatcaggcgctggaaggccttccggaggccctgcccctcatcgcttgcgccgaggtccttccgcagctctccgaccagggcggggaccccggcttcaccggagccacatgctgcggcgacgtgcgccaggatctttctcgtttccgccacagggcggaacccgcacagcgcctcaaacggcgtcagggcgagaatcatctcgggtttgtggttgtcgtcccggtaattgcggttcggggcgccagccggcacaccttccgcgttttcgcgggcaaaaccggcccgcgcctgctccaggctggggtggacctgcagtgagaggggctgggctgcggcgaggatcttggccaggaagggcagccggggtccaaatcgcgcaacggagtccgcgccgaggaaatggtcgggatcgcgggagatcagggcatccagcgccgtccccgcggacccgtccccggggacacgggcggtggacggtgagtcggggtgggcgccgatccacagttccgcttccgggcggcccgactcgggccggcccaggagggctgcgatggccgtcgtcgaaccccaggcatagtcgcgcaggacgttctcaatctcgtacaaaaccggttccgtttccctaggtttgctggataaaagtgtgcgctacaggggcgcgcactggccgttggttgccacgagctcggcgatggcctgttcgttgccctcgagtttgagctgggtcagcatctcttccgtgatcagctcgccgtcgggcgtggtggtcaccggggtgaagtccgacggcgcgggtgactgctgcgcccgaacagggcctgcgagggggagcctgccggcagttcgggctgccgcggcctggacatggcccggtgcggcgaccgcttccaccatggcgtcgtcctgcatgcctgctgcctgggccgaggatgcggaagccagcagctggtctactcggtcgtggatctcatcgaagtcagggaccgtggagaacgaggcgtcaaagtcgggagggccgatggtcagccgtttgatgtcctggcccttggccttcatggcaaggtccacgaagctgcccagctgcgaggaggagatgttggagtccaccaccttggttcccgcgtcggcgatgtcctcgaacttggccagcagtgtggcagggtccagctgcttgagcatggcctgctgcacgcactgctggcgctggatgcgcgagtagtcatccacatactcccgcgaccttccataccaaagtgcctggttgccgtcgagggtttgttcaccggccgggatccaacccaacggcatgccgtgggtctggctgaaatcgtcaaaatagccgctcatgggaacccatccgccggctttgatcctgataccgcccatcgcgtcgatgagcctggagaaaccgtccatgtccaccaggacataggcctgcaccgtgatcccaagcgtcccggaaacggcttccagggtggcctgtgcaccggggtcggccacgccggggtacaggtcggcgtactcgttcgtcacttcggtgttgatggcattgatcaggcattcgtccccgcagtcgtagccgtccgggtagatggcacgcatgggggagtcctcgctgaactgggcgttctggaggttccggggcacggagatgatggcggtctgccccgacttggcgtccacgctgaggacggaaaggctgtccgggcgcctgccggtgcggtcctcgcctgcgtcccctcccatcatcaggaagttgtagcggccttcaacgggatcgatcgtggggccggaggagaagatgctgccgatagcgttacgccccacattgagcaggtaggcagcatagccaagggacccgctgcccaggaccattgccagaaccagggctatcccgactgcgggccgtgcccgcggtgccagcagtgtgggccggatgagccggagggtgttgaggaacagcaatgcccaggcggcagccagggctgccagcaggaccacgatcaccagggaagcgaagggattggtgatgatgctgatcagcagggtccggttgaagagcagcaggagcacggcggcggccagggctgcccagacgccgagggtcacgcgcagcgcggcgcgcccaagtttgcggctgcccgccacgacctgggcgctgcccggaaccaggagggtcaggaggatgaggacgaaagccctttttgtgcgtaccgggtaggaagcgctggcagggtagcggaccgggtcagtcatggaggtcccgggggcgggctgccgcactttactgctggacatacgcgccgcctagcggccgccccgaagggcgccgttgccgtctgcgaagacctcgctgactttctggcgcaggttggcacccttccgggcggcgaccgcgttgaggtctgctgcgaaatcaaggaggtccgcgcgcagcgaggcggcgagctcgtccgtgcccgcagcgagcatccgcacggccaggagcccggcgttgcgggcccctgcgatggacacggtggccaccggaacaccggcgggcatctggacgatcgacagcagggagtccattccgtccagggttttgagcggaacgggaacgccgatgaccgggagcggggtgacgcttgccagcatacccggcaggtgggctgcgccgccggccccggcaatgatgaccctcagcccgcgctcatgggcagtctgcccgtaacggatcatttcggtgggcatccggtgggctgacacgacgtcggcctcgaagggaatgccgaactccgccagcgcgtccgccgcagcttccatgacgggccagtccgagtcggatcccatgaccaggcccaccagcggggcggcctccgaagctgtggcgggggtggttggggtgctcatggcttctcctcgaaggtacttggcagttcttctgccggtgcccggccgtcgcggatgatgctcgcaaccatcgtggcacggcggcggacggaatcaacgtctgcagtggacgaacccaccaggttcacatggccgatcttgcggcccgggcggacggacttgccgtaacagtgcacctttgcggcaggttcgctggcaagcgccatcgggaaggcggagaacaaatcctggttgtcgccgcccaggaagtttttcattaccaccacggggccaaggacatcggtggcgccgaggggaaggttcagtaccgcccgcaggtgctgctcgaactggcttgtcaccgagccgtcctgcgtccagtgccctgtgttgtgggggcgcatggcgagttcgttgatcaggaaccctgcgcccacgccgggggtctcaaagagctcaacggccagcactcccgtgacgccgagttcaccggcaatccgcagggcagcgtcctccgcggcagcagcgacctccaccgggatatccagggcaggggctatcacttcatcacacacaccatccacctggatggtgtgtaccaccggccaagcacgtgattcgccgtcgggcgtcctggcaacgagcgctgaaagctcccgggtgaattccactttggcctcggcgaggagggggctcatggcgtcaaaccactcagttgtgtcagcggcttcttccgcggaggcgacgatcctgacacccttgccgtcgtacccgccgcggggcatcttcagtacaaccggccagcccgtttcgtcgccgaagctgaccagtgccgccacgtccggcacggaggcccaggccgggttgggaagctccagccggtcgatggcagcacgcatgaccagtttgtcctgggcgttcacgagtgcgtcaggcccgggctggacgttgaccccggcgtcctgcagcgcccggaggtggtctgtggggacgtgttcgtgatcaaaggtcataacgtccaggccctgggcaaagtccaacagcgtctgcaggtccttgtagtcgcctaccggcgaggaggacactgccgagacggcggagacgtcctccccttcggcgaggacacggagttcgaagccgagggcagttgctgcaggggccatcattcgggcaagctggccgccgccaaccacgcctattactggaaaagtcacatgggccagcctaccgaagaccttccggtatcccgcgttccggtccggcgggccgggagtattttggtgcctggactacccccggccggtcgggaaggctgtctcacaggtttgggggctaaaatggcctctggcccaatggcccaaaattcacacagccatggagggccatgttcaccacacttgcagaccgtatccgggggctcgcctcgctgttttggcgcgaagtggccaaattcggagccgtgggcggtgtggccttcgtgatcgacaacggtcttacgtactacctgatgcacggcccgatgaccgacagcgaggccaaggcgcggttcgttggcgcctccgtggccacggtcttctcctggatcgccaaccgcctctggaccttccggcaccgacggcaggccaacgtactccgtgaattcctgatgttcgtcctcatcaacggaataggtatcggcatctccacgggcttcaccgccctcgcgaaatacgggctgggcatcacggacaagaacatgttgttcctggccggagtggcgggcattcttgtggctaccgtggtccgtttcttcgcctaccggttcctggtgttcaaccaggaactggaccaggaaccggagttctcccacgaccatgagctcatcgagcttcatcaccaccacaaggagcagggctccggggtggagcgcgaagcggagcgcgagccttcgacggacggccgcgccaagccttagctggacagcctggggcgcgggcaggctggaagccccccgcttcctagctgccgtgaatgcgctccgctgtgagcagcttctcggtcagcgccacctccggatgcgtcatgaccaccgatccaccgtgctgccaggcgcccaaggcattggacagcgcgctttccagtccgtttccggctggaatatgaaggcgtacgccttcatcgtggcgggcggcgaaggtgctgagcagattctggtgcgcgtgcgcccggccgtcacccgccacgacggcgcaccctgagggatcaggctcggcgtgcggcatgaagacgtccccgtgggagcggacctcggcggagtagtccaggtagccggcggtaagcgtacccggccaccgcatcgccagcgcgggcagggccacggcgatgacggcgtcgtagttcccttcaactgcctccggatccgcggtggccaggtagtccgcagcacccccgtcaaggacggtttggagccccacctgccaggcggccagcgcccagaccatggacttccagtgcgcgggcaggtccatgcgcaggcgcgagccgggggtggcgtccatctcgtcctggagcaggttgctcgtcttggcgacccagttgtccagcacccttccggagagttccacccgctcatcgtcagggccgtaccaggtgagccggggagccgttgaattgcccgaacggagcgttgacatgagttcagttagcgggttgcccatgccaccatcctgccactggcggccgggccagtcacggtggttgcagagccgtcggcgtaggtggagcgctcccgccgggtgggagtgatacatatcacaagagatactcagcctgcttgctagtttgtgtctttgcaggtattttccccgcggttgacggcgatttggggagttccggtgccctggtcgaagttcccggcgagccgcgccggggccgcgcgttaaattcccgggcgtggcgtacgccgcgttctccgttcggagtgattattatccggcggcagcttgactcgcccaagttacacacgtgtaattagataaccaaaggcaactgtgtaaatgccggcacacaaccgagtgccgcgtatccaggcagtagctgcaaatcaggagggtcgccgatggggcaagcagagcgtatccaggaagatgccgtcgtagccggtcaggcaacggcaaagtaccgtgctcggggggtgccaagcgactggtacgttgaccccgccgatcctgatgctgccgaccggtacaacaggaatgcgggcggcgtcctggaggaccaggccactgcattcctcgcggcccacgaagcgctgcttgacggtggcccggagccagaggatgacctcgacccgcccatggaactggcagccggaggcgcaagccagcctgtgtggatcggacttcccttccagcaggatttcgacgacgaaggcgagctgggctggcaaacagacgccctgtgtgcccagacggaccccgaggcattcttccctgaaaagggcggctccacgcgcgatgcgaaaaaagtctgcggagcctgcaatgtgcgctcgcagtgccttgaatacgcgctggcaaacgacgaacggttcggcatctggggaggcctttccgagcgtgagcgccggcggcttaggaagcgagcaatctaattcaccaggatgttcatgtcactgccgttgtggttgcccacaacggcagtgcctatctgcccaggacacttgcagccctggcgggccagacccggcccgcggacaacgcaatcggcgtcgatgccggatcacgggatgactccaaggtcctcctgcagcgggccttgggcgaagcaaacgtcatcagccagcagcgcggcaagggcggcatgggggcggcagtttccgctgtgctggccgaactggccccatgtcgggggagtgccgccccggacaagccggagtggatctggctgctccatgatgatgcagcacctgccccgcaagcactggccgaactgctcagcgccgttgaacgggcgccctcggtcacagtcgcggggtgcaagcagctggactggcacgcggaacgcaagctcatcgatgtcggcctgtccaccagccggtgggcggaacggctcaccctgatcgatgccgacgaactcgaccagggccagtacgacggccgcagcgacaccttcgccgtcaactccgcaggcatgctggttcgccgtgacatctgggagcaattgggcggtttcgatcctgctttgcccggcagcggcgacgacgtcgacttctgctggcgcaaccggctggccgggcaccgcgtcgtcgtggtgcccgcggcccgcatgttccacgtggcgcaccggccccacgccttgggcaacgcggcggcggcccggaaagcccaggtccacctgcgactgaagcattcgccgccatggatggtgccggtccacggtgccggggcactgctgggcagcctcttcagacttgtgctgagcatcctggtcaaggatcctgcgcacggcctgtcgcaggtggtagccacctgcgcggccctcggaaggccgcgcgcagtggcgaaggcccgccgcagcgcccgccggacacgccgcatccgccggtccgtgatccgcaagctccaaacccccaggcgtgaggtctggagccaccggcggtccctgatggaggcgctcggctcggacaccacaccggcggacgagcttgagcaggatccgttggcgcaccagcccactggcgatgcatcggacgacttcgcggccttggccaccacaaagcgcggatgggtgggcaacggcgccctggctgtggtcatcgttgcgtccgtggcgtcgctccttgccctgaccgggctctttcgggccgacgccgtttccggcggtgcggtcattcccgtcgctgccaacctcggcgacatctggcaccacgcttccagctggtggatcaccctgggggcagggctgcccggacggggagacccgttcggttatgtcctgtggatccttggggtcctgggcggaggcgatgccaacccggccatggcctggctgcttttgctcgccacgccgctgtccgggcttacggcatggttcgccgccggcgggctgaccgtccgccgccggctccggctggccgccgccctcctttgggctgccgcacccgcactccaggtcgcgctcaaccagggcagggccggagcgctggttgcccacatcatgcttcccctggtggttctggcgctgctgcgggccaccggatccgctgtgggccacggccgcttcacgctgccttcccctgtcgagggccgccccggtgagcggccccccgttcggcccggcattaacggcacgccttcctggaccgccgcggccgccgccggccttgcgctggcggttgttgttgcgtcggcgccgtcacttttggttccggccaccgtggtggtgttgctctgcggactcctgcccggccgccgcggccggacggtctggtgggccctgttgcccgcagcggccctgttcattcctttcggactctccgtcctcgacaggccccgggccatactggccgatcccggcctgccgcttgcctttgacgcagcgccgctgtggcagcagctgctgggccagccgctgcggtttgacccgcagggcggcctcgccggacttccgtcttttgccggcggcacagttccgtgggcgctggtgctggcactcctggtcgcagccccggtgctggcgctggccgtcgccggactggtggtacccgggcaccgcgccgccatggcgaagggtttctgggtggccggcatccttgcccttgcaggcggctggctggcaggccacgtggccactggcatcaacgcccagatcctcgtgaccccgttcaccgggcccgcagtgtctgctgcggccttcgccctcctggcggcaggcatcctgggagcggagcaccttctgtccatggcgcacaggggagcggccggcggcagcgccaagcgccgggcagcccttcggtccgccaccgcggtcagcatggtcatcctgctcgcggggcccctggccggaatggttgcgtggtcagcccagaacctgctgcgcccggccacggcgtccgccgccgccatggggaccgcctctccgggcgccgatgccgctggcagccaaacccccgacgccgccggactgcttggaaccccccggctggtggaggccgccaacccgcgcaccctccctgccaccgccatcgaccgcggaaccgggccggagcaagcacgcacgctgctgatcagtacgcgggacaacggcacattcgacgcatcattgatgcgcggtgccggaacaaccctggacagcctctccacgattgctgccgcgcggaacatcatcggaagcccgggtgccgagaccattcgcgacgacgacgatgtcaccgcggccgtgcgtcgcgtggtggcaacggtcgtcgccggccagggcgttgacccccggaacgacctcgaacagctgggcgtagggtttgttgtcctccgctccgctgactcagctgcccagctgacggccagccggatggacgcggtaccgggccttgttgccgtgggacaaaccgatgtggggtggctctggcggattaccccgctgaaccagccggccctgcaggcggcagacgtcgcacaccgggtacgcattgtcgatggaagcggtgctgccatcgggctggttccctccggcttcagcgacgtggacgcccccgttccggccggtcctgaaggtcgcctggtggtgcttgccgaacgggcggatgccggctggaccgcctggcttgacggccgcaagttgactgcaaccacttccggctggtcgcaggccttcacgcttccggccacgggtggccagctcaccatccgctacgaaaacccctgggccctgttgacggccattgcacagatcacgttgatcggcctgacggtcctgctcgccataccaatgccggccaggaggccacggaccggcatctcccgggacgagggctccctgcgtaaggaacaccagaatgcatgagcacactacgccgccggcagcgccggatgcccagtcctccggcgccgccggcgagccgctggaggacgcaagcacagcgcgcccggaaacccttgcacataccgggcagcggcctgtagcgcggggacgcaagacggcgttcgtggggatggcgtccgcggcaatgatcctcgccggggcaggggcggtagtggccgggggatcactgctgccacagccggaatcgagccgcgcggtagccgccgcagaggcagccgtccccgccggggcgagtgtgggcgtttgtccgggaccggcccggctgctcgaggggacagaagcaggcaccgacccccagttcagtccgaaatcagccaccgctgccagcgcagtgacgggcgcggtgctcggcgcggcagggatcctgccggccagccgtctgtcccagctggacgagacaaccgccgtcgaaatctccgcagggcccggccagggcgcttccgcgggggcgccccaggagctcctggcaggcgtggtggcggcccgtcccgtggagcaggtgagcgtgctgagcgccgacgcattggcgaaccaaaaagcctcggccgcagcggtaatgaagttcaccgccaccgatggggaccttcaaggcgcggcggcctccaactgccatcaaccttcgaatgaccagtggatcgcgggggcaagcaccaccgtgggccgggcatccgtgctggtgttgaccaacgcctccaccacccccgccacggtcagcctggagctcttcggcgcgaagggccagatccaggcgcccggcagcaggggcctgctggttgcgccgggcagttcgcgggccctcgtccttgccggcctggccccgggggagtcgcagctgagcgtccgtgtccggagtgccggcggccccgttgccgccgtcatccaacagagtgtcctgcggggcctcacacccgggggagttgacttcattgcccccggagcggccccggccgtgcggcaggtcatgacgggcgtggatatccaggaccctgccgggctgtcccagatgaccggaaagccaggatacgaggacgccggaccggcgctccagctaacagttccaggcccttcggatgcagtggtggaagtccggatgtacgggcgtggcggacaggaagccctgccctcgggtggggtcatcaccgccaaggccggcgccgtcacagaggtctccctggcaggtgtcccggcgggccagtacacggtggctgcatcttcggacgtttcgtttgtcgcggcggcacgggtcacccgcgggcttcaggaaggccagccctcggatgttgcctgggcgtccgccggagtgcggttgggcagccagcatgtggttccagtgccgcagggcgggatccgcagcctggtgttcggcgccctggacaccagggcaaccatcacgtacgccgccattacgtcggacgggaaagtaagggcaccggccaccgccgacatcgccggcggaacgacgtcctcgattgctgtccccgaaaaggagggcgacgccgacgtggtgggatacgtggtgtccgcgtcaggggacgccgcctacggctccgtgctaatccagcaggacggaaggaacgacgtctcaacactcgcgtttctggcggcggcggccggccaggaaacagtgccggtcaccctcagctactaacggcccctcagccgctgaatcaactgccggctgccgccggacggatcagtaccggcggcggtagaccgggtccagggtttccggtgccactcccagcatctcggccgtgtgctccaccacaacgtcatggaccaggtcctggagctcttcggggccggggcagccctgttccaccacgcgccggtagaccgtaatcatcggtccttcgccatccgcggcgggagtgtaggagcccattggcgccgacgccgagttggcggccagttgttcgaggtcaggcgggatctcatcgacgccgaaccggacgccgtccagcgtcttgccccagatgtcgtgcagccgctgcgctgaatccagcaccatgtcatcaaaccggtccgagcgcgtccggtacccggggtgtgtggggagcatgacttccccgcggagcccgcgtccatggcggttccggcggcgcatcatgaagcttttgccggaggagccggtgcccggattcccgggggcatccggaccagccaaccggaccgtgaaacctgatttctggttcgatgactgcatacatcgactctaaacccgggggaacatttatgcgatacattcgccgggcggcagggacgcgtcggctcaggcgggcaatgcacggttttggcgcggacaccgagtagtctgtgatgtcgtgggagctatccgtcagtgttcaagatctgcctgccgccagtcagcggtggctaccctgacgtacgtctacgcagactccacggccgtcctcggccccctggccaccttcgctgagccgcactgctacgacctgtgcgaacagcacgctgactcgctgaccgttccgcgtggctgggaagtcctccggcttgccatgccgtcatcgccgcatcagcccggccccgacgacctcctggcccttgccaatgcggtgcgggatgccgcggccctcccggcccagggacagcagccgccggcacagcgcgcgccccattctgcgctggaagcaccggccggcgccgaaggcacccgcaggggacacctgcgcatcctgcgtgaaccctcctgacatcctctggcggtaggctggtagctgcacaccagtccgctaccggcgcgagcgcgcccgccagggagcaccaagaatgccacttatcaatcctgagctgctgtccgtcctccgctgtcccgtcacgggctcggccctggtgcaggaaggtgaggaactggtggcggccgtcgccggggattccggagttaagacgcgctacgccatcgaggacggcataccgctcctcctgccaccggagctgctggcagcagccacggcggcaggatcggaccagcacgatgcagccgccggaacgggccaacccacgtagcagcgaacgggccggccgggacgcaggcgccacggccgccgtcgaactttacacagcaacaccggaacctacagcactccggacaggacgaaggattacccatgacttttgattacaaggttgccgatatcaccctggcggaagccggccggcaccagatccgccttgccgaacacgagatgccgggcctgatgtcgctccgcgaggaattcggccccacccagccgctccagggcgcccggatcgccggatccctgcacatgacggtgcagaccgccgtgctgatcgaaacgctcacggccctcggcgccgaggtccgctgggcctcctgcaacatcttctccacccaggacgaggccgccgcggccgtggtggtcggaaacggaaccgtcgaggacccccggggcgttcccgtgtttgcctggaagggcgagacgctggaggagtactggtggaccgccgagcagatcctcacctggcccggcgcggacagcaacccggacctcggcccgaacatgatcctcgacgacggcggagacgccaccatgctggtccacaagggagccgaattcgaggcccttggtgccgtcccggccgccgccgatgacgagtccgaggaaggccgcgttttcctcgaggtgctgcgcgcttcgctgcaggcggatccgcagaagtggacccggatcggctcccgcctgctgggcgtcacggaggaaaccaccaccggtgtgcaccgcctctaccagctcgcggagcagggcaagctgctgttcccggccattaatgtcaacgattccgtcaccaagagcaagttcgacaacaagtacggcatcaggcactccctgccggacggcatcaaccgcgccacggacgtcctgatgggcggcaagatcgccgtcgtctgcggttacggcgacgtcggcaagggcgcggcggaggctttccgcggccagggctcccgcgtcatcgtcactgagatcgatcccatctgcgcactccaggcagccatggacgggtaccaggtcgcaaaactggaatccgtcctcagcgagggccacatcttcatcaccaccaccggcaacaaggacgtcatcctggccgagcacatggccgggatgcgtgacaaggccatcgtgggcaacatcggccacttcgacaacgagatcgacatggccggactggcccgtatccccggcatccggaaggtcgaaatcaagccgcaggtgcacgagtgggttctcgatgagggaacagaccgggaacggtccatcatcgtcctctccgaagggcgcctgctgaacctcggcaacgccaccggtcacccttcattcgtgatgagcaactctttcgccaaccagacgatcgcgcagattgagctcttcaccaagagcagccagccggagggggagcgggagtacgggaaccaggtttacgtgctgccgaagatccttgacgagaaggtcgcccggctgcaccttgacgccctcggcgtggaactgaccgagctctcgaaggagcaggccgcctacctggacctcgacgtcgcaggcccctacaagcccgagcactatcgttactaagaagtgaagcgcccgggtgcccagcgcgcccgggccgttactttttgcgcctaggatcaaaatatggagcccgaagtcccgtcccgccgtcccggtcgactgaagaagattcttgtggtggcagccgtctgcctcctcgctgccgtcggcggtgtcttcgccgctgtcgcgccggacatcgcccgtgggtccatcgaatctgaggccagctcctccgtgaggacgtccccgggcatcgcagctccggtggtggctcctgtcacgtccgacgccgtgccggccaacggggcgaagcaagtcaacccggcagctccggtgtccctgaaggtcaccaacggaaccatcgaacgcgtcaccctcaccagcaccggcggggagaccgtggagggcgccatcgacccccagggaaccggctggactgccgcgggtcccctgaaattcaacaccggctacagctacacgtacgtggtcaaggacggcgcgggacgggagaccagcaccacgcagtccttcagcaccgtctccagctcccatgaggcggacgccgctatctaccccctggacggcatgaaagtgggcgtcggccagccgctgcaggtcatcttcagcgagcccgtggtcaaccgggaggccgtggagaaagccatcagcattaccagcagtgccggccaaacaggcgccttccactggcacagtgacaccatggtccggtaccggccggagaacttctgggctgccaactccaccatctccatggacatgaagctgttcggggttgacctcgggaacggccagatcgccaacttcaacaagaaggtgaacatctccatcggcgacaagaaggtggccgtggccgactccgcagcgcacacgttcacgctgagcgtcaatgaccaggtggtcaagacactgcccgtcagcatgggggacaagcgcttcccctcagcgcgcggctacggggtgctgatggaaaagaagcgctacgaccacttccgggcctcaagcatcgggctcaagcccgacgatcctgcctattacggggacgttgacgtggaatacaccatccgcctcaccctcagcggcgcctacatccaccaggcgcttgagtctgcctatccgttcatcggcaacgcgaacgtctcgcatggctgcattgggttcgctcccgacggcgctgcctgggtcttcgacaacatgggcaccggcgacgttgtgcagatcgtgaacaccgagggcgactacgccgcccacgatgacgggttcggcgactggaacatcccgtggagcgagtacgacaactagctcagctgccgaaaggaagccgctgcaaccgctcaccgatatcggtgttgcgccggcgtgcttccatcagccgggccagttcccggctccggcgttcagcaacgacggcggcaaggaagtcgtccgtgctggttcccgccggcgggggaggggccacatgggcggacagttccgtggcgatcgatgcggccatctctgaccgggacgtcggcgccatccgccccgcctgccggaggaactgggaagccctgcgcgccgtcgggtcgggaatccgtccaatgtccgcggcggcagcccaggcgcggagccgcggcggtacaaacaccggaaccggctgctccacgggcacgcgggtgcggaccgcgtaggttccggccatcaggtctccgagccgccgcgacctgtcattgaacagcgcaacggtcagcgccaccccgccgaaggtaaggtagatctccaggaatccggtcagtccccggatgacggcgtggcggaaacggatggcaccgccgtcgtccctgaccacccgaaggccggtggccaacttacccagggagcggccgcggctcagcgtttcaactgccacgggaacgatgaccaggcagaagaccacgctggccagggtcagggcacgggcagcagcctcatccaggtcctctcccgcagcggcaagcccgatcaggatcgcaataagcaggacgatgttgaaggcgacatcaaggaccagcccaagggcgcgggccgcgaaagatgccggccgcagctccaggaccacggcctcgcctgtgatgatcgaactcactgttcttccccgttccgccgcccctccggtgcgtcgctcaaagtctagtgcggtggcgctaggctggtcgcgtggatatggacgccttttccgcagccaacgcggacaagtgggcacggctgcacgagctcgccgccaagggcaggctctccggccgcgaggccgatgagctgctggcgctgtaccagtccacgtccgcccacctctcgctgatcaggtcagtcgctcccgaaagcggactttccgcctcgctgtccgccacgttggcgcaggcccggacgcgcttcactggcgccaggtccaacgtgccggcggacctggcgcacttttttgtggtggcccttccggccgcgctgtaccggttgacctggctcacgctggcctgtggtgcggcctttatccttattggcgcggcgtacgcgctgtggatcggcacgtcgcccgaggcgctgcgggcagtggccaccgaggcagcggccaggcagtatgtcgaggaagacttcatcaactactactctgaaaacccggctgcctcctttgccggtgctgtctggaccaacaacgcctggatcagcgcgcaggccgtagcgctgggtattacgggtttttgggtgccgatgatcctgttcagcaacgcccagggagtgggcgttgcggccgggattttcgccgccgccggtaaaagcgacgtcttcttcagctacatcctgccgcacggcctgatggaactcaccgccgtgttcattgcctgcgcggccggactgcggatcttctgggccatggtgtcaccgggccggcggaccaggggacgggctgttgccgaggaaggaagatccctggtcaccgtggccctgggcctggtccttgtgctgtttgtctccggtctggttgaaggattcgtcacccccagcccgctgccggtatgggccaagatcgggatcggagccgctgtcctggccgcgtactggttctacgtgctgaggtggggcaggcccgcctacctcgcgggagaacgcggcgatctgcggcgcgaggacgcgggctacacggaaatcgctgcctgaatcgttgtaattccgccggggtggttcctcgtccagcccaaggcccggacggtaggctcgacaccagataagcgcgccagctgagcccggcccggcgcggaaacacgacggaagtgacgctgctgtgaaagacgaaacaccggcccgcgccaagagcgctgagccgcagccggaaccccacctggacacgtccggggactccgacgagcccgcgttttcctggctgacccccgccgggaagggctccggtacggcggcggggtcctccgcctcacccgctgcctcttcacccgctgacagcccggccgcggcctcttccaccgctggcggcggttccactgttgagggcggctccgcaggccatgccgctggtgcttcctccgctgctgcccggagctccgccgttgcgggcggcgcagaatccaccccgggcagccggaacgggtccatccagccggagagcagggcggaccggaaagccgctgaagccgccgccgaggctcccggggaggacagttccctggtcttcaaggagccgcttcctacctccgcgctgcaggtccgcccgccggaggaggaggtggaacgccgcaatgcccagcgggagagtgccgccaacgccaagcctgtggcgccccgggtgatgcaggtcctgctcgccgtcttcttcccgctggtcctgctgatcctggctgtccgggcggtgaccagcccgctgttcctgtgggtggagtacaaccggcccgggttccccggcgacgggtacggcttcagcaccgacgaccggatgacttacggctcctacgccgtggattacctgagcaactggtccggcccgcgctacctcggggatctggtgcaccgcagcggcgacaagctgttcaaggacggcgaggtgagccacatggcggacgtcaagctggtgatcctgtccacgttcggcgccggcgtcctgctggtcctgttcagcatcattgccatcctctatctccgcaagcgaagcacgggcggagtccggaggggcctgttcgcaggctccatcgttaccctggtcatcatccttggcctgggcaccctggccgtgctcggctggcagcagttctttaccgagttccaccgcatcttcttcgccgacgggtcctggaccttcagcctggacgacaccctgatccggttgttccccggccagttctggattgacgccggcatggtgatagcgggcctggtgctgctggcctcactcgtgaccctggtcctcacctggccgacccgccggcggcgcggcctggccaaggacggcgccgcacccgcggcggttcaggagtaagccccgggacgtggcaggcagccgggggactgcgacctaggcgtagagttttgcgatctcatcggcgtagtcgcgcacgacggcggcccgcttcagtttgagggacggagtcaggtgccctgactccacagtgaactggacgtcgaggatcgagaagctgcggatggactccgccttggacacgagcaggttggcgtggtccaccgccccctggactgccgcgaggacgtccggatcgttgaccgcgtcagccgctgccagggcgggcaggccccgttcggagcgccagttgtcaacaccctccgggtccagggtcaccagtgccgagacgaagggtttaccgtcgcccaccaccaccgcatggcctaccagctggtgggcgcggatcttctcttcgagcgggcccggagccacgttcttgccggctgcggtgaccagcaagtccttcttgcggccggtgacggtgaggaacccctgcgcatcaagttccccgaggtcgccggtgcggaaaaacccgtcaacgaaggcctcagcgttcgcggcccggttgttgtggtaccccttgaagacaccgatccctttgaccaggatctcgccgtcgcctgccacccggatggtggtgcccgggaccgggatgcccactgagcccacacgcgtccgggccggggtgttggccgtgcacggtgctgtggtttcggtcagtccgtagccctccagcacgggtatcccggcgccgcggaaaaagtgcgcgtcatcgagggacaggggactggcgccggatacggtgtaccccacctgcccgcccagggcctgccgaagccggggatacagcagccggtcgaagagtgcgtgccggacacggcagatcagccccggcccgtcgccttggccgcggttgcgccggtcctcctcccgcgaaaactccatggcggcctctgatgcagccttgaaaagccgggccttgccggccagggctgccttgtgggcggcggtggcccggactttctcgaagatccgcggcaccaccagcaggaacgtgggccggaacgagcccaggtcctccagcagctgcgccgctcccggcgtgtgtcccagggtggcaccggcggtgaggcagaccacctgcacggcgcgggccaggacgtgtgccagcggaaggaacatcagggtgcgcgcctggtcctgcaggagcagctccggaaggaacgccacgatgttcttggccaccagggcgaagttcccgtgggtaatctcgcagcccttgggattgcctgtggtgcctgaggtgtaaacgagggaggcaacatcatccagcccggcctggctgcggtgccgttcaagctccgcgtccgtgaccccagtgccggcagcggcgaggctggcaaggtccggcgcgtcgccgtcgtaatccatcctcaccacgttgacgagccggtcacgaaggatgtcggagcctgccaggacccccgtgaccagggcgacaaggccgcggtccccggcaaagacacggcgcacgcccgcgtcctggatgatccactccacctgccgcgcggaggatgtttcgtagatgggaaccgtcaccccgccggcgaaccagatggcgaaatccaccagggtccactcataggaggtgggggacatgaccgcaactttgtcgccgggctcgatgccgccggcaatcaggcccttggccaaggcgctgacgtcctgcaggaacttggcggccgtgacgtccacccagccgttcgggcccttccgccggtacagggcatgggcagggttggcggcatgctgctccagcagcaggtcggtcacgttgctggcggcgtcaagctcaaccagcagttcggtgctcgcttctctcacagcaggtctccgttccgctgccacgccgcggcagcggctcagttggggtctgatgccatcctgccctagatccaggacggcatccacatccggactttccagccatcgtagggaatggtttcggcggcccagaccggataaaagaatgccgacagcaggatcgccgcagcgatgaacaggaccaccaggtacagccctgaccggcggcgccagggcgggtcggaggccctgcccaggacgaggcccaggcagtacacgagcgccaggatcaggaagggctcgaaggacaccgcgtagaagtagaacattgtccgttcggggtacaggaaccacggcaggtagcctgcgcccacaccggccagtatggcgccggcacgccagtcccgccgcccggcccaccagaacaacaggaccaccagggaaatgacggcgccccaccagatcagcggatttcccacggacaggatggccgaggtgcatttttccaccgcgcagcccgggctgccctgcggcggcgattcgtaaaagaacgacgtcggcctgccaagtaccagccagttccaggcgcttgcctcgtacgggtgatccgatccaaggccctggtggaaggtgtaggcctcccggtgatagtgggccagcgagcggacagcgtccggcagccagccccactcggcagaggggttgctttccgcccaccggcggaagtacgcattcccggaccggaaccagcctgtccacgatgccgcgtacaccagcccggccacgggcaccatgctgatgaaggccggaattccgtccttgatgatgccgccactgatccagccgcggatgccggcaacccgccgggcgttgaggtcccacaagaccgtgaggagtccgaacccggcaaggaagaacaggccagaccatttggtcccgacggcgagccccaggcagagccccgccgccacgcgccaccagcggatccccagccacggacctgacagcagctggcccgccgtcggacgccctccgttgtttgcggcggcccgcgccagccggagggccaaccgccgccggccactgtcccggtccagcagcagggacccgaacgcggccaggacccagaacatgagaaagatatccagcagcgacgtccgggacatcaccaggtgatggccgtccaccgcaaggaggagcccggcggcccccgccaggggaagcgaccggaagagcttcagggcaattagggacaggagcaggatggacagtgtgccggtcagtgctgccgcgaagcgccagccgagagggttgtccgggccgaagatcgccatgccggcggcgatcatccacttgcccacgggcggatggaccacgtactcgggggagtccagcagcacccccgggtttccggcgttgaacgcgtcattggctttgtccggccagccgcgctcgtagccgctgaccaggtaggagtacgcgtccttgacgtagtacgtttcgtcgaagaccagtttgggcggggcctcaagccggacaaacctgaggatcccgccggtaagggcggtcaggacggggaccagcaggaaccacagcctcagcgacggcgggtagtcgcgccatccgcgggcgctgcccaggagccgtgccagcagggattcgaccgtgaaggcatcggcggggcggctgacccagggccgggtgggggaactgccggaaccgcctgctgtcctcccggtttcatcgcaggccgccgcgggggcggcctgtccggtcccgcccggccgcgtcgaggtctgcgtcaccagcccatgctaccgtttgcggccggcggtccccggcagcagtaggctggtggcgtggaccctaaccccagcatccttcctgattccggcccggcacctgcagggcgcatcgtgcttgccgccaccccgatcgggaacaccggtgacgcttccgcgcggctggtggaactgctggggactgcggacatcgtggcagccgaggacacccgccgcctgcaccggctggtccagagcctgggcgtcactgtggccgggcgggttatcagctaccacgagcacaacgaggccaccaagacggccgagctcctggcccaggtgcaggcaggaagcaccctggtcatggttaccgacgccggaatgccctcagtctcggacccgggtttccgccttgtagaaggggcggtcgcggcaggcctcaccgtgacggcgatcccggggccgtcagcggtactcaccgccctggccttatccggcctgcccacggaccgcttctgctttgaagggttccttccgaggaaggccggcgagagggcgtcgcgcctggccgagcttgcgggggagcgcaggaccatggtgttcttcgaggcaccgcaccggctggaggtgatgctccgggcgctgcgcgaacggttcggaccggaccgtcccgtggctgtctgccgcgaactgaccaaaacatatgaagaggtcatccgcggcaccctcagtgaacttctggtatgggcggaaagcacggagatcaggggcgagatcgctgttgtcctcggcggggccccggaaaaggcggccgggacgccggaggaccatgtggccgccgtgaacgaactcgtggcccagggcatccggctcaaggaagcggtggcagcggtggccgaggacgtccgcgtgagcaagcgggaactgtactccgccgtcctggcggcccgctgacggtcccgcacacgatgcctgggcgggctgtgcagctgcacagcaacgccgtgatgcggcagtgcgcaacggcgtagaccagccggaagccgccgcagtagtctggcagtaattcagcctgtatgggcccggtcactccggccgccgccaaagggctgcaccaaccctactgacgagggagtcatcgtgactgtcactgcacagccggccgtttccgcagaccgcgaaagcgcccttctggcctctgtccccactggcctgctcatcaatggtgaatggcgggacgccatctccgggaagaccttcgacgtcgaggatcctgccaccgggaaggtgctgttgagccttgccgacgccggtgccgaggacggtaaggcagccctggacgctgccgccgcagcgcaggagtcctgggcaaaggtcccgccgcgcgaacggggcgagatcctccgccgcgcgttcgagctcgtgaccgagcgggccgaggacttcgcgctgctgatgaccatggaaatgggcaagccgctggccgaagcccggggtgaggtcacctatggtgccgagttcctgcgctggttctccgaggaagccgtccgcgcgttcggccgctactcggtgtccccggacggcaagtcccgcctgctggtgaccaagaagccggtgggcccgtgcctgctgatcacgccgtggaacttcccgctggccatggccacccgcaagatcgccccggccgttgccgcaggctgcaccatggtcctgaagtccgcgaaccttaccccgctgacctcccagctgttcgccgccgtcatgatggaagccggcctgcccgccggtgtcctgaacgtcatccccacctccaccgcgggcgccaccaccggcccgctgatcaaggactcccggctccggaagctctccttcaccggctcaaccgaggtgggccgccgcctgctctcggacgcgtccgaaactgtcctgcgcacctccatggaactcggcgggaacgccccgttcctggtcttcgaggacgccgaccttgacgctgccgtcgccggtgcgatgctcgccaagctccgcaacatgggcgaggcctgcacggcagcgaaccgcttcatcgtgcacgaatccgtcgcgtccgagttcgcggagaagttcgccgcgaaaatgaaggacatgaccaccgcccgcggcaccgagccggagtccaaggtgggcccgctgatcgacgcgaagagccgggacaaggtccacgaactggtctccgacgccgttgcctccggcgccacggcggtcctgggcggcgggccggtggaaggtccgggctacttctaccagcccaccatcctctccggcgtcaccgaaggcacccggatcctgtccgaggaaatcttcggaccggtcgcgcccatcatcaccttcagttccgaggatgacgcggtgcgcctggccaacaacaccgaatacggactcgtagcctacgtcttcaccaaggacctgaaccgcggcatccggatgggcgaacgcctcgaaaccggcatgctcggcctgaacgccggggtcatctcgaacgccgcagcacccttcggcggcgtgaagcagtccggcctgggacgcgaaggcggcctcgaaggcatcgaggaatacctctacacccagtacatcggcatcgcagacccctacgccggataacgcctggatcagccaaagcggccggtcagccgccgctttgccggcggacgccgttgcgcactccctgcctggaaggaccaggacgggagtgtgcggcggcttttgccgtcctgcgcaggaagcgccccgcgcccacgaacggtgcagcaagcagccggcccagccgccccatgacggacggcgggatccatgccgcctggagccgccgagccagccccgcgttggcctgcagggacg

SEQ ID NO: 29 - DNA, 124057 bp, Arthrobacter sp. OY3WO11
gctggtccggactgtccgccgtcggccgccgcttcggggacggcgccggacgggcggccgtagctgtggcgttcgaagcctgacgtgagcgcagcaacggcctggtgcgccgcctggtccaggccatcagggtcccccagcagcgcgccgcgcagccgcgctgaataggcgcggggcgattcgctggacccggcgggtaggccatagtcggtgccgaggtccagcagttcacgccagcccaggggtaccgcattaccggggtcctggggcttcaggcgcctggccctgatgcccgccctgatgagccggggcgcggccatcaggagtgccatccccaggacgccgcctgcgcccagcagccatggcaggagctgcacgcccgaatcggcgcttccgccgccgccgggggcgggcagcgcagtggcgctcggcgcgggtgtgggagccggggtggcgtcgggaaggaggtcgtcattgttgtccagcacgtcaggggcggtagcggtggacgattcggtggcgtagtcgggaaccacgccacgggacggcgtaggctcgaaaggcacccagcccaagccctggaagtagagctccggccaggcgtgggcatcgcgtgcgtccacctcatattccggcagcgctccctggcctgccaccgaaaccgtggcgccggtgagcctgcccggtgcgtagcccaccgcgatgcggctggggatgccttcgagcctcgccatcacagccatcgcggacgcgtagtggatgcagtagccgctcttttgctccaggaagtcggccaggaccgacaggccgttgccgtcgtagccgccctgcaccggagactgcagggaataggtgaactccgccgaacggaggtacttctggatggccatcgccttcgcgtagggggtgcctgtccccgccacggtatcggcagtgctgcggacaatgtccggaacgttgccgggaatcctggtgaaatcctccgggatgccctcgacggaggccgaggactgcgccaggagccctgccgtcagccggggagcggtggacgtgaccaggtactcctgccgcctggacgttgtggtgtccgaacccttgatgctcagggtggccgggtcccaggtccaccgcccgctgagtccacggaccgattccggggcataaggggcaggaagataggggctgttgaagctgccggcgtcgatggctgtgaccagccgctgctgctcgtctgccaggaccgtgtaaccggaatcgatgcgcccgcccaggggcagcctggaggcgtcacggtcgtccgggccccaggagtcgccgtcgaagtggtccacggtgacggaacgcaggtacagcggggtggaggcattcgtggcgtaggtgatgcggccgctgccgtcaggtgtccgcaggctgttgcccagcgtgatcatggggttcaggccagtggaggtgccccacgggttgagccgggaaccttgcggaaacgttccctggtcaaagccgggaattgccatgggcaccaccagtgtggcggccaacgcgacagagcccgtgagcacggcacgcttcatctggcccggactcctggcggaatcagtctggaaccgggcgccgggggcgaaatactggctgcaggcaaggatcgccaggtatcccgccaccgtgaaggcgaatccccagaagcccacgctctgcggtttgatcattgccgggaccaccaggatggccagcagccccaccccggcagcagctggcatgccgagcggcagcgcgagggcgtccaccaggatcaccgcaaggcccaggacagcgcaaatgaccatgacgattcccacattgggcgccacgggcgccgtctcggaaaggacggtttcgctggccctccggatgaggcggtccagctccaccagggttccgccggtagggatgaacccggccacgctggagccgcggaagaacgtcagtgtcaggacggcacccagggagatgaatccgccggccgtcaccagcaggggctgggcgcgcacggaccgcagggcagccagcgtgaggctgaccaccagcacggtggtcaggacgggccagtaccagccccagccgcggagcaccccattcagcgaaagcgcggcaccggagacggccacggcgatggcgccggccatggcccaggggtaggcgcccacccggtgccgggcggcggccttctccggccggctgccggactgcctgctggctcccggactgcgtgttggtgccgcggtcaccgcgcggccccggttccgcggcggacctccgctgagggagcgggcactgccacgtcctggtcgaactggctccaggccgatgccacggggacggcgggcgcaacagccaccgcacgccagcctccctgccgcagcacttccaggacctcggccgattcgccgggcttttccgtcacgatgacggcgaaggcattggtggcgtagcccgcggcaggggcaagggcgagggcctccattcgcgagagtgttccgaggactgcgatcaccggtcccctcatgcggtgtgcggaaagtttgtccatgagcaggtcatcgaacccctcaggtcccaggtcgagggcagtgcggtcgccggctgcactgacccggcccacccattgctggagggcattgtcacggtgtggatggtgggacccggtcagctggatggctgcaaggctctcggcgatggactggagcccggctgcgccgctgtattcttccacctcaggttcgggggcagacggcgaacgcaggaaggcgggtccgcccccggtgtcgagcaggcgcagcgcatagttccgttccgccaggtgtgcgctgatggacatgactgccaccaccgaccattcgaaggttccgctggtggccatggggtgcccgtccgcgcctgcctgacccgccggcccgccgccggaccctccggaaaacgcgccgtacctgtggtccatgatgaccgtggcctccggtgtggtgacggattcctcctggcgcaccatcaggtcgccgtggcgtgcggtggcggcccagtgcacccgccgcatcgggtcgccgtggcggtactcgcgggtcatcacgtcgtcgtcgctggggttggcgcggatcctggttgccgtcacaccatcgttgccgcgcgcgccggccagcccggtgaggggaagaacgacggcggcgggcgtcacggtgaggatgtcgccgtcgtctattgcctgcctgtgcagtgacaggccaaacggatccgtgaattcggcggtcaccgggccgatgaggaactggccgcgctgggccgaacggagatggtattcataccggctggtgcccccggtggctgaacgcgacgggaaccggaaagccggcgactcgccgaagcgggcaggcagccgttcctccatggtggcgctgccgctgccgctgcccgtccgcgccactgcgagccgcacggttgtgggcgcggacgtctccacgggagacggtgtgaactcccgataaacctggaaccggggcttgaccagccggatcccggcgagggaaaccagggggaggacaatcagcagcaccgccagtgtcagcaggtccctgcggcccatgacgtatgcggcgcccactgcgactccgcccgcggcgatcatgccccaaccgcgttgggtgaagaggtgccgcggcaccctgtccggcagcgccatgggtttcccctactggttcctgctcagcccggtgaccggggccgccgccctgccggcaggtgccgcattccgggtgccggttccggcagtctccgaagtgacaggaaggcgggacaggatgcccctcaggacgctgtgcggggtttcaccggaccctgcagctttgcggtccaggatgatgcggtgcgcgaggacggcttctgcgacgtggacgacgtcgtccggcaggacgaagtcgcgagcgtccagggcagcggtggctttcgctgcccgcagcagctgcagcagggaccgggggctggcgccgagccggagcagcggactttccctggtggccctgcccagcgataccgtgtactccttgacggccttggacacgtaaacctgctggacggtggtgatcatggcggccacctccgcagaggtgaccacggcggagaccttggtcaggggcgaggtggcctgatgcgtttcgagcatctcaatttcggcgtccttgtccgggtaacccatggagatccgcgccataaaccggtcccgttgcgcctcgggcaacggataggtcccttccatttcgatgggattctgggtggctaccaccatgaacggctcgtcgagccggtacgaggtgccgtccaccgtgacctggtgctcttccatgcattcgagcagcgctgactgggtcttcgcggaggcccggttgatttcgtcgccaatgacaatgttggcaaagaccgccccgggcctgaactcgaacaggcgggaggactggttgtagatggacactcccgtcacgtccgacggcagcaggtcgggggtgaactggatccggttgacggtgcagtcgatggtgcgggccagggtcttcgcgagcagtgtttttcctactccgggcacgtcttcgagcagcaagtgcccctgggccagcaggacggtcagtgccagcctggcggcgtcggatttcccatcgatgacggtattgacagacgaaaggatgcgctgcgttgccgcgtggaagccttccgcgtccatggcggccgggcggtgcccgttcaggtggctgacgggatcagcgagccccgccagagtgcggttcgcagcgctcacatcgttggcagtgcgtcggtgggattccatcggcaacctttcagcccggggtttcacctggacgggacaacaagcctgccgtcgcccgtcggtgggcgttcgcatgtgttcataccagactactaacacaactgccgcagctgacagagagttccgacaaaaagggggaagggtccgcagctaggctggatggatgtgcacttcgcttcctcctgccgcttatcaggaccctgccgccgatgactcgcaggagccgcgcagttcccggcagaaggccttcccgcccgctcccgagcccctgccggtgccagtcatggacaatcacacgcacctggacttcccggagggcaaggctcccgttggaatatctgccgcgcttgatgccgccgccgccgtgggcgtccagggggcggtgcaggtgggctgcgaccttgagtcatcacggtttaccgtccaggccgtggacctggaccggcggctgttgggggccgtggcgttgcaccccaatgacgctccccgctatgccgcccgcggccagttggaagaggcgctcgcagaaattgaacagctggccgcccacccgcggatccgggccatcggcgagaccggcctggacttctaccgcaccgaaggagagggcttggcccaccagcggcactccttccgccgccacatcgacatcgccaaacgcctggacctgacgctccagatccacgaccgggacgcgcacgacgacgtcgtccaggtgctccgggaagaaggcgcacccgaacgcgtggtcttccactgtttctccggagacgaggaactggcaaggacctgcaaccaggagggctggtggatgtcctttgccggaaccctgaccttccgcaacgccgccaacctgcgtgctgcgctcgcggtggctgaccccgaactggtcctggttgaaaccgatgcgccgttccttacgccgcacccgcaccgggggcggccaaatgccagctacatggtcccttacacggtccgggccatggccgaattgacaggaaccgacctggctgggctgtgcgccgggattgccgccaataccgtgaaggcatacggaagctgggactaggaggcccttttccgggcgctacataatgaatacccggtatgcatatttcttggcggctttataacgctacggttacagtggacatttattagccggggtcggggaaggccagcgggtaatttcacttctttcagcagcaggattactgggcgctgtcccggcttgcccgctgcgcggaagtatggcggcgcaacggtgcccggactgccatttctggcggtgccgggccttttattgcgcgatttccccgtgcccggaagtacctaaagttacgggcaaacgtgagcaagttcttcacatcggacggcaaattcagcttcgtcaaggttggtgcccagcttctggtgctgtgcgcgctcgtcgtgggcctcgtagccttcgtgggcaataacaaaaccatcacgctcaacgtcgatgggaaggtctcgtccgtgcagacgttcggcggaaccgtggggcaggtggtcaagagcgccaacctggagctgaaccctgctgaccgcgtgtcgccgtcggttgatgcatcggtccagaacggcaccgtcatcaacgtcaacaaggcgaaggaagtcaaggtcagcctcgacggttccgagaagacggtcaacaccaccgcccaggacgtcgcaggcctggtcactgaactcggcgtagccagcgcttcgtcggtttccgcccccaaggacgcacagctttccatcgctgggtcctacgtctccatctccacccccaagaccgtcagcctcgttgcggacggcaaggtggacaccgccaccaccacggctgccacggtgggcaaggtcctggaggacgccgggctggtcctgggggccaacgaccgctcctcgcagccggtcaacgcccatgtggtcaacaacatggtgatcaaggtctcgcgcgtgaacaccggccagaccgcggtctccacggaggacgtcccgttcgagagcgttacgagcgagagcggcgagctgctcaagggcgagaaggaagttacccagaagggtgccgcaggcaagctggagaaaacctacaagctcgtgctggtggacgggcgcgaagcctcgcgcaccctggtgtcggagacagtagctgtccagcctgtgcccgagaaggtcaccgtcggcaccaagccgaagcccgttgcccaggctgccccggcagcaagtgccgcaatccccgcaggtgcaggcgccaacaccggtgccgctgctccggccatgatgaacgaagccatgtgggacaagatcgcgcagtgcgagtccaccggaaactggagcatcaacagcggtaacggctactacggcggcctccagttcgacatccggacgtggatcggcgccgggggcggggcctatgcccccaacgccagccttgccaccaaggcccagcagatcgatattgccaaccgcgtgtacgcgcagcgcggccttcagccgtggggttgcggctgggcggccaccagctgaccctcgcgattgcgtgcccgtttagggcgctgcggccgggcacggatctccgtgcccggccgcacccgtttattccggctgtttatcgcgcctgtttctccctgcggggcggatgtgccgcgcgggataggatacctaggtgactgaaccaatccccgcgcccgcaccgctctttggtgcatccgacatacgccggctcgcggaggagatcggaatccgccccaccaagaccctcggccagaacttcgttattgacggaaacaccatccgcaggatcgtagccgcggcagacgttggaccggacgagacggtgctggaggtgggccccgggctgggatccctgaccctgggactgctcgatgccgcagcgtccgtggtggcagtggaaatcgaccccgtcctggcagccaagctcccggcaacggtcaaggagtggcggccgtccgctgcagaacggttccacctggtgcacgccgacgccatgaaagtcacggaactccccgtgcagcccaccgcgctggtggccaacctgccctacaacgtcgcggtcccggtggtgctccacctgctgcagcatttccccagccttcagcacgggctggtgatggtccaggacgaggtggctgaccggctcgccgcaggccccggatccaagacttacggtgtgccgtccgtcaaagccgcctggtacagccagatgcgcaaagccggcgtcattggaatgaacgttttctggcctgcgccgaaaatccactccgggctggtggcgttcacgcgccgcgagcctcccgccaccaccgcaacccgggaacaggtcttcgccgtggtggacgccgccttcgcccagcgccgcaaaaccctgagggctgcccttgccgggtgggcaggcggcgcgccggaagcagagcgctgccttgttgctgccggcgtcgaccccactgccaggggtgaggtcatagacgtccaggccttcgccagaatcgcagaagccaagcaggcgccggcatgaacgccctgccaggccggttcgccgccaggacagtccgcgtcaaagcccccggcaaagtcaacgtctccctcgaggtaggaccgctccgccctgacggctaccactccgtggcgagcgtctacctggccgtgtccctctacgaggaagtcgcggccaccagcaccgaggcgcccgggatcaccgtcagcctgagccgggcgagcaccgttgacctggatgccaccgacattccgctggacggtaacaacctggcctacaaggccgcagccatcatggcggacgtttccgaacgccctaccggggtccatttggagatcaccaagcgtgtccccgtggccggcggcatgggcggcggatcggctgatgctgccgcaaccctcctggcgtgcgacgcactgtggaacagcggcctgtcccgggaagaactcgcacaccttgccgcggagctcggcgccgacgtcccgttttccctcctgggcggtacggcggtagggctaggggtgggcgacgaactctccccggcgctggcgaaggcacagacccactgggtcctcgtcacggcagactacggccttcccactcccgaggtttaccggaccctggaccgcataagggaagccggcggcatcaaggcggccgaacccaccggagttgatcccaagatcctcaccgccctccgcggtggagatgccgaagcactgggccgggtcctggtcaacgacctccagcgcgcatccattgaactggcgcccgccctgcgcgatacgctgggtatcggggaatcgcacggagccgtcgcggggatcgtctccggatcggggcccaccgtggccctgctggccgacgattccgttgcggcggaaggcctggccgccgacctgcggcattacggcctgacagccctcgccgtccacggcccggtgccgggcgcgcgcatcatctccgacacccacctctaagtcttacagtccctccctcagcagcagaaagcagttccttgtggcacaccttcttggcggcgagaacctgacggtttcctacgcgacccgcaccgtcctggacggcatcaccctgggactcgaggagggtgacaggatcggcatggtgggccgcaacggtgacggcaagtccaccttgatgcggctgctggccctgcgcgccacccctgattccggccgcgtcaccaaacggggcgacgtcaacgtgggttacctggaccaaagcgacgtgctcgacggcgatctgacggtgggtgcggcgattgtgggggaccaggcggactacgaatgggcccgcaatccccagatccgcgaagtcatgggcggcctcgtgtccgacgtcgactggcacgcaaacgtccacgcgctctccggcgggcagaagcggcgcgtggcgctggccaaactcctgatcgaggaccacgacgtcatcatgctcgatgagccgaccaaccacctcgacgtcgagggcgtggcgtggctgtcccggcacctgaagacccggtggcgcgccaaccagggtgcattcctggtggtcacccatgaccggtggttccttgacgaagtctgcaacaagacctgggaagtccacgacggcatcgtcgaccccttcgaaggcggctacgcagcttacgtgctcgcgcgcgccgagcgtgaccgctccgcatcggtcatggaaggcaagcggcagcagctggtcaagaaggagctggcctggctccgccgcggcgctcctgcccggacggcaaagccgaagttccgcatcgaggccgccaacgccctcatcgccgacgtgcccgcaccgcgcgattcgatggccctcagcaagatggccaccgcacgccagggcaaggacgtgctggacctggaaaacgtctccctcgacttccagggcgccgaagacgggcggaagctcttcgacaacatcaccctgcggctggcccccggcgaacgcctgggactggtgggcgtcaacggcgccggcaaaaccaccctgctgaaactcctcaacggagagatcacccccgacgccggaaaggtcaagcggggcaagacagtggtcaccgcagtcctcagccaggaggtcaaggagctcgacgacgtcgcggaccttcgcgtcatcgaggtcatcgagcgcgaaaagcgttctttcaatgtgggcggcaaggagttcagcgccggccagctggtggaacagcttggcttcaccaacgagaaacagtggactccggtcaaggacctctccggcggggaacggcgccgcctgcagctcctgcggctgctggtgggggaacccaacgtcctgatgctggacgaacccaccaacgacctggatacggacaccctcgctgccgtggaggacgtgctggacggctggccgggcaccctggtggttgtcagccacgaccggtacctcctggaacgcgtcaccgaccaccagatggcgctcctcggcgacggaaagctccgcggcctgcccggcggtgttgaccagtaccttgagctgcgcgagttcgccctggcagggtccacagtcaccggcggcggcaaccccgtcaccagcgccgggtccgcgccggccgccgcagccccctcaggatcctcggaggccgaaaagcgcgacgcccgtaaagccaagaaccgcatcgagcgccagctgggcaagctcgaacagcaggagaagaaagtccacgaccagatggtcaagagcaccgaacagtcggacttcgacgccctggccgaacagaacaagaaactcaaggacctcgcaggggaacgcgaagccctcgagctcgaatggttggaagcactcgaggtcctcggcgagtagactgttccacccgttggctaggttgggtgccggagccggcccttcgacgtcgcttagacacaggacatagggagcgctccggtcgctgggcaacctccgcgctccgatgtcccgcgatgcgctcctttccgaaggaccgcctccgcgaggctacgtcaccgggccgccgggatgagcaggaaaccccgcgcggaacctgcggcaggtggatgagggcgggtgcggggcggcagatcccgtccggcatctttggcctgcatgtgcggcggcgcctagcgaagggaacgctgggcaatagcggtgcggggggccttcgcgtaggagcgcatcgcgggccatcgggccctcaaggtcgctcagcgaccggtgggcccttttggcccgtgtctaagcgacggcgaaggtctcctgcgccgtgaacctggccgcggctgacggcgaaggtgaccgaaggccacgaaaggtgacaacaatctcagccttcggacatgagctccgggtcccttttgaggccggtcaggccgttccaggcgaggttgaccaggtgcgcggcgacggtgtgcttgtccggctggcggctgtcctgccaccattggccggtcatggccaccattcccacgagcatctgggcgtacatggcgccgtcctcgccgctgaggccgcggcgggagaattcgtcggagaggatgtgctccacacgggcggtgacgtgggacagcaaagtggagaaggcgccttcgggctgcgacggcggcgcgtcccgcatcaggatccggaacccttcggtgcggtcctcgatgtaggtcagcagtgcgagggctgcccgttccaccaggacgcgcggcttagcttcctcggtcagcgcggcattgatggcgtcgaggaggagcctgaactcgtggtccaccacccgggtgtacaggccttccttggaaccgaagtgctcgtagatcaccggcttggacaccccggcgcacgccgcgatttcctcgatggtggtcccgtccaggcccctggcggcgaaaagtccgcgtccgacgtcgatcagctggctccgccgctgcaggccggtcatgcgtgtccgcggagggttgttgctcacatttccatcatgcaccactggccacgggcaggactgcagcggggcggcgggcgtaccgcaggacgggaaagcggagggcgaagccggcgggaccgccccgtgtcgcgcagcgccccgaacccgtggcaaaataactacttgtgcccggccgcgtgccacggcacggtccgctctggtgtaatggcagcaccccggcctttggagccgtggagtataggttcgaatcctatgggcggaactgctgcgcgtggagcgttcagtaggatgacattcggtgccgcccgtattgcggccggacaccgtcagcgccagcgtaaccaagcaaggagagcccgtacgtgatccccgagaacaccggcccggccgcagtaatcgtcctggcggcaggcgccggtacccggatgaagtcgcgtacccccaagatcctgcatgagatcggcggcaggtccatggtgggccatgcactgctggctgcccgcagcgtcaacccccgccagctggccatcgtcgtccgccatgaacgcgacctcgtggcccgccacctcgcggacgtggatccggcggccgtaatcgtggaccaggacgacatcccgggcaccggccgcgccgtggaagtcgccctccaggccctcgacgccgaccatcacctgacgggcaccgtagtggtgacctacggcgacgtgccgctgctctccggtgaactgcttgcggaactcgtggccacccacgaacgcgagtccaacgccgtgaccgtgctgacggccgtcctggacgacgccaccggctacggaaggatcctccgcggggaggatggaacggtcaccggcatccgtgagcacaaggactcctcagaggcagagcggcttatccgcgaagtcaattccggcatttacgccttcgacgcagcagtactccgcgacgccctggcccacgtgaccacggataattcacagggcgaaaagtacctgacagacgtcctgggcctggcccgacagtcgggcggccgggtggccgccgtcgtcactgcggaccgctggcaggtggagggcgccaacgaccgcgtccagctctccgcccttggcgcagagctgaaccgccgcaccgtggaggcctggatgcgtgccggcgtcactgtcgtggaccccgcaaccacctggatcgactcatcggtgaccctcgacgaggatgtccgcatcctccccaacacacagcttcacggcaccaccaccgtggccagggacgccgtcgtcggacccgacaccaccctgacggatgtcaccatcggcgagggcgccaccgtgacccgcacccatggttctggtgccgtcatcggcccgcgcgccgccgtcggccccttcacctacctccgccccggcaccgtgctgggcgagaccgggaagatcggcgccttctacgaaaccaagaacgtgaccatcgggcgtggctccaagctgtcccacctcggctacgcgggcgacgccgaaattggcgaggacaccaacatcggctgcggaaacatcacggcgaattacgacggcgagaagaagcaccgcacggtcatcggctcgggcgtccgcacgggttccaacacagtattcgttgccccggtcaccgtgggggacggcgcctacagcggcgccggcgcggtgatccgcaaagacgttcccgcgggagccctcgtgctgaccgtcgcggcgcagcgcaacaccgagggctgggtggcggcgaaccgccccggaacccgctccgctgaactggcgcaggcagccaccaaagattcctcaagtaccccggcatctacagaagagggcaaccaaccatgagcgaaattacggcgcgcggcgaaaagaagctggtgctcgccaccgggcgggcccaccccgagctggcccgggaaatcgccaaggaactgggtaccgagctgctgccggtggacgcctacgactttgccaacggcgagatctacgtccgggccggcgagagtgtccgcggcaccgatgcctttgtcatccaggcgcacccggctccgctgaacaactggctgatggaacagctgatcatgatcgattccctgaagcgcgcctccgccaagcgcatcacggtggtctcgccgttctatccctacgcccgccaggacaagaagggacgcggccgcgaacccatctccgcccggctggttgcggacctgtacaagacggcaggcgcggaccgcatcatgagcgtggacctgcacacctcgcagatccagggcttcttcgacggcccggtggaccacctcatggccatcccgctcctcgctgactacatccgcacccgggtggacgccgagaacgtcaccgttgtctctccggacacgggacgcgtcagggtggcggaacagtgggcagagcggctcggcggagcgccgctcgcattcgtgcacaagatgcgtgacctcaccgtgcccaaccaggctgtgtccaagacggtggtgggccagatcgaggggcgcacctgcgtcctgatcgacgacatgatcgacaccggcggaaccatttccggtgccgtccaggtgctgaagaatgccggggcgaaggacgtcatcatcgcggccacccacgcggtcttctccgatcccgccgccaagcgcctctcggagtccggcgcccgcgaggtagtggtcaccaacacccttccgctcaccgcgtcccagcgcttcccccagttgacggtgctctcgatcgccccgctgatcgcccgcgcggtccgtgaagtgttcgacgacggctccgtcaccagcctttttgacggcaacgcctaggcaggccccgcggcgccggtttcgttttcagtaaacgggaccggcgctggtaagctggtcagcgataccttggcgagggagagcgccggttaccgttcatgcggtcgccggagtgcaggtctccgttatcgactgggtctgaatctcccttcgaagatgggcatggctccggccgcctggcgttgaaggtcgcgacagacctccgcccttgctgaacaccgtttagttttcaaggagatttccatgtctgagcagaagctcgcagcagaagtacgcaccgaattcggcaagggctacgcccgccgcgcacggatggccaacctgatccccgccgtcatctacggccacggcgcagaccccatccacatcaccctgccttcgaaggccaccaccctggccgtccgcaccgccaacgccctgctgtccctggacatcaacggtgaaggccacctggccctggtgaaggacgtccagcgcgatcccatcaagcagatcatcgagcacatcgacctcctgaccgtccgccagggcgagaaggtcacggttgacgttcccgtccacgtttccggcgaaaccgcccccggcaccgtgcacaacctggagctcaccgtcgtgtccctcgaggccgaggccacccacctgcctgaatccgttgaggtcagcatcgaaggccgcgcagccggcgagcacatccacgcttccgacctggtgctgccgaagggctccgtcctgctcaccgacgccgaggcgctcgtggtgaacatctcggaagctgtcgagatcgccgaagaagaagccggcgagggcaccgaagccgcctccgaagaggctcctgcagcctccgaggaagaagcagccgagtagtcagccgcattccccgccagtggccggactcctgtgggggtccggccactgccatgtctactgcccttctccggcgccgggcgcggcaaaccccaaccctaggattgattcatgactgatacctggctcatcattggcctcggaaacccgggagcgcagtaccaaggcaacaggcacaatgtcggccagatggtgctcgacgaactcgcgtcccggatgggtgccggtttcaaaagccacaaggcccgcgcccaggtgctcgaaggacgcctgggcattggcggaccccgcatggtgctggcaaaaccgatgagctacatgaatgtttccggcggccctgccgctgcgctggcgaacttctacggcatcgcccccgaccacgtggtggcagtccatgacgaaatcgacatcccgttcaatacggtaaagctcaaaatcggcgggggagagggcggccacaacgggctgcgggacatctccaaggcattggccaccaaagactatctccgcgtcagggtaggggtgggacggccgcccgggcgcatggaaacggccgactatgtcctgcgcgacttcggcactgccgagctcaaggaactccccttcctgctggacgaagcagcggacgcagtggagatcctggtccgggatggcctcaccgcggcgcagcagaagttccaccccgcgaagtccgaacgctagcaacatgaaaacttaaaggccctttgccctgtctcgttgtctgtgccccggggtagtcttcttcctatgcgggggagcaatggggctacatcccgctatcgcggggatgtaggggaaaagtacatgtcaatcgagccactcagctggggacgtgggtcaacacctcacgacgttgggctgaacagggatgcctccggcaagcgggagggtcagctgtggtctgcccctgcccgcggcgcaaacctcgaatcggtccgcaccgccctcaccggcgccgagtcccttggcgtggtgatcaccgggggccgcggcgtggggaagtcgtcgctggcccgggcagcggtcatggacctgggccctgatgtgtggtcactgcagctccgcagcggtccggccggttccaccacaccctacggctgcctctccttcctcctcgcccggctcccgcaggcctacatgggctctcccacggcaatactccgcggcatcacttccctgatccgcagcgacgcggccggacgtccctgcgtgatcaccctggacacctccggaagcattgacgaaatgagcgcgggggtactgctgaacgtactcctgaccggcacggcgaagatcattgccgtggcgcccaagatcagcgacctgccggcggacttccactggctgctgacggaccggcgcctcgccgaagtccggctcagcaacctcaacgagctgcagacccgccaggtcctgctgtccctcctgggccaccgggtgtcggcatccctggtcggcacctaccatcacatggtgggcggcaacccgttgttgctgaaggcgctcgtcaccgaacagcaactgtccggaaaccttgtcctgtccgactccgtctggacgctgcgggacaaagtggtgctcgacggcgcggccagcctggacgacatcgtccggtcccggtggtccagggagaagcccgaaacccgcgaagtcatcgagatgctgtcctgcgcccgccgggtggaactctcaaggcttactgccatctacagcgccgaagtggtggcggacatggaagacggcgggttgctggagatcgatgcctcggaccaccgctgggtgtcgctgcgcgaaaaatacattggagatgtggtccgcacctggctgagcattgcccggcgcagggagctgcggagcgtgctcctgggcggcacggaacccgatcctgccgggatgacggttgaggaactgatggcgttcgccgcgtggacccacgagtgcgaggcggacctgagtcccgcccttgcactcgcggctgccgacgctgccgtccagcttttcgacccacggttcgccctgacctacgcggagatgcttcgccggacggacagggagtgggtggccgggcagcgccagaaagccgccgcctacctccagctggacatgcccgtccaggccatggccgcacttgatgacatctcgcagccggaactggatggcctcgacgtcgaggagtacgcccacgtcatagccgccaagtcacacgtcatgatgtggcttccggaagcagcagccaaggtgccggacctgctggcggaagcccggcagcggcttgaggacgcgccgaaccgcacggcgtggcccgaggctgctgctgcggctgccaaccgcgtggcgctgagcgagttcgagtacagggccttcgcgggcgactacgccgccatcatcccggcccttgaaaaagcctcggatccagcgttgaacccggataccgagtaccgcatgaatgcagccatcctgctgatgaccgcgctggccatgacggggcgggaaatggatgccctcagcgtcatgcggcagctgggaggccaaatcagtgacgcgtcccatgttgtaggcctgcgcgagcggtacaccaaggaggcctatctggtgctgctgatcgcggggcagtggcggcggtgcatcgacctcctgggcccgcaggccacggacgagccgcacagccttcccttccggagcgccgcaacggagctggcagccggcatcgcttatgtctattcgggccgtggcgccgctgccctggaccccctgatctccgcggcagcacagctggagctccaacccgtccaggctgccctccgctgcgcctacgcggccattgcgctggcccatgcccagaccggcaatgctgcgcaggcacgcaaatacctgggcaaactgcagaggacgtccggaaagtccagcttcattaccgagagcatggctgaattctgcgcactcgtggcgggccgctggctgggcgatcccgacgccgttgccgggctcaagcagtccgcccgcaaggacatggaggcagggcgcttcaccctggccgggatcagcctgctcgcggccaccgtgaacggcagcgacgccgacttccgcctcctggaggacattgccggccaccgccagggtccgctggcagagatctcccggctgatcgccgtcggcactaggaccaaggacgccaagaccctcctcgcgggcggcgagctggccgccaccctggagctcgatgccgtggaagcacggtgcatggcccttgccgtggattttgcacgccaggacggcgactcgctcacggcacgtacagcccaggcccggctcgacatcctggccgccaccgtggccaacctccccatcgtccccagcagcggaagcccgctgcttaccagccgggaacgccagattgcccggctggcaggacgcggcgcttcgaaccgtgacatcgccctggaaatgggcgtctcagtccgtaccgtggaaggccacctctaccaggtcttcaccaaactcggcgtaacttccaggggtgatctgactggactcgtctaacgggcacaagcccaacaccacgcagcgtttcctcacggggcggaaagagccgctggaccggatctgcaacattgtccggaaccgcagcagccaggcggtttttatcatggcgggccccggcattggaaaatcctcactcacggaggccattgccgagcgggttagcggggaaatgaatgtgctgcagatgcatggcagttccgccctcgccgcggtcccgtttggtgtcctgaccccgtacaccggtgacctgaccgccgaggattcggtctctcctgtcgccgtcctgcggtccatgtggagctatttcgaggaagtaaaggccggcaacggggcgcccgtcctgctcatcgttgatgatgcgcattacctggacgaggattccgccggcgtggtggctgagctgatttcagccggctgggcaacagtggtggttgcggcgaggccgcggccgggcctgccacaaccgctggaccagctctggtacgacggcctggccgaacgcgtggacctgcgcccgctgaaccgggaacagatcgaggaagtccttgcccacgtcctggacggcaccgtcccggacgccaccgtggacgccgtctggagcgcctccggaggcaacccgcgcgtcctggacgccctgctgcatgacgccgcggagtccgggatactggccaaacggaacggaatctgggtcctgctgggctccttgccaacggacggggtccgcctcacggctgtggttaccaaggatcacctccggcggcggccggaggaacaggaagccctgaaattcatcgccctcgccggacctgtgggccggaaagtaatcgaagacatttgcggggcggcagttgtccgctccctgctggaccagcagatggttgtcgaaaactccggtgtcccctccgaactcaccatctggaacgggctgttcgcaaaggccatcaggaacaccatctccgtgtcccggagcctgcagctgctggaaaaaatccgggagcaccaggaccctgccagcctccgcggggaaggccgtctgcggtttgtggaatggtcccttgaatgcggcctgcgggtgtccgacgccgacctgctggatgctgcgcgcgaggcactggcccgcttccggaaccacagcgcccggtccatcgctgccaaggtgcaggaccccgggcttgtccaccttgcccacgccgtgctggcgcgcgccctgtacaacgagggtgcctacgctgaagctgccgcactccttgacgacagctggctgcagctggccgaagacccccacggcacgtcggtcctgttgctgcggacgtcagcccaccaggcaacgggccgccctctggctgacctggcagaggacgtgcgggagcgccaccaagggttgccggaagcaacacgggcggggcaggaagagctgttgcagctgctgcagtccggcgcggacgtcaatgtgctggcgctcggcagccgtgttgcggacatcaggaaccgcagctccacaggaaacgccggcgagcctttgaaggccatcggcgaggcgctcctggcgcatgcgcttgccgcggccggacggccctcggaaggtctcgacgccgcgcttcttgcggcgtccgagctgccgacgctggaagacgacctgttcttctactccgagttcgtcctggggcggctggtcatcgactatcttgccatgggcgagtgggaatctgcggagcgtgaactcgaaagctatgcggcgggacatgctgccggaacagggacattcaacggcagcctccaggtgctgcgcggctattcaatgctgcggcaaggccggatggaacgggcctaccagctgctgctgcccgcggtggaagcgctgaggctcagcgatccactgcagctgttccggttcggttcggccctcggcttctacgtcgccgcacggctcggcgacacggcccagtcaaagcggctggagcaggactgcaaggatgcggtggcaggaggccccgcccatgagttcctggcagacgcctacggtgccgccgcgtcagagtaccttgcccgcgacggcaagggcctcgccgcgctgcacaccctggtgaccaccacggaggcctcgtcaagggccggcaccctgctggagctcctgtcactgtgctgggacctgggagatgcctcggtgatccccatggtgcaaaacgccgcccgcgccgtggagggccgctgggccgcggcgctgctgaagctggccaccgactgggaggcagctgacggggatgccctgatggaaactgccggcacgctggaggagtccggcttcgttaacctggcccgtgaggcttatgcccgcgccagcacggtgctggatcaggcaggggagcggcggcggtccaggcaggcagtcgcccagcgcgagaagtgtgaccacgagctcggcgagcggttccgggaaggccggttcattgccgcggcccctgcagtccatctcacccggcgcgaacaggacatcgttgagctcgccgtgcagggcctcacggaccgcgagatcgcccagcgcctgatggtttccgtcagaacggtggagggtcacctgtaccgcacctacgtgaagctcggcgtgcgcagccgggacgagctggactcggcccttcccaagtagcagggccaggacaccgcccgctcacggctgctccagtggacacagccatgtttcttcctgcccgttgcgggctgttactcgcgcctgcccgcggtccggagaaagccctaccgggtattcggcccccggtcccggtagtacccggtcgttgaattcgagtactgcctactcgtgtgcgtcggggccccgcaggctttacttaaggaggtgaaggaagcggccgggacataggccgcaaaccacgcctgagaagttcaaggtctcgcaagcttccggtcaaggtgaccgggccatacggggccggcgacgtcagagtcttctgagaccgagactctccccccagccgtcgccggccctccaatccgcggggctgaagcccggagcggacgtggcggctgcccccccgggcggccgccacagccgtgctgtgggacaattgagtgtcatggttggcatctcaaggagtacgtcttggccctagtatcaacgccgcccacgctggagcgcgccctgccggtcatggataacgccgaggtcctccgcatccgcaacgacttccccgtcctgaaccaactggtcaatggccagccgctggtttacctcgattccggagccacctcccagaaccccctgagcgtcattgaagccgaacaggaattctatgagcagcgcaatgctgcggttcaccggggcgcgcaccatctcgccgtggaggccaccgaggtgttcgaggacgcccggcagaccatcgctgactttatcggcgctgactacgcggagaccgtctggacatcgaacgccaccgagggcctgaacctgatcagctatgcattgtccaatgcaggcctgtgggctgcccagggcaggggtgacgcggggctcaaagagcttgccctgaacccgggcgatgaaatagtggtgactgaaatggagcaccacgccaacctgatcccctggcaggaactggcgttccgcaccggcgccaccctgcgctacatccccatcgacgacgccggatcactccgcatggacctggccggggacatcatcgggaaccggacccgggttcttgcgttcacgcacgcttcaaatgtcctggggaccatcaaccccgtagcggagctcgtgggactggcccggaaagccggcgcgctggtggtcctggacgcgtgccagtcagccccgcacctgcccctggacgtcaagggactcggcgtcgactttgccgtcttctccggccataagatgcttgcccccacgggaatcggggtgctgtacgggaaacaggaactgctggatatcctgccgcccttcctcaccggcggctccatgatcaccaccgtcaccatggaacgggctgagtaccttcccgcaccccagcgcttcgaagccggtacgcagaggatttcccaggcggtggcgcttgcggcggcggcgaactacctcacggaaacgggccttgaccggatccaccagtgggaagccgggctcggccagcgcatggtttccgggttggagtcgatcccgggaatccgggtcctgggacccgccgccggccaggaacggatcggacttgccgccttcgatgtcgagggtgtccatgcccatgacgtggggcagttccttgactcgcgcggaatcgccgtgcgcgtgggccaccactgcgcccagccgctgcatcgcaggctcgggctgacggccaccaccagggctagcgcctacctgtacaacacaacacacgacgtcgaccagttcctggatgccgttgccggcgtacgggcctatttccgcgcctagcagggaagaccgaaggtaacaccatgagccttgaccagctgtaccagcagatcatcctggaccattccaaagcccggcacggcagcggccttgccgggatagaggcgccagagggcgcgaacaccggccagtcgcaccagctcaacccggtgtgcggggacgaagtcacgctgaggatcgccgtcgagaacggcaaagtggcccaggtttcgtgggacggggcgggatgttccatctccatggcgtccgcgtcggtgctcagcgaactggccgaggggatgaccgtggcggagctgcacaacgccatcgacagcttccgcgaagtcctgcgctcacgcgggaaggtctccgcggatccggacctgctgggggacgcagcggcgttcgaaggagtggcccgctatgcggcccgggtcaagtgcgccatgatttcctgggttgccgcggaggacgcgctcaaccaggccgcctgaccccggagtcccttttcggggttccctggaacgacagaaggccctcctcccgacgggaagagggccttcatcatgcacttcagtgctgttcccgcaggcagtgcagcccgttcagccggccatcgccatgatgccgatggcggcagtggcggcgcccagcaccatggagatgctgaccagcaccacatggacggtaaggaacctggtggctttgccggcggagtcccgggcacgcggatccttcatgacccggcgcaggaactgcggccagaccaccaaggaccagacacccgcaatgaccaggaccagtgaggcgaaaacgggcagttccacgggttagtggctttccagccaggcctgcgcctgcttggcctggaggttcagggccttggctaccatcggctccgcagcgtcggcgatcttaccgccaaggaacggcaccgaggactttactgcgccttcaagctcaacgcgggtgccgccgtcggctgccacgagccgctggacggcggtgacgtcaacaggtgcgccggcaatcttcagcgagatgttgctctggcgggagccgtccgcagccggggcgtcccagtcttccacctgggtgaccttgaggtgctcacccacgaacttccgggcaaactcggggaggcgggtggtgggcagggtccgcacggaagtggcgctgaaggctccggcaatatctccgtccacggtgaacgactccagcgagccgcccacgagctggctgacgtggcgctggaaatcctcgttcaccaggacagctgcgacgttgtcgacggagtgcggaagggtggtggttgcgctcagggccatgtgtcctcctgggacgtgcggaacggttttaactccacacatcctacgggctttgctctgcgtgctccgcatccgcgatcttttgggcggcggtggtgatgttccgtgccatggccgggaagatcaggctgtggaagggaagcaccgccagccagtacagccttccgctgagccccttggggaagaagatggcacgctggcggtagcggctcccggccccgtcaggctccacggagagctccagccaggcacgccccggagcccgcatctcggcccgcagccgcagcagcttcccgcggtcgatccgttcaacgcgccaccagtcgaccacctccccggtggccagggtgtggggatgccgccgcccgcgcaggagtccggcgcccccggtcagcttgtccagccagccgcgcacctgccatgccaaggggagggagtaccagccgttccgcccgccgatgccttcgatcactgtccacacgtgggcagggtccacgtcgccgtggaaggtccgctcgtcgatgtagaccttgtgcccggcccactcggggtcgctgggcaggggatcggaagcagccccggcattggcccacgttgtttgcacctggccgtcgcgttccttgccgagggccagggcgacggcggtgcggtacgtggtcagtcctccctcgggctgcgggatgtactggtcgatgtcgtgctcatcggatacggcatcgtgctggagcgactggaccagcggtacagccatggataacgggatgggggtggtcagggcaacccacatgccggcaagcttgggcgccgggacgggcagcgccagcaccacccggtaggggagcccggcctcggcagcgtattccttcatcattccggcatacgtgaggacctgccggcagccgatgtcgaacgtgcggttgattggcccctcaagggacgccgccgagacaaggtagtacaggacgtcccgcaccgcgatggcttcgatccggttgcggacccagctgggtgccggcatcagcggcagcgtctcggagaggtggcggatcatttcgaaggacgccgagcctgagccgatcaccacgccggcctggaacacgatggcgtccaccgggctgtccaggaagactttccccaccgcttcgcgggagcgcatgtgcgtggacagttcgacccccgtggggtgcagcccgccgaggtagacaatcctgccaacgcccgcagccgcagcggcttccgccgccgtccgggccatggcctgttccttggcctcaaaccctgacccggccgccatggaatgcaccaggtagtagaagacgtcgacgccgtccagcgcctcccgcagcgccgcgccgtcgtcaaggctgctttcgacgacctccacgtggtcccgccacggcactccggcgatcttgtcaggcgagcgcaccaggaccttgaccgtgtggccggcctccaggagcttgggcacaagccggcccccgatgtagccggtggctccggtgaccaggacagtcctggaagaacgcggggtgttgctgggttcggtcatggtggctccttatcgtccacaggccattcggagcggcccgcggtctggacggctgctgcttgcgtagactgccgccggcttcagctgccggccttgtccgtccctgccagcctagtcctgtgccagcgcgcattgtcggagctgcgcggtaggctgggtttacccgggattcgcagcgaatttcgggttttcgcgttgcctgctttttccgtaacaccacaggagcttctgccatgagccttcccggcccgtccaatcacggcccgtccctggacggactgcgccgcgcacttgccgcggaccagaccttcgcgcgcgtccgcgccgaggctgcccgcgggttcgcggtccgcggccaggattaccagatcagcgcacccgccgggctgcgggctgtgcttctggctgagatggcggacggcattgccgccgccggcgcaggggacgacgccggcgggtccggtgtggtgctggccgtcaccgccacgggccgggaggctgaggacctgacggcggcgctgcgggcataccttccggcggactgcgtagccgagtttcccagctgggagaccctgccccacgaacgcctctcgccccgttcggacaccgtaggccggcgcctctccgtgctgcgccgcctggcgcatccggaaacgtcgacggctggcccgctccggattgtggtggctcccgtgcgcgccgtggtccagccggtggttgcaggcctgggtgagctcgtcccggtcaccttgaaggtgggccaggaacggcccttcaccgaggttgtccggagcctctccgacgcagcctacgcccgggtggacatggtgacccaccgcggtgaatttgccgtccgcggcgggatcatcgacgtctttccgcccaccgaggaccaccccatccgggtggagttctttggtgacgaagtggaccagatgcgctggttcgcggtagcagaccagcgctcgctgtcttcgcccgggctgcaccaccccaccgagctgcacgctccgccctgccgcgaaatcctcatcaccccgtccgtgatgtcccgggcagccaccctcaaggcgcagctcccggcagcggctgacatgcttgagaagatcgccggcggaatcgccgtggagggcatggaatccctggcacccgtgctggtggattccatggttccgttcgtggagcagctgcccgccggctccatctcggtggtcatcgaacccgagaaagtccgcacccgtgcccacgacctcgcggcaaccaacgaggagttcctcgaagcggcgtggtccacggcgtccgacggcggggcggcacctttggacctgagctcccaggccagtgccgcactgcactctgcgagcttccggtccctggcagaaacgcgcggctcctccctggagcacggggtgtcctggtggtccatcacctcgctggcccaggacgaggaactgctgccggagatcgacgtcctgaacctgcacgcccgggagccccgcggctaccagggcgatgtggcggagatgatggacttcatcggctcccacgtccgggaccagtggcggatcgtcgtcgccaccgaaggtcccggtcctgcccagcgcctggcagagctgttccatgagaacgacatcccctgcgcccgggtggacagcctggaccacgagccccaggcaggcatcatcgaggtgaccactgccgccgtcggacgcggttttgtcctggacggcctcaaactgggcctgctcacggaagccgacctgctgggccggacctccgcagggtccaccaaggacatgcgccggatgccctccaaacggcgcaacgccgttgatccgctgcagctcgtcgcgggagaccacgtggtccacgaacagcacggcatcggcaagttcgtggaactgattcaaagaaaggtcgccggcggcggcgacggggtacgggagtacctggtcctcgagtacgcgccgtccaagcgcggcgcgccgggggaccggctcttcgttcccacagaccagctggaccaggtgacccgctacgtgggcggtgacacccccgtcctgagcaagatgggcggcgcggactgggccagcaccaagtccaaggcacgcaaagccgtcaaggaaatcgccggggagctcatccggctgtactctgcccggatggcgtcccgcgggcacgccttcggcccggacaccccctggcagcgggaactggaggaagccttcccgtacgtggagacgccggaccagctgaccaccatcaacgaggtcaaggcggacatggagcgcgagatccccatggaccggctggtctcgggtgacgtgggctacggcaagacggagatcgccgtgcgggccgcgttcaaggcagtccaggacggcaagcaggtcgccgtgctggtgcccaccacgctgctggcgcagcagcactacgaaacgttcaccgaacggttctccggcttccccctgcgcgtaaagccactgtcccgtttccaggcgtccaaggaggccaaggagacggccgagggcgtcaagaacggcaccgtggacgtggtgattggtacgcaccggctgctgtccaaggacttcgagttcaaggacctgggcctggtgattgtggacgaggaacagcgcttcggggtggagcacaaggaagcgctgaagaagatgcgcaccaacgtggacgtgctcgccatgagtgcaacccccatcccgcgcacgcttgagatgtccctcaccggcatccgggaaacttccaccctggccacgccgccggaggaacggcatccggtcctgacgtacgtgggcccctacacggacaagcagacctccgccgccatccggcgcgagctgatgcgcgaaggccaggtcttcttcgtccacaaccgggtgtccaccatcgaacggacggcggccaagatccgcgaactggtgcccgaagctcgcgttgaggtggcgcacggcaagatgtccgagagccgcctggaacagatcatcgtggacttctgggagaagcgctttgacgtcctggtgtgcaccaccatcatcgaaaccgggctggatatctccaacgccaacaccctgatcgtggacggcgcggacaagtacggcctgtcccagctgcaccagctccgcggacgcgtgggccgtggccgtgaacgtgcctacgcctacttcctctacccgtcggagaagccgttgggcgaggtggccctggagcggctcaaggccgtggccacgcacaacgagctcggcgcgggcatgcagctggccatgaaggacctggagatccgtggtgccggcaacctgctgggcggtgagcagtccggccacatccagggcgtcggattcgatctgtacatccgcctggtgggagaggccgtagcggacttccgcggcgaggccgaggaaaaggcagcagagatgaagatcgaactgccggtgaacgcccaccttccgcacgactacgtgccgggggagcggctgcgcctggaggcctaccgcaagctcgcggctgcgctcaccaacgaggccatcgacgaagtcctggccgaactcgtggaccggtacggggagccgccgctgccggcccagaacctggtgtccgtggcccgcttccgcgtgggcgcccgtgaagctggcctgtccgatgtagccctgcagggcaacttcatcaagttctcgccggccacccttccggaatccaaggtcatgcggctgaaccggatgtacccggggtcccagtccaagccggcgcttgacgccgtgctgatccccaagccgaagacagcaaggatcggcgggcgtgacctgcaggatgcggagatcctggagtgggccaacggggtcatccgcaatatcttctccgacgcgccgctcgccgctccggcagtcaacggatagccgcatgatgggaggacaccacgccgcgtcgggagccgcggcgtgggtggctattgcctcgacgggcccgtacacgctgggctggtatccgctggatgccaccgggatcctgatcggaggaatggcaacggcgggaacagccctggtatgcgactgggaccaccggcacagcacggtagcgaattccctgccgccgctgtccaacgtgatcgccgtcggcattgaaaatgccagcggcgggcaccgccaggggacgcactccgtcctaggggcggcgttctttgtcctgctggccacgctggcggggaagatccagctgcagacagactggagcctgttgtccgtaggcgcggggctgctgtgcatgttcatgatcaacattgcggccaaggccttgaagctgttcccgaaggcagggttcatcagcaactggatctttgcgctgaccatggcggggctggtcacctggttcgcgccggaccagtggacctggcttccggtctccatgctgaccggcgttgtggttcatatcgtgggggacctggtcactaccggcggggttcccctgctgtggccgctggtggtcaggccgccgaaacccctgcggcgggtgccgctgctgcgtcaggtgtggcggcccaacggtgcactgtccctcccgctgctgggacgggccgggtccaaacgcgagtggctcgtgctgatcccggtgagcgcctacgccatggtggggctgtccatggccgcctggtccctggcccacgcccactggggccgcgctgccgatgccgccctggcctggacgcgcctctggttctgaacctgaagcaaaagcaaaagacccttggacaatctaatgtccaaaggtcttgcggttaattatcccaactgggtagcgctaagtgtcgttttggcgcttcataacgacacttagcgctacgtagttgggcctagtgttcgccggcggagtccgagcgtcccaggatgctctgcggaatccagaaggccagggcaaacagcccaatgcagactgccatgggccaggggttatccagcgtaaggaaggagagcgagtacacggctcccaggaacagcgcgatcatgaccacaaagagaaggatgctcgtgccgagcttgttctcgttctgcggagtctggatggtcccttcctgggcagatgagccctggctggacgccgtgatcttgctggacatagttcctcctcggccccgcggggctcaatctgtggcggcttccggtgccttcagtaagacgaagaaccttgttcaccgttcacaatggcaatcccggagctggcaccaatacgtgttgcacctgctgcaatcatagcctgcgcatcagcaagggaccgtaccccgccggaagccttgacgcccaggccgggccccaccgtcgcgcgcatcagggcgatgtcctccgctgttgcaccgccgccgttgaaccccgtggaggtcttcacaaagtccgcgccggcttccacagccgcctcgcaggccgtgaccttctggctgtcggtgagcagcgcggtttcgataatgaccttcaggatcgcaccgctggcgtgcactgcctcggccacggaggagatgtcctcaatgagcgcgcctttgtccccggccctggcagcggcgatgttgatgaccatgtccacttcatcggccccgtccagcacagcaccgcgggcttcgaaggttttgacgtcggtgggtgtagcacccagggggaaccccaccaccgagcaggtgaggacgccggtgcccctcagcgcggttttgacggttttgacccagatggggttgacgcagacggacttgaaaccgtattccgcagcttccgcgcacacctggaggacgtcggcttcccccgcctcaggcttcagcagcgtgtggtcgatgtaggacgctatgctgccggaacctgcggcgccggtggctgcggtctgaacggaaggggtggcttcgttgctcatgatggtcctctccagggggccgtgggcagggcgttgtaacgcccgtgactcgtttcggaaccatcttgccacagcccggatcggcgccggcccgcctgccgggcgggcatcctaacctcccggcgtgccgtcaggccgcggcctgcagggggacgggagccgaggctgcggtcagcagctgcgtggcgcaggcacccgcagcggaagccgcggcaaccagcaggcccagccggacgccgtcgaacgctgcggcgtcaccgagggcccagatgccggggaccgacgtccggaagtcctggctgatgacaatccctccgctgggcgcggtccgcaggccggcgctggcggccagtccgtcccgcgagatccgttcctccgccagtaccaccaggtcaccgttcatgctgctgccgtcctcgaagatcaccgcggacgcagccaggccggacgcggacgtgccgggaacgacggcggcagggcgggccgtggtgcggatcgggcggacaccctgggcgcggagcacggcctcagcctggccggccgccgtgccgttgcctaccaggatgcccagggggcggcggcccagctccctggccagctcgctgacggcctccccgatgcgggcggcatcgtcgatggtggagtagctcaggcacgcgcccgccccctcgacagggctggccacgggtgccgatccggtggcgatgaccagctggtcgtaggcgaattccatgccgtccgcggtggctaccgtacggttgacggcgtcgatgtggcttgccggctggccgaaccggaccgagacctgcggcagcagtgccagctccagcagttcctccggggtgtcgtcccggttgctcagcacggtgatggtgccggtgaaacgggcccggtccagctggctgacaagcgcctgggcagcaggacccgcccccgcaatgacgatgcgggtggcggtggagggggatggggagggtgccggagcggacatgtgctggccctttcgctggcggccgggagcggccggaacttcgtgatggaacccagcgtaggcccgtgccttttccggcgtgtttcccggcagttgctgattaaaggcccggtgttcgccagtgtttaccggccggtaacagaacccgtgacctgcctctcatccgccagttggccgacacaattgccctgtggtgcggcccgtcggtgctgtccgtcccgggattcctagacgcggatacggtaaccgcgcttcaccacagtttccaccaggcggccgtcaggcagggaagagcggagacggctgacggtcatgtccagggcgtggacggaaccgcggagttccagcaggtcggagagcgattcgcgggacaggactgcgccgccggcaccgagcagggcccgcaggagcagcaacggtgcaggggctagttccaccggctgcccgttgatgcgcaggctgcggccgcgcagctctatgttgccggacctggtatccagccggcgcacgtggttgagggcgaggtgctcgcacaccagccggatcagcgcacccatccggaaccgttccgggatcagcggggtcacaccggcatccagcaggggctgcgccgtgaccggacccaccaccgccgtggtgacgttggtcttcaggctctcgatcagctgcttgtagacgcccatctcgtgggcggtgctccacatggcatccaccgcgggtgcgctggtgaaggtcaggacgtccaggtttccgctgcaggcagcctcgatgagccggggaagccggtcctcgccgtcgggcttcacccagcggtacggcgtgactgtcaggacggtggcgccggacatgcgcaggcgttccagctgccgcacgtcggtgtagccgtgcagctgcacggcaacggttttgccgcgcacgccctcggccagcagcatgtccaccagtgttgcggtggtttcgtcgctgctgattccgacgtcggcgaggccggcggcgcgcaccgcaccgcgggccttggggccgcggacgaacatccggcaggcgcccagggtctcgagcagctgctcgccaataccgaaggaatccgcggcctcgcaccagcgccgcatcccgtaggcggtggtggcgatgcagaggtccggccgggccgcgatgatggccctggtgtcctcgatcagccgcatgtcctcctgcacgggtgcgattttcagggcgggggcgtgcagcacttccgctccgcggcgttccagcgcctcgatcaggtcctgggaccgccggtgcgaggtgacaccgatgcggaaaccctccaatggagcctctgcggcgtcgggtgcttcttcaggcgtttgttcgacctgcggtggttcggccggtgcaagtgcagtcatgggggtcaattctttcacgaacccagcagcgaggccgccagcctgtccaggtcggctgcggcctcggcatgcccgcggttggcctcagccacccggaccacctcgccgatgaccagcacagcagggttgctgcatccggcggcggctgaggtgacggtgcccaggtccgcgatggtggtgcgctggccggggcggtagccgcgctccaccacggccatgggcatgtcagcccgcattccggcccggcggagtccggcagcgagctggtggagggttccgatgcccatcagcaccacaatggttccgccgagaccggcaaggtgctggtgctctttttccgtgagcggggcgtggccggacaccacggtgaacatgtggctgacttcccggtgggtgacggggatgcccgcggcggcggggacggaaatggcgctggtgacgcctgagatgacgcggaccttgacgccggcggccacgcaggcggcaacttcctctccgccgcggccgaagacgtacgggtccccgcccttgaggcggaccacgttgttgccggccagggcgctttccaccatgagcttctcaatgtcgccctggcttaccttgtggtggccgggcttcttgcccacgtccaccagttcagcggaggtgagcgaaggaagttcctggtacggggcgagccggtcgtagaacaccacgtcggcgtcgcggagtgccttgacggcggcgacggtcaggagctcggtggtgccgggcccgccgcccaccagggtgacgtgccccggggcgccggcagcgggctccgcagccaccggaattccggtatcgcggcaccggccaaggagggagtcccagccgggctgtccgtcctccactgctgcaaccaggaaggggcgttcgggcaacgggccgtcgtgcgccgcgccttgcggagtgctgaggcggtagacgactgcaccggcggcttcgtagcggcggaccgcctggcgggcagcgtgttccgagcccgtcaccagtacttcacggccggtgagatcaatgctgagctgcatgcctatacctcgttcctgatgggttccggcgtgcctggtcggaccgggatggaagccccgatgaggactggctgctgggcggctgacgccttttcctcggcggtggcggggcgcatctgcccgcgctcgtcggggacgaaggtgatggaatcgtccttctggtcgggcgcgttgacgaaggagcggaagcggcgcagccgctcggggtccttcagggtgtctgcccattcgtcgatgtaggtatccacgtgcttggccatggcggcctcgaggtccgcggcgatgcccagggtgtccttgaccaccacgtcctcaacgtgcttgatgccgccgtcgagctcttcctgccaccgtgcagtgcgctgcaggcggtctgcggtgcggatgtagtacatgaagtagcggtcgatgtacttgatcagtgtttcgtcgtcgaggtccttggcgagcagctgggcgtgtgcgggtgttgcgccgccgttgccgccgacgtacaggttccagccgtccgcggtggcaatgacgcccacgtccttaccgcgggcctcggcacattcccgggcgcagccggagacgcccatcttgagcttgtgcgggctgcgcaggccgcggtagcgaagctcgagctggatggccatggccaccgagtcctgcacaccgaagcggcaccaggtggaaccgacgcaggactttaccgtgcgcagggacttgccgtaggcctggccggattcgaagccggcgtccaccagctccttccagatttccggcagctgctccaggcgggcaccgaacatgtcgatccgctggccgccggtgatcttggtgtacaggttgtacttttcggcgaccgccgcgatcacgccgagtttcttgggcgtgatttcgccgccggcgatgcgggggaccacggagtaggtgccgtccttctgcatgttggccagggcgcggtcgttggtgtcctggagggtgccgcggccggcatccaggacgtaggcgctgttctggctggccaggatgttggcgatggtgggcttgcagatgtcgcagccggcgccggtgccgtacttggccatgatctcttcgaaggaggtcagttccaggacgcggatagcgtcgaagagttcctggcgggacagttcgatgtgctcgcagagggacttggagacctcgacgccggacttggtcagttcggtttcgagcagcttcttgagcatcggcacgcaggaaccgcactgggtgcctgcgcgggtgcagcccttcagctcaccgagttcctggaccggggcgttgccctcgcaggcgccgcagccgttgatggcgtcgcggatgctgccggcggtgacgttgttgcaagagcacaaggttgcgtcgtccgggagttcggtttcgggagcttcgccgccgccggctgcactgaggaacgcacccggctcggcgggaagttcgcggcccagcagggggcgcaggctcatgtacggtgaagcgtcgccgacgaagatgccgccgaggagggtcttggcgtcgtcggtggtgacgatcttctggtacacgccgcgggcggggtcggcgtagacgatttcgagggcgtgctcggtcttggcgaaggcgtcaccgaagctggcgacgtccacaccggacagcttcagcttggtggcggtgtcgaagccggggaaggtggcgtcgccgccgtggaggcggtcggccacgatttcggccatggtgttggccggggcaaccaggcccaggcacatgccgccgaagttggccacttcaccgattgcccagatacccggtacttcggtggcgcagtagtcgttgatgaccacgccgccgcgctggcccagcgagaagacctgctcttcgccctccgcggcgcggaagagttcgtcgcggggccggacgccgatagcgacgatcacgaggtcggcgtcgatcacgcggccgtcggccatgaggacgccggtgacctgcccgtcgtcgtcggacaaaacctcggacgggaagacgccgccgtggacgtcgaagcccttggccttgatgaggcgccccattgcctggccggcaccttcgtcgagctgggtggccatgagccactgcgaaccgtcgatgacgatcgggttggcgcccagctgctccgtgccggcagcggattcgaggccaaggaggccgccgccgatggttaccgcgttgactttccggcccagcttctctttaagccctgcgatggcctcgttgatggcccatacgtcttcgagggtgcggtagacgtgcgtgtgttcggcgcccgggatgggaaggcgtgcggcgttcgagccggtggccaccaccaggtcgtcgtattcgaaggtgttgccggcagctgtctccacggtcttggcttcagcgttgatcttgatgacccgctcgccggtcttgagctccagggacgggtggtcccacatggacgcagtccccagcgtaaggtccacgtccttgaccgtgagggccttggacagggcaacgcggtcgtagggaaggtgggcttcctcagtgaggaccgtgacatgccagccatcgaggccacgggcatgcattgcgtccgcaaaacggtgggccgcggggccgccgccggcgacgacgatgcggcgcggagtctctgtgcttgaagtctgttcggtcactgatgggcctttcgcatgggccgcagtgaactgcagccttctctgtcgagctgtccatccagactagggagacgcagtttcgcttcagtttcccaattgtttcgtcaacttaacttctgcatcacgaacgcatttccggccgtgtgaggtgtcttttacgcgccggacacattcactgcacgccactgaaacacccggagcctagcgtggttcacggctgcaaaggcggccactgagaaggattacacgcacagggagaggagccggacatgacggcaacactggaacttggggcactcgaagccggccttgacgaggcggtatccgggatcacgggcggctggcacagcgtttgcccggtggaggacctggaaatcgcctggggcgaggcagccctggttgcgggacgccaggttgccctcttccgcaccggcgccaccgaagttttcgcggtagcgcaccaggacccggccaccggagcgcacgtgatggcgcgcgggatcctcggctcacgcggcgagcgccccaccatcgcctcgccgctgcacaaagaggtctacgacctcaaaaccggcgaatgcttcagcacgcccggcctgggcattgccaccttccgcacccgcgtcagcgacggcatcgttgagattgaactgtagcggctagagccccagcgcttcgctgacgtcgcggagcacttcatccagcgccgcccgcaccgcctgacgggcggccggcagttccgcggcggaacccacgtgctggatcacctcgaggtagcacttgagcttgggttcggtgccgctcggacggatgatcacgcgcgtcaggtcccgggtgacatagagcagcccgtccgtgggcggcaactggtcactgccctcggccaggtccgtgtacacctcaacagcggatgatccgaacgtttccggcggggagaccctgagccggttcatcatcgcgtccaggagacccaggtccgcaaccctgatactgagctggtcgctggcgtgcaggccgtgctgcaggtaaagctcgtccagggtgtcaaagacggtcttgccgtcagccttggcggccgcggcgagttccgcgatcagcagggcagccgagatcccgtccttgtccctcaccagatccggcgccacgcagtagcccagggcttcctcgtagccgtacaccagtccgggaacccgggaaatccacttgaacccggtcagcgtctcctggtgggcgtaaccggccgctgtggcaatgcgggccaggagccgtgacgacacgatcgaattagcgaacactccctgggcactttcttccgtgccgccgtcgtcctttgccctgcccgctgcagcccgggcggccacgtgcgctcccaggagggcgccaacctcgtccccgcggagcatccgccaggcgccggtgtcggggtctttcgctgcaacggccgccctgtcggcgtcgggatcgttggcaatcacaatgtctgcccccagccgttcagcagactccagtgccaggtccagggcgccgggttcttccgggttcgggaagctgacagtgggaaaatccgggtccggctcggcctgctcagcaaccaaggtgatgtccttgaaacctgcggcgttcaacaccgccagcgcggtcccgccgccaacgccgtgcaggggagtcaggacgatgctgaggtcacgggcagggaactcgccgggcatggccagcgcggcggtggagcgttcgtagtccgctgccagggacccatccaggacagtccagccggagggggcaagggtgatcgattccagcggccccaccgcgttgatccgggcggcgatggcggcgtcgtagggagcgacgatctgtgcgccgttgccgttctccggcacggcatggcggcccaggtacaccttgtaaccgttgtcctgcggcgggttgtggctggcggtcaccatgactccgccgtcgcattccagcgcccttacggcgaaagccagcaggggagtggggagcgctgcaggcatcaggaatgtctctatccccgctgccgtgaaaatcgcggccgtttcctcggcaaagatgtccgagttgtgccgggcgtcgtagccgacgacggcgcgcggccgggttcccggcgaggactcggcgaccgccgcgagcaggaagtccgccaggccggcggcggcccgccgcaccacgatcctgttcatccggttcgggcccggccccagcgccgcgcgaagccccgcggtgccgaactgcagcgtgccgcggaagctgtcttcgagttcctggcgggctgccgggacgccgttctccacgtgcccgatgagctcaaggagggaggccgaggtcaccggatccgggtcttgggcagcccacgcgcgggcatcatcgagcaggcggatttcggcatcggaagacgtcatgggcataacgctatcgtcattgaccggccacttcttccaaccgcggccacgaaatgcccgcgggaggcgcgccgcacgtgaccgcgcgcctggttagagccgggcgatgatcccggccagcagcttcgaaatccgcgggccggcagcctgcccggactcgatgacttcctggtggctcaacggctgggggctgatgccggcggcaaggttggtgaccagcgaaatgccgaacacctccataccggcgtggcgccccgcgatggcctccagcgccgtcgacatgcccaccaggtccgcgccgatgcgcttggcgtactgcacctcggcgggcgtctcatagtgcgggccggggaactgggcgtaaacgccttcttccagggtggcatcgacttcacgggccaggccgcggatccgggccgaatagagatcggtcaggtccacgaacgtagcgccctccagcggcgaggctgcggtgaggttgatgtggtcgctgatcagcaccggggtgcccggggtccagttttcctgcagccccccgcagccgttcgtcagcaccagggttttgcagccggctgcggccgctgcacggatgccgtgcaccaccgaacgcacgcctttgccttcgtagtagtgcgtccttgcacccaggaccaatgcccgcttgccgtccgtggtcaggaccgaacggatggtgcccacgtgtccttccaccgccggggcgtggaacccggggacctcgtcggcggacagggtggcggtggtctcgccaatcaggtcggctgcttcgccccagccggagccaagcaccagggcgacgtcgtggctgtccacgccggtttcctcggcgatgtagtcggcggcggcacgcgcggcggcaaagggatcggtgttcaggaagtcagttgtactcacaggtacaagctatcctgccgtccgtcatgccgcccagccggggcaggttctcctcagagaccgttttctttggccgtgcgggggagttgcaggagaatgattgtttgtgactacgcatccagatttcagttccccccggatcgcaatcctgggaggtggtcccggcgggtacgaagccgccatggtggccgcctcgctgggggcgcaggtcaccatcatcgaacgtgcgggactgggcggatcggctgtgctgaccgacgtcgtcccttccaagaccctgattgccaccgcggacctcatgacccgcgtgggcgaggcgggcgagctgggagtgaagttcgacgtcgacggcggcgcctttgtgcccgtgatgcgcgccgacctcaaacacatcaacgaccgtctgctgaaccttgcccgcagccagtccaaggacatccacgacggcctggaaaacctgggagtgcggatcatcaccgggtccggccgcctgctcgatgaccacaccattgaagtcctcacggcggaaggcaccgaaaccgttgaagcggacaccatcctgctcgccgtgggcgcccacccgcgcgagcttcccacggcacggccggacggggaacggatcctcaactggacccagatctacgaccttgatgagctgcccgaggacctgatcgtggtgggttccggtgtcaccggggccgagttcgcctccgcatacaacggactgggatcgaaagtcacgctgatttccagccgtgacagggtgcttcccggatccgatgtggacgcggcagtagtactggaggaagtgttcgaacgccgcggcgtccgggtcctgtcccgctcccgcgccgaaaccgtggagcggacggacgacggcgtggtggtcaccctcagcgacgggtccaaggtcaccggcagccactgcctgctgtgcctgggctccattcccaacaccgcggggatcggcctcgaagaggccggcgtggcggtcagcgaaagcggccacatcaaggtggacggcgtatcccgcacctcagcccccaacatctacgccgccggtgactgcaccggcgtgctgccgcttgcctccgtggcggccatgcagggccgcatcgccgtggcgcacttcatgggcgacaccgtcaccccgctcaagctgcaccaggtggcatcgaacatcttcacctccccggaaatcgcgaacgtcggcgtctcggaagctgagatcgagtcggggaagtaccagggcgacgtcatcaaactctcgctgcgcagcaacgcccgcgccaagatgcggaaccaccgcgacggcttcgtgaagatctttgcccgcaagggttccggcaccgtcatcggcggcgtggttgtgggaccgaacgcctcggagctgatcttccccatctccatcgcggtgcagcaaaagctgcacgtggacgacgtcgccagcaccttcaccgtctacccctccctgagcggctccatttccgaggcggcacgccgcctgcacgtccacttgtaagggcgcgtcggaatccaccagattccagggccatgcgagtctggaccacttcgcgccgcgtgcatagactcctcgaaggaacggccgggaattccatcagcggattttcccggccgtccctgcaccagccatcaacgcaaggagcagcccgtggaactgaacgacgtcaagtggaacgaacaggcgcgcgaaaaaatcctggtggatgcggaccgggccctgcaggaagcggtccgcgaggcaagctcgtccctggccaacgcggacaaggacgaagtgtacaagttcctgtttgagcagctgaaggaccagttcgtcgatttccagcccggcccggacctcacccgttatgcggaggcggtagcaaacggtgacttcggttccggcggttcaacgggtacggaagggtaggcagaagcaatgtcagcagcactcgtgaggccgcgcagcggcaaaatcattggcggggtgtgcgcggccctggcagcccgctttggacttccgaagttcctggtccggttgggcttcatcatctttggcctggtaggggtcggtgaactggcctacatcgtgctctggatcctcattcccaaggcgccggcttaaggcaccaagaaggggatttccgccaggacctcgggttggccccgcgctgtggggccaaccctttatttacttgaggggcaaattgttggggttgcagaggaccccgggatggcgggtggccagcggtagaaggcgggtccctctttgtcgaaagccacagaattctttgcggacgcctcccagccgcctgggacgttgggccctaccgcctgagcccaccccgcgggcactgtggagcatggccactatttacattgcttacggcagcgttgaagggcagacggcccgcatcgcagagtacatcgccgacgtcattcgggcacacgggcacgaggcagaaacagcggacctcaaacaagctccgaacagcattccggacgggcaggacggcgtcatcgtggcggcatcggtgcatgttggcaagcacgagggctacgttgcagactttgtccacaacaaccgcagggcggtttctcaccaacgtcgcaacaccgactgaaagtggtgttgattcatgcgcagttcgacgcgccgatcgaggaaaatgggcccagagggcttggttgagaagaagcccttgtacgttcagctgatgaagcagggatattccaactccgaggcctgcagggtcctcggcataggccggaacacaggccatcactggttgcatggacgcaacggtgtggagggcttgatccagcaaggtttggatccgaggccgcgcgtagcggtgcctgcggccggcggatccctccgttacttatcagaagatgaacgcatcttcattgccgaccgtctattggcccgtgcaagccttcgatccatcgcccgggagcttggcaggtccgcatccacgattagcagggagttggcccgaaaccgtcctgactcccgccgctatcatccgttccgtgcccagaaaatggcgcagaagagacgaccgagaccccggctttccaagctgaccggtgacgccgacctgcggcagtacgttgtgcaatgcctgtcgaagcgatggagcccgcaacaggtctgccgagcgttgaagaaacggtttccaggcgaactccacaggcatctggctcacgaaacgatctaccgcgcgctttacggcctgagtattcgccctgtcccatcgggctctgcccggctgttgcgttccggaaaatacagccggcggccgcggtcgcggaccaaggtgaagccgcgccaatacatcaccgatgccctgaagatcggggatcggccggcccatattgccacccgggaggaggcaggccattgggaaggcgatctcatcatggggaaggcgaacaagtccgcgatagtcaccctggtggagcggtcctcacggttccttatcgcctttgcgcttccgccagggatcaggtctgacgtcatgcgcgaccggctcatagaagttctcggagtcctgccggccacgctgcggagaacattgacctgggaccggggttccgagatggccaggcacgccgaggtgactgtagcgctcggtacgctcgtctacttctgtgatcctgccagcccatggcaacgggcttcgaacgagaacgccaacggtctgctccgccaatacttccggaaaggagccgacctcagcacggtagaaccagccgatgtccgcttcgccgcggacgagatcaacggtcggccgcgtgccgtcctcgcgtggaacagtgcaaccgtccggtttgcttccctccaaaccattgccgcgcttcagaacactgcgatttccagcggcaccgagggcacgcttcctccgcccacagctggggataatcctttatgagttatccaccgctacggctaccagggagctacgccaatggctcccccgataacccgaattgacccccaactgtggacggcagggtgttgtgccgggatgctcgttagggaaccctgaccggaccgggcctggtgcccccgctgtcctcttaaacatcccacctgctgcgacccgcaagctgaggagggaggtctaggatcagagcaactttagatgtgatgtccgtgcagatattcatgggagtcgctaaatgaagatgaaagtgattgttgcaaccgctctcttcctggcgtgcctggcggtggcagtctggatattgtccggctccggcgacctcttggcgggaatcataatggtcgttggaatcgcagttggcgctcatttcgcggtccgatggggtggctctcgtgcccaggaaaatgagaagaacatgcaggagttgctctcgaagagaaaacctcgcgaccctgatccagacgagaacgtttgactcttaccagttgcggatagctgtcaacaatctcggcaccacccgctgaattatccatcgttgctgacccgggtcgaagcttcgcgtagtcgatgctggataccgaacgtattgagcgttcgcacgccgacgtacctttccgggcaccgaacacctcacgaaacacagcgaaacatttcttgcacccccgcccgtttagaccgtcccgtaagccggtccctgagccgggcgcactcagagaccgactaacttcgcagaaacaacgttcgaggaacgttccctaagactcgtcctgtgtattgaccggtgaggggggcgccatctggcttacctccacacaaaggatcagcgtcgcggctcgtgtcctgccacccgcaatcagcatgctgctagggtcaaaaaactgactgttgcgacgttcgttggaaaccgcccagcgaacttgagcgtttgccgtccgccctggtctccgtcagcctggccgcccacggcgatgaagctggcgccgagggctacgtggcgacgttcgaggcggagaccggctggcacccccgccaggtagcgatgttctccggtgcgctgatgtacacccaatacaacttcctgaaacgccagctgatgaagaagatcgtcaaggacaagggctcccaggacctggacacgtcccgcgactacatctacaccgagtgggacggcgtaaagcacttcacggaggagttcctggccggagtaactgctccagcgggccaggcacagggtaccgggacaactccgacagaggtcccgggatcttctccaggcgtcaacccgtgaaaatccccgcagccatacccgtcctgttccttgctgcgtccgcttttcttggcgggtgttcgcagcccgggaaccaaagcgcgccggcgccggcaccccgcccctccaccggtgccacaagccctgcctgcgacctcatcacgcctgaaattgcggcgaaagtcgtacccgggattatgccggtaggccagaacagcaatgacaggccgcccggaagcaaggcctatctctgcacgtattcgagcaagtccatggagggaggcattacggccccgtcggtggccctcacctctcccgcctcgtcgcaggacatctccacagcggagtcggcgccttactgctcacccgtcaccggaatcggtgactttgcctgcctgcagtggaccggctacttccgcggcgagaccgggggcgcctccgcgaacgttgtcctcacggctgtccggggcgacgagacgctcgaaatgccgtacgtcacctccgcgcccatgaacggcacgcctgcacccgacggcgatgcgatggcccgtgcgctcgcacaggcagctgtggaggccggctggggcaacggcaccccgctcggcgttcccgcggcccctgcccctgcttcctagtcaggcggcctggaccgcccggaagtgtttttcgatgagccccttgatgtcctcgtggcagccgccgcagccggtgccggcgcgcgttgccttggacacctctggcacggtggagcagccctcctcaacagcgccctggatggcggctccgctgactccggcacaccggcaaacggtgccggcgggatcggcggcacccgtgcccggcagttggtccggcccgtcgaggcgcagcagcagggaccggtcagcgggtagttccgcaccgcgttcgaacagccccacaagctcggccgccgtgcggggcattcccaccgccaccaggccctccaggacgccaccgcgggtggtcattttgacgtagcggccgtgctcagggtccgcccactgggaaacctggaggcgcgggcgcccgttcactgcaccggccgcgagggcgtcctcgtcccagggctccgcggaattgtcgccggccacggccatgttcatgccgcgtgccttcaggacaatgacacccggctgctccgccggcagtgccggcagcagggcggcgtcctccccgccgtccgccagcagggtcaggtacccggccagccactcggcctgccgccagcccggccccacaaggccggaggggcccctcgcgtagcggcagggggcgcagtccggatccgggcagcgcacctcggcgcagtcaccgatggcaaagatgtgcggctcgtggtgcgcgcggagtttgtggtccaccaggattcccgcggatgtggagagcccgcagccctcggcgagctcagtgcggggacggacgccgcaagagagcaccaggaggtcgccgtcaatcgcggacccgtcgtcgagcagcagcgcagagaagccgccgtcggccgcgttgtgctccacacccgtggagcgggcgttgccagccatccgcacgccgcagcggcgcaggctcgccgccagcacggagccgccgccgcggtcgatgttgcggcccagcggatgcgggccgttgtggaccaccgtgacggtggctccttcttccgccgcggccagtgcggtctccaggcccaggacgccgccgcccagcaccaccacccgcttgccgccggtcacggcccgccgcagcgcctcggcgtcgcggaggtcgcgaagagcggtgacgccggcggggaggacggggtgagtggggtcggggttgatgccggtcaggttgggaatgaccgggcgtgaccccgtggcaaagaccagccggtcgtagtggacggcgccgccgtcggacaggaggacctgttgccgggcccggtccacgcgcttcacccgcacacccagccggatgtccactccgtccccggccaactcagcggcgtctgagagcgccagggcttcggcagtggtcctgcccacgccgagatcggccacgagcacgcggttgtaggcggcttcagcttcctcgcccaccactgtcaggcccaccttgccgctgcggacggcaggcaggagttcgtcaatcagccgggccgccaccgggccgaatcccacaatgacaatctgctcgctcatgaggcctccgtcgtttgaagcacgtgggtggaaagggacgcggctacgggccggacccatacggtgttgaacttgaactccggcatcccggagatggggtccgtggccgcttccgtgaggcggttcgcactctcaagttcggagaagtggaacggcaggaagacggtttcgggacggatggcggtgctgagctgcgcccggcactccacctcgccgcgctcgttggccacggacacgagcgccccttcggtgatgcccatcgacgccgcagctgccgggtggatttgcactcttgcttccggctgcgccgccagcagctccgacacccgccgggtctgcgcgccggactggtagtgctccaggaggcggccggtgatgagggtcatggttttcgcggcggtgccatcccctgtagggggcgcagcaggagtacgacggcggcgcggcgtcaccggggtcatcacggctttgccgtccgggtgcgcgaaccggtcctggaacagccgcggtgttccctggctgccggcggggtagggccagtaggcggcttcgccgcggtccagcatggcgtagtcgatcccggagtagtccgccaggccgccggcggaggccagccggagttcctcgaacacggtctctgggtcctcgctgtaggtggacggggcatcaagggcttcggccagccgcgccatgatccacagctcactgcgggcaccggctggcggagtgagggcccggcggcggcgcagcacgcggccttcgaggttggtgagtgtgccctcttcctccgcccattggaggacgggaaggatgaggtccgcctcagcggccgtctcggacataaagaagtcgcacaccatcaggaagtccaggctccggagccctttgatcacagcgttggcatcgggggaggccacggcgatgttggaggcgtggacaaaaaggcagcggacgccgtcgggcttgcccagcgacttcaacagctgcacggccggcagccccggcccgggaatgaggtcctcctccacgccccagaccttggccacgtgggcgcgggcggcggggtctgtgatcttgcggtagccggggagctggtcggacttctggccgtgctcgcgcccgccctgcccgttgccctggccggtcagggtgccgtagccgctccgggccgagccgggcaggcccagcagaaggctgaggttgatcgctgccgtggcggtgtcggtgccgtccacgtgctgttccacgccgcggccggtgaggatgtagctgccgccttcgcgggcgccgcgggccagccggcgggccgtttcgcggatgaggtcagccgggacgccggtgagggactggacccgttccggccagaaggagttgacgctgcgggctacggcactgtagccggaggtgcgttcagcgaggtacgaggtatccaccaggttctcgtggatgaccacgtgggagatgcccaggaggagggtgaggtcggtgcctggaaggggctggaggtggaggccgccgccgtcagccgtgaaggcggctgtggcggagcggcgcggatccaccacgatcagcccgccggcgtcgcgcgttcccttgaggtgctgcacgaacggcggcatggtttccgccacgttggagccgagcatcaggatggtgctggcggtgtccagcgcttcgagggggaaggggagcccgcggtcaacgccgaaggcccgcattccggccgctgcggccgaagacatgcagaaccggccgttgtagtcgatgcgggaggtgccaagggccagccgggcgaacttgcccagcatgtaggccttttcgttggtgaggccgccgccgccgaacacgccgacggcgtcggcaccgtagcgggcgcgggcgtccttcacggcggacacggcgaggtccagggcctggtcccagctgatgggccggtggacgccgtcggggcccttcaggagcggctccgtgattcgccctgggtggttcaggagggtggccgacgtccagcctttgcggcacaggccgccgcggttggtggggaagtcccggccgctgacttcgaggggtgccgccaggggtattccggggtcagttcctggcacggggactgaccccggctgggaagccggggccagtgccgtgggagacgtgagcgtcatggcgcactgcagggcgcagtaagggcagtgcgtgtcggcgcttttggtcatgttagacgtgtcccatcgcatttcggttggcgttgcggatgtagcaggcccagcacacaaccagcatcaggacgtacgccccgacgaagccgtagaaggcgggggtatacgagccgctggacgagttggaggcgttcagcacctgcgggatgacgaacccgccgtaggcgccgatggcggagatgaggcccagggcggaggaagcgaggcgctgggtggccaccgagctggcaccgttccgggcagcccggctgttcgtggcgaagatgatgggaatcatccggtaggtggcgccgtttccgaagccgctggcggtgaagagcatcaggaagaggaccaggaagagccagaagttcttcagcggcagggtccagatcatggtgagggtgatgacagccatggcggcgaaggcggccacggtcatgcgggcgccgcccatccggtcagccatgcgtccgccgtacgggcgggccagggagcccaccagcgggccgaggaaggccagggacagtgccacggtgcccactccgatggaggagaaagccgggaagtagtccttgatcagcttggggaagacaccggcgaagccgatgaaggagccgaacgtgccgatgtatagcagcgccatgatccacaggtgcggttccttcagtgctgcaatcgagccggccacgtcgcccttggcgctggtgaggttgtccatgaacttccaggcaccgaaggcggcgatcaggatgaacgggacccacatccagccggccagcggcaggttgacagtgcccacggcgaggagggtgatggcgatcgggacagccagctgtgccacggctgcacccatgttgccgccggcggcgttcaggcccagggcccagcccttttcgcgggcggggtagaagaaggtgatgttggccatggagctggcgaagttgccgccgccgaagcctgccagggcggccaccaggagcatgacgccgaagggggtttccgggttggagacacacagggccaggccgatggaggggatcaggagcagcagggcggacacgatggtccagttgcggccgccgaagcgggggaccatgaaggtgtaggggatgcgcagggtggcgcccaccaggctgggcatggagatcagccagaagatttctgaggtggagaaggtgaagcccgctgcggggagctggaccaccacgatggaccagagctgccatacgacaaagccgaggaattcggcgaagattgaccagttcaggttgcggcgcgcaatggagcggcctgcggtttcccactgttccttgttctcggcatcccagttggcgatccagcggccggggcggaattcaagggcgggggcgtctgtggtgcgggtagggccgggctgtgcgctggcggatggggcggttccgggcatcgcggagtcttcgagatcaagggaacttccggtgcgggcatcggcggtgcggtcaacagtcacggggtacctccttctgggggatgttgttcctccaaggtagggaagccgcgtttcatggacggacgccctgtgttaacgcgctgtgacatttgcctatcggcgggcttcggcaggcgtgaggcggccgccaggaccacagaatgagacgcaccacacaggtccgcatactggacctttcgtccattgactggacggggggaactaatattgaactctgactatttcgagccgttcccttaccccgggtccggccagtcctcacgaaagcgtttacctatgtcatccacccatacctccacggtgtccgggtcccagccggtgaactcacgcggacgcgtgatcgtcgccagcctgatcggcaccacggtcgagttctacgacttctacgtctacgccaccgccgcggtgctcgttttcccgcagctgttcttccccaaccagaacgaaaccacccagctcctgagctcgttcgccgtgttcggcgtggccttcgtcgcccgccccctcggctcgatcgtcttcggccacttcggcgacaagttcggccgcaagggcaccctggtggcttccctcctgaccatgggtattgccaccttcctgatcggctgcctgcccaccgcgctggttcctggctgggcgttctgggctccggccctgctggtggtcatgcggttcgcccagggcctggccctgggtggtgaatggagcggcgccgcgctgctggccacggagaacgccccggccaacaagcgcgccatctacgggaccttcccgcagctgggcgcccccatcggcttcatcatcgccaacgtgatcttcctggtgttcagctactcgctctctccggctgacttccaggcctggggctggcgcgtgccgttcctgctcagcgccgtcatggtgatcatcggcctgtacgtccgcctgaagctgatcgaaacgcctgccttcaccaaggtgatcgagtccaacgaggtggccaagctgccgctgggccgggtgttcaagaccagctggcgccagctcatcctgggcacgttcatcatgctcgccacgtacgtgctcttctacctgatgaccaccttcaccctcacctatggcacccgtcccgccacgctggacgctgccagggccgcggctgaaaaggccggaaagccgatgtcggaagcggccgccgcggcgttcgtccccggcctgggctacacccgcaacgacttcctgtggatgctgattgccggcgtcgtcttcttcggcatcttcactctcgtgtccggaccgctggccgagaagtacggccgccgcaagatgctcctaaccgtcaccggcgggatcttcgtcttcggcctgctcttcgtcccgctgttcagtggcggattcgtcggcaccatggcgctcctggtgatcggcttctccctgatgggcctgacgttcgggccgatgggtgcactgctgcccgaactgttccccaccaacgtccggtacaccgggtcggcagtgagctacaacttctccagcatcctgggcgcagcggtggcccccttcatcgccgtcgcgctgtgggaactcgctgacggcagccccgtcctggtgggcgtctacctgacctcaatggccgtgctgacgctcattgccctgttcgtgagcaaggaaacccgcgacctggactacgagaacaacgtggcctagcagcgcggactgtacgttccagcccgtttcgtggctgcggtgcccggtgcgttccccgtcaacaggggcgtgcgccgggcacttttgtgcccgggccggggcaagtgggcgggaacgcacgacgtcggcgcttcggggccgtccgcggtgtcaccgggcgtagcggtccacgaaattccgcagcaccttcatgggttcggtgacggtgaactgccgggcgtcctccatcaggtcttcagccgattccggcgggaagtagccagcgtggcggtagatatcgatgcgggtgatgaggccgtccacgtccagttcagggtggaactgcgtggcgtacagattcgtccggatccggaacatgtgcaccgggcaggccgcggagcgtgcaagcagcacggcgtggggcggcagggcggtacaggcctccttgtggccggtgaaggcgctgaaggtgcggggcatccccttcaggaccgggtcctcgagtcccgcgtccgtgagctctatctccactccgcccagcggttcaccgtaggtcctgtcgatgacggcgccctggtgcgtcccgagggtgcctacgccgtagcatgcgcccaggaacgggaagtccccggccaccagcccgtccagcagcccggacagctcacgttccaccctgtgctggacggctgatttctgttccggtggatcgctggaggtgaaggggcttccgccaacaatgacgcccgagtagtccgcaaggtccaggtccggcagtggtgcagcctccagcctcacgcggtgcagttcccgctcttccaggccgccataccgcaggtaggcgtcgtattcgtcgtcggcggcggcgtcctcggcccgggaagccaggagcaggaaaggcagcatctgctaagtgtgccggtttgggccggacctgtcagctggccgggggctgggtgagggagcggcgcgactgcgggcgcgcggcagggtccgcgtgccggtggacgagcttccagtagccttcctcgcgccggaagatgctggtgacgcggagcgcaaactcctccacggcactcccgtccaggcgggcgcggaagtgttcggtctccaccaggtaggcggtatcccgtgcggtgtaggacgtgatggtgtcgaaccccagcatctggccgtcctggaactgccgggcagcctggtccagccttgcctccacctgcgcccagccgcgggcgatcccgccaaaggggttggccagtgtgacgtcgtccagccgggaatagagctccttgacgggctctggattgccccgggtaatttcggggacggccaggtggtaccggcccacttcttcctggaaactgggtgcgagcatgggtgcctccggcgcttactggtcttcgatgatggcgatgatggcgccggcggacactgtttcgccggatgacgcctcaagcccgatgacgattccggagcggtgcgccgtgagaggctgctccatcttcattgcctccaggaccaccaccaggtcaccttcggaaacgacgtcgccgttggagacggcaaccttgacgatggtgccctgcatgggggacgtaagggcattgccggtggccgctgcaggaccgccggagcgggagcgcttcttcgactttgcgggtttccctgccgtcgccgcccctccggatcccaaagaacccaaggaggcgggcaggaccacttccaggcgcttgccgcccacttccaccaccacgcgctggcggtcttctgcggcgccgtccgcgtcggcggagccgtccggggtccaggccggaaggttgttgacgaattctgtttcgatccaccgggtgtggaccgtgaacgggccctcggccggggcgaacgcgggatcggacaccaccgcgaggtcgaacgggataaccgtggggatgccctccaccaccatttcctcaagcgcgcggcgggcacgctgcagggcctgcgggcggttggctccggtgacgatcagcttggagagcatggaatcgaagttgccgctgatctcgtcaccctgctcgatgccggagtcgatgcggactcccgggccggtggggttcttcagcacgcgcacggtgccgggcgccggcatgaagttgcggcccgggtcctcgccggtgatgcggaactcgaaggagtggccgcgcacctccgggtcgccgtagccgagctcttcgccgcgggccagccgaaactgctcgcgcaccaggtcgatgccggtgacttcctcggagacacagtgctccacctgaaggcgggtgttgacttccaggaaggagatggtgccgtcctgtcccaccaggaattcgcacgtgccggcgcccaggtagcctgcctccttgaggatcgccttggaggactcgtagagccggcggttttgctcttcggtgaggaacggcgcgggggcttcttcgacgagcttctggttgcggcgctggagcgagcagtcacgggtggaaaccaccacgacgttgccgtgggcgtccgccaggcactgggtttcgacgtgccggggagcgtcaaggaagcgctcgatgaagcactcgccgcggccgaaggcagcggtggcctcgcgcacggcggattcgaagagttcggggatttcctcgcgggtgcgggccaccttgatgccgcgcccgccgccaccgaacgcggccttgatggccacgggcaggccgtgccggtccacgaactcgaggatttcctcggcggattcgaccgggtcagcggtgccggggacctgcggggcgccgaccttttccgcgatatggcgggcctggaccttgtcgccgagggcggcgatggcttcgggggaggggccgatccacgtgatgccggcggcgatcaccttggcagcgaactcggcgttttcggccaggaagccgtagccggggtggatggcgtcggcgccggactggctggcggcgtcgatgatcttgtccatgaccaggtaggactcggcggcggtgttgccgcctagggcgtaggcctcgtcagcgaggcggacgtgcagggcgtcacggtccgggtccgcgtagacggccactgaggcgatgccttcgtcgcgggcggcccgaatgatgcggacggcgatttcaccgcggttggcgatcagcacctttgtgagggtcgactgcgtggttcctgcggactgctccaaatttgctgacaaggcgtctccttctttccttcagggagcctagcgcggttttgagggttccgccgatattacttgcggaatccgcgtgtaaaccggcctagctttgtagggaagctacaagaccctgccaattgcggcgcttttgttgcaggcggggaaggtgccgtcagccgtgccacaggtccgtgatgcgcacgttcgcggcggcaagcaggccccggagcgtggagaccgaaagcccgacgacggtgtgcgggtcgccgtcaaccttccggatgaacgcaccgcccaggccgtcgatggtgaaggagcccgcgcagtgcagcggctcgcccgtggcgatgtaggcgtcgatttctgccgggtccatctccaggaaggtgacctcggccgaggccaccgtcccgagggtggcgccggtgccggctccttcgccgtcgtcgtcggaacccgtgtcccggcagtccaccagccagtggcccgtatgcagcaccccggcattgccgctcatccgcagcatgcgctcgcgggcgacggcggcggtatagggcttgccgtgcgcctcgccgtcgaactcgaacacagagtcgcagcccaggaccagcgcgccctcagcttccggaagcgccgccactgcctccgccttggcccgggccagcagcagggcggtgtcgtgcgggtcggtgacgccgtagcgggcctggacggcgtcctcgtccacgtcggacaccaggatggagtgccggatgccggcctcggccaggagcttggtgcgggcgggggactgggatgcaagaatcaggcggaccacaaatccagcctaattgaccggtccggcctggtggaccagttccccgggcgccggtgccgcctcggtccggttgagtttggcgccctccacatccacgtcaggcaggatccggtccagccaccggggcagccaccaggacttttcacccagcaggtacatcacggccgggacgatggtcatgcgcaccacgaaggcgtccaggagcacgccgaacgccatggcaaagcccagcggccggaccatagtgaggtggctgaagatgaagccggcgaacacgctgaccatgatgatcgcggcggcggtcaccacagcggccgcgtggcggaagcccacccggacggcctccttggcggtggagccgtgcatgtaggcctcccgcatgcccgaggcgatgaacacctggtagtccatggccaggccgaacagcacaccgatcaggatgatgggcaggaagctcagcacggccccggggttggcgacgtcgaacacgccgccgagccagccccactggtacacggccaccacggcgccgaaagctgcggcgagcgagaggaggaaaccgcccgtggccagcagcggcaccacgatggagcggaagaccagcagcagcaggatcagggaaagcccgacgacgatcgccaggtaaggcggcagggcgtcacccagcttggtggagacgtcgatgttgccggccgtctggccggtcaggcccatcgccaccccgtgcccggactggatttcatcattgaggccgcggagttcggacaccacgttgacggtgctggcgctggccggaccttcctcggggatgacctggaagacggcggtccggcggtcctcgctgagggcaaccggcacggcggccactacattgtccacggcgcggagcttgtcagcgacgtcgtactgcagggtctgtgcctggccttcatcgaggccggccgggaactcgcctacggcgacgatggggccggtgacgccctcgccgaagctgcgggccgtgaggtcgtaggcctggtaggcctcggagtccactggttcggagccgccgtcgggcagcgcgagctgcagctgggtggctggcagcgcgagggttcccaggaggagcacgccggccaggagggccaggacggggtgccgggtgaccaggccgccccagccgcgggtgctgcgctcgcggtccttggcgtcatcggctgcttcgtggccgggctccgcgttgtgggcatcggccttggcccaggcccgccgggagatgatgcgccggcctatcagggacagcatggcgggcgtcagggtgatggccaccaggacggccacggcaacggtgccggccgcggccaggcccatgacggtgaggaacggcaggcccggcaccaccagtgcggcgagggcaatgatcacggtcaggccggcgaaaaccacggcgttgccggaggtgccggtggcccgcgccacggattcctctgggtgcatcccggccagcagctgggtccggtggcggttgacgatgaagagggagtagtcgatgcccacggccaggcccagcatgagggccagcatgggggagatggagctcatgtcgaagaggccggacagcgcgaacgtgatgccgacccccacgccgacgcccaccacggccatcagcagcggcagcccggcggcaaccagcgtgcccagcatcaggatcaggaccagggccgcgaccgcaatgccgatgatctcagcggtgccgaagagttccgagatgtcctcggtgatttccttgctggcataggcggtgacgccggccccggacgtctcgtgggcgatgtcctggacctgctggcggacatcggggctcaggccgttgatggaggtgttgaattgcacttgggccacggcagcgcggccgtcttcggacacgaaccgtatggctgatgacgcttctgcctggcgcttgccgagttcgagctttgccttgctggtttccagctcctgggcgcctgcctcaagccttgcctggccctcggccagtgcggccttttgctggccgagctgggcctcgatgagcgcggcaggggcgccggctgcagaaagctgctgctctgctgcggccagctgtgcctggccggtttcgagctgggcgcgcgaggcgtccagctgggcctggccggcggcaagctgctgctcgccgtcggtgatggcctgtcctgcctggtccacctgggcctgcgtggcgaagggatccacggtgccgcggacgaccggcacggtctcaagtttcttgagcacatccgtgacggcggtccggctctcggcggtaaagccgccgtcgggcgcctcaaaaacgatggtggcggtgcctccggatgccgagggaagctcttctttcagcttgtcggcaatccgctgcgtctccgtgccgggaatctggaagttgttggacagcgtgccatggaacgctgctgcggcaccgcccacggccagcagggcggcaagccagagggaaatgaccagccagcgccggcggtaggagaacttgcccaggcggtaaaggaacagtgccatgtaaggtgaccgatctgatcaggaggaacgggaggctgagggtgagggggcgggcgtactgcccgtggtgaaaccggaaccgagcagggccatggcgtcgatcaggagctgcctgagttcagcgagggatgccggtgagaggtcggcaccgcggcgggaaaaccagacctccatggcggccttgccgcaggaaatcaccgaccccgccagggcgcggaggtagagctcgtccgctgcgccgggcgttgcggacgcacggtcgcgggccactgctgtgatctgttcccggcagtggtcccaggcttccagttcggaatgggacatcaggttgctctgctgggtcagcgtgaacagttcggccagcggggccaccgtcatcggatccgcaagcgccatcagtgcctcctgggcggactggaggacgggttcgtccgcgggccggagtttgaactgctggatggcgttgtccaggaagccgtgggtgatggaggccagcgcggcgtcggtactgccgaagtagttgaagaaggtccggcgtgaaattccggcggcgtctgcgatgtcctcgacggtgaagttcccgggccccttgctgcgcagaagggtcagtgcggcgtcagtgatggcctggcgggtggcggctttgttcagctcccgccgcgatgtcggcgcgggtgcctgcgcggaggcttccggcggaatggggtctggggaaactgtcacgtatttacactaggtgcaactttgcactctgagcaacttgctttcacaggagaatgaaaggttccggacagctctcccatgacttgcccgcggatgctggaaatgtcccgaataggactaacgatcagcagccgtcccggacggcagtaccaggagacaagaaatgtcacgcacaaagaaaatgaccctcggcctgtcagctacggcgctggcccttggtgccggaatcggcgttgccggcatggcctccgccaccacaacaccggctcccaccccgagcgcgagctccagcgcctcggccgacgggagcaccagcaccatgcccggcggcatgggcaagcacggcggccggggcggtgagcgcggaattgcccaggcgtccgcactggcggagaagctgggcgttgaggaagcaaaggtgacggaggccctgcaggccttccgcgaggccaacaagcccgcaggtcctccggcggagggggagaagcctgatgcagccacccgcgaggccgcccttgcgaagtcgctggctgaatcgcttggcatcgaggaatccacggtcaccacggcgctggaggagctccgcagcgaacggcaggcagagaaggcggcgggcctgaagacccggctggaccaggccgtcgcggacgggaaactgacccaggccgaggcggatgccgtcaccaaggcggtggagaacggcgtgatcggcggcgggcactgaccgcactccctgctggatagcgccttgcacggaacctagggccatatacagaaagaagtccccgggaacggttgagttcccggggacttctttcgtgatgggtgagcaggggcccttaggccttcgcatcctccaggtggcgcggagcggtgtccgtggtggtcccgtccgacgatgcggcggccggcgtaccggcgtcggcagcgtcgaagctgtcgtcaacaaacggcgtgccgttgcggggcgcgttgtacagctgctcgtccaggatgccctggcgcttggccacgatggtggggaccagggcctggccggccacgttgaccgcggtgcggcccatgtccaggatcggatcaatggccaggaggagaccgacgccggccagcggcagtcccagcgtggacagcgtcagcgtaagcatcaccacggcgccggtggtaccggccgtggcagcggaacccagcactgagaccagtgcgatcagcaggtactgggtgaagtccagctggatgccgaagaactgggccacgaagatggctgagatcgcggggtagatcgcggcgcagccgtccatcttggtggtggcgcccagcggcacggcgaaggaggcgtaggcgcgggggacgcccaggctgcgttcggtgacgcgctgggtcagggggagggtgcccacggaggagcgggagacgaaggccagctggacggcgggccacacgccggagaagtactgcttgaccgagaggccgtgggcacggaccaggatggggtacaccgcgaagatgaccagggccaggcccacgtagatggcgaaggtgaacttgcccagcgaaccgatggtgtcccagccgtagacggcaacggcgttgccgatgaggcccacggtgcccagcggggcgatgcggatgatccaccacagcaccttctggatgacggccagcgcggaagcgttcaggctcaggaagggttcggcagccttgcccaccttgagtgcggcaacaccgacggcgatggcgatcacgaggatctggagcacgttgaagttgacggaggtggtgaccgcgccggattcggcaacggtggagctggcgcccagtcccaggaagttcttggggaacaggcccaccaggaaggcccaccagtcaccggacttgcctgagtacttggcttcctcggagatgccggtgttggcgccgggctgcagcaggacgcccaggccgatgccgatcagcacggcgatcagggaggtgatggcgaaccacagcagggtgttccaggcgagcttcgcggcgttggacacctggcggaggttcgagatggaactgaccactgcggtgaagatcaggggtacgacggcggtctgcagcagtgacacgtagctggagccgatggtctgcagggtggcgccaagggcgttggggctggctttggtgctgccggtgtacttggccagcaggccgaggccgagccccacgatgagggcggcgatgatctggaagccgaacgagccagcccatttgggcagctggaagccggtctttcctgcgggggaagaggtgcttgtctgagtgctcacccgactacgctagggccaccccgcataccacggcgaacgaacattgagaaatattacgcacctcaattttcagctcgagcgcatcaaccccgtgaaatcaagggagtgcagcggccatgttacttattcccggcccgggtgtgcttaacatctcgcgcaacgcggagtcaggactaagaaagcagcgcccgccggagcgtgtccagtccgaccgagccgatgttgagtgcccttgtgtggaactccttgaggtcgaacccggggcgggcctcgagttcggcgcggatctgttcccagagccgctggcccaccttgtaggacggcgcctggcctggccagccaaggtagcgggtgaactcgaagttgagttgtccttcgctgatgggcaggttctccttcaggaattcatagcctttgtccggggtccacgtgccggtgccccagcgttccgggacctccagctcaaggtggacgccgatgtcgaacaccacgcgcgcggcccgcatccgttgcatgtccagcatgcccatgtggtcgccgggatcgttcaggtagcccagctcctgcatgaggttttccgcgtacagcgcccagccttcgccgtggccggaggtccagcagacgttgcgccgccatttgttcagcagttcgcggcggtaggtggcggtggccacctgaaggtggtggcccggcacgccctcgtggtagacggtggtggtttcggcccaggtggtgaaggtgtcctcgccggcggggacggaccaccacatgcggccggggcggctgaagtcgtccgaggggccggtgtagtagatgccgccttcatcggtgggggcgatcaggcattccagctttttcatgacgtccgggatgtcaaagtggacgccggcgagttcggccacggctttgtccgaaagctcctgcatccattcccgcagcgcctcttttcctttcagctggcgagcgggatcgttgttcaggctctccttggcctcggcgatggaggcgccggccttgatggtgtccgccacttgttcctgctgggcgatgagcctgtccagttcctccacgccccaggcgtaggtctcctccaggtcaaccgttgcgccaaggaacgaacgggaggcgagggcgtagcgcgccctgcccacggcgtccttctcgggcgccgcgggcagcagttccgcgcgaaggaactcggccagtccggcgtacgctgcccgggcggcggcagcgccggcgtcgagctcttcctggacggcggcgggcagcggcccggcggccgtggctgcccctgccgccagcttcgcaaagaagccgtccgcggcggcgtactttgtgacctgctcaatgacgatcttcacctggcgcaccgcggcaacccggccggcgtccttcgcctgccgcagggattcggtgtacccggcgatggcggcgggaacgttggaggcgcggccggcaatgtgctgccagtcctgcacggtctccgtgggcatgaggtcgaagatggcgcggatgtcctgtgccggggaggcgatgttgttcaggtcggcgtaatcccagcccgaggcgtggatcagcagctgcaggcccagccgctcctgcatggcgtcgagagtgacggcgtcaacatcgtcctccggttcgaggccctcgaggtcggtcagcgccttgcgtgcggcctctgcgaattcggcgatgcccgccggggagaagtcctggtattcggtttcgtgcccgggaacgccgagggtggtggcgaaggatgggttgagcctgatgagggtgtcggtgtagtcatctgctacggcgtcgatgcgggtctgcgggcgggcggcaggcgaggtgtctgtagtcaccctcagagactaacggcgctgcggcatttccgaacaggcccacgccgccggggcgcgcggccaggttcgctagccgcggctccgcttccacgcgccgggacccggggtgggagccagcctcagctgctggcggcggacccagtgccggaccggcggcttgtccgtcccggtttgctggactccgccaagggacagcacgacggcggtgagcgccgccagctcctcagctgtcggctgccccttcaccacggagaggaggggcacggagggtgcgttgttttcgtcagcaggttggttggggatcacagcgggatgttcccatgcttcttggtggggaggctggcgcgcttgtcgcgcagggcgcgcaggcccctgatgatctgcagccgggtttcggagggggcgatgacggcgtcaacgtacccgagttccgccgcctggtaggggttgaggagctcctcctcgtactgccggatcacctcggcgcgccgtgcctcgacgtcgccgccggcctccgccactgcggcgaggtcgcggcggtacaggatgttgacggcaccctgggcgcccatgacgccgatctgggcggtgggccaggccaggttcaggtctgcgccgagcttcttggagcccatcacgatgtaggcgccgccgtaggccttgcgggtgatcacggtgagcttgggaacggtggcctctgcgtaggcgtacaggagcttggcgccgcggcggatgatgccctggaattcctggtccttgccgggcaggaagccgggcacgtccaccagggtaatgatgggaatgttgaacgcgtcgcagtgccggacgaaccgggcggccttttccgacgccgcgatgtccagggtgccggcgaactgcaggggctggttggcaacgatgcccaccgtgtggccttccacccggccgtagccgatcatgacgtttggcgcgtacagtgcctgcatttccaggaagtggccgtcgtccacgatctgctcaaccacggtgcgcatgtcgtagggctggttggcggagtcggggatgagcgcatccagggcgaggtcgtcgtcgtcgagttccagttcctgggtgtgctccaggacgggtgcctcggacaggttattggacggcaggaagtccagcagttcgcggacgaactcgatggcgtccccttcgtctgaggcaaggtaggtggatgttcctgtggtggcgttgtgctgccgggccccgccaagggtttccatgtcaacgtcctcgccggtcaccgtcttgatgacgtccgggccggtgatgaacatgtgggaggttttgtccaccatcaccacgtagtcggtgagggcgggggagtaggcggccccgccggccgaggggcccatgatgagggagatctgcgggacgacgccggaggcgtggacgttgttgcggaagatgtccgcgaacatcgccagggaggccacgccttcctggatacgggcaccgccgccgtccaggatgccgacgacgggacagccgttgcggagcgcaaattcctggaccttgacgatcttttcgccgttgacctggctgagcgaaccgccatagacggagaagtcctggctgtacacagccaccaggcggccgtccacggtgccgtagccggaaaccaggccgtcgcccagcggcttcttcttctccatgccgaacgcggtggagcggtgcacggccagggcgtcgaactccacgaaggagtcttcatccagcaggaggccgatgcgctcccgtgcggtgttcttgccgcgcgcatgctgcttttcgattgcttcggggccggaaggctgttcggcacgcgcctggcggtcgcggaaatcggcgatctttcccgctgtcgttgtcagatcgtggctcatcaagtgtctccggctctgtagcagattgattctgtggtgctgagttgctggccggctgttgtgcgggggtttaagtagcttccacacaaaagacgaaccctgctggcaagtctagtgacgcgtccggccgccgcagctgtagggaacctacaattttctgcgccgccgtcgccagcaatgtcatgttactcatcagtaacttagctgggttagagtggtgccatgacttcgagcaatgacgcttcgcgcgcccccgcaggcccgtaccgggctgccggttccctgaggggacggaccctcgtgatctccggcggaagccgcgggatcggcctggcgattgcacttcgggcggcccgggacggcgccaatatcgtcctgatggccaagaccggggagccgcaccccaagctcgccggaaccgtctatacagccgcccgggagatcgaagacgccggcggacaggcccttccgctggtgggcgatgtccggaacgatgacgatgtggcccgcgccgtctcctctgcggtcgagaattttggcggtatcgatgccgtcatcaacaacgcgtccgccatcgacctctcccgcaccgatgatgtggacatgaaaaagtacgacctcatgcaggacatcaatgtccgggggacgttcctgctgtccaagctggcgctgccggcgctccggtcgtcggacagtgcccacatcctcacgctctcgcctcccctgaacctcgatccgcactgggcggggaaacacctggcctacaccatggccaagtacggcatgagcctgacaacgctggggcttgccgaggagctgaaggcggacggcatcagggtgaattcgctgtggccgtgcaccctgattgatacggcggccatcaggaacatgccccatggggaggatattgcccaggcagcgcgcggcccggagatcatggcggatgcggcccacgccgtgctcaccggcggcaacctggaaaacgccggccggcccagcggaaatttctacacggacgaagcagtgctcatggcggctggagtcactgatttccggccgtacagcctgggggctccggaagaccgcctggtaccggatatcttcctgtagtccgggcatccgcggtcccgctgtctgcacccgcggcgggccgccgggaccgggccgggtcggtagagtttaggtatggatgacgcacatgcccccggtaccccgctgaaccggagcgacctcgcggatcaggacttcctgtccgccaccggcatcgcacggctcgaggtggtggactccaccggatccaccaacgcggacctgctccggtcggtgaccgtggagccctcggcgtggccggacatgtcggtgctgacggcggaattccagacggcggcccggggccgcctggacaggcactgggaagcgccgcccctgagttcggtctccgtttcggtggtcctgaggcccgcgaacgcggaaggccggccgcttcccacccaaagctattcctggctgtcccttatcggagccctggcgctgcgcgaaacccttctggaaacggcaggcctgcccgcggagctgaaatggcccaacgacgtcctggtgcgcggcaagaagatcgccggcatcctggcccagttgggtcccatggtggacggctcggtaccgcccgtcatcctcggaaccggcctgaacgtcaccctccgcgaggatgaactccccgtgcccaccgcaacgtccgtggtccttgaggcgccgcggaccgcggaccggaccgaactgctgaagagctacctctcgcactttgccgtgctctaccgcagtttctgcaacgccgacggcgatcctgcggcgggcctggccggcggaccgtcgctgcacaaacgggtggaggccgtcatgacgacgctggggaagcaggtgcgggcgcagctccccggcgatcacgagatcattggccacgcctcccggctcgacgagtacggctcattgctggtggttgaccgggagtcccgcgagcacgtggtgaccgccggcgatgtggtgcacctgcgtccgtggacctccccggatgcttccggccagggcggatatgcgtaaagacctcgtcccgggcgagcaggtgattgtcaccacccgcccgcagccgaggaaactggccggggcagccgcagccttcatactctcaccggcacttgccgcctttgcttcggcatgggtggtccgcggggaggcggcgagggtcatccccggcctggagtcgcggtggacgccggcgctggtggccggctgcatcctggcggcggccggagtctggctgggttactgcctgccgaggctgctgcggtggcagggcacccggtatacgctcaccagccggaggctcatttccaggtccggcctggtgcggcggcaggaccagcaggtgaacctggcgtcggtgcgccacctgactgtccacgagtcggtacttcagcgcctgttgcgctccgggaatatatccttggaaaccgggtaccagggcgtagtgactttccgggatgtgccggaggttgccaggttccgggatttcatccttgacgccctcgaggaactgcccgacgaacacgacggccagtccggcggggcgctggactaccctgccggagcattgccatgggaactgagagaaggtggacgggatgaacgatgaggaccagcaggaacgcgtggactccatcacgcccccgcccgcgatggacgcccaccccgcgacgggcaccatgtcagccgaacggctcgccatgaaggcgctggaggcccggctgcttggcggggaacgcaagctccgccgtcgtgaagtcgccgcaggcgcagggctgtccctgctgtccgcacgcaagctgtggcgcgccctgggctttcccaacttcggcgacgaggacgtcgccttcaccgagcgtgaccaggccgccctctccaccgtggtggatctggtgcgctccggcaaactgacggaggaggccgcgatctccgtcacccgctccatcgggcagatgacggaccggatggtggtgtggcagatcgaagccctggtggaggacatggtccacgagcagggtgtcacggacgccgtggcacgcaagcggctcgtcaacgaactgcccgcgctggtggacgccctcgaagaagtactggtgtactcctggcggcgccagctcaacgccggagtgcagcggctcgccgtccgggcggaggccgggctccaggccagtgaggaaggccgggaaggcgatgaggacgacgcgccgctgccgctggcacgcgccgtcggcttcgcggacctggtctcctacaccagcctgtcgcggcgcatgaacgaaaaaaccctcgcccggctggtccagcgcttcgagaacaagtgcgccgaaatcatctccgtaggcggcggcaggctggtgaaaacggtgggggacgaagtcctgtacattgcggaaacccccgctgccggcgctgaaatctcccttgccctggcccaggcctttacggaagacgaaatccttcctgaagcgcgggtggccatggtatggggaaggatcctgtccaggcttggggacatctacggtcccacggtgaacctggcggcccggcttaccaccctggccgaccccgggactgtgctggtggactccatgacggcctcggccctggagcatgacgaacggttcgtgctggagccccggccgcccgaaaacgtccgcggtttcggcgagatccgtccggtgcgcctggagcgcgggcttggcaaggggcttgtgctggactagggcgcccggagtttatccatttgttggccaataaggctatatttgttgtgcccggctgtcgcaagccggaagccggccatcgccgggatctacctgggggaaccgatccatgaatcttcgcggacgaacacgcgcgcagggcgccgcatccgcaacggcattccgccggcggattcttcgctcccggctcttcagcggcaccgtttatgggctggtgctcactgtgctggcggttggggccgtggtgtatccggggttcaagaccaccgaggtggagttgaacgacggcggcgtgtgggtggtttcgaagtccaagaacgcggtgggccggttgaattatccttcgcgggttcttgatggtgcggtgactcctgcttccacgacgtttgacatcctgcaggacgcgggggacgtgttcgttgatgatgagaccgggtcaacgctgaaccaggtgtcgccggcgaacatgcggctgggcggggataagcagctgccgggatctgcggatgtgagtttcggttccgaggtgatttcggtgactgatgcggcgtcggggaaggtgtgggcggtgtctccgtccacggttaacggttttgatgaggagtcgtccgagccggtgatggtgggttcggagggcattgtttcggtggtgggggatgatgaccggatttattcggcggatcccaagtccggtgcggtgacggtcaccggtgttgacgccaacggggaggtgacgtcctcggagtcggagacctgggctgatctgaaggggtccggtgatctgcagatcacggtggtgggcgataagccggtgctccttgatgcggccgcggggaagctgttcctgccgggcggcaagcgcctgcagctggagaacgcacgcgaggcgaagctgcagcagggcggccctgccagcgggtttgttgccatttccacgcagaaggcgctgctgaagcagccgctggatgggtccactgcgaagacggtggcgttcgacggtgagggtgtgccggctgcgcctgtccagttgggcgggtgtgtgcatgcggcgtggtcgggggcgaacaagtatgttcgggactgcgtgaacgatggtgacgataagaacgtggacgtgcccaaggcgagtgcgtcgccgtcgtatgtgttccgggtgaaccgtgacctggtggtcctgaatgatgtgaactccggcaacgtgtggctggtgaaccagaacatgcagctggtcaacaactgggacgacgtcatcccgcccaaggaaacctccgacgacgccgacaaggactccgcggacgaggtccagcagacggtcctaccggaccgcaccaaacccaacacccctccggtggccaacccggacactttcggcgtccgggccggaaggacggtcatcctgcccgtcctggataacgacacagacgccgacggcgacatcctgacggtccgcgccgaacccatcgggtccggagtgcttgccccgatctacggctccacgggcttccaggtcaccgtgccggcggaccggtccggctccgagactttcccgtacacagtggacgacgggcgcggcctctccgcctcttccagcgtcaccctcaacatcattcctccgggcgaaaactccgcccctcggcagaagccgaaccgcaacaccaccctggtgctgcaggccgggaaaagcatctcgcagaatatcctttccgactggagcgatccggacggcgatgacctctacgtcgtgggcgccaccggcagcgacccccgcgaccaggtcaaagtgcggccggacgggctcctgagcttccaggactcaggttcggagccgggacgcaagaccatcaccgtgacggtttccgacggccagtcgacaacggatggccaggtcaccgttgacatccgtccggccggagcgctgccgcccgtcgccaatgcggaccacgtcgtggcagtggccggcgtggacactgtcattgcaccgctcaagaacgatctggatccgcagggcggcgggctgcgcctggcccaggtcacaccggacggaaattccacggtgtccatgggagcggaccagcagacgttcacgttcaactccgcgggccaaggggcgcactacgtgtcctacctggtgaccaacggccccgccagcgcccagcaactggtccgcgtggacgtggtgcccggcaatggcagcggcgctccggttgcggtgcgggacacggccctgctgcccagcggcggcagcgtactggtggacgtgctgggcaacgactcggacccttccggcggcgtcctggtggtccagtccgtcacggccgcggacggactgcccgtcagtgtttccgtgctggaccactcggtggtccggatcaccgatgtccgtgcgcagggccagctcaacgtcaggtacaccatttcgaacggaacaacgtcggcaagcggggacatcgcagtactggtagttcccgcccctgccaagctccaggccccgcaggccaaaccggatgaggtctcggtgcgtgccggagacgtcgtcaccatcccggtgcttgccaacgacacggaccccaacggcggcaagctcatccttgagcccgacctggcgcagaaacccgatgaagcggccggcaggatcttccggtccggcgacacgctgcgttttcttgccggcgggacgtccaccacggtctacgccatctataaggtcaccaacgagtccgggcagtcggactcccagcaggtcaccatccgcatccgtgcccgggatgacgaacggaacacccggcccgagccggggaacctgactgcccgggtcatcgccggaatggcagtgcgcatcccggtcccgctggacggcatcgatgccgacggtgactccgtccagctgatcggtatagacaaagcccctgccatgggcacggcggtggtcaaggacgggtacctggagttcactgccaccggaaccgccgccggcacggatactttcacctaccgggtccgtgaccggatcggcgcggagaacacgggcaccgtgatcgtcggaattgcaccagcggcggccaacaaccaaaagcccatcgccgtggacgacgcagtggatgtccgccccggccgcaaaatcgcggtggaggcgctggccaacgacactgaccccgacggtgatccgatcggcctggtggctgacgccttcgaggccaggcccgaactcagggtcgaaacggcggatggcggcaaagtgctgctcacggcgccggaggctgcagccaatgaaagcgtcagctacaagatccaggacgacaaaaaggcccagggcagcgcggtgatccgcgtccgggtgagccctgacgccgcactcaaggccccggtagccaaggacgacgtcgtcacccaggccgagaccctgggcaagtctgctgtagacgtcccggtccttaagaacgactccgaccctgatggtgtggccgcggacctggaaatcagcctgccggacggcaaccccaacgcacgcgtcggagccgacggcaatgtggtggccacactcgctcccgcagaccagttgattccctacaccgtgactgaccttgacggccaaagcgcaacggcagtgatctgggtacccggccagggcgaacagcaccccaccctggcccggaccgacgtcatcgaggtaatggccggacaggaagaaaccatagagctgagcgagtacgtccgggtgcgggaggggcggaccccgcgcatcacgcaggctgacaaggtccgggtgcagggcgctgaccctggaaacgtcattgttggcaacggtgatgtgctgcggtactcggcgctgccggactatgtgggccccggctcgctcaccttcgaagtcacggacggctccggtcccgaggatccccagggcctgaagtccaccctgaccctcatcaccagggtggtgccggaccccaacgccaaccacgcgcccacattcagcggctcagggcttgaagttccagcggcggaagccgccagcctggagctgggcaacctcgccaaggacgtggacaacggcgaccaggagaagcttaaattcgacatcgatggagccctgcccgaggggttcacggcctcgattgacggccagacactgacggtcaggccggagcccggattggcgcccggccgtaagggaaccatcccgctgaaggtcacggacggccggtcggacccggtcagggcagcggtggaggttaccgtcgtggcctccaccaggccacttcccacggccaacgaagacgttgtggacaaggccaatgctggccggagcgaaaccgtcaacgtgctggctaatgatttcaaccccttcagcgagaccccgctggagatcgtatccgccgccgtggaaacgggttcatccgcctcgccgccgtccatcactggcgattccatcacctttacaccggcagacgggttcaagggagtgatggtgatccggtacaccattgccgacaagaccaatgatccgtcccgccaggtcaacggcagggtccgcgtgacggtgcgggacaaaccggacgcgccctctgccccgtcggccaccgacgtgcgcagcaggaccgcagtactgaagtgggcgccgccctcggacaacggtgcacggatcaccaagtacacggtgcgctccaacggtttcagccaggaatgccccaccaccacctgcacgctcaccggcctgaccaacgacgtcaagtacgtctttaccgtcactgccaccaatgaggtcaatgagtccgagccgtcgcctgcctccaacgagatccggccggacgaaaagccgtctccgccggaggcccccgccgtccgggcaggcgacaagaacatggagatcagctgggcgccggccaggactgaaggttcggccgtcaagagctacaacctggagatctcgccgcccccagcaggcggcatagctgcgaaaaacgacgtgaccggcctgaactacacctggccgggactgaccaacggtgtccggtataaggtgcgtgtccaggcagtcaatgagctcggaccatccgagtggggactgttctcaagcgaagacaaccccgccggcgtcccggctgctcctgccgccccaacgtcgtcagtagcctcagccgtgggaaccaccaaccagctgcgtgtggactggtccgagcccgacaccaacggtgacgccatcaggaactactacgtgacgatgagcggaggcggtgcagcgccgcagacgcagatggttgccggtacggtgcgcacagccaacttcaccgcaaacaactccgaaacgggctacaccttcacagtccaggcggaaaacaaagccgggaagggaaccgtcagccagccatccgcgccgcggcgcgccaccggcaagctgggccaggtctcgggcgtcagcgccacacccgcggacacggggggagccgggcggcaggtgaccatcagcttcagggaactgaccgcggcggagcgcaacgggtccgcccaaagcgaggtcacgtacagctataactccagtaccggccaaagcggtcccatcaggccgggccagaccgtcggcgggttcgccaacggggcaaccaccaccatcacggtgatcgcacactccactgcggccccgagctccgacgccagcgccggggcaccggccaccccctacggctcacccggtacgccatccgcctccggacaggatggcgccctgaaccagaagtccctgaccttgaactgggcctcaccttccaccgccaccaatgacgttgcttccaccctgatcaggatcgacaacggcggatgggaacgtgttgccgcgtccggcagcagggtcatcaacacgggcgggttcagggaaacccaccgcatcgaggtcaaaacggtcaactcgctggggacggaaagcggcgtggcctcagcaacagccacgtcgggtgcacagggagaatggatcaccacggtcgtcaaaggcaccgacctggtgcgcacctgcacctttgaatacgggaaggccagctaccgcccggcaccatacttcgactgccagggaatcaacaacggagataccccgccctggtactacgtcaacaccggcgagcggatcgttgtccactgctacgtgatgatgaacgaccactggacgaataccccggaccagcccttctaccggatcgaacccgggtccaaccgcaacgtcggctactacatggttgcgggacactcgcaacttggccagccctactcccacgggatcccgcggtgctgatcacgggaatgaacacaggtacaggcagtggggagccctgcccatcgcagctccgaactgccttcggtaagctggcccggggaacggagaggcctataccggctcttcagacgcgcgggcctgggggccatcgcaacaaattgagggaaaaatcgctgtgacaagtctgctggggaaacttgggctcaatcggcgccacaaaaagatggtgacgggcactgctttcagtgccgctgttgctgttgtggtgacgggggcaattctgtatccggggttcaagaccaccgaggtggagttgaacgacggcggcgtgtgggtggtttcgaagtccaagaacgcggtgggccggttgaattatccttcgcgggttcttgatggtgcggtgactcctgcttccacgacgtttgacatcctgcaggacgcgggggacgtgttcgttgatgatgagaccgggtcaacgctgaaccaggtgtcgccggcgaacatgcggctgggcggggataagcagctgccgggatctgcggatgtaagtttcggttccgaggtgatttcggtgactgatgcggcgtcggggaaggtgtgggcggtgtctccgtccacggttaacggttttgatgaggagtcgtccgagccggtgatggtgggttcggagggcattgtttcggtggtgggggatgatgaccggatttattcggcggatcccaagtccggtgcggtgacggtcaccggtgttgacgccaacggggaggtgacgtcctcggagtcggagacctgggctgatcttaagggtgccggggatcttcagatcacggtggtgggggataagccggtgctccttgatgcggcggcggggaggttgttcctgccgggcggcaagcgcctgcagctggagaacgcacgcgaggcgaagctgcagcagggcggccctgccagcgggtttgttgccatttccacgcagaaggcgctgctgaagcagccgctggatgggtccactgcgaagacggtggcgttcgacggtgagggtgtgccggctgcgcctgtccagttgggcgggtgtgtgcatgcggcgtggtcgggggcgaacaagtatgttcgggattgcgtgaacaatggtgacgataagaacgtggacgtgcccaaggcgagtgcgtcgccgtcgtatgtgttccgggtgaaccgtgacctggtggtcctgaatgatgtgaactccggcaatgtgtggctggtgaaccagaacatgcagctggtcaacaactgggacgacgtcgtcccgcccaagaacgagtccgacgagcaggaccaggaatccgcggacaacaacaccatcaacgtcctgccggaccgcaccaaacccaaccgtccgccggaaaccaagcccgacgccgtcggcgtgcgccccggccgcaccaccatcctcagcgtcctggacaatgattcggaccccgacggcgacgtgctcaccgctgccgtgggggactccgggccccaggccggaagcctcgaaaacatctacggcggcaccgccttccagatttctgttcccgctgacgcgaaacccgggaccgaaacgttcagctacagcgcctctgacggccgcggcctctcggcaagcggacaggtggcgctcagcgtggtggccccggacgagaacaagccgccgcagttcaagcgcggcgacaacaccaccatgctcgttgaacagggcaagacagtcagccagaacatcctcacggactggattgaccccgacggcgacgacctggtgttgctcgacgcaaaggcagacaacgaccaggaccaggtgaaggtccgccgtgacggcctgctcaccttccaggactccggcgcgacagccggcaagaagtccgtggaagtgaccatctgggacggccgggacaccgtcaccgggaaagtcgtggtcaacgtccagccgccgggagcccttgcaccggtggtcaacgccgaccacgtcactgccgtggtgggccaggacctggtcatctcgccgctgaagaacgatgtggaccccaacggcggagcgctccgcctggcacaggtggaggccaacggccccgccgagctgggtcccgtgaccgacggcggcaccttcacgttccgcagcaccacccccggcccggtctacctgacgtacatcgccagcaacggcccgcaaagcagccaggggctcatccgcgttgacgtggaatccggagacgaggccggtgaccccgtcgccgtccacgacgtggcgctcatgcccaccggcggcagcgtgctgctggacccgctggccaacgactccgacccctccggcggtgtcctggtgctgcagtccgtgaaactgcccgaaaactcgaccgcgtccgtcagcgtgatcaaccacggtgtccttcgcatcaccgacatcctggggaccaaagacccgatcctcttcgaatacaccatgtccaacgggaaaaagtcggccacgggcagcgtctccgtggtgcccgtcccggcccccgccgtcgtggaagcaccccagcccaagccggacgaggtcaacgtcagggtcaacgacgtcgttaccatccccgtactcgagaacgacacccacccgcagggccaggaactctcggtggatcctgtcctgccgcagggcgtggatcccgtggacggaaagagcttcgtctcggagaacaccctccgcttcattgccggcccgcagcccaagacggtccgagccatctataacgccgtggacccgcagggccagaagagcgccgccgcggtgaccatccacatccttccgctggaaggtgccgaaaactcacgtccgcagccgcgcaacctgaccgccagggtggtggccgccggcacggtgcgcattcccgtcccgctggacggcatcgatccggacggcgattcggtccagctgaccggcatcgacagcacgccggcgatgggaacggctgccgtgggcagcaacttcatcgacttcacagctgccggtgacggcgccggaaccgatacgttccgctacaaggtggtggaccggcagggcgccgtcaacaccggcactgtcaccgtgggcatcgcgccgcgcggggaggtcaaccagaaacccactcccgtggatgacgaggtccgggtccgcccgggtcgccagatcgccgtcgacgccaccggcaacgacaccgaccccgacggcgacctcatccgcatcctcagcgacggcatcgaagccgaccctgcgctgcaggccaccgtgagcaaaaccagcggccggatcatcctgctggcgccggaggaagccggaacggtcaacgtccgctacaccatcgccgacgaccgggacgccaccgcgcaggccaccatccgcgtggtcgtggacaacgaggtgcccctcaaggcacccgtcgcccgtgatgacagggtgacctccgcccagaccatggggaagaccgccgttgatgtccccgtcctgaagaacgacgaggaccccgacggcgtcggcgaaaacctcaaggtcagcaccgaggccaccaccgcccggccaggggcagacggcaccatgatcgtggacctgacggagcagccgcagctcatcccgtacaacgtggaggatgttgacggccagcagtccacggctgtgatctgggtaccgggcctcggccagcaggtgcccaccctggccaaggacgaagtcctcgaggtcgtcgccgggcagtccgtggacgttgacctcgacgagtgggtcaaggtgcgtgaaggccgctcgccgcggctcacccagaccgaccgcatcaagctcatcggcgccgacggcggcgatcctgtcatcggcgacggcacgggcctgaagtacacggcaggcactgactacgttggtcccggctcgctcaccttcgaggtcacggacgggaccggcccggatgacccggaaggcctcaagtccaccctcagcatccgcaccaaggtcctgcccgaccccaacaagaacaatccgccggaactgctgggcgcaaacgtcgacgtacccaagggcgactccgccagcaccgacctgggcaagctgacctcggacccggacggggacgacgtcgaaaggatgaagtacgaactggtgggcggagcgcctgccggattcaacgccagcatcgacggcaggaccctcaaggtctccgcggccgactcgagcggctcaggaaccaccgccgccgtccaggtcaaggccaaggatccccgcgggcttgaagccaccgccacctaccagctgaaggtgaccgcctccaaccggccgaagccggtggccaacgacgacgtgcaggacaacgttgccgctggcaaacccgtgacggtcaatgtgctggccaacgacgccaacccgttcccggagaccgcgctgaagatcattgcggccgccgcggaaaccggcagcggcaacgtggacgtgaacggcgattccatcacggtcacgcccgcgccgggcttcaccggaaccatggtggtgtcctacaccgtggcggacaagacggaggacccctcccgccaggcaacggcccgcgtccgcctcacggtcaaggacaagccgcaggctcccgccaccccgcaggcgcagagtgtgggggaccagacggccctcctgaactggacggcgcctgcggaccgcggctcgcccattaccaagtacaccgtgtacggcgagggcgggttccagcaggactgcccggccaacacctgcacgctcaacgggctggtcaacaacaccaagtaccacttccaggtcacggccactaacgagttcggcgagtcggaccggtcgcctgcctctgccgaggtgcgccctgacgtgaagcccgacaccccgctggcgccggcgatgaagttcggcgacaaggcgctgtccatcagctggtccgcccctgcaagcaagggctcgcccgtgaagtcctatgacctggagatctcaccccctcccgccggccagaacgcccagatccagaacttggcagcggtcagctatgtctggaagggactgcagaacggcgtctcctacaaagtccgggtcctggcgcgcaatgatgccaaggaaccgtccgaatggagcccgtactcggcggccgaggtgccggccggcgttccggccacacctgctgcaccatctgcggcgcaggcgggttcggtgggttcgcaaagccagctgaaggtgagctggacggccccgaacaacaacggcgacgccgtctcggcctacaccctgaccaccctccgcggcggcgcggtggtggccagccagcaggtcgccggtacttcgcagaacgtgaccgtggacaactcggaaacgaactacaccttcacggtgtccgccacgaacaaggcgggtaccagcgggacgagcgccccgtcggcggccatccgggcggtaggcaagccgggcatggtaggtactccggctgccacactggttgacacgggagggaacggcggaaagatcgatgtacggttcccggttttgacggctgcccagcgcaacggttcgaccgccgacgagattacgtacaaatacagcctgacgtctggcgggggcagcggcaatatccctgcaggcggcggtactgtggcggcagccaatggcacccagaccgcagttgtggtgtgggctgtgtcgtcccgcagctctacggccggcgatgccagccctgcgtcgaactccgtcaatccctatggcctcgctttcgccccgaccgttacgggcagcaacagcagcggcgtaggggacaggacggtgtcctggacgtggaaccagccggacggcaacggccgcgcggtgaccggttaccagtacagcctggacggaggcaactggcaggacacacaggagcggcgtttctccaagaccgtggggtacagcgagacgcacacgctccgcgttcgtgccatcagtgccgaccagcccggccggatcggcagcgatacgtcccgcagtggcgcggaaccgccgcctcccgtacccacgtcgtggaacatcacggcaacgccggtccgcagctgcaccgaaccccgcaaggggaccgacagctacgtcgccggcaacccgtcggaatgcaacggcgagggaaagtggctggacgccggggctgcagcgactaccgaccgctaccaggtctggtacaagacgtccaacaaccccaccggcatctggtaccacctgacctcgggcatggctgccggaaactggatccgctgcgacacctcgaaccttgggtgcaacccgcccaacggcatgccaaaccgctagtccaccacctccgcgacactggggcccgggcctcccgggccccagcaagaacctgaaaccttgagaaggaagaagccacaccatgaccatgacccccgagcaggccgcctggtttaccgacaccttcgagaagctcgttgccaacgtgggccaggccgtgctgggtaaggaacacgtcatccggctcaccttcacggccatgctggccgagggccatgtgctgttcgaggacgcccccggcaccggcaagacctccctggcccgggcactggccgccaccgtgcagggctccaacaaccgcatccagttcaccccggaccttctgccctcggacgtcaccggtgtgaccatctacgaccagaagacgcagaagttcgagttccacaagggcccgatcttcaacaacattgtcctcgcggacgaaatcaaccgtgcctcgccgaagacccagtcggccctgctggaagtcatggaggagtcccgggtcacggtggacggcgtcacctacgaagccggacggccgttcatggtcatggccacgcagaaccccatcgagcaggccggcacctaccgcctgcccgaggcgcagctggaccgcttcctgatcaagacctccatcggctacccggaccacgcctccaccgtccggctgctgggtggctccaacctcaaggaccggtcccaggaactctccgccgtcatcaccacccaggccgtggccgacatggcagacctcgcagccaccgtgcacgtggacaccgccgtactggagtacatctccaggctctgcgaggagacccgcaacgcccccgaaacccggctcggcgtctcggtgcgcggcgccctggccatggtccgggcagccaaggtctgggcagccgggcagggccgcaacttcgtcctcccggacgacatcaaggaactggctcccgtggtgtggacgcaccgctttgtcatggaccccgaagcggagttctccggcgcaaccgccgaggcggtgctgacgcgcatcctggcggacatcgcggctccgcagcagcgcaccaacgcctgacgccccggccaggaccccaccactttccacgcaacaacgaaggcacatatatgtccagcggcacgccgttgacccggctcacggagcgtctgaagcaacccttcgccaggaacggcagtcccggcgccctgcacccctcagccgtctgggccgaggcaaggaacactgcagccatggcgtcggcgcccgcctggcgtgccgttcgtgaaacctggctgaagtatgcctggcccgtgctgtcagtggtcagcgtcctgggctggtcagtcctcgcggccgccatcctgctctgggcaacagggcaggcgtttggctggcaggaggcgaaggccgcggcaatcgcggcgttcgtgatgttcgtgattgcggtggcgttcgtcctgggccgctcctcctacggcgtggtccttgacctcgcccgcacccgggtggcggtgggggacagtgccgtgggcagcatcgcggtgtccaacacctctgcccggccgctgttgccggcagccctggaactgccagtgggcagcgccaccgccgtgttccacctgccgcggatgaagccgcagcaggtccacgaggacctcttcaccattcccaccgcgcgccgtgccgtgatcgtcgtcggccccgtcaggtcggtccgggcagaccccctgcaccttttgcgccgccaggtcctgtggaccgaaccggaggacctgttcgtccatccgcgcacagtggccctggccggttcggcggccggattcatccgggacctcgaaggcatgcccaccacggatctctccagcgcggacgtatccttccacgcgctgcgcgactacgtgccgggggatgaccggcggcacatccactggaaaacaacggcacggaccaacaagctcatggtgcgccagttcgaggaaacccgccgcgcccacctggccatctcgctgtccatcaacaccgacgaatacgcgtcggaaaccgagttcgagatggccatctccgccgccgcatccatcggcaggcaggccatccgtgagcagcgcgagctggacgtcctcacccagaaaggcccgctgcgctgcgaaacagggcggaacctgttggacgacatgactcggatcatcggcgcgcccatgcgccggaccgccgtcgacctcgccaggacgctggccgacaccgtccccaacgcctccgtggtgttcttcgtggtgggcagcaacgtgaccgccacccagctgcgttccgccgccgcttccgtgccgccgggcgtccgcagcctcgccgtccgcgtcgaggccggcgcctcgcccacgcgagcaaacatcgcagacctgaccgtgctgacgctcggcgacctgactgacctggccattgtgctgagaaaggccgcagcatgagctccacagaaaacatgcgcccgcgcagcacgcgcccccgcaccaaacaaacccgcaccaaacaaacccgcgccgcgcagccgcgcaccatccgcaccgcaccccgggaccaggcggactccgcctttgccaacgggcagccgctctggcacttcatgctcgacgccggcgctctgacggtgctgctggggctgggcctgctcgggttcgggctcagcttcggcggcgacccctactacctgctgtccggcttcggcggaattttcctggggctggccctgggcgccctgaacgcacacctgcgccttggactgctcatcaccacggcactggccctgggcgcctacctggttttcggtaccctgctggcggtcccggattccgccatcgccggattcgtccccaccctggactcgctccgcatcctcctgctggggatcgtgttcgcctggaaggacatgctgacggttggtgtccccgtgggcaccgcgggcggtgtgctgatcgttccgttcctaagctccatgatcaccgcgctggtggccgccatcctgacctggcggcttcgaagcccctacttcccgctcctgccggtactggtcctgttcgtcaccggcatcgccttcagcaccaacgccgccttcctcaccgtggaacgcggcatcggcctcacggtgctggggatcgcctgggccaccttccgcagggacgccctccggaagaactccacccggaaggtctccgtcaacaacccgcagacggataccgccaccgcgcagcgtgccaggctccgccggctgggaatggcggcaggggtcatcgccgtcagcgttgccgtgaccgcgctcgccgcccccctggtcacggcgggcaacgaccggaaagtcctccggaacgtcgtggtcccgccgttcgatcccaaggactacatcacacccctcgccagcttccggaccttcgtcaaggacaagaaagacgacaccctgttcgtggtccagggcctgccccgcgacggccgcgtccggctgggtgccctggatgccttcaacggcaccaactacacgatggacccgaacggctccggcaacttcagcaaggtgggcgataccgagtcgatcaacaccctggccgatacctccggcgttgtccccaccaacgattacgccatcaacatcaccgttgaggactaccagggctttttcgtccccggaggccgcaagaccaccggcttgagcttcgacgacaccgcatcagccgcggcgtccggcctgtacttcaactccggcaccgacaccgccgtcaccaccaacgggctgtcccgcggcgactcctaccgggtgcaggtctcggaccccgtgaagctggagcacgggcagctggcgcagtacgacttcgcgaagctgtcccttcccgacgccgtggaagtgccgccggtggtgggatcgcaggccaacgacctctcctccgatgcgcccacgcccatcgaccgggtccgccagatcgaggcccatttccagaagaccggggccttcagtaacgggctcgtcagcgagggccagctgcccagcgtctccggccacggatctgcccggatcaggaacctcctcacagccaagcagatgctgggcgacgacgagcagtacgccgtggcgatgtccctgatgctgcgccacctcggcatcccgtcccgcgtggtgatgggcttctaccctgaacccaccagcccggagaacggcgcgggcgaggtcaggatcactggcaaggacgtccacgcgtgggttgaagtggcgtttgaacgggttggctgggtgagtttcgatcccacgccgcccaaggacaacatccccatcccgccggacccggaaaacaagtccaagcccaaaccgcaggtgctgcagccgccgcccccgccgcaggagccggcggacctcccgccggactcgtcgcccgacgcgctggacgcggatgagaagaagaacaacccctggcttttctggggcgccctgctgggcgccctgggcatcgccctgattccgctggccgtccttgcgctgccgctgctgctgattgccctgctgaaatcccggcggcggaagtcgcggttcagcgaggggcaccctgcgcagcgcgtaggcggcggctggagcgaggtggtgagcctggccaccgacatgggcgccgccgttgactcccgggccacccgacgggaaagcgcggcggtcctggccgaagcgttccccgcggcgggcagcaccaccaccacgctggcccggcgtgcggatgcgtccatcttcggcgcgggccagccgagcgaggacgaggtgcgcgagtattggaccatcgtggacagctccctgcaggagatgacctcgacggccggcttctggcgccggcagcaggcgaggttctcgccgcggtcgctcctggccgacgcgcggaacgccctggccctgcgtggcccgctggcactgccttccctcaaggctctcaacccggcgtcccgccgtcgtaatggaccggcggccacaggaccgcaggggaaaacgcttcagggcactgcgccgaaggggactgctgcggagcggactgcggagcaggaccgcacgacgccagaacctcctcagcagggacccgcggcaccgtgacggcagaccttcaaacctgcccccgctgccggcagtccatccgcgcgggggcggccttctgcacctcctgcggagcgcccctgcccaaccgggcggcgcgcagcacccgcaccctgcagcccggcggcaccgcgggcagtgaaccgcggcccgctgctccggctgcccacggaacggggattcccggtactatcccggtagtacaaagatccccggcgacccagtctgcggatccactcaacgcaggcaccgggcgggggagcgccggcggtttcaccgcgcagtcgggggccgtcccagggggaggaacgggaatgggagtgaaccttcagcttgctccggccacggccggcaagcggcttggggctgccgtcattgactggctgccgccgctggccgtgctggtggtgacgttcgccatcggcttcgccgggatcacgcgtacccgcagcggccagttcatcacctatgacacggcgtcgctggtgctgtccggcggcattggcctggcgctgacagccgtgtacctctttgcggtcatggggatcgaagccaggacgggcaagacccccgggaacctgctcatgggtatccgcagcgcggacaacgacggctatgccccgggcgccggcacggtgttcctccgcggacttatcaccggtgccgggatcatcttggcgctgctggcggccgtcctggtggtggtcttccggtggttcgagcccgccctgttcatccttgcgccgctggtgtttgcgggcgctgcctgggccgtgctggtggtggtgtccaaccactgggacaagaacagcggcctgcgcggctggcacgacaaagcagccaaggctcttgtgttcgatgtgaaggccggccgggaccccatcaccaccggcggcatccagggcccttacagcttcgcgccgctggaccttcccccggtccagcaggtgctctctccggtggccggcccccaggcagcctcggcgcagccaggcccggtggttccttccgcgcttgccccgcctgcccggacgccgtccgccccgacgccgccgtcgcagcccatgccctacgccgcgtcggcgtccttcgcgccgacggcagctcatgcgcccgccggccaatctgttccgggcggcctttcggtttccgctgccccggccttccccgtccagggtgggcagggagtgcagcaccacgtggacgacgacgttgaacgcacccaggtgcggccgggcgcaggcgggccggcacccgtcgctgtgctgcggatccggctggacgacggccgcgacttccagctggaccggagcgtcctggtgggccgcaaccccgtgggccaggcgggcgagcagcatgcccagctcctcgccgtcgacgatcccggccgctccatctccaaaacccacctccacctgctgaccgacggttcggggatctgggtgacggaccggaactccaccaacggcagcgccgtgaccacccccaacggcgccaggacgcccctcgcgccgggggtccccacttttgttacgccgggatccagtgtccacttcggagaccggaccttttacctaggacaggcatgaaccaaaagcccgccagcgttccctccaccttccagccgggcgtcagcctgagctacggctacgggacagaccggggactccgccgggagttgaacgaggattcctacatcgcttccgatcctgtgtttgccgtggcagacgggatgggaggccacgaggccggcgaagtggccagcggcatgtgcgtccgggccctcgccgacatcccgcagctcgccacaggtgaacggagcgtcaccgcagccgtcctgcagcagtacctggtccaggcggacacctccatccgtgaggccaccggggcgcgtgccggaaccacgctggccggtgccgtggtggtggagcagatgggcatgccctactggctggtcatgaacgtcggcgattcgcgcacgtaccgcctcagccaggggcggtttgtccagatcagcgtggaccactccgaggtgcaggaactcgtggacgcgggggagatcaccgccgaacaggccaccgtccacccgcgccgccacgttgtgacccgcgcgcttggcacgggcgacgagaccgaggccgactactggctgctccccgtggaggaaggcgaccgggtcctggtctgctcggacggcctcaccggcgagctgacggacgagcacatcctccgcatcctcagcacggtgggcaacccgcaggacgcggctgacgccctgatccaggccgcgctccggagcggggggagcgacaacatcacggtgatcgtggtggatgccaggaatgtcctgaacgacgccggtgccgccaccaccgcaccgcggcgcgaccccgatgtggtggatgaagacacgctgccacggtcgcaggtgggacagaaggcgcaggcagagcaggcacaggcggcgcagcctgcggcccaacacggcagcgaagcagcggcgcaccaggacggggagccctccgatgaccggcactagctacgttccgggcagctggctgggaatcgtccgtgggcgcacggccgtcatcctcggcccggatactccgccggcactggcgggtgcggtgtgggacctgctggggaccggtcccgaagtccacgaggtactccacgcggtgaccagcagctcgggaggctcgctggcgcagatgccgtccttcggcatccttgaggccaccggtcccttgcgggtcttcctccgcggcgacctcgacctcgcagtggacctgcccgacggccgtgtggagctcgacggccgggacgtcaccacctggaacgagcgccggttcgccctcccgggtgcatgccggctggccattccggctgccggcccggcagggcagcaggaacttccgctgggggagggtgttgtcctgctgcagtccctggcgctggtgctggccccgcgccagccggaacttggaccttccgcagccactccggcttcggtggtggtggacaccgcaggcgttgctgacgtcggggacgccgcgcccgaggctggcatctccaccgagatgaccatcgccccggaccgcgagacctcagtggaaaccgttgtgccggaacacggggcctcggcggagaccgttgtgccggaacacggggcctcggcggagaccgttgtgggcgtgctcgacgacgacctgctggccgacgacggcggcctggaacaggaagacggttacgcgcacgttggcgtgacaggttccggcccggattccggccgtgtcgatgcttcgtctgccggctccgcgccggcagaaatgcttccctcgggggtacgtgcggcggaagtccttccggcagaacccgcccccggtgaaccggtacttcccgtcgagccggcaacccccgccagcgaccacaccagctcctacgatcacctgtgggagaggaccgttgtgcggagcatcgaggacgcggcggtacgcgacgacgccgaagcggaaatcgacggaactcccgaagcaggcccggaagcggaggaacaggcagaacccccggttcccgggcagcctgacggacaggaacgtccgacgcctggcccggcgcccgcgtcagcaccgccggcagcccctcccgcaccccctgcttctcacatagcccctgcttcccccgtatctcccgctcctgccggggtgctcattgactccgttccgtggaagaagggtggggacgccgccgcgcagggcagcgccccgcagatcaatgtcccccagggcagcgccccgcagatacataccccgcaggcgaataccccgcaggccggcgctgggccgcggcccgccagggccgagcctgcagcagccgtcgtcccgccgtccacggatcccgctggcactgcgccggccgctgcagtgcagcactcccatcctggcagcaccggcgtcgacacggaccacgacggccagacggtcatgaagagcagcatcgcgccctcagccggacagcccgccacacgggttgcggaggatccggcggccgggcccaccgtcctggcccgggtctgcccccagggccacgccaacccgcccacccgggcgcagtgcgccgcgtgcggggccgggctgatcccggacgctgtccaggtgccgcgcccccggctgggtcgggtgcgtgtgtccaccggggaactcctggacctcgaccagtcgctgatcattggacggcagccgtccgtgtcccgggtccagggcggcatcatgcccaggctggtccaggttccaagccccgaaggtgacatctcgcggtcccatgtggaggtccggctggagggctggcacgtcatgctgtgcgacctcaaggcaacgaacggtactgtcctggtgcgtgaaggccagtctccccgccgcctggcacagaacgagatggccatcctgctggacggtgacatcgctgaactgggcgacaacatctcgctgcgttttgaggagattccttgagttccaaacggcccgtcgcgccgcctccccgcatccaggggttcacctatatcagcctgctgggctccggcggcttctccgacgtctacctgtacgaacaggacaggccgcgccgcaaggtggccgtcaaggtgcttctctcggacctgaaaacggagggtgcccgccgcaggttcgaatccgaggcgaacctgatggcccagctgtcctcgcacccgtatatcgtcaccatcttcgaagcggaagtgaccgacgacggccactcgtacctggcgatggagtactgctccaggcccagcctggacgtccggtaccgcaggcagcggttcagcgtggatgaagtcctggccgtcggcatccaggtggcctctgccgtcgaaaccgcccaccgtgccggcatcgcccaccgcgacatcaagcctgccaacatcctggtgacggactacaaccgccccgccctcaccgactttggcatctccggcacgctcgccggggacgccgacgacgactcgggaatgtccatcccctggtccccgcccgagcagttcaccgacggcgcggtggacggggtcatggtggatgtgtgggcccttggtgccacgctctataccttgctggccggccggtcgccttttgtgatgcccggggcggacaactcgcagcgggaactgatcaaccggatcagtaacacaccggtgccgcgcctgggccgcgcggacgtcccggagtccctggaactggccctctccacggccatggcaaagtcgccgcagtcccgatactcctcggcgcacgccttcgccttggccctgcagcgcatccaggcggaactcaacctctccgtcacaccttttgaagtgctggaggagccccaccacgaggacaaccagccggacgacggcgtcgaggagacgcgggtccggagcatcgcggcgatcgatccggaacggaccggcagcgcccccaccttccctgcacgcacctggccccaggccggcggcggccaaagcggtggcggccaaggcgctggcaaccaaagcagtaacagccatggccccgcagcggaggccccgccgtcgcgctttaccccggcctcttccccaggctcccggccggcaccagccccagccccgcagccgcaggagtgggcgaacgccacggtcctgcgcgcttccggcggcagcgccggtgcagcccaggacgaggggacgctgcccggaaccggcgttggcgcgggcgccgacgccgcggacaccaccgtccaccggccggcaagggtggaagagccggctgctgcggctcccgccgcggaccaccgcaagcgcaacctctggctggcaatttcgggcggcaccctgcttgccctcactgcggtggtgggcctggtggtggccaacgcctcgcccgagaaaaccgcggcggtggagacccagcaggccagcaggccgccggccgatgcactggacaacggaaccgtgccggacgtggaaggcctcaccgggacagcggcaggggacggcaacgcctccttcacctgggtgaacccgcagcccaaagagggagacacgtacaaatggcgggtctacaccatcggtggcggcggcgaataccagtccatcgaccagccgccggttaaggtgacggcgaacccgtcgggggagacctgcatccaggtcatgatcgtgcgctctgatggcgcgttctccccgatggaggaaagctccattgcctgcaccggctcctgagccgcggaccatcccggcagcagtacgacgacgaaacgcaccatgtggcggaacgaccaggttgtcgaacggcagcttgtccaacgaaaagttagcccggtgaaattttgcccaacgaggaggcacagaaaatgggggatctagcaatagatttctgtggtgagtggtacgagccatcggacgaggacgtcttcaacatcggccgcgaaggcgacctggaagtcgatgacaacccgtacctgcaccggcagttcctgcaggtagcccgctacgacgggatctggtggctcagcaacgtgggcagtatgctctcggcgacggtggcggatgcctccggcgggatgcaggcctggctgtcaccgggcgcccggatcccgctggtcttcagccacaccaacatcatcttcaccgccgggcccaccacctacgagttcgcggtgcacctgaagacgccgtctttccggcaggagtcacgcgagggtgacagcaacggcgacaccaccatcggcccggtagtgttcacggattcccagaaggccctcatcgtggcgctcgccgaacccatgctccggcgggaaggaaccggcttcagcgccattccctcctcggccgcggccgccaagactttgggctgggccctgacccgcttcaaccggaagctggacaacgtctgcgacaaactcgaccgcgtgggtgtggtgggcctgcgcgggggcggcggcaaactggccaccaaccgccgagccaggctggtggagcatgccgtgacgtcgcacctggtgacccctgacgacctgtacctgctggagaagatgaggggcgtggacgaaggatgaggatccgcctgacccttcgccgcgatcctgccgagtccaaggacctggccgtcaccgtggacggcctggccaccgtggccgataccgccgccgtgctctgggccgcggacccgggccgcaagggcacgccggccccggacaacctctccctgcggatcgaggaagccttcgtcggggcaggcctgagcggaaacatgctcacccggaccgacaacctcctggagtccggcctgcgccccggctccgtggtgtcactggcacaggtcagcacgcagttcgacgtgcccggtgcgggccgtggtcccgcagcggccaccctccgggtcctctcggggcccgacgccggccgcgagttttcgctgcccaccggcaccagctacatcggccgggaccgggacgtggacatccgcctctcggaccccctgacgtccaagcggcacgcccggatcacggtgggcgacggcgtggaaatagtggacaccaactccgccaacgggctcttgatggacgggcttccggttacccgggccaccctcaattcctcggacacggtcaccctgggcgacaccaccgtgaccgtggtgccgctggggcataaccacgcggcagccccgacgtcgcccctggtcagcttcaaccggtcaccccgggtggttccccgcttcgaggagccaaagcgtgtggtcccgtcagggcccaaacggcccgaggacaatccgttcccgtacatcatgatgattaccccgctgctgatgggcgccgtgatcttcgccgtgaccggcaacccgctctcggtgctgttcatgctgatgatgccgctgttcgtcgtgggccattacgtggaccagaaaatgcggaccaggcgccagcagaaggaacagctcaagcagttccgcgcctccatggccgacttccgccacgacctcaccgaactgcagaaggtggaacgcgccgtccgcctgcaggaggcaccgtccgtcagcgacaccgttgacgccatctacaaactgggtccgctgctgtggacccaccgtccggaacaccgcgggttccttggccttcggttcggcctgggcaccgcaccctcgcgggtcctccttgaagaaccgcagaacaacgacaccgaagtccagtacgcccgggagatccaggactgcctgaagcagttccgcgacgtcgagggcgttcccgttgtctcgcagctgcggagctccgggtccctgggtgttgccggggcccgcggcctggtggatgacgtggcccgcggcatggtgctgcagctcgtggggctccactcgcccgcggaagtggttctcactgccatcacgtcagcccagtcccgggaacggtggaactggctgcagtggctgccccacgtgggctcggggcacagccccctcgccggcgaccacctggcggccggttcggccggcggggcatcgctgctggcccggctcgaggacctccttgacgcccgggaggcggcggcaaaacgcactggcgccgacctccggccggagctggaccccgcgaagcaagaggtgccggaaccggtgcttccggccgtgctggtcatcgtggaggacgacgccccggtggaccgcggccggctcacccggctcgcagagcgcggccccgactccggcgtccacgtgatctgggtggccaccgacatccagtcgcttcccgcagcctgccgcgacttcatggtggtggacggagaccacggcaccaccaccgggcaggtccgcctgggcaggcacacgtaccccgtcagctgcgaaagcgttgacgcggaactggccgcccagctggcccggatgctggcgcccgtcatggatgtgggcaaacccgtgaacgacgactccgaccttccgcgggccgtctcttacgccaccctgatcggcaaggacttcctggacaacccccagtccgtcgccgaacgctggacggaaaacaattccgtgcacgccagcgccgtggccaaccgcaaggacaacggcaccctgcgggccctggtgggctccaaaggcatcgaaccgctgtacctggacctgaagaacgaggggccgcacgccctggtgggcggcaccacgggcgccggcaagtcagagttcctgcagtcctgggtgatgggaatggccgccgcctacagtccggaccgggtcagcttcctgttcgtggactacaagggcggcgccgcgttcgccgactgcatcaacctgccccataccgtgggcctggtgaccgacctttcgccgcacctggtccggcgtgccctgacctcgctgcgcgctgaactccactaccgcgagcacctgctgaaccggaagaaggccaaggacctgctggccctgcagcgcgaggccgacccggacgcgccgccgtacctggtgatcgtcgttgacgagtttgccgcgctggccagcgaggtgcctgaattcgttgacggcgttgtggacgttgcagcccgcggacggtccctggggctgcacctcatcctggccacccagcgccctgcaggcgtcatcaaggacagcctgcgtgccaacaccaacctgcgggttgccctgcggatggctgatgaggacgatgccacggacatcctgggcgtgccggacgccgcgtactttgatccttccatccccggccgcggcgccgcgaagacaggtccgggccggatccagggcttccagaccggctacgcgggcggctggaccacggagaaaccgcagcggccgcagatcgacgttgttgagatggccttcggctcggggcccagctgggaggcgccggctccagagaagcccgaagcggcagagcccacaggccccaacgacattgcacggatgaccgccaccattgtgcgggccgccgacacgctgtccatcaatgccccgcgcaaaccctggctggacgaactggccaagacctacgacttctccaggctgcccaacccccgcacggacgaacagctcctcctcggcgtggccgacgatcccgcccgccagtcccagcccaccgtgttctacgaaccggacaaggacgggaacatggccatctacggcaccggcgggtctggaaagtccgcagcgctgcgcggcatagcgattgccgcggccatcacaccccgcggcgggccggtgcatgtctacggcatcgactgcggctcctccgggctgaggatgctggaagagcttccccacgtgggcggcatcatcaacggcgacgacgtggaacgcgtcgggcgcctgctgcgcctcctgagggacatcgcggagcagcgctccgcccggttcgcggaagtccgcgccgccaccatcgtcgagtaccgcaagctggccaacaggcccgacgaaaagcgcatcttcgtgctggtggacggcatgtccgcgttccgtgaggcctacgaacacagcaggctgtccgccctgtgggacatcttcctccagctcgccaccgacggccgcgccgtcggcatccatcttgtggtcaccggtgacaggccgaacgccgtgcccgcatcgctgctcgcttccatccagcgccgcctggtcctgcggctgtcctccgaggacgactacatttcgctggacgtgccccgggatgtcctcaacgccgcctcacctcccggacggggactcctggacggccttgaagtccagctggcagtcctcggcgggaactccaaccttgcgctgcaggcccgcgaggtccacaagctcagtgaagccatgcagcgccaggggctggatgccgcccccgtcatcgagaggcttccggaacaggtggacctggaggtcctgcccgccggcagccagggccttccggtcattggcgtcgacgacgaaacgctgcagcccgccgagatcctggccaggggaccgctgctcctggccggccccccgggttcaggccgcaccgtcgccctggtgacactcgcgtatgccctgaggcggtccagcccggacacggagctgatctacgtgggatcccggcgctccgccgtcgcgtccctgcccctctggaaccgctccatcgtgggcgcggacgacctcgccgaggtggtggaggacctggtcgaacactcatcggggaatccgggggccctgggcatcttcatcgaaggcctcaccgagttcaccgacacccttgcggaatcgggagtggcccaactggtgacagcatccatcaaggctgaccaatgggtggtgggggagtccgaaacctccacctggtcctctgcctggtcccttgcccagccgttcaaatccggccggcgcgggctgctgctgaaccccggcgacatcgaaggtgagagcctgctgaacacctcgctgggccgtgtcagcccggacttcatcccgggccggggctacgtggtgggccgcggcaaggcccggaaaatccaggtggcgctgccccccgaaaacagggtctgacgcccccttcttccaccgcatcacggagggccgcaggtccggcggatttgcggccctccgtgacggtatacaaaactaccggggacaccagaaagccgcagttatccgggaacgggaggaccggatcccctgaccatcacggccggtgtgctgcgggtgggaaccgccgggccggcttttgcctggtggggcaggacccgcttccgggcacactgacggacggtgaggcaagataggtctgtgactacaggacctggccccgcagaaaagaccgcctcgatgtccccgcacctgacacccggtgctggaacaaccaccggcgggaccccaaaggaacctgagtccgtccccaccgaagcggtccgcgaggaatacgagaccctcgtggacctggtcaggaagtaccggttcgcgtattaccaggaggacgcgccgctggtctccgatgcggagttcgatgacctcttccggcgcctggaggagatcgaggcactccaccctgaactggtggcgaacgactcgcccacccaggaggtgggcggggaagtctccgccgcgttcgccgccgtggagcacctgcagcggatgtacagcctcgaggatgttttttccctcgaggaactggaggcctggctcgccaaggctgaggccagcatcggcaagctcggtgacggcacccctgctgcggcctggctgacggagctcaagattgacggcctggccgtcaatctcctgtaccgcgacgggaagctggtccgcgcagccacccggggggacggaaccaccggtgaggacatcacccacaacgtcctcaccatcaaggagatcccgcagcagctccagggcggggagtttccggccgagatggaaatccgcggggaagtctttatcccgtccaaggctttctccgaattcaatgaagcactgattgaagccggcaaggcgcccctggccaacccccgcaacgctgcagccggctcgctccgccaaaaggaccccgctgaaacggccaagcgcccgctcaaaatgttcgtccacggcatcggcgcccgtgaagggctgcaggcgcgcagccagtccgagacctacagcctgttgaaggaatggggcctccctgtcagcccctactccgaggtgctgggaagccccaaggaagtcctggacttcatcaagcgctacggggaccagcgccacaagctgctgcatgagatcgacggcatcgtcatcaaggtggatgacttcgcaacccagagggcgctgggctacaccaccagggtcccgcgctgggcggtggcctacaaatatccgcccgaggaagtgcacaccaagctgctcgacatcctggtgaacgtgggccgcaccggccgcgtgacgcccttcggcatgatggaaccggtcaaggttgcaggctcaacggtggaaatggccaccctgcacaaccaggacgtggtcaaggccaagggcgtgaagatcggcgacatcgtgatcctgcgcaaggcgggcgacgtcattcccgagatcgtgggcccggtccttgccctccgcgaccagcaggaccctccggtgcgggattttgtgatgcccaccgaatgcccctcctgcggtacaccgctggctccggccaaggagggcgacgtggacatccgctgccccaacgcgaagtcctgcccgtcccagctgcgcgagcgggtgttccacctggccggccggggagccttcgacatcgaggccctcggctgggaggccgccattgcactgacccagccggccgagccggaagtgccgcccctcacctccgaagccgcactgttcgacctcacccgcgaggacctggccggcgtccgcatccggcgggagaaacggtccaagggcgtccccaccggcgaatacgaactggtgccctacttttacagcaagggcacggccaaggcaccgtccaagcccacggccaccacggaaaaactcttcaaggaactggagaaggcaaagacccagccgctctggcgggtgctggttgcgctgtccatccggcacgtcggcccgcgggcatcccgtgcgctggctaccgccttcggcaccatggacgccatccgccaggcgtcggaagaggacctcgcgcatgttgacggcgtgggtcccaccatcgctgcggccctgaaggaatggttcgcggaggactggcaccaggagatcgtggaccgctgggccgccgcgggggtccggatggcggacgaacgcgacgactccatgccgcgcacactcgagggactgacggtggtggtcaccggctcactgccgaacttcagccgggacgaggccaaggaagccatcctggtccggggcggcaaagcggccggatccgtctccaagaacaccagctacctggtggccggcgagagcgccggaaccaagctggacaaggccgagcagctgggtgtcccagtgcttgacgaggacggcttccgcacgctccttaccggcgggccggcagcactggagggcggcgctgaagcagaggggcctgagcctgcggccccttcagaacacattgacgcggaggtaacagcatgacggatcctacagccctgctggaggtggccaaggctgcagcggcggcgggagcggcggtgctggccggccgcaacgcagaggccctgcaggcgagcaacaagggcgacgccggcgactgggtcacggcgttcgacgtcgcggcggagcacgcagtccgggacgtcatcgcagcggcccgtccgggggacgccatcaccggcgaagaacacggcaccaccaggccggcggaacccagcggctaccgctggtccatcgacccgctggacggcaccaccaacttcatccgcaacatcgtctactacgccacctccgtggcagttgccgatgccgacggcgcgtggctggccggcgtcgtcaacgcccctgcgctgggccgcgtctactacgccgcacgcgaccagggagcctggctggaggaagcaggcagggtgacccggctggaggggcccgtccccggccggaagggccagatcctggccaccgggttcagctacgatcccggggtccgggccgagcaggccgccttcctggccgggctgatggacggctttgccgatgtccggcgcctgggatccgccgccctggacctctgcctcgtggcggacgggacccacgatgcgtacggtgagcgcggcctcaacgagcatgatttctcggccggtgcgctcatcgcggaagaggccggctgctgggtccggcggccgcgcctggccagtccgctggaaggcgggcccaccgacgccgaccgcctggaggcctggacgtgcgccggcggcctggagctttcgggcaaattcccgctctgaccactcccgcgctgatagttcgctcacgaaaagcgcaggttcgccgggtgttaccggccagtaccactaccattgacgggtgcagccgcagataacagtccgtcccgccgtcgaagcagattacgacgccgttgcccgcattacgcgtgattcctacctcgccgcgggctactttgaggacgccgaccacccctacatgcgcaaagtccaggacgttgcgctgcgggccgggcatgccaccatctgggtagccgagcggaacggagtggtggtcggttcggtgacactggcccgcgccggggagccgtacgcggacatcgcccttgaggacgagctggagttccgcatgctggtggtggaccctgccgtgcagcgcagcggcgcaggcaaggccatggtggaagccatcctggactacgccaggcagctcgagggcgttaaggccgttgccctcaccaccggccaaacctgggaaagcgcccacggcctgtaccgcaaaacaggcttccaccgggcgcccgagcgtgactggctggtccccggaactgacataaaactgctggtttaccgcctcgacgtatagcagccctacagtggtgccgaaccccatccagcagtgaaaggcccaccatgcgcaaaaccttcggcaccggctccgtctgggaacagaccctcggctactcacgggccgtccaggtggacaacaccctctacatctccgccaccgcggccagcggcgaggacggaatcgtcggggacgatttctacacccagacccagtacatcctgcagaaactcggcaaggtcctcgctgacgccgagtactgctcgccgggaaccagggattccagcaccgccgcttcggttgccgagcggggttttgacgacggcgtgacgtcgcccgggatcagggcgcgcttggcgcgctccaccgcctcctggtccagggccccgggctgcgccagcaggcgacggtaccgggcatacgaacgcagctgctgggacagggcttccgacgtaaaaggcttcaggaggtagcccagcgcgccgcggcggaaagccacccggacggaaacggcgtcggaagccgctgtcagcatgatggtgtccacgtccaactgctggagcaggtccagcccggacgcgtccggcaggtagacatccagcagcaccaggtccggcctcaggctgtggatggactgcagcgccagcgacgcggtgcccaccggtgccagcgccataaatcccgccacggaatccacgtaggcggcgtgaagcttcgccacgtggaagtcatcgtccacgatcagcacccgaaaatcttcaggcatgggtgtcctttccggctgtccctgtgcttgtcctgcctgccgtccctgccgtggtccccggcagggtggccatgaataccgcgcctggtccgcccggactgcccggctccaggactttgacctccccgccgcgccgccgggccagctggcgcgccagggccagcccaaacccctggccgccgctgccgttccgggcaagtggtccggacgccgtgctgaagccttccgcgaagatcgcttccgggtccgttccctccgccagcccatcacccgagtcagcgacgacgatgtgcagcgtgccgccgtcgtcgtccggctcgtccagtacctccagctccacccagcggtccgtggcggagcccgccactgcggcgttgaccgcgttgtcgatcaggttgccgagcacggtggtgacgtcctgggcctccgccacttggcccctgaccagggtctcagggccgattcgcagtgccacgccgcgctcgtccgcctccacgccctttgctcccacgaaggcctgcaggtacgggtcctggaggagctcggcctggtccaccgggaatttcaacggcccggtggctgccagccgtgccaggtactcccgggcctgctggtgctggccgatgctcatgaacccggcaagggtgtgcagctggttggcgaactcgtggcgctgggctcgcaacgccgtggacatggttcccacggcatccagctgccgggtgagctgctgaagctccgtgcggtcgcggagcatcaccacccagccgaggtcctcccgccggtgcagggccttgcgggcgttggccaccagcacacgtccgcccgccaccagctcaaccgcgccggggctggtggagcctgcccgggtgagggacttcagctggtatggcaccggagcgtcctcccagcggctgccggccaggtccggcagttccagcagccgttgggcggcggcgttgaacaccgtgatccgaccgtcggcggagacgccgatgacgccgtcgtccacgccctggaggaccgccacctggtcgtggaccagtgtgctgatctcctcgggctcaagccccagggtgagtcgctgcaggcggcggcgcagcaggaacgaacccagaacgcccgccagcagcgccccggctgcagtgagggcgacggggccaatatcccgtgccacactttggcccaccgtttccatggagtaccccacgctgacctcgcccaccacggtggtgctatccggcgcgtagaccggaaccttcgccccggcggagggccccagcgttcccgtgttgcgggtggtgacctcccggccggccagggcctcggacggatcggtactgaccttttcgcccaggcgctcggggtccgggtgcgccagccgcaggccggtctcgtccgtgatcaccacgaacagggcgccggtccgggtccgtgcggcttcggccgcttccatcagcgggcccccagcgagctcggcggccgggggagtgccgggctgttggctgatcgccagcacgtcagcccgcaccgaggcatccgaggccaccgtccgcgccagcgtcagggcctggttttccgcctcgctgcccaccctgtcgtaggtgagccaggcgtgcacggcggcgctgaacaggacgacgagcagcaccacggacaactggagcagcagggtctgggtggagaaccgcaacggccggcggggcacggaacgctgcatgatcctccttgattagggcgggcatccgtggacacaaccagccgtgagcacaatgagcaaaatgctcccaataagcagtatgccaatcaattgagccaaaggcacggccgtgacggccgccaccctacagtctgtagcacgcgtcacaccgctgtgccgctgttcacatagtaaggagccggccgtgctggtattacttggattcgcaatgatcgcggtattcatggtgctgatcatgacgaagaagttgacgccagtgctggcgttgatcatcgtccccactgtttttggcctcttcgccggtgccggcctgggcataggcgacatggtcatggattccatgaagtccatgacctcaaccgcagccctgctgatgttcgccatcatctacttcggcctgatgatcgacgtcgggctgttcgaccccctggtccggtttatcctccgcaagctcggcaacgaccccgccaaggtggtcctgggaaccgccatcctcgcagccgccgtatccctggacggtgacggctccaccaccttcatcctcaccaccgcggccatgctgcccatctacctccggctgaagatgagccccgtggtcctcacctgcgtggccggcctggccaacggcaccatgaacatcgtgccgtggggcggccccaccgcccgcgccgccagcgctttgaacatcgatgtcaacgacgtcttcgtcccgatgatcccgtccctcctgggcggcatcgccgtggtcttcgccttcgcctggctgctcggcctgcaggagcgcaaccgcctccgtgccacccagccggagatctggggaatgccgtctacggcagagccctttaccgctgaggcgttcgacggcggcacgcacccttccggtggtaccagtggtgcaggtaccggccgcggacgcaaggggaccaaccccggcggagcagcccccgccgtcgggcgcttctccacaggcggctcgtccgttgccgtcctggaacgcaccgaagacctggtggacgaccacgacaccgccatggcagacaccgcactggaccccaaccgcagtaccctgcgtcccaagctgcagtggttcaacctgggcctcaccgtcgccgtcatgggcatgctcatcgccgacctcgtgcccctcccgtacgtcttcatggtgggctccgccatcgccctgctggtcaacttccccaacgtcaaggaccaggccgcccagatcgtggcccatgcaccgtctgttgtcgccgtcgtgagcatggtcatggccgccgcagtcctgaccggcgtcctcaccggcacaggcatggtggaagccatgtccgcctggctggtccagatcattccctccagcatgggcccgctcatggccgtcatcaccggtgtcctcagcattccaatgacgttcttcatgagcaacgacgccttctacttcggcgtgctgcccgtcctgagcgagacggccggccactacggaatcagcgccgccgaaatggcccgcgcctccatcaccggccagccgttccatatgcagagcccgctggttcccgccatcctgctgctggtttcgctggccaaggttgacctgggcgaccaccacaagaaggtcctctggcgcagcgccgtggtgtccctggtcatgctgggaatcggcatgctgaccggagccatcggaatcggttagtctatagctgccgtgctgccgccattcgttggcggaacccggcaccaaggtgcccgtctgacgcccgctgggggatgtcagacgggcatcattgtttccccactagaatggatcggaaatcaattcgaactttgcaggggagatccatggctgcgatcaaccgtgacgacgtcgcgcatctcgcgcggctcgctcacattgagatgagtgaccaagagctggacaggatggccggagaactcgccgtcatcgttgattcggtcaaatccgtcagtcaggccgccggagacgatgtcccggccacctcacaccccattccgctgagcaacgtgttccgcgaagacgttgtgggccacaccttcaccgcggaacaggcgctctccggggccccggattccgatgagaaccgtttcaaggtcccggcaatcctggatgaggcataacccatgactgaaaccaacgaactgatccgcctctccgcagcgaaactcgcggaaaagctggccgccggcgaagtcacctccgtcgaggtcacccaggcctacctggcccggatcgcggaggtcgacggcggtgaacgcggcgtcaacgcgttcctgcacgtcaatgccgaagaggcgctcgccgtcgccgccgaggtggacgccatccgcgccgccggcggcgccgaagccgaggccctgcatgtcctggccggcgtccccatcgccgtcaaggacctgatcgtcaccatcggccagcccaccaccgcgggctccaaaatccttgagggctggcacagcccgtacgacgccaccgtggtggagcgcctgcgcgccgcgaagatgcccatcctgggcaagaccaacctggacgagttcgccatgggctcctccactgagcactccgcctacggtcccacccgcaacccctgggacctggacaggatccccggcggttccggcggcggctccgcggcagccgtcgccgccttcgaggcacccctcgctctgggcacggacaccggcggctccatccgccagcccggcgccgtgacgggcaccgtgggcgtcaagcccacctacggaagcgtctcccggtacggcgccatcgccatggcgtcctcgctggaccagatcggccctgtgacgcggaccgtgatggactccgcgctcctgcaccaggtgatcggcgggcacgatccccgtgattccacctcgctcccggacccgctggccgacctcgtggccgcagcgaaaaccggcaacgttgacggcatgcggatcggcatcatcaaggaactgcacggcgagggctaccaggccggcgtcgaaaaccgcttcaatgagtcactggagctcctcaaggaagccggcgcggaaatcgttgaggtctcctgccccaacttccagtacgccctgggcgcctactacctgatcatgccctccgaggcctcctccaacctcgccaagttcgacggcgtccggtacggcctgcgcgtcctccccgaggaggggcccatgaccatcgaacgcgtcatgggtgccacccgcgccgccggcttcggcgacgaagtgaagcgccgcatcatcctgggcacctacgcgctgagcgccggctactacgacgcctactacggctcggcccagaaggtccgcaccctggtgcagcgcgactttgacgccgcgttcaccgtggcggacgtgctgatttcgcccaccgcccccaccacggccttccgcctcggcgaaaagctggacgatccgctggccatgtacctcaacgacgtcgccaccattccggccaacctggcaggtgtgccgggcctgtccctgcccggcggcctggcggacgaggacggcctccccgtgggcatccagctgctggccccggcccgcgaggacgcccgcctgtaccgcgtgggcgccgtcctggagtcgctgctcgaggccaagtggggcggaccgctgcttgcgcaggcgcccgagcttgccgccgccgcggccgggcccgtcgacacccttgttggaagccaggaggcaaagtaatgaacacagaggcaatcctgagcttcgaagaagccatggagaagtacgaccccgtcctgggattcgaggtccacgtggagctcaacaccaagaccaagatgttctcctccgcgcccaacgtcttcggcgacgagcccaacaccaacgtcaacgaggtggaccttggcatgccgggcgtcctgcccgtggtgaacaagaccgcggtggagtcctccatcaagatcggcctggcgctcaactgcaagatcgccgaaagctgccggtttgcccggaagaactacttctacccggacacccccaagaacttccagacctcccagtacgacgaacccatcgcgtacgacggctacctggacatcgagctctccgacggcaccgtgttccgggtggagatcgagcgcgcccacatggaggaggacgccggaaagctgacccacatgggcggtgccaccggccgcatccacggcgccgacttctccctggtggactacaaccgcgccggcgttcccctggtggaaatcgtcaccaagcccatcgagggggcaggctccagggcgccggagctggccaaggcgtacgttgcggcggtccgggagatcgtcaagaacctcggtgtgtccgacgcgaaaatggagcgtggcaacgtgcgctgcgacgccaacgtttcgctgcgcccgcacggccgtgaaaggttcggcatccggtccgaaaccaagaacgtgaactcgctgcgcgccgtcgaacacgccgtccgctacgagatccagcgccacgccgccgtcctggacgccggcaacccggtagtccaggagacccgccactggcacgaggacacccggaccaccacgtctggccggcccaagtccgacgccgacgactaccgctacttcccggaaccggacctggttcccgtggtggcctcgcgcgagtgggttgaggaactgcgcgccaccctgcccgagcccccggccgcccgccggaagcgcctgcaggctgactggggctactcggacctcgagttccgcgacgtggtgaacgccggcgtcatggacgagatcgaggaaaccattgcggccggggcctcggcctccgtggcccgcaagtggtggatgggcgagatcgtggggcgtgcgaagaacgccgacgtcgatcccggccagctcggagtccagcccgccaccatcgtggagctggcacgcatggtggaagagggcaagatcaacaacaagatggccacagaggttttggacggcgtccttgccggcgaaggcacccccgcggaaatcgtggagaagcgcggcctggccgtggtctccgacgacgggcccctgctcgaagccatagatgccgcgctggctgcccagcccggcgtcgcggacaagatccgcggcggcaaggtccaggccgtcggcgccatcgtgggcggagtcatgaaggccacccgcggccaggccgacgccgcccgcgtccgtgagctgatcctggagaagctgggcgtcaccgcctagcatctcctgcccaaccgggtagcagcagatgtcgttttgagcgctcataacgacacctgctgctacccggttttgtttaagtagtactcggatcttacggttcgcaggctactcgtgtgcggcagtacaaccccgtcctacactgaaccaccagggctccgctcacgggaaatgccctgccgttgctgtgggaggtatgggttatgtcggtaagggaaccgctgggattccgcaaggctgcgcttggtggagccgtggcactcgtcctgaccgggacaggggtggcgttcgcgacggccgcgaacgagactccgccgcctgcaccgtcgtcgtcatcgccgccgggaaagtcgggcaatgcccctggacagaacggtgcccccggccaggacaaagcgccgggacacaccaagcctgacagggcacagcgcccgcagcacctgcacagcgagagcgtggtcaaaaaggctgacgggacttttcaccgcgagttgacccagcgcgggaccgtggagtccgtcagtgacgcctccatcaccgtcaggagcgaggacggctactcgcaggcctacaccatcgacgctgacacgaaggtcacgcaggtgatggctccgccggcggatggcgcggcggccagggacgacggcggcaagcggctgaagccctcaggcggaaccattgcggacatttctgctggcgacgacgtccggatctccggagccaagactggcgacgccgtgacagcggagcggattgttgaaggtgccggcgacggtcctgggctcggactgggccgcggccacggcaaggggcataagtaggtagcgccaggtgtcgttttcaaagctcaaaacgacacttagcgctacctagttgggtcagccctgctccaacagtccggccatgatgccctgcagcgcctcgcacacgatggtcacggaccgccgcttcaggttttccggcctggccagcaggtcgatccggcgccgggtgctgattcccttgagcggccggagcacgatgtcgggattcagtaccggacccgcggtgtacctggggagcaaacccaccacgccgccggcggcaaccagggcggccaccgtggagtaatcgttgatccggtggacaatgttcagttcacggctggaaacggcggcgacggcggtcaatacatcggcgggggagtagccggcgtggctggtcacccaggcctcaccgccgacgtcgtccgctgtgaccgccgccttggcagcgagggggtgcccggcaggcaaagccacatccaggggttcgtgggcaagcgggatcactgtcacccgttcggctggccagcgcgggctgtggtccatccggtgggcgagcaccaggtcatagcgtgcggtgagggctgggaagtcctgctgggccacgtcctcgtccgagagttctatccgcggctgtccaggggcggcgaggatccgggcaagcggggcgaagactgcctgccccgcactgtggaatccgcagaggcttactttgccggcagcggaaccgtggtagttcccgatggcatctttggcgtctgccatggcgctgacgacggcggccccggcatcggccagcacctggccagcctcggtgagcaccaaattgcggccctccttgcgggtaagcgggacctcgatcttccgctgcagcagggcgagctgctgggagacagcagacggggtcaccatgagggtgtcggccactgccttgacgcttccgagggcgcccagttcgcgcaggatttcaagctggtgtatctccatcccagcagtctatgcattaggaaaagctacatcgtcgattgagtaaattgctgttgtgctaacgcttcttcctcgctgtaatgaggaaggcaggacctgccacgacagacaaagagtgaggaagccgatgaaggctttgtacaaggccggaccccaggccggcttcgaactggtggaccgccccgagccggtgccgggccctgctgatgtgaagatccgggtgatgaccaccggcatttgcggcaccgacctccacatccagtcctgggattcctgggcgcaggggatcattgaagctcccctcatcccgggccacgagttctacggcgaggttgtggaaaccggagaggacgtccgcgacgtcaaagtgggggacagggtgtccggagagggccatgtagtatgcgggatctgccggaactgccgcgccggcaggcggcagatgtgcatccataccgtcagcgtgggcgtgcagcgtgacggtgcgttcgcagagtacgtggtgatcccggagaccaacgtctgggtccaccacgatccctcggtcactccggagctgggtgccatcttcgaccccttcggcaatgccgtgcacaccgcgctgagcttcccgctggttggggaggatgtgctgatcaccggcgccggacccatcgggctgatggccatcgccgttgcccggcacgccggggcacgcaagatcgccatcaccgatgtctcgcgcccacgccttgagcttgcccgccagctgggggcagacattgccatcgacgtttccaccacccgcgtgcgcgatgcccagcgcgacctcggcatgcgtgagggcttcgacatcggtatggaaatgtccggccgtccgggagcgctgccggagatgatcgacaacatgaaccacggcggccggatcgccatgctcgggctgcccagccaggacatcatcatcgactggggcaaagtggtcacccacatgctcacgctcaagggcatctacggccgggaaatgtatgaaacctggtacgccatgagcgccatgctctcgtccaaccccgtgctgcacgccggaatttccgccgtcgtcactgacacgctccctgccggccagtgggaaaaaggcttcgaccttgcccgcagcggcgcaggtggcaaagttgtcctcgactggacccaactctaaggaacaccatgtacacctcgatcaaggaccagctgcgcaccgagctggacgatatccgcagcgcgggcctcttcaagaccgaacgcagcatcagttccccgcagtccagccacatcacggccggacagatcgggcagccgggcgcggacgtgctgaacttctgcgccaacaactaccttggcctggcggaccacccggacatcatccacgcggccaaggcggccatggacgagcgcggcttcggcatggccagcgtgcggttcatctgcggcacccaggacctgcacctggaactcgaatccagggtttcccgctttctgggcacggaggacaccatcctgttctccagctgcttcgatgccaacggcggggtctttgaatcgctcttcggcccggaggatgccatcatttccgatgccctgaaccatgcttccatcatcgacgggatccggctctgcaaggcacagcggtaccggtacgcgaaccaggacatggcggacctcgaggcgaagcttgtggaggccaaagatgcccgccgcaggatcgtggtcacggacggcgtcttctccatggacggataccttgcgccgctggaagccatctgcgacctcgccgagaagcacgacgcgctggtgatggtggacgactcccacgccgtcggcttcatgggcgccaccggggccggcacacccgaacacgcaggcgtgtcccaccgggtggacatctacaccggcacgttcgggaaggcgctgggcggagcgtcaggcggctacgtgtccggccgggccgaggtggtggccatgctccgccagaaggcccgcccctacctgttctcgaactcgcttgctccggccattgttgcggccaccatcaaagccctggacctggtggagaactcggcgggcctgcggcgtatgctcttcgagaacgccgccctgttccggcgccggatgaccgaggagggcttcgacctcctgcccggcgagcatgccattgtgccggtcatgttcggcgacgccgtcctcgccgcaaaggtcgctgaccggatgctgcagcacggtgtctttgtcacagccttcagcttcccggtggttccgcggggtgccgcgcggatccgggtgcagctttcggccgcgcactcagcggacgacgtcgaagcctgcgtgcgtgccttcgtcgccagccgtgccgaggcagcaggccaggaacactagcgctggaagccaagtctgcgaggatggagaaatggcagcacactacgatgtcctgattgtcggcggcggcattgccggcctgtcgctagcgtccgcgctggccggcaagtgcagcgtggcgctggtggaggcggagcaggaactggcataccacacctcgtcccgctcggcccggcagttcattcccagctacggcccgcccgtggtccgggaactgaccgtccggacccttgagctgctcgccgcgcgcgatgctcaactgcccgaacccatcctgacgccccgcagcttcatgctgatcggtgcggagggagaggtggccgcggaagccagcggactcatgcgttccattacccccgctgaggcgctggccctgtgcccggcgctggtccccggttcattcgaggccgcgggactggacgaggggtcctttggctgcaatgcgccgctgctgctggcagaccaccggcagcgcgctgaggctgccggggtggatatcattaccggcgccagggtgcacaccgctcaacggcttggttccggatggcaggtgggtgccggcaccgagggtttccaggccggtgtcctggtcaacgctgccggcgcctgggccgacgaacttgccgtgatcagcggcgtggaaaagctgggactccagccgtaccggcgcacggcggcgattgccgccgtcgaccatcccttgcctgagcacagccccatggtggcggcagcggacaattcgttctatttccggcgggacggggacgacgtgctcatttcgccctccgagtcggagcccagcggaccggaggatgcccggccgcggcccggtgacatcgagcggctggtggacagcttgaaccaggtaaccacgctggggatcacggaagtccgcagggcatggacggggctgcggactgaagcggccgacggcgttcccgtggcgggcttcgatgccgaggcccccggcttctactggctcgctgggcagggcggctacgggttccagacgtcctcggcgatggctgaactcgcggcagcccagattgtggcgggccagggcggtgcgggccagcccggtgcggccgccgcaaccggaaccgccggtccgggatcccggacagcgcaggcgctggcggccacccgctggtccgtgcggcgctgaagaatggccgtatgagtacgctgatcaccaatatcgccgagttgatgacgcaggacctggagcaccgggtcctgaaggacgccgcggtggtgatggagggtgagcggatttcatggatcggcgctgctgccgatgctccggccgccgatgacgccgtggacctgggcggccgcgccgtgctgcccggctgggtggactcccacacccacctgctgttcgcaggggaccggaccgccgagttcgaggcgcggatggcgggcgagccctatgcggccggaggcatcgcggtaaccatgaacgcgacccgcgccacgtcggattttgacctgacgcgcctggcgcttggccgtgttgacgaagccgtctcgcagggaaccacctaccttgagacgaaaaccggctacggcctggacgttgaacacgaaacccggagcgcacggattgcctccaccgtggcggaccaggtcacttttctgggggcgcacctggtccccgcgggacaggacccggaggaatataccagcctggtatgcggtccgatgctggctgccgtccggccctttgttcagtgggcagacgtcttttgtgaggaaggagccttcactgcggaacagtcccggcgggtcctgctggcctgccgcgacgccggactggggctccgcgtccacgggaaccagctaggcgaaggcccgggcgtgcagctcgcggcggagctcgaagccgccagtgtggaccacgtcaactacctcgccgcaagggacgttgatgcactggccggaacctggaccggctgggacgtcggcaccggtaccggcagccgcggcacggtggcgacctgcctgccggcctgcgacctttccacccgccagccgctggcccccgcccgtgcgctcctggatgccggggtccaggtagcgctcgcatccaactgcaacccgggcacgtcctacacgagctccatggcgttttgtgttgccactgccgtgctgcagatgcgcctcagcgtccatgaagctgtccgggcggccacgtacgggggagccctcgcgttgcacaaggacacagggaacgacgccgacggcgaacgggcggtggggtccatcgccgtcggccaccgcgcggatctgcatgtccttaatgctccctcggccacccatctcgcctaccggccggggatgcccttgacatacgctgtgtggcgggcaggaaagcgggcacggtagctttcggcttcatgtgacgttagatgatcgtttgaggcctgttatgatcagaaagcgtcatctgaggtggtggcttaagtacttggaggccttgcatgacccgcactgacagacttacggcaatcctggacctcctcgcacggaccggccaggtggaggtcgaagagattgtcagcaccctgaatgtgtccccagccaccgcccgtcgcgatctggacagcctggccaagcgccggctgctcacccggacccggggcggtgccaccaccggagcccttgcctacgacctgcctggccggtacaaccgtgacgatcacgctgaggccaaggaacagattgcccaggctgcttcagctctgatagctccaggcgcagtcatcggattgtgcggcgggaccaccagcaccgccctggcacagatcctggcaacccgcgaagaccttaacgcaccttccaaccagcccaccctgacagtggtcacgaacgccatcaacatcgcttcgcagctggcggtccggcccagcatcaaggttatggtcacgggcggcatcctcaatccacggtcctatgagctggtgggtccctatacggacatcatcatgcagaaggtagtgctggacatcgccttcatcggcgtgaacggcattgatcccgaagtggggccaaccaatacgggtgagggtgaggcctccgtcaacgcgctcctcgccagcagggcgcggatatcctatgtcctggcggactcgtccaaggtcggagtgcgcgcctttgccaccatggacgggtacaacttcacccggctgatcacggattccggaatctcggcgaaggacaaggccgccttcgaagccaacggcacggaagtgatcgtcgccgccggctgagcggcaccggccctgcggttgcggctgagcagcacttgccttgcggttcaggcccgccccgcagttccggctccgcagctctggccctgcggttccttcgtggtaatcgggccggtgcctgcgtgacactggaggacaatcagcccggatccagaaactgaaggcaagatgggagcatgctggttccctcccgccgccgcctgcggtttgaagtctggattgtcctgggcctctccctgggccagtctgctgtgtactccgtagtgcagctcctggacaagatgacccgggcaccgctggcggaaggcacctccacactcaaccgctcgcagagcacccgcgagtatttcgaccttacgtaccagctgctggacattatgttcgcgttggttccggtgctgctggtgctctatttccttaccgaccagcggcaggccgcgtccggcgacggcagcagcccggggtccgctttccacaagcttggcttcaactttgcccgccccggccgggacctgctccagggcctggggctggcagcactgatcggcatcccctccctgggcctttacgccgcaggcagggcactggggattacgacggccatcattcccagtgcactggacgcatattggtggacggtgccggtgctgatcctgtccgcgatgcgccatgccgtggtggaggaggtcatcgtagtcggctacctgatgaaccgttttggaaagttcggctggagcattccgctgtcaatcatggctagttcgctgcttcgcggcacctaccacttgtaccagggcttcggcccctttatcggcaacgtggtgatgggcatcgtcttcgcctggctgtacacccggactcggcgtgtgatgccgcttgtcatagcccactcgctgctcgacatcgtggccttcgtgggcttcagcctgttcggcaaagctgtagggctgggctaagccttggcgacaacgtcaggcacatttgtcagcacgacggcggacgggaggtggcagctacgtcagtgccgggtcccagcccgttatcaggtcccagtcattcagggggtattggggcaggacgggcggcagggcgtagaagtcgtcccatagggggtcgtccactggtatgtcgtcaaggtctatgaggttgtcatcttcaggttcctccggtggaggttccgggtatgggaggtctccggctgggctggcctgggcagcgggcatcggcggataaggcagcacgccggggacttgcccgttgtgatgctcctccaattccagccgcggaggcagggccaacatgacagtttccggcaagtggggtggttcccagtcctggtattcgctcttgtagtggcggccggacggtgagatccagccgggtggttcgttctgcatggcctgggttggtgtccacccgctgctgtgtctgagtttgtggtgcttcgggcagggttgtccgaggttgctgatcccggtggttccgccgttctgccaggcgaggaggtggtctgcctcgttatccaacgacgggttgttgcagccggggaaggggcatgtgccgtcgcgcagccggagccagttccgcatggctttggtgacgcggtagctggtgcggccgatttccagcggtgccccgtcccgcggatcaacgaggacccggtggaaggaatcggcaccgttcgcgaccaggaaccgtgccatggacggcgggatgggcccgtacccgtccaatagggctggttcatccgtcaggcccgtgagcgcgaataccggcaccatgacgagcacctgcgcccggaccgccgacgacagcccggcaagatccatccctgcacccgccccgtcgctggtacccaacccatcaccgtcgccgttgccaacccagtcgctgttgccggcatggaggctggaaccgttgccatgaccgccactgttaccgcggctggtgccgctggtgaggattgcttcggcgaattggtcggcccggagttgggtgagggtgcggggttcgtggggtccttgtgcggcccgggcgagggcgttgaggcggttccagcctgccatggcgtggtcggcggggaggtaggcggagagccaggccatgccgtcctggtccggcctgtactcgacccgccggtcggctacgcccttggcgtggcgcttctcgatcgattcggggtggtggcgttcgcgccaggtgcgggccttggccttgaaccggtacgccggcatctccccggtcgttgcagctccggccggtctgggtgtgtccgggtctaggcagtgcttttccagggccgctgccccggcccggtcaaggccgacggtctcgtccgccatgccccgggcgtgctgccacgagagtaaaccggcctgcagggcggaaagtgtcagtggcaaggtcttgtccagggcgtgggacgcggccaggaacgcgcttgcggcccgcggtccgatggccagcacgcacccgatctccgcggccacagccattttctgcgcctgcaccggcatcccgggaggggccagggcctgggcggtgtccgcgtacttcatggcagcgcgggccttcaggcctgcgagcccggcttctgcctcttggcgccggcgaggatatccaggtttccatcggccagcccggccaacggatcagcagccgaaaacggctccgcaccacacccgtccacctccgcgttgagcacagcaagggcggccttgatgtccgcaaacgccttctctaccgcttccctgcccatgtactaatcatggcaagggggtctgacaatgacgccggaagaggctggcgcgcgggaacccggcaaaccagaactgctgggacaagaattcggccgccatcggcgggtgacgccattgtcacctgctgaaggcggccgaagattatgccggcagtctgaagtgcctgcccgagccggtgccgggcagggaacgcgcccaagccggcaggtgagaatcagatagtaactgccccgttggcggtctcgaatgtcaccgaaaggatcccgggggttccatgcggtgccacccactccacggcgacgtcttccagcggcttctccaccggttcacccagccactcggtcacccgggctgccgagccggcgatggtgaggcagctcatcttgacgttgctctcgtaggcgttggacgggtgcagggacgggtcaccctcccacttgagcatgtacgggacctgggggtcggcgatcaagccgaggatgccgatctgcttccacacgagttcgcggccgtcagggaatttgcggttgccgttgactgaggagcgtcccaggcgttcctcgaagggggccagatcgtccacttcgacgcaccagcccatccatccgccaccggcggcggagcgtgcccgcaccgcctgaccgaaaggggccttgtccgaagccgggtggtccaggacctcaacgacctcaaggtacttgtgccccgagagcgggatgatcatattccgggttccgaaccgcgggtgtactccacccttcactgcctcaacgccgagggcagaggaaatacgttcggtggtggcagccaggccatcgtgttcacaggcgtaagagacgtgatccatgcgcatggcaacatcttggcactttgtgatcgggctctcagctaagggtagccttactgggatcttaagcggcagccgtgctggaatttccgcccacaacgagcgcagggtgcgcctggtatcaaccct

SEQ ID NO: 30 - DNA, 78706 bp, Arthrobacter sp. OY3WO11
gagttgccggtagggagcctgggacgaaaaagccccagctgccgggtaggtcggctcgatgtacagaagccggcttgccgttccgctggcggtccccgtgactcttccggtggcggcagcggaaatgatcttttcagccacctgggcaggggtcagtccgggggttttcgacagaaggagtgctgcggcgccagccacatggggagtagccatggatgttccgctaagtgaagccgtggccgtcgtcgaagtgtgccaggtggagctgatgccggcgcccggcgcgtagaggtccacgcatttgccgaagttcgaaaaggaggcctgacgatccgaagaatcgctggccgccactgtgacggccgccggggtgcgggccggggaactcatgcatgcgtctgcggcggaatttcctgccgccacgatggcaggcaggccatcgttaataatgccctggactgctgcgtcgagcacgctgcttgtgggtccgccgatactgaggttcactacggccggagtgccagggcgatgatgaccggcaacccagtcgagccctgcgatgatgtccgaatagaggccggaaccatcacacgcgagtgccctcaccggaataagggtggcggatttggccacaccgtggacggcgccgccgatgactcctgccacgtgtgtgccatgaccattgcagtcgcttgatcccaagccgtcagcctttgctgtccagccagagctgacccggccgccgaaatcggcatgtgaaccgaggattccggtgtccacaacgtatacgctgacaccctggccggaggcggcaggtgtgtaagagccggagagcggcagtgcctgttgatcgatccggtcgagtccccatggggcgttgcgctgcgtctcggataccgtgacggtgtggtccggctccactgctgcggcccggccggagcggagcagcgcggcagcctgcgccgcgctggcctcaatggcagcgcccttcacggccttcgtaaacgttcgggtgacaccaattccctgggcgcggagggccgccgcctctgccgggacgtccttgcccggggcgaattgaacaaggtagcggccaccgtcgcttgccggtgaggcagcaggagcggcgtacgctgccggcgccggccacgggccggctgccaccgcgcttgagcagagggcgacggcggagagcaggacggcgcgacgtgccaggctaaagaactggggcaacggaatgtgttcctttggtgtctaagaagaactgtcgggtgacgatttcccggctcaaatctaacggaggaccggtggcaaacggctaaacttcgcccaatactgcgcatctcctgtggaaccttgcgaaatcaacatccggctgctcttaactcgccccgatcccgggggatccgcccttcagcagggacgggaagtcacaaccggtcacactcgtggcggcgggcacccgctgttcctacactgggctcaggttatgagtgccagcgccaagccccggcttgctggccggcaaccctccttccgcggtggggtgccccgggtgaggacctggctgcccggcaatggccgggtggcaagcgcggcccgcggtgcttcgagcatgccgggcccagtcaaaggagcctttatgtccaacggatggtcattcgaaacccgccagatccacgcagggcaggaaccggacagtgccacgggcgcccgggcactccctatctaccagacgacgtccttcgtgttccccagcgccgagagcgctgccaaccgcttcgcccttgctgaactggcacccatctatacccgcatcggcaaccccacccaggaagccgtggaacagcggatcgccagccttgaaggcgggctgggggcactgctgctgagttcaggccaggccgccgagaccttcgccgtcctcaacattgcggaggccggcgaccatatcgttgccagccccagcctctacggcggaacgtacaacctctttgcccacaccctgaagaagttcggcatttcggtgaccttcgtagcggacccggacaacctggagcagtggcgcactgcagtgcagcccaacaccaagctgttcttcggcgaagtggtttccaatccccggcaggatgtcctggacatcgaaggcatctcccaggtggcacatgatgccggtgtgcccctcattgtggacaacaccctctccaccccgtacctgatccggccgctggaatggggagcggacatcgttgtccattcggcaaccaagtacctgggcggccacggctccgcgattgccggcgtgatcgtggactctggcaacttcgacttcggcaaggacccggcgaagttcccgggcttcaacacgccggaccccacctacaacgggctggtgtacgccagggacctcggcaaggacggtgcgctgggcgccaacctgtcctacatcctcaaagcccgcgtccagctgctccgggacctgggctccgccgtctccccgttcaacgcattcctgatcgcccagggcctggaaacgttgagcctgcgcgtggaacggcacgtagccaacgcactggacgtggcgcagtggctggaagcgcgtgacgacgtcgaatccgtcgcctacgcgggtctgccctccagcccgtggtacgagcggggccacaaatatggccccaagggcacgggcgcgattgtgtccttcaacctggctggcggggccgaggccggcaagcgcttcgtggacgggctggagctgcactcccatgtggcaaacattggtgacgtccgttcccttgtcatccatccggcgtcgaccacccacagccagctttccccggagcagcaggctgttgccggcgtaacgcccggcctggtccggttgtcggttggaatcgaacacatcgatgacatcctggcggacctggaagcgggcttccgggcagcgaaggacgctgccggagcctagacggacgtaaagaacccaacacggcggtaagccggggaagtcacaaccagtcacactcttggcggcaggcgggggctgtttcgtacactcgaaccaggtcatgagtgccagtgacagccccggcttgctggccggcaaccctccttccgcggtggggtgccccgggtgaagacctggcctgccggtcattcgacggcgggcaagcgcgtaagaagaggtcttgccatgacggttaccgtcgcccgtaccaccgtttccgaacacggaatagtccgctatgcctccattgggggactggaacttgaagccggcggctacctgccagacgtcacgctggcctatgaaacctggggcacgctcaatgcggacgccagcaatgcagtcctgatcgaacacgcactgaccggcagcacccacgtgacccgtggcgacaccgacgaaccgggatggtgggagcagctggccgggccgggcgcgccggtggacacggaccgtttctttgtggtttccattaacattgtgggcggctgctacgggtccaccgggccgtcgtcgccggcaccggacggggccccctggggatcccggtttcccctggtcacgctgcgggacagcactggggcggaggcccggctggcggaccagctggggatcaggagctggtttgcggtgctgggcggttccatgggcggagcccgcgcacttgagtgggccatcaccttcccggaacgggtgcagcgctgcggggtgatctccattggcgccgcaagcacggccgagcagatcgccttcgcccaggcgcagaccctggccatccgccaggatgcgaatttcaacggcggcgactactacggcggcccgttcccggagaacggcctggccctggcccggcggatcgcgcacattacctaccgctccgcggcggagctggaaggcaggttcggccgcgaaccccaggctccggagtcacccctgcagggtggcgtcctcgccgcccgcggacgctaccaggtggaaagctacctggaccaccaggggaacaagctggtccggcggtttgatgccaacagttacatcgccatcaccgaggccctcatgagccacgacatctgccggggccgggggccgcttcccgagaccctggcgcggtcaggtgcgcgtttctttgtggcagccgttgattctgaccggctctacttcccggcccagtcccgggaacttgccgcggccctgccgggagaagtggacgtccacgtcattgaggcgccgataggccacgacgggttcctgacggaaataggccagctgggtcatcagctccgggcgcacctctcggcataagaacgcccctaacaggcaagcaaatgtgcatttatgcagatagcctctgcatgattcgccgttgagcttggcgttcaggcggaccatactcgttgggacccggcggttcgtggcccaaatcacacgtatccgccacagactgtcccagtggtgtcgaagaagacgccgaaggagttcaccaatgagtacggaaaagtccgccgccgcacggcggcccgaggaaaccgacgtcaagtcctcaggcctgaagaaagtcgtcacggcctccatggccggcaccgtggttgagtggtacgagttcttcctctacgcctccgccgccacgctggtgttcggcaagctgttcttccccaactccggaaccgagctggacggcatcatcgcagcgttcgtcacctacgctgtcggcttcgttgcccgccccatcggcggcatcgtcttcggccacttcggcgacaagttcggccgcaagcagctgctgcagctgagcatcgtcctggtgggtgttgccaccttcctcatgggctgcctgccgacctttgcgcagatcggctactgggcacccgcgctgctggtgttcctgcgcttcgtccagggcttcgcggtaggcggcgaatggggcggcgccgtgctcctggtcgccgagcacagccccaacaagtcccgcggcttctggtccagctggccgcagtccgccgtccctatgggcaacctgctcgccactgccgtgctgttcaccctgtcctccaccctttccccggaagccttcctcggctggggctggcgcgtagccttctggctctccgcagtgatcgtcatcatcggctactacatccgcaccaaggtccaggacgcgccgatcttcctcgaggcccgcaaggaagtcactgtcgagaacaagggctacggtgttgccgaagtcttccgccggtacccgcgcggtgtgttcaccgccatgggcctgcgcttcgcggagaatatcctctactaccttgtggtcacgttctccatcacctacctgaaggtggttgtgcagacggacacctcccgcatcctgctcctcctgctggtggcacacttcatccacttctgcgcagttccgctggtgggcaagatgtccgattccctgggacgccgcccggtgtacatggcaggtgctgtccttgccggaacctggggcttcttcgcgttccccatgatggacaccggcaacgacctcatcatcctggccgccatcaccatcggcctgctgttccacgcgctcatgtacgccggccagccgtccatcatggcggaaatgttccccacccgcatgcggtactcgggcgtttccctcggctaccaggtgacctccatcgtggccggctcgctggcacccatcatcgccagctcgctgctgggcagcttcggctcgtccgttccggtggcgttctacctcctgggtgcctgcgtggtaaccgcgatctcggtgttcttcctcaaggaaacccgcggcatctcgcttcacgatgtcgatgccgccgatgcccagggaaccgccgacctcctggccgcggccaggaaatagccgccaagaagtagtcggcacggcaccacggacacgtcagctgcccggacctgcatcaggcgcaggtccgggcagctgcctgtccccaacataaagtcaggaacaccatgcgagcagcagtcctctattccaccgttccccctggcaccagctatgccgaagcgcagcccctggtggtccaggagctcagccgtcccgaaccccgcgccggcgaactgggtgtcactgtcacctactccagcctgtgccactcagacctgtcagtcgtgggcggatcccgcgtcaggccgcttcccatggcgctggggcacgaggccgtagggcgggtggctgcagtgggtgagggcgtcaccgacgtttcagtgggggaccacgtggtcctcgttttcgtccccagttgcggttcctgccgtgcctgcctggcggggaggcccgcgctctgccaccgggctgccgaggtcaatggctccggtgaccttttgcacggcgaggcgctgctgcgcacgcctgcgggtgatcggatcaaccaccacctgggggtttcggcattcgcggattacgcggtggtggcccgcgaatcagtggtggtgatcgacgacgacgtccccgacacggtcgcggcgatgttcggttgcgccgtgctcactggaatgggagccgtcctcaacacggccgccatccaggagggccagtccatagccgtcttcggactcggcgcggtggggctttctgccgtcatggccgccacgctcgccggtgcctccgccgtcatagccattgatcccaacacagccaagcacggacttgccatcaagtgtggggcaaccgcggtggggactccagaggacgccgcccggctcatcgcggaagccgccggtgacggtgtggacatcgcggtcgaggccgtgggctcggcccgggtgattgcgtcctgtctcgggcacgtgacgaggggtggcgcggtggtctccgtcggcctgccgcaccccaccgcagagctgactgtgcctgcgctgcagttcgccggcgcgggcaagcggctgctgggctcatacatgggcgacgccgtaccggaccgggacatacctctctacctggggtactggcgcgagggccggctacctgttgagctgctgcacaccgacaccaggcccctggcggagatcaacgaaggcctcgatgcgctcgccgcagggcaagtggtgaggcggcttttccaggcgtgaaaatggcacggcggccgctacgccggcgaacgtccacgctgccggcagctcaggctgccaacagatcctggcgttccgccacctcatgctgcagcgcaccgatcacggcctggacccgggcggaccgcagcgactccgggcgggccactgcccagatggggacctggcgctggaaggcttcagggagcactggaacgaactccgggttgcgcgccaccatgaagttcggcagcagcccgatcccggcactccggcgcaccgcctccacctgggcaaaaatgctcgtggcctggaagctggacttcggcatcggcagctgcgaggacctgtgccccagctcggccacctgaagtgccgactcaacgtaagagacgaagccgtgctgccccacgccgtcgggtgtttccggcaagccgtgctccgccgcgtaggcagggctggcgtaaagccggaggaagtaattggtcaggaagatggcctgcgcgttgctcacgtcggtgcggcccaccaccacctcaaggtccacgcccgagcggttctggctgaccctgcgcgtggcgctcaacatctccacattcagcagtgggtgccgctgctgcagtcggaccagcgcgggcgtcacgaattcggcgccgaaaccgtccgaggtgctgatgcgcaccatgccggacagggcgtcccggtcctggcttgtggcagcggccagtgaaccgagtgtttcctcgatcctttccgccgcggcgacggccgaagctccgagctccgtcagttcccacccgtgcgggctgcgctccagggtccggccgcccagctgcctgtcgagggccaggatccggcgcgaaatggtggtgtgcgttgtgcccagcgtttcggcgaccgcgttgaaacgccccagcctggccactgtcagcaggatcagcaggtcgtccggactcggtagctgcgccatccctacctcccaggcatgtgcatcagtgcacatgccatctgtgaatttttaccttgattgcactttaccgggatgtgatggtggacacggaccttacggccgccggccggagacaaagcaaaggagcttatgccatggcagtaattggttggataggtttggggaacatgggcgggtccatgtcggcgaacctcgcaaaggccgggcatgacgtacgggggttcgacctcaacccggcagccctggccgccgcggaggccggtggggtaaagccggcggggagcattgccgaggccgttgcgggtgcagatgccgtgttcaccatgcttccgaaaggcgagcacgccaaggcggtctacctgggcggggacggggtactggcgcacgccgctacaaacaccctcctcatcgattcctccaccatcgacatcgcagccgcgaaggaactgcacgacgccgccgctgccgccggcttccgcttcgtcgacgccccggtttcgggcgggatgagcggcgccaaggctggaacgctgacgttcatggtgggcggcgaaccgggcgccgtggccgacgccggccgcttcatcgagccgatggccgccaacgtcatccccaccggcggacccaccactgggcaggcggccaagatctgcaacaacctcatgctcctgataaacctggcgtccacggcggagggtgccgtgctggcggacaagctgggcctggacaagaaggtgttctgggacatcgcctcggtttcctccggagacagctgggccctgcggacctggtatcccgtaccgggtgtcgttcccaccgccgcgtcaaacaacgactttgaaccgacgttcacggcagagctggcgaacaaggacatcggactggccatcagcgctgccgaggacacgggaacgccgctcgaaatcggcaggcatgtgcagcagctgtaccagcgcctcattgactcaggtaacccgggcaaggactgctccatgatcatcaagcttgccgacggctcgctcgatgcagcgaagtagctgcctccgcgagcacaccttccacgccacagccatctgaacgccccagaaagagatcttcgtgcaaaccattccgcattacatcaacggcagccgcgtcaccgatgccgagcgcttcggccccgtcttcaatcccgccaccggcgagcaggaaaagcaggtggcgctggcctccgcggccagggtggaggaagccattgccgcagccaaagccgcgctgccggcctggcgggcaacgagcctggccaagcggaccaacatctttttccgtgtccgcgaaatcctgaacgagcgcaagtccgagctcgccgccatcctgaccagcgagcacggcaaagtgctctccgatgccgaaggggagatctcccgcgggctggagaacatcgagttcgccaccgggctgtcccacatgcttaagggagaacgctccgagcaggtgtccagcggtgtggatgtccactccgtccggcagcccgtgggcgttgtggcctgcattacgccattcaacttcccggccatggtgccgctctggatgatcggaagcgccctggcatgcggcaacacggtgctactgaaacccagcgaaaaggatccctcctctgccgtattcatcgcagaggtcttcgcggaggccggactccccgccggtgtgctgaacgtggtgcagggcgacaaggaagccgtagacacccttctcgaacaccaggatgtcaaagcagtcagcttcgttggctcaacgcccatcgcacaatcgatctacaagcgggcagccgaccacggcaaacgggtccaggcccttggcggcgccaagaaccacatggtggtcctgcctgatgccgacctggacatggcagccgacgccgccatctccgccgcctacggctccgctggtgagcgctgcatggcggtgagcgtgctcgtcgccgtcggcaacatcgccgatgacctcgtagctgccatcaagagccggatgggcaccctgaagatcggccccggcacggacccggcgtcccagatgggtccgctgatcaccgcggaacaccgcgcgaaggttgcctcctacgtagccggcgccgaaagcgagggtggcacggttgtggtggacggccggtcacagcagttcgattccaacgggttcttcatcggcgtcagcctggtggaccacgtcaagcccggcatgaaggtctacgacgacgagatctttggccccgtcctgtccgtggtccgggtggacagctacagtgacgccgtccgcctggtcaacgacaacgagttcggcaacggggttgccattttcacccgcgacggcggcgccgcgcggcagttcgagttcgacgtggaggccgggatggtgggcgtcaatgtgcccattccggtgccggtaggcaccttctccttcggcggctggaagaactccctgttcggtgacacccacatgtacggaccggacagcatccggttctacacccgcggcaaggtagtgaccacccggtggccggacccggcaacatcggtcattgaccttggcttcccgcaggtcgactgagccagcgggtggactgaacggccggacgcccgttgtgccctagccgttcatgatctcgctgcggcggctcatgtactcctcgacggacagctcaccgttgctgtactgctggtccagttccgcgagcttgcgcgcccggaacccctggggggccgacggcggcgggggagtggcgggggcagcgggctgctgcggggcttcttcgcgccggttctgcccgtacggctgctgtccgtaaggctgctgcccgtacggcgggagctgctggtccgtgggcggcaccggcgggacaggctggattgggggcagtggctggctgggcgggagcggcgccggctgcccgatctggcggaagccgcccgcgaggtagtcctgctgggtaaagccgtcccggggctgcttgctttgcggaccgttggagccaaagtgccccggcccggggaactgcccggaacccgggaactggtccgggtaccgtcccgagaaggtttgctcctggttccggcgggccacagacttccggtacatccgcatggccatcggaatcacgaatgacaggatgatgatccagaaaaacaggttgctcacggtgctaagcctctcgtgtgtgtccctccagcttaaccccggggcgtaaaccccgcggttagttccagctgccggcggcctgccccagcggaccctcgccggatcccagcggaacgcccggaccaaagacgggacccggcgtcggccgcttcgccgtgatgccgtcccctgacgactggttgcgcagccggcgcagcacccatggcacaaagtactggcgggcccataccaggtcgccggaacgggcctcccgccagctccggggcgggaacggcttgggctggaggggctccagggtgtgctccacgttcagcgaatccagcaccatggcggcaatggtgtggtggcccaggggcgagaagtgaagccggtcctcgtcccacatctgggggtcgctgagctggcggagggaccacatgtccgcaatgacggcgtcgtgccgggtagcgacggtccgcaggttctcgttgtagatggcaaccttgctgcggatcctgccgagcacggatgtaccggtgtccgggccgttgaacagcaccaccgtggcgccgcccatggtgaggatctgaaccacggaatcgagcttcgcggcgaggacgtcgggatcccctcccctccgcaacagatcgttgccgcccgcggaaagggtgaccaggtcgggcttcagcgcgaggcacggggcgagctgctggtccacgatctgctgcagcagccggccgcggacggcaaggttggcataggcgaagtccggctgaatccggcccagttcctcggcaacgcggtccgcccagccgcggtacccgcccgggcttgaaggctcgggatccccgatgccctccgtgaaggagtcacccatggccacataccgggtccacgggtgggagccggcggtcatggatggggtctcgatggcgcttgtgtcactcacggtcctatcctgcctttcgcttccctggctacgccaacgtaggtagttacctgtgggtaactggtatgaatggaaaccatgactgacgccgaagtatttcctgcccctgttgtcctgtggtcccatcctgaggaccagcgtgatggcaagcccctgctggtgctcctgcacggctacggcgcgaacgaacaggacctgctgagcctggccgacctgctgcccggcggctttgccgtcgcgtccgtccgcgcccccatcgccatgggcccgggcttcacctggttcccgctcacggcgtccatcgactactcgctggaccgtgtcaaggaagcatcggcctacgtgctcgagtggatcgacgccatcagggtggggcacccatccgtgtcactgctcggcttctccatgggcatggccatggccaccacgctcctgcgccagcggcccaccgacttcgctgccgtcgtcggactctcaggcttcgttgtggacgccggcgacgatcccagcttcaaggactccgagctggacggtaccgtgcccatgttctggggccgcgaccagcaggaccccgtgatcaccccggacaagatcgacttcaccatggcctgggtgcgccggaacgtcaagctcaccaaggtcctctacacgggcatgtggcacgggatcaaccagcaggagatcgggcacgtgggcgagttcctcacgcatgaggtcctgaggaaatagaacgtacgacggcgggcggcggcttgggcggccaggccggcgcgtgaggccggcctgccttccctgcggcggcggtcaggccaccggcgcgacgaccttcacggtctggccgttcaccgtcacggtgtcgccattgtgcagctggcggccgcggcggtcgtcgatctccccgttgaccttgacaagcccgttcttgatgagctctgccgcttccaccccgtcctccaccaggttggcgagcttcaggagctggcccaggcggatcatgctgtcgcggatggtgatctcttcaacattgctcatagatgcaatgatgcctgacgtaaggtggattcaatgacccacagcccccgcctgccgctgttcgcaggccttccactcgcggtgggcgcgggcctcgccattcccgtccagggccgcattaacggcgccctcggaacccgcctcaatgacggcatcgccgccgcggtggtgagtttcagcacagggctggtggtgatgatccttatctcgctggtcctgccgcgcggccgggccgggctggcgcggatcctgccggcggtccgcagcagggcttttccgcgggtgtatgtccttgccggcggcatcggtgcgctgttcgtcttcgcgcagtccttcactgtgggcatcctcggcgtcgccctcttcaccgtcgcaactgtcaccggccagaccgtcagcggcctgctggtggacaagctcggtattggaccggccggccggaagcaagtcacggccatccgcgtcatcgggtgcctcctgaccatcgccgccgtcgcctgggctgtgtcgccccggttcacggcatcgtcagccgtggcctcagacggcggcgcagggccaggcggccccgcggcgctcctcgttccactcctcctgccggtggcggcagggttcctgatgagcttccagcaggccatgaacggaacagctaccgtccactacggcacacccatcgcggccaccctggtcaacttcgtggccggctccaccgtgctgtggatcgcgtacgccatcaaagtctcggtggccggatggggcaacccgctgccgggggagtggtggtactacgtgggcggtcccatgggctgcgtcttcatcggcctgggcgcgctgctggtccggagcctgggcgtgctggtcaccgggctgggtatgatcgccgggcagctgctcggctcgcttgccctcgacgtggtactgccggcaccgggaacaatcgtggcgccggccactgtactgggcaccatccttaccctggccgccatcatcctggccaccctgccctggccgcggggcgccctgcgcagataacatccgggcaggtagcggccggtaggctggtacacgcatctttttcgcatttccttcatccgccccgctgtgcagccagaggtatcccgccgctggcttcgccggggccagaaaccgcggaccgcacccagcggccctgtagaaattggagttacccccatggcagcaaaatccgtactcgaccaggtcatctccctctccaagcgcaggggattcgtgttccaggccggtgagatctacggaggttcgcgttctgcctgggactacgggcccctcggcgcggaactgaaggaaaacatcaagcgccaatggtggcagtccatggttcgcggccgcgaggacgtggtgggcctggattcctccgtcatcctgccccgccaggtctgggaagcctccggccacgtggaggtcttctccgatccgctggtggagtgcctctcctgccacaagcgctaccgcgcggaccacctcgaggaagagtacgaggaaaagaagggccgccccgccgagaacggcctcaaggacatcgcctgcgccaactgcggcacccggggcgaatgggccgagccgcaggaattctccggcctgctcaagacctacctgggtcccgttgccagcgaagagggcctgcactacctgcgccccgaaacggcacagggcatctttgtgaacttcaacaacgtgctcaccacctcccggaagaagccgccgttcggcatcggccagatcggcaagtccttccgcaacgagatcaccccgggcaacttcatcttccgcacccgcgagttcgagcagatggaaatggagttcttcgtcgagcccggcacggatgaggaatggcaccagtactggatgaaggagcgcatggcctggtacaccggcctgggcatccgcgaggaaaacctgcgcttcttcgagcacccgcaggaaaagctgagccactactccaagggcaccacggacatcgagtaccgcttcggcttccagggttccgagtggggcgagctggagggcatcgccaaccgtaccgactttgacctctccacccacgccaaggcctccggcacggacctgagctacttcaaccaggccaccaacgagcgctacaccccgtacgtgatcgagcctgccgcgggcctgacccgctccttcatggcgttcctggtggacgcctacaccgaggacgaggcccccaacgccaagggcggcgtggacgtccgcactgtcctgaagctggatccgcggctggcgccggtcaaggccgccgtcctgccgctgagccgcaacgaggacctgtccccgaaggcgaaggatctcggcgcccagctgcgcaagaactggaacatcgacttcgatgacgccggcgccatcggacgccgctaccgccgccaggacgagatcggcaccccgttctgcatcaccgtggacttcgacaccctcgaggaccaggccgtgaccatccgcgagcgggacaccatgagccaggaacgcgtctccctggacaaggtggaaggctacctggccgcacgcctgatcggcgcctgagcatggccatcgaataccgcgaatggcgggaaggtgacgatctggcgctgctggaaatctggggcgacccggagacccaccaggcccgccagttccgtgccgcgctggcggtttcctccgccgggaccaacggcatgccgtggcggcgctgcattgtggccgaggacgtgatcgacggcgtcgggattccggttgccgccggcgtcgtttacgaggcttccctgcatcccgagcggctctggacgtacatcgaggtggcgcgggaccaccggcgcgccggcatcggtgccacgctcctggcgatgctgcgccgtgaagctgaacactcgccgtcgggcgttaccaagctccgcgccaaagtggagccgggcaccccgggtgccgccttcgcggaggccttcgagctggcacccatccagcgttcccggctggtggtcattgaaccgggggccctgcggctgccggtgttcccggccaaggacgacggcggcgggccggcaaacgacgagaacgcgggctcagacgtcgtgatggacctggccacgggctccgtggaactcaccgacgttgtgggcaggtattacacctccatccacggctgggactcgccgggcgtactgtcggtgggccaggtgcagaagctcttcctggacgacctcaccggcgcccacggcgcaatcgtgctgagggcccagcctgaatcggctttcggggcaggcgttgtacccagtaagaaaggccggatccgggccttcgccgtgagctacgcggcgccggccaatccggacgcggcaccaggccaggaagataccggggcggaaacgcccacggacgtcttcgtcggccacgagcccgccctcgcggcggacgacgccgcggaagccgtgcgcgacatgctctcgctgatcgcgtaccagcacccggtcatgctggaactggacgattccatgactgccctccgcgccgccgtcgaacccctgctcgagaacggcaaggcgcggctggcaggcggggaaaccctcgtcgtctcggactagcccccccaaccccaactaggtagcgctaggtgtcgttttgaagcctcataacgacacttagcgctacccagttgggaagctcgggccgaatccgggggaccgggcttacagggtcacctggacggctgattccggcagcagcctggtgtaatccgcaggtagggggagctcagtcccgatgctgtcggagaaggctttcatcacaaagccggtggtcagcgtctgccacaccccgatcttgcggagcatgaagtggccggcacccttgagggcaacgtactgcatgctggctgcctcggcagaggcacgccgggcgaacagcagggacgcagaggcgctggtccacctgtccgtggtcccgtgcacaataagcaccttgcggttggccacgccggacgtgggagttgcggggttgagccagggggcaagggcgacgacggcctccacgcctgggtggtccgcggcgatcacagcggtgagcccgcccatggaatggcctaccacgaacacgggcacgtccgggtgctgctcccggatccgggcgagtgcccagcgggcgtcctgcagcggagacatgtcaggaccattccagccgcgaacgctgttgcggagcgaccacacggccagcccgtgcttccgcccggcgcggtgcagatgccaggcgaagggcaccatccttgccggactcaggtgcctggcctccaccggctcacggctttgggatttgcccccgtgcaggaccagggcgacgccccgcgtgggccctgacgaattccggacgctgagcactgcctgccgcgcagcgccgggtgcttcggaagtgcgcgcgccgccgtttttctcagtattgctgttggccatacctggtacctccgagtccccgatgatccgtttatcaaccctacggtgccggacgtagagttcaatgtatgaggttttacagctgatggggtccggtcactcccacgcttccacaggtcattcggagccaacgccggaggcgatggccgcccggcggaaggcaaaccgcatcctcgcggcagtgctgattccgctgacgctgctcacactcgcagggatggcgatgctgtggccctcgggcagcaaggagggcatctccctggccaacccctactccgccgctcccggtgtcaccttcgacaccggcgccatccagagcgtggtgacggaaaactgcatgcagggtattgcccaacagggccagggtgaccaggcccaagcccagcagggccagcagagccaacagggatcagactgcacttttgccttcacggaaccggacaagggcggaagcccggtcaaggtggtgatcaacccggacgtcgcgaagtcgcacggggtgaaggccggtgaccagatccgctacctgaacctgtccaacgcccagggcgcctccgcgtcccagggttcgcccgccttcatctttgtggacttcgtccggaccctgccgatcgtcctgctggcgctcctgtacgcggcggtggtgatcgctgttgcccgctggaggggactccgtgccctgatcggacttgtcggcgcgtatttcgtgctggccagctttatgcttcccgggctggtggaagggaaaccgccgctcctgctggccctggtgggatccacggtgatcatgatcggggtcctgtatttcgcccacggcttctcggccaggacctccaccgcactgctgggcacgatgttcgggctggggatcacggcgctcctggccgcctgggcaaccggcgcggccaatcttgccggtgtggggaaccacgaggcaaccaccctggtgaacacctccgccaacatctccatctccggcgtcatcctgtgcgggctcatcatctccggcctcggcgtcctcaatgacgtgaccatcacccagtcctccgcggtgtgggaactgtacgaactggcgccgggcagcagcgcgcggaaactcttcacctcggccatgcggatcggccgggaccacatcgcttccaccgtttacaccatcgcgttcgcttacgccggcgcggcccttcccatcctcatcatcgtgatgctctacgaccgcccgctcgctgacacgctcaccagcgcggagctgtccgaggaagtcatccggaccctcgtgggctccatcgggctggtcctggccattccggtcaccacgctgatcgctgtgttggtggtcaaggccaccggagtccgggcaggagtcccggaggctcaggcgccacaagcaaccgaagcaggcggccagggggagccgggcgtggatgacaccggctcgctggccgcagcagcccttgcccgccggtcgcgcctttccgccggggagccggaggacgcgcccaccaggcgtggacgccgggcagaccgcggctgaaccaatacggcaaacagcccgatttgcccggctttgcaacaatggacaggtgactgttgcagcaacccctcccgcccccaagctggaactcccgcccctgaagctgggtcccatcaccgtggacacgccggtgatcctggcgcccatggccggcatcaccaactccgcctttcgccgtctgtgccgtgaatacggcggcggcatgtacgtggccgagatggtcacctcccgtgccctggtggagcggaccccggagtccctgcggatcatttcccacgacgacgacgaaaaggtgcggtccgtccagctctacggcgtggacccggtgacagtaggcgcggctgtgcgcatgctcgtcgaggaggaccgcgcggaccatatcgacctcaacttcggctgccccgttcccaaggtcacccgccggggcggcggctcggccctgccctggaagatcgaccttttcacctcgatcgtgcagaccgccgtcagggaagcgtcaaagggcaatgttccgctgaccatcaagatgcgcaagggcatcgacgacgaccacctcacgtaccttgacgccggccgcattgcgcgcgatgccggcgttgccgccgtcgcccttcacggcaggacggccgcccagttctattccggacaggccgactggtccgccatcgcccgcctgcgcgaggccctgccggacattccggtgctgggcaacggggacatctggtccgcggaagacgcggtccggatggtccgcgaaaccggtgttgacggcgtagtggtgggccgcggctgccagggccggccctggctgttcggtgacctgcaggctgccttcgaaggcagcgacacccggcacaagccgaatctgggccaagtagcccagggggtttaccggcacgccgaactcatggtggaaaccttcgctgacgagggcaaggcgctgcgggagatccgcaagcacatcgcctggtacttcaagggctacgtggtgggcggcgaactccgcacgcggatggcgctggtgaacagcctcgaggaactgcgcgccgccctggacgagctcgacgtcgactcgccctacccgggcggcgacgcggaaggtccccgcggccgtgccggctcaccgaagaagcccgcattgccgaaggactggctggaatcccgagcccttaacgctgaccagtcgcgggacatctccgcggcggaactggatgtttccggtggctgaaacgcgcactgcagcccccgtcctgccgggctatgacacgcacgactccgcccgctgggtggaggaaccgcccaagaacgtctaccgctcggactttgaacgggaccgtgcccgggtgctgcattcctcggcgctccgccggctgggcgccaagacccaggtggtggcgccggacacggacgattttgtccgcacccgcctgacccacagcctcgaggttgcccaggtgggccgcgagctgggccgttccctgggctgcgatccggacgttgtggacaccgcctgcctcagccacgacctcggccacccgccgttcgggcacaacggggagtcggcgctcaacgaagtggcgcacgccatcggcggcttcgagggcaacgcccagaccctccgcctgctgacccggctggagcccaaggtgctgacgcctgacggccaccccgcaggcctgaacctcaccagggccagcctggatgcggcagccaaatacccgtggtccgcactggaggccccggtgatccacggccagcggaccagcaagttcggcgcctacgaggacgacctgccgatcttcaactggatacgggagggggctccggagcgccgctcctgcctggaggcccaggtgatggacctcgcagacgacatctcctattccgtgcacgacgtcgaggacgcgatcgtggccgggcacttccagctgcgctggatggacaacccggaccaccgcgcccgggtggtgggttacgccaagcagtggtaccttccgcacaacgatcccgccgccatcgacgccgccctggcccggcttgaagccacggacgtctgggtccgcgaggccgacggcagccgcaaagccatggcggccctgaaaaacatgaccagccagctgattggcaggttctgccagagcgcgctggaaaccacccgcgccgtgtacggcccggagaacctgacgcggttcaacgccgagctcatggttccggacgagaccgtcatggagatcgccgtcatgaagggcctggctaccaccttcgtgatgaccaccgagcaccgacagcccatctacgagcgccagcgggaggtgctccatgccctggtcacggcgctgagcgccaccggcgaccggcacctggaaccgatgttcgcggcggactggcgggatgcgcccgacgacggtgcccgccttcgcgtggtcatcgaccaggtggcgtcgctgacagatggttcggcgctggccatgtacgaacggctggtagggagcctgccgtcgctgtggtgattgacgccgtggtgatgagcgctgtggtgaggaatgccacgtggcgctcatcgccgtcgtaccccggcactaggatggctctgtgccagggctgatcaaacgcgaagatattgacgaagtccgccagcgcacggacatcaaggaagtggtcgacgggtacgtcacgctcaagggcgccgggctgggaaccttcaaaggcctgtgccccttccacgacgaacgttccccttccttcaccgtccggccgcaggtgggccgctaccactgcttcggctgcggcgaagacggcgacgtcatcgccttcgtgcagaaacaggaccacagctccttccaggaagctgtggagaagctggccgcccggatcgggtacgagctgcggtacgaggacggcggaaccggccccaaccgcgaggaagtggggcgccggcagcggctgctggacgcccacaagatcgccgacgagttcttccaggcgcagctgctgacgcccggcgccgcagaggcacgcaccttcctgcacggccgcgggttcgaccgcgcagccgcagaacagttcggcgttggctacgctccgcagggctgggacgcgctgctcaagcacctccgcggccgcggcttcacggatgcggaactcaagctgacggggatgttctccgaaggcaaccgggggatctacgaccgcttccgcgggcgcctgatctggcccatccgcgacatcgccggcgacaccatcggcttcggcgcccgcaagctctatgaggacgaccagggccccaagtacctcaacacccccgagaccacgctctacaagaagtcccaggtgctgtacggcatcgacctcgccaagcgcagcatcgccaaggaccggcagcttgtggtggtggagggctatacggacgtgatggcctgccaccttgcaggaatcacgacggcggtggccacctgcggcaccgcgttcggcaccgaacacattaagatcgcccgccgcctgctgtccgacgacggcaccgggggagaggtcatcttcaccttcgacggcgacgccgccgggcagaaggcggcgctgcgcgctttcgaggaggaccagcgcttcactgcccagacgtacgtggcggtggagcccagcggcgcagatccctgcgacctgcgccaaagcaggggcgacgaagccgtgcacgcgctggtgcagtcccgccggcccctgtttgagttcgccatccggaccaccctgaaacagttcaacctggacaccgtggaggggcgggtccagggcctgaaagcctcggtgccggtggttgccgccatccgggacgcctccacccggaccggctactgccaggccctcacaggctggctgggcatgccggaccccaacgaagtcctgcggatggtcacggcagaagtcaaaaacgccggcaagcgcggcgaccagggaggggctcccgctgccgctccccggacctccgcccccgcagccgcacccggaggtcccggcgtagctgcagggccgccgtcgggagctgtgccgtcctaccaccggcccgacccccgggaccccgtggcctccatggagcggcaggcgctggaggttgccctgcaggagccgtcactcctggttggcggggtctgggaacgcttctcggccgcccgcttcgccacccccgccttccaggccgttcacgatgccatgcgggccacggatcccgccctcacggccgaccccgtccggtgggttgagcatgtgatgcacgaggttccggaaccgttgcggcccctggtctccgagcttgctgttgttccgttgcccgccagcaccgaagaagccgtgcagaagtactgccgggacatcctctcccggctgttcgagcttcagatcacccgggtcaaggcggataagatgggccagctccagcggttggaccccgcggctgatcccgaaacgtaccagcggctcaaccgcgaactgatgatgctggagatggaacgccgggcgctcaggtcggacgcctgatctgctgcctctggggtttaggacccctcggtcccgttccccgatttcgcttccagccggggtctttgctaggctaatacccgcttcattcctccttagctcaattggcagagcattcgactgttaatcgaagggttgctggttcaagtccagcaggaggagcgcacaatccccgttccggcctccggaacggggatttttaatgcctgcaactgcccgttccaccacggaataacgccgatttcactttggccggaatcctttgctaatgtcatacctgcttcattcctccttagctcaattggcagagcattcgactgttaatcgaagggttgctggttcaagtccagcaggaggagcaacacggaaaatccccgttcctcctttggtaggaacggggatttttgttggtcagacgaagtccatctccacctgcaggaaacgctccgcctccgcaatggcggccaggaacgcctctttttcggtgggtgacttccggggctggcggggattccactcgtggggtgccgaatggacgcgcaccactccggtgtccgggggcgcgtagaagattccgaagcgctgtacgggccactcgggggaggtctcaggggctaccagcagcgcggcgttgaaggcggggttgaaccactgtgcgatgggccgccgtcggtcatcagtgaacagtcccgcggcgtacagcgctgctgattgctcgccggcctgggcacacagccgctcccaccacagtggcagtatccggtgatcgcaccgttgccatgtggccggaagcggcggttgttcctgccaggtgggcacaaacactattttatcgcgggcgccctgccggtggcaggtacttcacgcccgccacgcgctttgcttccgccctgcggtgcggggtcagggtcggttccagggccccgggttgacccggtacagcagtgccgaccctgcaaccatgcccagggcaatgcccatggcagggttgcccagggcccggccggcgaagtagcccgcgacggcgccaatcaccgcgccgaggaaaagtccccggcggttccggtgcggcttgcgctttggcgtgttcttcacggcgtcagtggattgacggaacggtacggggccggaccaccagccacagcgcggccatggccagcaggatgcatgttccctgcaccgcacccatcggggcggcgctggtgatgcccagccaaccaaccacgggggagatgagcccggccatcatgaaggtcgagaacccgagcagggatgctgcagtaccggcctggcccgcatggccggcaagggcgagcacctgcacgcacgggaacatgaaccccgtccccaggatgtagaaccacaagggaaccagcacgccccacaggccgaaccccagctggtcgaacaccacgatcagcgtggccatcacgaacatccaggcagtggcggcagcgatgatccactgcggcggaacccggcgtatgaggcgggcgctggtttggattccggcaacaatacccagggaattaatgccgaagagcaggccgtactcctggggggagaagccgaaaacgtcctggaacaggaaaggggaggccgacaggtacgtgaacaggccgccaaagttcagtccggccaccagcagcaaaccaacaaacaccctgtcgctgaaaagtatccggtagcgctggcgcgctgtcataccgctctgcctgcgcttctccggcggcagggtctcacggacaaggaacagggcggagacgatcaccagggtcccgtaagcggcaaggaacacgaagatcccgggccactccatcaccaggagcagctgtgaaccgatcacgggcgccaggatgggtgccagcccgttcaccagcgccatgcgggaaaacatcttcaccatggcataacccgagaaaaggtcccggaccatggccatggccacaacgccgccgccggcagcccccacgcccatcaggacgcgggaaatgcccagcatggtgatatccgtggacagggcagcacccaccgacgccgcgatgtgcaatgccgttgcaaggatgagcggggtcctgcggccgaacctgtcgctgaaggggcccaccaccagctggccgatggcgaatcccacggtggtgccggccagggtcagctggacctgggcctcggtcacgccgaggctctcctccagggcggggaacgcgggaaggtaaaggtcgattgtgaacggacccaacgccgtcagggcgccgagcagcaggatgtacaggagtttccggcggcggctcaagaggtcgcccggattgctgggaatggtcacggagatcaatcctaggcccggcgctgcctaattttgcagcgttgtagggctcgccgcccggcaagccccgaagttcgccctgaacctgaatgatagttttggtgcggggactgtgcagctgcactttcctgcagcacacggaagccgattcgacccataaccagtaaggcggaaccgatgagcggacgtcacagcgggcgtaccagccagggattgcgcatcactgcgctgcccaggacgcttaaactccttttccggttggcgccgcgccagctcaacgacgaaatcgccttcgcgaagatcgaactcaagcgcaagggaatccaggtcggagttgccgctgcctttttcgccgtcgccctcgttttcctgatgttcctggtggtgggcctcatcgtggcagccatcatggggctggcaaccatcatgcccgcctggctggcggcgctcctggtgtccgcggctttcctcctgatagccctcataggtggcctgattggtatgcggaagttcaagaaggccatgccgctgatgccggaagaaaccatccgcggcatcaagcacgatatcggcgtggccaaagaaggctccgcgttcaaccctgccgtccttgaccccaacagtcccgaggccaaggctgccaaggccgcaaaggatgaagcggctgccaaggccaaggccgagaaggcagccaaggccgctgaacacgacaaggaattcccgcacgcctccgaaccggagctgtcccgccggctcagccagcgccgccaccacctcaccgaagtgcgcgacgaactcggcaccgagctggacgtcaagacccagggcaggtacctcctggcaaccgcccaggacaaactgcgcgaaggccaggccctggccggccacggcagggatgttgccgggcagaaatttgcagcgttgtccggatccgccgacctggaacagcgctggaagccgctggcagccttcatcgctgcgggaaccgtcttcctggtcctggtgcgcaagctcctccggacgtactagaaccgggatcgggcaggctttccggcagcccgcggaagttcaaagagaaacggctacaacgctcgcagggggcagcaggaaggaaggggggacggggtgaagttcattggtgccggctcccgtcccggacgcccccaggtggaccacgatctcgtgttcaccatccccaacctgctcactgtggtgcgcttcatgggggtgccgctcttcatctggctggtcctggcccagaaggaatacggtgccgccgttgtggtcctcgccgtcatggccagcaccgactgggttgacgggtacatcgcccgccgcttcgaccagacctcgaaactcggcagggtcctggacccgatcgccgaccggctggcgctgatagccgtcgctgtcacgctggtgattgccggcgtcgtccattggctctatctggccgcgctggtggtgccggacgctgtgctgctgaccatgacgctgttcttcttccggggccacccggaccttccagtgagcgtaattggcaaggtgcgcaccggccttctgctgctggggacccccatgctggtcctctcacggctggacacagggttctccactgagctgttcgtcgccgcgtggatagtcctgggcctggggttgatcggccactggatagccgcctacaactacttctgggccatcctgcggaagggcagaatgcaggcacaccacgacgacggggccgcctgatggtatggctggcagtcgggcttgcgctgcttggcgcgttctgcctggcccttggtgcccagcgccaggggagcgccgtcaaagccgatacgggcggcctggccctgagttccaacggcttcctgcgcctgcttcgaaatccccgctgggtgttcggcctcctgctcctgtgtgccggcatggccatgaacgccgtggcgctcgtgtccgcaccgctcaccgttgtccagcccatcggtgccatcgccctggtgatcaccaccatcattaacgccaaggaccaggacctcaccatcaaccgggcaacggtggtggccattaccgcctgcgtgaccggctcggcgctcttcgtcctcctggcggtcaacgtcacccaggaaaaccacgacgtaaccctcgcggacgaggtcaccattgtgctgctgctggtgctcgccgtgggactcttcggcaccctggccgtgatgttcaggcaccggatcaacgccttcatctatatcttgggcgccggggtcctcttcgggttcgtggccgtcctgacccggatcattggcaagcacctgctggatccgaacgggctgttcctgctgaacgtgcagtggtactccgtggtggccctcatcgccgcgggcggtctggggtcgtggtttgtccagagcgcctactcgtcaggtccgccggacctggtgatcgcaggactcaccgtcattgatccgcttgtgggtatagccatcggcattgtgatcctcggcgaattgcggccggatgtccacgccgtgatggccattgccatggcaaccgctgcctcccttgctatcgttggggtgatcgccctttccaggcaccaccctgaggtcacgaagcgcaagaaggacgcgcggaaggccgtgggccgggcgagccgctagccactgtccaccagattccccttgattccgccagcaagattcaccacgaggccaggcgccaccacgccagcggccaactgtgctgccagtacatgctgtgcgcaccgtgaccatcaggagctctccacgtgaccacgcccgcagaccagcgtcccctgaccatcctgatcgctgcagacacgtatccgccccacatcaacggagcagcgcagttcggctaccgcctggccaagggaatgaccggccgcgggcacaacgtccatgtgctggcctgccgtgcggacaacggaaagagctttacggagttccggcctgaagggacggtccacaggctccgttcccacggcgtccccacgcatgagtacttcaggatttgccttccctgggagatcaagaaggaaatcagcctcctttttgaccgggtgaaacccgacgtggtgcacatccagagccactacatgatcggagagcacgtcctgtacgaggccgtgaagcgcggcgtccggattgttgccaccaaccacttcatgccggagaacctcaacccgttcctgccgtttccgcagtggttcaaggacatcatcgggcggatctcctggaaggacatgggcaaagtcatgggcaaggcggacgtggtcaccacgcccaccccgcttgccgccaaggccatgcaccagcacgccttcctgcgcaaggtgctgccgctgtccaatggcattgactccgccgcctacgagctccagcccggcgagcagatcgaaccgcacccgcaccccaccgtgatgtttgccgggcggctggccgaggaaaagcacgtggatgtgctgatcgaagccgtcagcaagactccgccggaactcaacgtccacctggaagttgtcggcggcggcgaggtccggtcctccctggaagaactggtacgccggttgcacatgacggaccgggtaaagttcctgggcctcgccagtgacgaggaactgcgccgtgcctacatccaggccgacctgttctgcatgccgggaacggcagagctgcagtctctggtgacgcttgaggcgatgtccgcctccacccctgtggtgctggcagatgccatggccttgccgcacctggtgcgcgacggcgaaaacggctacttgtttacgccgaacgacagtgacgaccttgccaagaagatcaccatggtcctggagctgcctgccgaccagcgcgccgccatgggccaggccagccgggagatggtggaaccccacagcatcgagggcacccttcagacctttgaagacctctatcgcggtgcgggcttcgaggacaaggtggtctgaacgctttcccgggtttgctagagtaattttgccctgccaccgcgtaccgattacgggaggcccgggcatggggggctatagctcagctggttagagcgcgggactcataatcctaaggtcctcggttcaagtccgagtagccctaccacccgcgcggaaaccgcggccggcatgcatgccggccgcggttttctttcttaagccctcgatctgcggtatgttactgagcagtaacttaccgtgctccttcctagcgagccccggtcaccgctgatccttgtgaggtaaccatgtccaccaccgctgccgacctcaacgaccttccctatgccgatggcgacttcttcgccttcgagcaactgctgagtgacaaggagcgggaccggctggcggagatcagggagttcctggcccgcgaagtgcggcccatcgccgtggactgctggaaccggggcgagttcccgatggacctcatcccgaagcttgccggcatcgacctggtcagccccgtccaccggcagggccactccaacctgttcgccggcctggtccacgccgaggtgacacgcgccgacacctccatttccaccttcatgggagtccatgacgggctgttcaccggttccatcgaagcgctggcttcgcaggagcaaaaggatgcctggctcccggacatctacagcatgaagaagatcggggcttttggcctcactgagccgcttggcggatcggacgtcgcgggcggaacccgcaccaccgcgcgcagggaagggggctcctggatcctgaatggagaaaaacgctggatcggaaatgccaccttctccgactgggtggtggtctacgcccgcgacctcgccgatgacaaggtcaaggggttcctggtggacacggcactcgacggcttcagtgccagcaaaatcgagaacaagattgcactccgcaccgtccagaacgccgacatccgcttggacaacgtggtggtgccggacttctacaagctagccaacgccaacagcttccgcgacgttaacaaggtcttgaaggtcacccggctcggtgtcgcctggcaggccgtcggccagcagctggctgctttcgacgtggcccggcgctatgccgtggagcgccaccagttcggtcggccacttgcatccttccagctggtgcaaagccagctggtccagatcctgggcaacgccgtgagctccatgggcatgatggtccggctctcccagctggaggacgcgggcgaggcgaaggatgagcagtccgccctcgccaaggctttcaccaccgcgcggatgcgtgagagtgtggcgatcggcaggagcctgctgggcggcaacggcattgtgacggactttgaaatggccaaaatctttgcggatgcagaagccatctattcgtacgaaggaacgcacgagatcaatacgctggtgaccggcagggccatcaccgggatctccgccatcgtctgaaccctggcacgcctcgtccggcctgctgcctacgtgtccaggggcagcaggaccgatggcctcaggtccatcacgaactgcagcggattcacgtagtcttccccgcgccggacgccccagtggacacagggcacggcagtgcagtgcccgggaagcgccgtgccgatgacctggcccgcagccacaggggtgccggcggccagggtgctgtcaacgggctcgaagctgctccgcagcccatccccgtggtcgatagtgatcaccggccggtccaccaccacgcccacgaagctgacggtgccggccgccggggaggtaaccgctgcgccgtcggccgttgcgcccaggtcaaccccccggtgtccgctgagccagggcttgggtgggggatcgaagtcccgcagcacctgcgggcgcggggcaagcggccattgccaagagggcgcggccgccgccgggggactggcggccgccctgggatgccccgcctgctgcacagaataagctggtccgaacgccaggggctcgccggccggggccagtgaagccggcagcaggagaagggccgcgagccgcagtggtggtttcatgccaccagaatgcgcctgcttcagaggcgccgggagtgcccgctccggctatgtggacaagccccgtgccggcgtcgtttctgtcctcgtcagtgtcctccggctgaaggtgcctgtagtacacttggtggagcagtttgctgcgccctcaatgctttcggtccggcggatatcccagtggtcttaccagcggtatatgcccgtgtccggaatgcgtcggcacatctcattcaggagtgtgggggagcagaagctgactacgcgcatccagccctcctgcaagcgacgctccggcctcgccgacgggggatcaggcctcctgcggtcaggaccagcgtcctgatgggaagcatggtggatgctaggagcacggcccagcctgggccacgctaatcaaccgtcaactagtggcagggtaagagagccatgggctctctcatgaatgacctgccggaaggagcgtcggcatgcccgtcgtaactatgcgccagctgcttgacagcggcgtccactttggacaccagacccgccgttggaacccgaagatgaagcgcttcatcttcacggagcgcaacggcatctacatcatcgaccttcagcagtcgctgtcctacatcgaccgcgcctacgagttcgtgaaggccaccgttgcacacggcggcaccgtcctcttcgtcggcaccaagaagcaggcccaggaagcgattgccgagcaggcaacccgcgttggccagccgtacgtcaaccagcgttggcttggcggtatgctgaccaacttccagactgtctccaagcgcatccagcgcatgaaggaactcgaagagatcgacttcgacgacgtcgccggttccgcttacaccaagaaggaactgctgctccttcgccgtgaactcaccaagctggaaaccaaccttggcggtatccgcaacctgaccaaggcaccgtccgtgctctggatcgtggacaccaagaaggaacacctcgccgttgacgaggccaagaagctgaacatccccgttgtggccatcctggacaccaactgcgatcctgacgaagtcgacttcccgatcccgggcaacgacgacgccatccgctccgtgaacctcctcacccgcgttgttgccgacgccgttgccgagggcctcatcgcccgcaacaaccgcggtaccggtgctgccgaagctccggaagagcccctggctgaatgggagcgcgagctcctcgaaggcagcaaggctgaagaagctgctgctccggctgctgaagaggctgctgctccggctgctgaagaggctgctgctccggctgccgaggaagctccggccgctgccgaggctcccgccgaagacgccaagtaacacaagtacatccggatttccggcgctgcctgcagcgccggagctgctgacaggatggcggcccacccgtgggctgccgtcctgtcagtccgtacaccaccacacatttctagacagaggggttcacatggcgaactacactgccgcggacatcaaggccctgcgcgagcgcaccggcgccggcatgatggacgtcaagaaggctcttgacgaggccaacggtgacgccgagaaggccatcgaaatcatccgcatcaagggcctcaagggcgctaccaagcgtgaaggccgctccaccgccgaaggcctggtggccgccaaggtcagcaacggcgtcggcgtcatgatcgaggtcaactgcgagaccgacttcgtggccaaggctgacaagttcatccagctggccgacaaggtcctggccgtggccgtcgagtccggcgctgccgacctcgagaccctgctcgccaccgatgttgacggcaagcccctctccgaggtcgtcgtcgaagaaggcgcagtcctgggcgagaaggttgttgtccgccgcatctcccgcatcgagggcgcaacggttgacgcttacctgcacaagacctccaaggacctcccggcccaggttggcgtgctgttcgctgttgacggtgaaggcgaagccgctgccaccgcagcacacgacgtcgcagtccacatcgctgccatggctccgaactacctgacccgcgaggacgtcccgtccgacctggtcgagtccgagcgccgcatcgccgaagagaccgccaaggccgagggcaagcccgaggcagcactcaccaagatcgtggaaggccgcgttaccggcttctacaagggtgaggtcctggttgaccaggcattcgcgaaggacgccaagaagtccgtggcgcaggtcctcactgaggccggcgtcaagggaaccgcgttcacgcgtttccgcgtcggctcctagccgaaacttcaagggggtggccacttcggtggccgccccttttgcatgcgcggggggcgccccgaacgggacaggcccccaataggacctttggccgcgcagcaggataacctttttagagtccaccaacgggaaggcatcatggaagccgtcaacactgtaatccagccagagaaaagccgacgccgggtcctcttgaagctctccggtgaagtctttggcggcggaaagctgggcgttgaccccgagaccgtccgcgacgtcgccaagcagatcgccgcagccgtcccccaggtggaggtggccatcgtcgtcggcggcggcaacttcttccgcggtgcggagctctcccagagcgggatggaccgttcccgcgcggactacatgggcatgctcggcaccgtgatgaactgccttgccctgcaggacttcctggagcaggccggcgtcgaaacccgggtccagagcgccatcaccatggggcaggtcgccgaggcttacattccccgccgcgccatccgccacatggaaaagggccgcgtggtcatcttcggtgccggcgcgggcctgccgtacttctccactgacaccgtcgccgcccagcgggccctcgaggtccacgccgacgtcgtcctgatggccaagagcggcgtggacgccgtctacaccgccgaccccaaaaaggaccccaccgccgagcggctggaaaccctcagctacgatgacgccctccgccgcgacatccgggtcatggaccagaccgcaatgaccatgtgcaaggacaacgacctttccatggtggtcttcggcatggaaggcgaaggcaacgtcaccagggccatcctcggcgaaaagctgggcacgctggtcactacctagctgcggctaggatgatttcaggactgttccgtccctgcccccgcgggcggggacgggccggcatcaaagaaccacgtttgtgcatggacccggcgccccggactgcaccagaatcgtcaggagagaccgtgatcgaagaaaccttgctcgaagccgaagaaaagatggacaaggccgtagaggtagccaaggaagacttcgcttccgtccgcaccgggcgtgccaacccgggcctgtacaacaaggtcctggtggagtactacgggtcacccacccctctgcagcagcttgcctcgttcgccatcccggacgcccgcaccatcctcatcacgcccttcgacaagacggcgctgcgcgacatcgaacgtgcgcttagtgattccgaggtcggtgccaacccgtccaacgacggcaacgtcatccggatcaccatcccggaactgacgaaggaacgccgcaaggaatacgtcaagatcgtcaagaccaagggcgaggacgccaaggtctccatccgcaacatccgccgcaaggccaaggaaaccctggaccgcctggtcaaggacggcgaagccggcgaagacgaaggcacccgggccgaaaaggaactggacagcctcaccaaggcgcatgtggacggcatcgatgagctgctcaagcgcaaggaagcagagctgctcgaagtctgatgggccaggcagatcaggccccggcacccagggcgcgcatacgggggaagcagcccaggagcaacccgacgccgaaggcagggaggaacctccctgccgccgtcgtggtgggcctggccatgctcttcgccgtactgggcggactgctgctgctcccgcttgccttcgttgcggtcaccaccaccttcgccattttcggcgtgtgggagatctaccgcgcactggaggccaacggcaccaggatgcccatcatcccggtcatgaccgggacggtggccatgcctttcgccgcctatctcggaggcattgagagcctcctcttcgcgatgctgctgagctcagtggccgtgcttttgtggcggtccatcgaaagtgcggcaggttcggccaacagcatcttcgccggcgtcttcacgctcggctgggtgccgttcttcatcagcttcgcggtccttccgctgcacgcggccggcggtgcaacgccgctgggcctctggccgggcggaacggttccccacggcgcgtggcaggtggccgtgatgctcctgctggtggtctccaacgacaccttcggatacctggtgggcgcatccctgggcaagcaccccatggcgcccaagatcagtcccaagaagtcttgggaaggattcgccggctccattggcggagccatgctcattggaatcctggcctgcctttttgtgctggaccagccctggtgggtgggtgtcgtgctggcggtcggcctggtggcggcttccacggcaggcgacctggcggagtccatggtcaaacgcgaactgggcatcaaggacatgagcagcatcctgccggggcacgggggagtcatggacaggctcgactcgatcgtgttcgcgtccccggccgcgttcatcttgtacggactggtgtccggcgcctgacacaaaccctgccggacctgcagagaacccccggcacaaataagctggtgcagaagcactaccgctgaagagcattgaaggaagcaaagtggcattggacattcatcggcagatccctgcgtcctttgagcgcgtccagcgcggtgagtatggctacaacgccaaacaggtggaccagttcctgcagcaggcgcgggtatcgctggagaccccggaatcagcgccgcagcccatcaacagcgcggatgtgcgggctgtctccttcgaccccgtcaaaggcggatattccgccgccatcgtggacgccgccctggaccggctcgaggatgccttcgcacgccgggaacgggatgagctgatcgctgccagcggcgaggaagcctggctgcgcgagatcggacacctctcgggcatcctgcgcggccgcctgcaccggccggacggcgaccgcttccgccgccccgccaagaacaaggcccgcagctacaacacggccgacgtcgaccggctgtgccgtgaactcatcgcctaccttgagcaggacaagccgctcagcgtggacagcgtccgccgggccgtcttccgccccgcagtgggccgcgacgggtacgaggaagcccaggtggacgccttcctggaccgggtcgtcgagctcatggctgccatcgactgattctgcctgtatgggcccggcctcaacgttcggtggccagcggccgctcgggggtatgcagccgggtcatcactttcgacatggttttcgggacccgctgcgacgttgcgcgggacacgatgaccatcaccgcaaaggccgcgggaaccgtccacgccgccggctgcgccagccagccgggcgtgctggcggccccggccagggctccggcgatcattgccccgccgcacaggaccccgccggtcagcatgccggcgatcgcgccggcatcggtcagcccgcgccaccagatgcccagcagcaacaccgggcagaccgttgacgcggtgaacgcgaacaccagcccgacgctcccggccagggcgaacgagtcagtcatgaaggcaaagcccagcggcaccacggcggaaatgacggctgccagccggaagctgcccacgcttgcccccaggacgtcctggctgatcacgccggccagggaaaccaccagccccgacgttgtggacaggaacgcggcgaacgctcccgccaccaccagtgcggacaacaggtcacccgccgttccgcccaccagttcccccgggagcagcagcaccatggcgtccgcctggcccgcagtcgccaggccgggagcgaacatccgtcccaccagcccgtaagccgtagggaacaggtagaacacggacagcaggcccaggacaatcagcgtggtgcggcgggcggactgcccgtccgggttggtgtagaagcgcaccaaaacgtgcggcaggcccagggttccgaacagcagagccaccaggagtgacacgttctggtagagcccggcagggggcgcgcccgtggggttgaccgacggcggcgccagcgcggcggtcccgcttccggcaaggacaaagatgatgaacaggatgggcacggccaaggccgtgagtttcagccaatactggaacgcctggacgaacgtgatggagcgcatgcctcccgctaccacggtgaggcaaaccacgatcaccaccgccaccgaccccacccaggacggcaggcccgtagtgatgcggatggtgagggcagcaccatggagctggggcacgatatacagccagcccaccagcaccaccaccaggctggtcactttgcgcaccggcagggaatcaagcctggcctcggtgaaatcgggaatggtgtaggccccggaccgccgcagcggagccgcgacgaacagcaacagcatcaggtacccggccgtgtaccccaccggaaaccacagcgcatccgttccggacagcaggatcaggcccgcaacgcccaggaagctggcggcggaaaggtactcgccgccaattgccgaggcgttccaccacggccggaccgtcctggaggcaacatagaagtcacccgtggtccgtgaaatccgcaggccgtagaaaccgatgactgcggtggctacggacacccctaccagggcagctatggccacgcccgggttcacggtatcctcaccggtcctcggccaggtcccggtagcgcgcctcattgcgcgccgccgtccggatgtacagccacgcgctgagcccgatgaccggatagatgccggctcccagcagcagccaggcgaacggaatgccggccacccgggtttccgccaggccggggacggccgcgagcagcagggggaaggcgcaaaggatcagcaggaaccccgcggccaccaccagggccagccgcagctgggacctgatcagggacctgacgaacacctggcccacttccgagtcctgcgccgcctccctcgtctccttggccggacgcgccgcagtccgcggggccgtcacgcgcaccctggtcatgtattgggcctgatccgggtggcctcaagcttttcccggacggtgggcaggtgccgcctgctgatgggcaggcccgcgcccgccacggtgacgctggggccgtctgcggcgagcttcatcgaagtcacgtgcttgagggccaccaggtaggaccggtgcgtccggatgaaccccgcatccgcccactgctgttcgaggtccgcaagcggaaccctgatcaggtagctggcttcggcggtgtggagccttgcgtagtccccttgtgcctggacgtaggtcacgtcgtcgcgcctgatcatcttggtggtcccgcccaggtccaccgtgatcatctccggggcggcgccgccgtcgcgcagttcactgatgcggcccacgcagcgtgacaggcgttccgcccgcacgggcttaagcaggtagtccaccgccgcgagttcgaaggcgtccagtgcgtggtcctcgtccgccgtcacgaacacgacggcgggcggacggctgctcccggcgatggcacgggcaatgtccaggccggacaccgccggcatgtggatgtccaggaagacggcgtcaacaggagcggaggcgagcgctttcagcgcatcgctgccggaggtggcacggagaattttgcccacgcgctcgtccttgcccagcaggaaggccagttcctcaacggcaggcagctcatcatccacgacgaggacgttaatcatgctcctagggtagctttccggagcaggggcgaggcgccggcggtgctcaccacagtcccggccaagtcatgcatcgtgcccgggctgggacttggggacccgcatggtgatcagggttccctcgccgggcgcggtctcaatgaccagcccgtggtcgttgccgtacacctggcggaggcgggcatcgacgttgcgcaggcccacatgctcgccgtctgtgtggccggccagcatggactgcagctgctccggatccatgcccactccgtcgtcctcgatggtcacctcggcgaaagcgccggcgtcgttggcggtgatactgatgtgtcccggcccctccttggcctcgagcccgtgccggaccgcgttctccaccagcggctgcaggctcaggaacgggataacggtgctgagcacttccggtgccacccgcaggctgacctgcacccgttcaccgaaccgggcccgttccagcagcaggtaccggtcgatgcagcggagttcctccgcgagcgtggtgaagtccccgtgccgccggaacgaataccgggtgaagtcggcgaactcgaccaccagctcccgggcgcgggctgggtccgtgttgatgaaggatgcgatggcattgagcgagttgtagatgaaatgcgggctgatctgcgcgcgcagggcccgcacctcggcctccatcagctgagtgcgggaggcgtccagctccgcgagttccacctgcacggccacccagtccgccacttcgctggtggccctgaccagccccgcgccggcggagggagcgaaggcggcgacggcgcccaccacccgggtgccggcacgcaccggtgcaatcacggcggcgagcgggccgccggtggcctccgtggcggcccctgcctccccggcgggaaggacagctgtccggccgctcgccaggactccggcagcaagatccatcatccgcggcttcaggtcctcgccggcaccgtcccacgccagtactccggaggtgtccatgatggccagggcgtcacagcccagcagggtgcgcagctggcggctggccttggcagccccggcggggttgaggccccggcgcaggtgctggcctgcctgggaagcggcatgcagggtgtggtaggtggcgcgttccgcatcggtgcccaggtcgcggaaggaccggagcaccttgagccccacgccgacgacgacggcaatggccatggcgatgacggccacggccgcggcggtcaggaggggggagtccggcatggtgcccagcgtagccgcgggcgccgtttgtcgcagcatcccgaccgttgagcgcccgcaggcctgcaggctctggaactggcgcgatgcagcccgcagagtgattgcagtcacatttgcggtatcccgtcttccgggcctgccgttgggtgtgttcaggcaagtctcaacgaggaggaacgatgggtaacgatgcccacactccggacgcagcggcgtccgtggacttcgagcaggtccagtcgacggagcagttcaaggaactgcgcaagcgtcaccgcagctttgtcttccccatggcagtcgcattcctgctgtggtacttcgcatatgtcctgctcgccgactatgccgtggacttcatgtccaccaaggtctggggcaacatcaacgtgggcctgatcctcggcctgctccagttcgtctccacgttcgccatcaccggctggtatgtccactactccaacaagcgcctcgaccccatcgccaaggagatccgggacgaaatcgagggccacgaattcgataagcacggaaaccgagtaggcggagtcaccaaatgatcaatatcgcaacagcggtggacgtggccgccctcaaggaaaccacgctgctcaacatgggcatcttcggcatcttcgtggccgtcaccatggtgatagtgctccgcgccagccggaacaacaagaccgccgcggactactacgccgccggccggtccttcaccggctcgcagaacggcaccgccatcgccggcgactacctctccgcagcctccttcctgggcatcaccggcgccatcgccatcaacggctatgacggcttcatgtactccatcggcttcctggtggcctggctcgtggcgctcctgctcgtggccgagctcctgcgcaacaccggcaagttcactatggccgatgtgctgtccttccggctgaagcagcggcccgtccgcatcgccgccgccatctccaccctcgccgtttgcttcttctacctcctggcccagatggcaggagcaggcagcctgatctccctgctccttggcatcagcgactggggcggacaggccctggtgattatcgtcgtcggcgccctgatgatcatgtacgtcctgatcggcggcatgaagggcaccacctgggtgcagatcatcaaggccatcctgctcatcgcaggcgcagccgtcatgaccatatgggtcctggccatctacggcttcaacctctccagcctcctgggcgccgcagtggagacggccaacaacccggctgtcctgaatcccggcctgcagtacggcaagacggaaacctcgaagatcgacttcatgtcgctcggcctcgccctggtcctgggcaccgcagcgctgccgcacgtactcatgcgcttctacacggtccccacggccaaggaagcccggaagtccgtggtgtggtccatctggctgatcggcctgttctacctcttcaccctggtgcttggttacggtgcagctgcactggttggcgccgaaaccatcaagactgcaccgggcggcgtgaactcggctgccccgctgctggccttctacctgggcgggccgctgctgctgggcttcatctcggccgtggccttcgccaccatcctcgccgttgtggccggcctgaccatcaccgccgcggcatcgtttgcccatgacatctacgccagcgtcatctccaagggcaaggccgacgccgacactgaggtgaaggtggcccggcgcaccgttgtggtcatcggcgtcctggccatcctgggcggcatccttgccaacggacagaacgtggcgttcctcgtggcgctcgcattcgccgtcgccgcctccgccaacctgcccacgatcgtctactccctgttctggcggaagttcaccacccagggtgcagtctggagcatgtacggcggcctgggttccgcgatcatcctgatcatcttctcgccggtggtttccggcggagcaacatccatgatcaaggacgccaacttcgcactcttcccgctgagcaacccgggcatcgtgtccattcccctggccttcttcctgggctggctcggaacgacgctcgacaagaatcgggaggacacagccaagcaggccgaaatggaagtccgctcccttacaggggtgggtgccgaaaaggccgtcgaccactgacctgacggcatcaacagcaaagagcctccgcaccgggaagcagtacccggtgcggaggctttgttgtgctgccggccggggctacgctgccggccgcagcttgatttcggtcatcttgagttcgtcagtgccctcgaagcggtaggcgaggtccacctctttgccgtcgcaggtgatgagcccggcaacattcgccgatttaacgccgttctcggtgaccacattgaggtccctgtagtccggcgtgcaggtttcatccatgtcgaggctgctaaccccctcaatgaacgcttccttggacagctgctcctggagggcggggtcaaggtactcgtcgtaggcccttgagccgtctccggcgaggaccagcttggtaaagccgtcagccagccccctggcctggttggtggcgctgcccaccacgttcaccaaaataactatgcccaggaccacgaggaggaggacgccgccggcgcccgccaggatgatccacagtttccgccggctcctgggcggaggctgccccggaagcccgaacggggatccctgttcctgcccgtagtacggaggctgcagctgcggggatgccgggccggcgtggcccggctgaaacggttcctggggagtgctcaaaatggagcctttccggacaaatggtgcagcgcaccgcctggatgcggggcggcgctgtgcctgccccgccaactaactggcattcagcctatagcgcggccagcctgggccgaactccagccccgccggccgccgtcgtgttttccgccgtgggggcgcccgctgctaagcccgcccggggccgcgttcaagcaggggctggacgcggaagggtatgagctctcccatggcgagcgccgtatcggtccggtctacgccttcacatgccaggatcttcccgttgatccggaacaggtcctcggcgtccagcgccaccacgcgcagcagcaggtccgccgacccggtcaggccgtagccctcgagaatctcgggaatgtcagcgagttccttcgccagcagggcgagccgctgctgctggacatggacggagatgaaggccatcagcgggtaacccagggccgccggattgatgcgccgttcgaaggacaggaaaacgtgtttcttctccagctgcgccatccgcgcctgcacggtgttccgggagaggcccagcttctgggccagtgccaccaccgtttgccgggcgtcctgcgccagggcagagagcaggcgggcatcggtgccatccaaggcttgcataatgcgcaacgctagcacggtcccgcgctctcctgcagagcattttgctcagtgatcgcgcgggtagttgtacctcctgagcattgtgagtagggtcacaaatatccggggcaacggcgcccgggcggccggcggctgaaggggccacaagtcccaaaaccgcgggtcaacgacgtgagaggttgcgggctatcgtgtctacagacgaaacgggccagggcggaccagccgcccccaacagcgcccggcacccccatgggcaggggcgggacctggtccaactggttaccccaaccggagagcggatcagccatccggagttcgattactgggtcagggacgtcactgacgaacagttgtgttccctctacgaggacatgaccgtgatccggcgcattgacgtcgaggcaaccgccctgcagcggcagggtgaacttgggctgtggccgccgctgctggggcaggaagccgcgcaggtcggttcgggccgggcgctccgcacggacgactttgtcttttccagctaccgggagaacggggtggcctactgccggggagtggacctgacggacatcctccgggtatggcgcggcactgcatcctcgggctgggatccctacaccatcaacatggccaccccgcagatcatcatcggcgcccagaccctccacgccaccggctatgcaatgggcatccagaatgacggcgccgattccgtggccgtgacctatttcggtgacggcgccaccagcgagggcgacgtcaacgaggccatggtcttcgcggcaagcttccaggtgcccgtggtgttcttctgcaccaacaaccactgggccatttccgagcccgtccggctccagtcgcacatccaactggccgacagggccgccgggttcggcatccccagcctgcgggtggacggcaacgacgtcctggccgtgatggcagccacccgcgtagccctggaccgggcccgacgcggcggcggccccacgttcgtcgaggctgtcagctaccgtatgggcccgcacaccacggcggatgacccgacgcgctaccgtgacgccaacgaactcgaggactgggcggccagggacccgatcacccgcgtcgccgcgctcctcgagcggaagggcctgctgacggaagacctgcagcagcaggtgaaggacaaggccgacgccgtggcacgcgagatgcggacgggctgcaccaccatgccggacccggagcccctggacgtctttaataacgtctacagcacgcccaactcctggctggaccggcagcaggaccactacgcccgttacctggccaccttcggtgatcccgcaggagccgtttcagaagaaggtgcacgctgatgacccagatgacctttgcccgcgcgatcaacgcgggcctgcggaagtccctggagaacgaccccaaagtcgtgctcatgggtgaggacatcggcaccctcggcggcgtgttccgggtgaccgacgggctgcagaaggacttcggcacgcaccgggtggtggatacccccctggccgaatcggccatcgtaggcaccgccgtcggcctcgcctaccgcggctaccgtccggtggtggagatccagttcgacggattcatctatccggcattcgaccagattgtcagccaggtggccaagctccactaccgcacccgcggggcagtcaagatgcccatcaccatcagggtcccgttcggcggcgggatcggctcgcccgagcaccactcagaatcgccggaggcctacttcacgcatacgtccggcctgcgcgtcgtcaccgtgtccagcccgcaggacgcgtacaccgtgatccagcaggccatctcctgcgacgaccccgtgctctacttcgagcccaagcggcggtaccacgacaaaggcgacgttgacgagtcccttgaccacaccgcgcccctgcccatgggccaggcgcgcgtcctcacccaaggcaccgacgtcacgctggtggcttacggcccgctggtcaagacggccctggacgctgcgtcggccgccgccgatgaaggagtctccatcgaggtcatcgacctgcgctcgctggcaccggtggactacgaaacgattgtggcctccgtccgcaggaccgggcgcctggtcatcacccacgaggccgcacaatcgggcggcctgggggcggaagtggccgccagcattaccgagcggtgcttttaccacctggaggcggcacctgtccgggtcacggggttcgatattccctacccatactcaaagcttgagatgcaccacctgccgggcctggaccggatcctggacggcgtggaccgtgccctgggccggccgaactcccttagcgggctggaaggatgagcgggaccatgatcaaggaattccggctgccggacctgggcgagggcctcaccgaatcggagatcctcagctggaaggtgggggtgggcgataccgtctcgctgaaccaggtaatcgccgaggttgaaacggccaaggcagtggtggagctcccgtccccgtttgcaggggtcatcaaggaactccatgaacagccgggcgccgtcgtggaggtgggcaagccgatcgtctccttcgaggtggcggacgacgccggcccggcaccttccagggcaggcggccccgccgcttcggtcaaggatgagggcaagggcgtggaggatgcggcggggcaggcagcgggggagagctccgccgggacccccaggagggagccgaacctcgtgggctacggtgccgtcgtcgaaagcaccggccggcccgcacggcgcccgcggaccttcccggcacacatgcctgccgacgcgacgcccgcggcaaccatgcccgcggcacaccggcctgcagacaccatgtccgcggagaccacccgtggcgtagccaaaacccctgcgaatgagcacgccgcagctgcgtccgaccagcccgcaggcgagcgtccacggtccaccccgcctgtccggaagctggccaaagacctgggcgttgacctggccagggtcaccggtacaggaccccagggactgatcacccgggaggacgtccagcacttcatggacggccagtcctcggacgcagagtggcccggcgcggttgccgcggaccgtgcgggcgtgcaggccggccagagcgcgcgggaaacgcgcaccgccatcaagggtgtccgcaagttcacggccgccgccatggtgcagagtgccttcaccgcgccgcacgccaccgagttcctcactgtcgacgtcacgccgtccatggaactgctggccaggctcagggacagcagagagttcgcgggtgtcaagctcacgccgcttaccctgacggcgaaagcagtgctgatcgcactccggcgcagtcccgccctcaactcgcgctgggacggggagaaccaggagatcgtcaccttcaactatgtgaacctgggtatagcggcggccacgccgcgggggctgacagtacccaacctgaaggatgcggattcgctgtccctggtccagctggcagaagcgctttcggcgctcgcggagacggcccgtgccggcaagaccactccggccgacctcgccggaggcaccatgtccatcaccaatatcggtgttttcgggattgacgccggcacccccatcctcaaccccggcgaagcggcgatccttgccctgggagccgtgcgaaagatgccctgggagtaccggggggacattgccctgcgccaggtgatgaccctcagcctgtccttcgaccaccgcctggtggacggcgaacagggctcacggttccttgccgacgtcggtgccatcctcgctgaccccggcctggtgctgaccatggtgtgaccccccgagtttttgtccagatacgcagggttccaaccggtttaagcctgcatatctggacaaaaactccggccttcagagggtaattggggagttcaccagcagcgcggccacggccatgctctcgagcaggggccgggcagttccggacgccatcttccggccgtggctgcgcacggagtggggggtggagttgatgagcccgaacgtggcatgggcccgcatccggagctccgaagcgtcggtctcgggatggagccccgcgaggacctccacccacacctccacatagctcctttggagggtcctgactgccgcctggtcctcatcggagaggcagctgaaatccctgtcctggaccctgatgacgtccggcttgctcaacgcgaagtccacctggaacgccaccaggccacgcagtgccgccaggggatcggcattttctgccgccacccggcgcccgccgtccagcagttcctggctgacggtaacaagcaggtccgccaggaccgcctgcttgccgggaaagtggcggtatacggccgggccgctgacgccggcggcagcccccagatcctccagggagacacggctgaacccatgcagtgcaaacagcgaagctgcagcggacaacagcgcctggcggcggttctcctttgcccggctccgctgtgttgggctgccgggctgggtcgtgctgctggccgcagcggcgtcagtgcttggcacaattcctcctcggaccccggaagtctagcaaggcagctgttgtgttggacatcacagttaatcgagactaacctgaatttcagttattgagtactaaccgagttggcttatcgcctcgggccggaacaggaacaggacgcgtcgatggagacccttgccagcaggatcgaccccgccagcagcactttcctggcaaaccgcgaagcgcagctgctgctgacggaggacctgcggaaaaggctcgcagacgctgccctgggcggaccggaaaaatcgaggcagcggcacgtggcccggggcaagctcctgccccgcgagcgcatcgaccagctcctggatgacggcagcccgttcctcgaaatcgctccgctggctgccaacgggatgtacaacaacgaggcccccggcgcgggggtcattgcgggcatcggcctggtccatggccgccacgtgctggtgatttccaacgacgccaccgtcaagggcgggacgtactatccgctgacggtgaagaagcacctgcgggcccaggagatagcccttgagaacaggctgccgtgcatctacctggtggattccggcggggccttcttgcccaaacaggacgaggtgttcccggaccgggaccacttcggccgcatcttctacaaccaggcccggctctcagcggccaagattccccagatcgcctcggtcatggggtcctgcaccgccggcggcgcctacgtgccggccatgagcgacgaaacagtcatcgtccggaaccagggcaccatcttcctgggcgggccgccgctggtgaaggcggcaatcggtgaaatcgtcacgccggaggagcttggcggcggggacgtgcatgcgaggatctccggcgtcaccgaccacctcgccgaaaacgacgaacacgcgctgcagatcatccgggacattgtgtctacgctcccgcctccggcgccgcccgcgtgggaggtggatgccgccgtcgaaccttccgcggaaccggcggagctctacggtgccgttcccacggacgtcaacgccgcctacgacgtccacgaggtcatcgcccggctggtggacggcagccggttccacgagttcaagaaggagtacggcaccacgctggtcaccgggttcgcacggctgcacgggcacccggtggggatcgtggccaacaacggcgtgctcttcagcgaatcctcccttaaaggcgcccacttcatcgaactctgcgaccagcgcggcatcccgctggttttcctgcagaacatctcaggcttcatggtgggcagggattcggaacagggcggtatcgccaaaaacggggccaagatggtcaccgcagttgccacggcccgggtgcccaagctgacagtggtcatcggcggctccttcggcgccggaaactactccatgtgcgggcgggcctattcgccacggttcctgtggatgtggccggcagcccgcatctcggtgatgggaggcaaccaggcctcgagcgtcctcgccaccgtcaagcgggaccagtttgaagcggccggccaggaatggtccgccgaggacgaggaagccttcaaggctcccatccgccggcagtacgaggaccagggcagcccgtactactccacggcccgcctctgggacgacggcgtgattgatccggccgatacacgcaccgtcctgggccttgcactggacgtggtgtcccggacaccactgccggaaacctccttcggcctcttcaggatgtgagcacgcccatgactaccccttccctgaccggcatctccaccggcagcacgcccatgttcggcaccgtcctggtggccaaccgcggcgaaatcgcctgccgcgtgatccgtacgctcaaggtgctgggcatccgcgcggtggccgtctacagcgatgccgacgccggcgcccggcacgtgcgcgaagcggacaccgccgtccggatcggcccggcagcggcatcggagagctacctgaaaatcgaggccatcattgaggcctgccggaggagcggggcggaggctgtgcaccccggctacggcttcctcagcgagaacgtggaatttgcccgggccctggaacaggcggggatcgcgttcatcggcccgggtgtggaagccctgaacatcatgggggacaagatccggtccaagaaccatgtggccggctacggcgtccccgtggtgcccggcgtggcgaaaccaggaatgacggacgagcagctggttgacgcggccgcggacgttgggtttccgctgctgatcaaaccgtccgcgggcggcggcggcaagggaatgcatgtggtccggcgcccggaggacctcgaggcgacgctggccaccgccaggcgggtggcggccagtgctttcggcgacgacaccctgttcctggaacgcctggtcaccaccccgcggcacatcgaagtgcaggtcctggcggacaaccacggcaacgtcatacacctgggcgagcgtgaatgttcactgcagcggcggcaccagaaagtcatcgaggaggcgccgtcgccgctgctcgaagccttgccggacggcgccgccatccgcgcccgcatcggtgaagcggcctgcaacgcggcccgcagcgtgaactacagcggagccggaacggtggaattcctcgtctccgacgacgcgccggaccagttttacttcatggagatgaacaccaggctgcaggttgagcaccccgtcaccgagatggtcaccggcatcgacctcgtcgagtggcaggtgcggatcgccgccggccagggactcaccgtccggcaggccgacgtcgaacttaacggacatgctgtggaggcgcgcgtttacgcggaggtccccgaaaaaaacttcctgccctccacggggacggtgctcctcctccatgagctgcccggcccgcggcagcggcccagcgcgtcggaacgcaccgaagtagcggccgcccgcggcagggtccgcgtggattcatcgctaatcgaaggactggagctctcgtccagttacgatccgatgatctccaaggtcatcgcctggggcacggaccggaccgacgccctggacacgctggacgaggcactcacggggtacacggccctgggcgtgcacacgaacgttgagtacctccgcctgctggttaacgacggcgacgtccgggctgggcggctggacaccggcctgatcgagcgcaggatgccggaactcgctttccgccgggcaggcgtcttcgaattcgtggcagccgcgctctacgcggccgagctggaacgccaaaacaccccgctcccgccagccggcccatggcagcggcaggacggctggcgggtgggcagggcagcaccgcggcgcatcagcatcggaacgcccgacggcggcgtggccaacgtggcggtcagcagcctgcaggtgccggagggcttggcccgggactccgagccgatccaggcatccgtccaggtggacggcggtcccgtgcgtggggcctcgctgtccctcgcatcacggagcagcctccggctggagctcgacggcgaggccagggagtactcgctggctccggtctacaccgggccggcgggccccacctggaccaacccgctgcccggcgctccgtcggaactgttcctgggccatgggggctggtcctgccggctggacgtactgagccgggaagcgcggcttggacgggtgcttgcggtcctccagcgggaggaaggggccaccgatcccgcggtgcgttcacccatgccgggaacagtggtttcagttccggtcagtgacggcgacaccgtggcggccggccagcttctcgtctcggtcgaggccatgaagatggagcaccagctggtggccccgctggacgggaccgtccatctcagcgcccgccccggcgacctggtgaaggcggaccaggtgctggccaccatccacccccacaagaccgctgcaagcgaagctacagacacggatgcagccacagacacaccaaatggcgaaggagcctagacatggcaggttttgaactcagcgaggaataccaggacctcagcgacacggtccgggactttgcggacaacgtggtggcgccggtgtccgcgaagcacgacgaggagcacagcttcccgtacgacgtcgtcaagcagatggctgaaatggggctgttcggcctgccctttcctgaggaatttggtggcatgggcggggactacttcgcccttgcccttgccctggaacagctgggccgggtggaccagtccgttgccatcaccctggaagccggcgtctcgttgggcgccatgcctatctaccgcttcggcacggacgcccagaagcaggagtggctgcccatgctcgcgtccggccaggcgctcgccggattcgggctgaccgaaccggaagcaggatcggacgcgggcggcaccaaaaccacggcacggcgcgagaccgtcggagacaagacaaagtgggtgatcaacggcaacaaggagttcatcaccaactccgggacggacatcacgcggctggtgacggtcaccgccgttaccgggcagaaggagcgcggggacggcacggtgcagaaggaaatctccaccatcctggtgcccacggaaacccccggtttcaaggcggaaaagccctacaacaaagtgggctggaacgcctcggacacccacccgctgacgctgaaggacgtccgcgttccggaagaaaacctgctgggagcggaaggccgcggttatgcaaacttcctgtccatcctcgatgaagggcggattgccattgcagcgctggctgccggcgcggcccagggctgcgtggacctctcggtcaagtacgccaaggagcgcagcgccttcggccaccagatcggcaagtaccaggccatatccttcaagatcgcacgcatggaggcccgtgcccacaccgcccgcctggcctactacgatgccgccttccgtatgcttgccgggaagccgttcaagacccaggcggccatcgctaagatggtcgcaggcgaggcagccatggacaacgcgcgggatgccacccaggtattcggcggctatggcttcatcaacgagttcaccgtggcacgccattaccgcgactccaagatccttgaagtgggggagggcaccacggaggtgcagctgatgctgatcgcccgcgaactgggtctgtagtactggccctgtagtaactggcaccgtagccggcctgagaggatcactgatgattgacaaggttgttgccagcgctgacgaagccgtagcggacataccggacggcgcctccctggccgtgggcggtttcgggctctgtggaatcccggtcaccctcattgacgcactgcaccgggcaggcacaacagacctggaaaccgtcagcaacaactgcggcgtggacgactggggactcggcatcctgctccgggacgggcggatccgccgcaccatcagctcctacgtgggcgagaacaaggagtttgcacgccagtacctggccggtgaactggaggtggtgctcaccccgcagggcaccctggctgagaagctgcgcgccggcggcgccgggatccccgccttctacaccaaggcaggggtgggcacccaggtatcagagggcgggctgccccaaaagtacgacgccggcggcgcgattgccatggcctccgcacctaaggaggtgcgctccttcggcggggttgactacgtgctggaggaagccttgaccccggatttcgggctggtccatgcctggaaaggggaccggcacggaaacctggtctttcacgccaccgccatgaacttcaaccccctgtgcgccatggccggcaggatcaccattgccgaggtggaggaactcgtggagccgggcgagctggacccggaacacatccacaccccgggcatcttcgtccagcgtgtggtcctcgcagccaacgcggagaaacgcattgaaaaacggaccgtggccctggcccggcccggacaggcagcatccgcacaagaggccggcagcgcccggcaggcaggagcatagccatggaccccaacagcccctacgcaccccggcccgaaggcgtgcggcccgaataccgccgggccgcggcccagcagcacgagatgccggctgacggagccggcgccaaagggtggacgcggaacgaactggccgcccgggtggccaaagagctcagcaacggccagtacgtcaacctcgggatcggcatgcccaccctcatccccaactacatccccgacggcgtggaagtggtgctccactcggagaacggaatcctcggcgtcggaccctatcctgcggaagatgccgttgacccggacctcatcaacgccggcaaggaaaccgtcacggtgaacaagggcgccgcgttcttcgactccgcttcatccttcgggatgatccgcggcgggcacgtggacgtggcggtcctgggcgccatggaggtggccgcgaacggagacctggccaactggatgattccgggcaaaatggtcaagggcatgggcggcgccatggacctggtgttcggcgccaagaaggtgatcgtgatgatggaacacgtggaccgcaacgggaatcctaagatcgtccaggaatgctccctgccactgaccggcaaagcctgtgtggaccggatcatcacggacctggctgtgatcgacgtcgtgacggatgagtacggttcccggctggtgctgcgcgaactggcgcccaacgtgtcagcggaggacgttgccgcggccaccggggctgagcttttcgaagaggaccaggaactgaccgtatgagcggcggcggtatgggcggcggcgctgcgacgggcccggccagcggggagccgcgggtgatcgaacagcgcggactgtacttcgaggaactggaagaaggggtcacgtacgcccaccgacccggccgcacggtgacagaggcggacaacgtcctcttcaccacgctcaccatgaacacccaggccctgcacctggatgccgcctggagtgccggtcagcccttcggccagcggctcatgaactccatgttcaccctggccaccatggtgggccagtccgtttcccagctgacgcagggcaccatcattgcccagctgggcctggcggatgtctcgttcccgcatccgctctaccacggcgacacgctctacaccgagactgtgatcagcggaaagcgtctctcaggctcccggcccgggcaggggatcgtcaccatggagcacacgggccgtaaccaggacggcacggtggtggcacttgccacgcgaagctgcctgatgtggacgcgggaagcccgtacgggccagcctggagggcaggggaacggacaggagacaatgccggtatgacttttgtgatgggccccgccctgctgttctgccccgccgaccggcccgagcgctaccagaaggccgctgcccgggcggacgccgtcatcctggaccttgaggatgccgtggcagcagcggacaagcagcgtgcccgcggcgccatcctcgcccagctggggaccaccggggtggagccggagcttgaacccagctgcactatcgtgcgggtgaatcccgcgggcaccgaggaatttgagaaggatcttcactgccttacccataccccctaccggacggtcatgctggcgaaggcggaaacggcccagcagctcgaagccctggagggctacaaggtcatcgcactgtgtgaaacggcgctgggagtcctcaacgccccggccattgcagccgcccccaacgtggtgggccttatgtggggggcagaggacctgctggcatcgctgggcggcacgtccagcaggaaggccgacggcgggtaccgggccgtggcgctgcacgcccgttccgccgtgctgctggctgcgcgcgcccacggcaaggaggcggtggatgcggtgtacacggacataccggaccttgccgggctggaggaggaagctgccgatgccgtggcctccggcttcagctccaaagcgtgcatccatccgagccaggccgctgtggtccgggccgcctacgcaccttccgatgccgacgtcgcggctgctgaagcgctcctggaggctgcagcgtcggccggctcgggggtgttccagcaccaggggaagatgatcgacggtcccatcctcaaacacgcccaggaaatcatccgccgcgcccaggccaccggttagccggccttcccggagcggcccccgtcatcccatccgcccgggcgagcgccgcagtgacaacggcggaataggctcgtagagcagcgtccgcacccaacggttcccggtctccctgaactctttccggccggcaaagcggtagtggtagctgcgcacacgcacccagcgcggcggcgcgccgtcgaacgggtcatggcggaggagccgcagggtctgccggtccgcctccagcagctttcccaggaaggcgtagaaccactcctcgtggacggtccttagcggcaggaaccacatcagccagtcaagccgcaggtggtagggcgcccactggcgggggagcctgcggacatcgccgggcttgcccctgaagccgtactcccgccagccggaggcgctgtccggatcctcgtcgagggttccctccaccacaatttcgatccgctgcttggttacggtgccgaacgccccgtaggtattcaccagctgccaccggttgaagctggcattcatcagctggccgcgggagaaaaggttgcgcagcggccagtagctgaggaccaccagcagcagcgttgccgccagggtgacggccagccaccacagaggagtctccctgtctgcgccggcctggccgtgccagtccagggggatggccggcagcacggcgtgcgcaacgggatcgctgacggcagcgaaagccagcacaatggcgatccagttcagccaggcgaagttgccgctggccaccagccacaattgggtgaaaatgacgatccccgcggccacgccggcaacgggctggggcgcgaacaggaaaaacggcaccaccagctgggcgaagtggttaccgatgacttcaaccttgtgcagcggtttcggcaggagatgcgcctgccggctcagcggccccggcatcggctgggtctcgtggtggtagtacagggccgtcaggtcccgccactcccggccgccgcggattttgatcattccggcaccgaactccagccggaacaccagccacacgatcaggatcaggatggtgcgcggcggatctgtctggtccgagcccaggaaggccacggtaaagccggcctcaaggagcagcatctcccagccgaagccgtagaaggtctgccccacgttgacgatggacatgtacagcagccacagggccaaaaatgcgatgagcggaacccagggcgggccctgctgcgggatgcccgccaccaggagcgccgacaccagcagcccggtggcacacacccagcgcagcagcctgtccgaataccgccagcggaacagggacggccgccgcaagcggctgaaaccggaaaggtgttcgggtaccggaaggaggccccgctcacccaggagcgccgggaactggttcagcgaggacaggaacgcgacaaagtacagggccgccacaccccgctgcagcacctgccgcgcgaattcgtattccggcgcatcgaaccaggagagccagtccacgcactccacgttacgcccggctcccgcagggatgccacaggtggacacctggggcatcacaccaataagttgccactaggatcgagggatgttcgtgctggtgctgatcgccgtcgttgcaggcgcgctggcccagcggatcgcgggcctgggctttgggctgctcgtctccccggtgctggtggtgctcctgggccctttcgacggcgtgatgatcatcaacctctgcggggccacgtcatcgctccttatcctttcccgggtgtggcggcacgtggcctggaagaagtacttcgggctggcgctcgcagcactggccggcgtactgcccggtgcctggctggcgagcaacgtgccggaggccccgctggaaatctgcatcggcatcctgctcatcatcgccctgctcgcgtcccagcggctgaccaggagttcctggcgtgccagcggcccggtgcccatggcctccctggggttctccagcggcctgatgaatgcagccgcgggtgttggcggtcctgccatcacggcctatgccattgcctcccgctgggagcagaaaagctttagcgccaccctgcagccctacttcatcaccaccggcttcacgtcgctgctcagcaagtacgtgctgtccggcgggcacgtccctggcttggaaggctggcagtggctggcgatcctggcggcgatggttacgggcatcgtcgcgggcgacctgctggccggccgggtacgccccgcgtccgcccgccgcattgtcacggtcattgcctacctgggtgccgtggccacgctggccaagggcctggtggaactcgcggccgcctgagtacttggcccggtgcgccggcctgcataaacatgttttgctggacccatgacacgtgttgcagtggtaggtgcagggatcgtcgggctgtccacagcccacgcgctccgaaaagcaggggcggacgtcaccgtctacgagtccgggaccccgggctcaggacagtcggccggggagtcgaggatcttccggcacgcccacgacgacgtccggctggccgcgtttgtgagccacagccgcacgctctggcgggagtgggaggcggagtttggcgtggaactggtctccggtgccggtgcggtggctatcggggacagcgtggaggacaagctccgcgttctcagcggcctgccggagattcccgtgaagctgctggcacctggacaacttgcggccgcgctgccggtcctcgcggacttccagggcaaggcgatgctcgatgcccacggcggggcaatccgcacccgcgccgcgttccgggccctggccgggaatctggaagacgccctcgtggcggaccacgtgcttgctgtccggcccactgccagccggggtgtggaggtcaggaccgggacctgcgtggaccggttcgaccatcttgtcctgtgcgccggacgcggcacggcagccctggcgcggggcgccggactggacatacccgttgaactcgccgcgcacgcccgcgtgacgttccgcgtgcgggatgatgtgcccgccccgctgccaacattccaggacggcagcggggtattcggggaaaccggcgtttatgcggcgccctcggccgataacctgcgttactcggtgggcctgagcgaaacaaccgaagtgcgccaggacgggagcctcgccgacccggctgctttggagtcgctgtcggcccgtgcggcatcctatgttcggcgtgccctgcccggcctggatcccgaaccggccggctacgtccactgctgggtgacgcggctgccgtggggagatgacggcgtgggcatctggtctgccggcagcgtcagcgccgtggccgggcacaacctcttcaaacaggcaccggcactgggggaggcgctggcagaaacagccctgtccggcgtcgtccccgctgtcctgcggccggaatcacagctcggaaggtcttgaacggccgggcaccacggtgcgcgatacttaagcaatgcagccacgcagaatcgtcctcctcggatccaccggttccatcggcacccaggcgattgacgtcgtcgacggcgccccgcacctttttgaggtggtggccctcagcgccgggggaggcaacctggagctcctcgccagccaggcggtgcacaccggcgcgtccgtgatcggcattgccggcggtgaccccgcaaagctggcatcgctggtggccgacgctgccgcggcggcgggaaagcccggctaccgtccggagatcatcgccggaccggacgcctccacgcggatcgccggcgttgaggcggacgtggtgctcaatggaatcaccggctcgattggactggcgcccacgctggccgccctgcgctccggcgccacactcgccctggccaacaaggaatccctcattgtgggcggatcgctggtgaaggctgccgcccgggaagggcagatcgtacccgtggactcggaacattcagcgatcgcccagtgcctgcgctcgggctcggccggggaagtggaaaaactgatcctgaccgcctccggcggccccttccgcggcaggaacagggacgaactgcacggggtcaccccacaggaagccttggcccaccccacctgggacatgggcgtcatggtcaccaccaactcggccacgctcgtcaacaagggcctggaggtcatcgaggcgcacctgctcttcgacgtgccgctcgaccggatcgacgtggtggtccatccccagtccgtggtgcactcaatggtgcagttcatcgacggttccatcatcgcccaggcatccccgccggacatgcgcctccccatcgcactggggctgggctggccggaccgggtgcccaaagccgcagcggcctgcgactggacgcgcgcggccacctggaccttcgagccgctggacacggaggcctttcccgccgtcggactcgccaagcacgcagcggggcagggcagcacgttccccgccgtgttcaacgccgcgaacgaggaagccgtcacagccttccacgccgggcgcatcaggtttaccgacatcgtggacacgatcgatgccgtcctcagcgaacacccagggtcctccgggctgacagtggagtcggtgctggatgctgaaagctgggcacgtgcccgcgccaatgaacgtttagcaatcagaagtctctaggaagcagcagcacgtcaatgacccccgtcctcctttttgtcctcggcgtcgtctttgtggcgatcggcattgccgtgtccattgcgctgcacgaagtggggcacctggtgcccgccaagctgttcaaggtccgcgtcaccaaatacatgatcggcttcggccccaccctctggtccaggcggaagggtgaaaccgaatacggggtgaaggccatcccgcttggcggcttcgtgtccatgatcggcatgtacccgcccaacaaggacgacggctccgtccgcccctccagcaccggcatgttccagaccctggccaccgaagcccggtccatggcccatgaggaagtggggccgggtgacgaaaagcgggtgttctaccggcttccggtctggaagaaggtcatcgtgatgctgggcggcccggccatgaacatggtcctcggcgtgctcctcaccgcggtcctgctcatgggctttggcatggccacggccaccaccaccatctccgaggtgtcaaaatgccaggtggcggcaggggagaccgtggatccggattcggcggactgccagcccacccccgctgccgccgccggcctcaggcccaatgacaggatcacctccttcgacggcaaagccgtgaccggctgggaccagctgacggaatggatccgggcctccgcggggcgcgaggtgggcattaccgttgagcgggacggcgcccaggtgtccaccacggtgaccccggtgctgtcggcccggcccgtcatcggagcggacggccgccaggaaacggacgacgccggcaccctccgctaccaggacgtcggcttcctgggcatcggctcccagaccgaacttgtggcccagccggcgtcgtccgtcctgcccatggcgggggagaacatccgccaggtggcaggggtggtgttcaacctgcccgcccgcgtggtgggtgtggcgaaggctgccttcagcgaggaaccccgcgaccccaacggccccatcagcgtggtgggcgtaggacgggtcgccggggaagtggccgccatggaagaaatcccggtgcagtcccggctggccgcactgatcgggctgcttgcgggccttaacttcgcgctcgcagtcttcaacctgataccgctgctgccccttgacggcggccatgttgccggtgccctgtacgagggggcgcggcgccgggtggccaagctgtttggcaaacctgacccgggcgcgttcgacatcgccaagctgctgccggtgacatacgtggtggccgccttactgatgggcatgagcgcgctcctcatctatgccgacatcgtgaagccggtgaacctcttcggctgacactggtcctccatccggacggatgccgtgcagccacttcagggaaggcggtcacatgaagccgcaggacaccggccgctggatccgcgcgggactctgggcgctgcctgcatcctggcttctcacggcgtggtcttccctggagccccagccggaccaggagattgatcccggcgcctgggcccggtttgtcagttcggactcctaccaggtcagccacctcatcggcagtacgggaggcaccatcctggccgtcttcgggctttttgcactgggctgccacctggcgggcagccggtccgggcgcctggcactggcagcaatggtcacggcggctgccggtaccgctttgctgttggtcccggcagtaatttccacgtttgtaactccggccgtggggagggcttacctggcgggaaaccaggatgtcatgcagctcgacttccctggatcgatggcggcggcgtttatggccgggctcctgcttgcctttgttgggactgtcctgctcggcgtcgcggtctggcgttcgcgcatactcccgcggtgggcaggagcgctatgggtggccggcgccgtcctgttctatgccctcggggtggttgtggggcaggcgacaaccgggagcagcctgccgacccaaagcgccggggcagctctgttggcagttgccggcggagggatggcctggcacagttcaggccggggtgcacgggagtaaccccctgcaggctgactgcacaaaatcagcctatttcggctgatataaaataatcagccaaatatgtttgattattagtcatcagctgcgtacggttagggcatgtacgtcctcacgatcgaccagcagggcagcacttccgatgttgaccgggtcccggacctgatcgccgccctgcgggaccttacgcccgtgccctttgagcgttcggtaggcgacgaactccagggggtggtggaacaggcagccgatgtggtggatgtggcgctgcatgcgctccgcggcgggcactggtacgtgggcataggaatcggggcggtggagttggcgccaggtgccagcccgcgcgagggttccggaagcggtttcgtggcggcccgcaaagccgtggaactcgccaagggcgccgccggccaggttccattgtcagtggtgtccggcacgatggtccggagcagggatcttcaacaccatgccggggaggacgccatggccagcgccaacgcccaggcggtgcttcggctgatcggacgcctggtgcagcagcgcaccgaggcccagtggcgggtggtggacgggctgcgggccatccagggtgaagccaggcatggcagccagaagcaggtggcccgggagttgggtataactgaacagtcggtgagccgtgcggtgctgaggtccggatggcaggaagaatgggcggcgaggccggcagccgccatgctgctggactatgcccgttccctggttgcccgcacttcaacggaaggaaaacggtgaacgtactctggattacggttgcgctgctcgttgccggattcgccgggtggccagtcaccgcactggtgttccggctggccaggacaatcgatgacagggcggacgcagccaaggctgcggtggacgccaagagggccgccgacgatccgtccgcggatgtgaccgttgacctgccgcaagccggcgggtcccagggcgtcgacggcgagttgaccgcagctgccgacgccccgccgtcgggcctttccggctccggaccagccgctcccgcccagcggatccttcggggcggtgccatcatcggaatcctcgagcggctgggtgtgtgccttgccatcctcaccggccagccggtggccatcgcctacattgtggccatcaagggcctgggcaggtttgcggagcttaaggaaacgccggtggcggctgaacgtttcattattgggacgctgacgtccatgctgtgggcggcaggaacagccgcagccatcaaggtcctcttcctggcctgagcgcaggcatcccgttccgctgccaacccgcccctccggccaggcgcgtccgcactccggatgggtgcgaacgcaggcaggagatagggtagcggtatgacagtttttgccgttgagtacgtttatgccgccgattccacagaagaccgcaacgccgcccgggcagcgcaccgcgaatggctctcgggccttgcgcaggacggtgccgtccttgccagcggaccatacggtgacggggccggcgcgctgctgattttcaagacagcagacgaggccgccctcaactcgatcctcaagcaggatcccttcgccgctgccggagtcatcgccgggacccgcatcacggagtggtcacccatcatcggcgtgctcgccggcctcaccgcataagccgccgccctttttcaatctctaggagtcctcgtgacctcggtcagcctgggaatgccctcagcaccgccacccgtccttgccccccgccgcaagacccggcagatcaaagtcggttccgtgggcgtgggatcggactcgcccatcagcgtgcagtccatgaccaccacgcccaccacggacatcaacgccaccctgcagcagatcgccgaactgacggcgtccggctgcgacattgtgcgcgtggcctgcccgtcggccgatgacgccgaggcactgccgatcatcgcgcggaagtcgcagatcccggtgattgcggacatccacttccagcccaagtacgtcttcgccgcgatcgaggccggctgcgccgcggtacgcgtgaacccgggcaacatccgcaagttcgatgaccaggtcaaggaaatcgccgctgcggcccgcgatcacgggacgtccatccgcattggcgtgaacgccggatccctggaaccgggcatcctcaaaaagtacggcaaggccacccctgaagcgctggtggaatctgctgtctgggaagcgtccctctttgaggagcatggtttccacgacttcaagatctcggtcaagcacaatgaccccgtcatcatggtggcggcctacgagatgctggcggaaaaaggcgactggcccctgcaccttggcgtcactgaggccggcccggcgttccagggcactatcaagtcggccacggccttcggcgcactcctgtccaagggcattggcgacaccatccgggtctccctctcggcaccgccggtggaggaaatcaaggtgggaaaccagatcctgcagtccctcaacctgcgcccccgcaagctcgaaatcgtctcctgcccctcctgcggccgcgcccaggtggacgtgtacaccctcgccgagcaggtcaccgccgggctggaaggcatggagattccgctgcgcgttgccgttatgggctgcgtggtgaacggacccggcgaggcccgcgaagccgatctcggtgttgcctcaggcaacggcaagggccagatctttgtgaagggcgaagtcatcaagactgtccccgagagccagattgttgagacactgatcgaagaggccatgcgtatcgcggaagagatgggggaggccgatggcgaagatgctgtcaagggtagccccgtggttagcgtctcgtaaggacgtccccgacccgccggggatttccgtccgcacccttgacggggacgacactgctgccttggtgctcctggcgcagcgtgatcctgttgccaacgtgttcatcctcgcgcacctgcgcgcagctggcaccgccgctcccaccagcggcggtgcaggcgtcctgggcgtgttcgacgacggcgtcctggcaggtgcgtgctgggccggggccaacctggtgcccgttcagcttgatcccgccctggccggagtagtggctgccgccgccaacaggtccggacgccgctacgcatccgcctttgggccggccacggccgtgctcgccctgcatgccgaactggttgaactgggacaccgggcccatgaagtccgcccggaccagccgttgatgaccatcaacgaaccgccgtccgtggagccgaacccggggctggggctgggaaacctcgcggacttcgaccgtatcctgccggcctgcgccgccatgttcgaagaagaagtggggtattcacccttcctgggcggccgggaattctacagccgccgcgtggaaggcctgatccggcaaggccactccctggtgcatctgaacgaagcccgcgaggtggtgttcaaggccgaactcggtgccgtcacctcggatgtcacgcagatccagggcgtctggatgaacccgctgtaccggggccagggcctgagcgccgggtacatggcgtccgtggtggagcaggcgcggaagatcgcgcccgtcaccagcctctacgtcaacggcttcaacgcccgcgcgcgggctacctacgagcgggtgggcttcagccaggtggggaccttcgctacggtgctcttttaggcgcctgtgctctaagtgttctttcccaggcttcgcaacggtgctcttcttgccagggatatgggcagcacttgtcatcgtgcgctgcatcacataggttcgatctagctgcgctggagtggcgtgggcggtctcaccagtcctcaccagtacttgggcgataacggcgtcgagccacgcccggatgcgatgaccagcctcttggggggccaggggctttgcatgtccgggcgtggctcaactgcgttccgggctgttctgcaccgggtgtatgcggggcggcgcccgtcagggaaccgggccgccggaaaaggccccacaagccggtagattagtacccagacgaaaatgcccggcttgctgttgctccagcacctccccagaaacggatacccacccgtggttacacgactgtcccagctgttcctgcgcaccctgcgtgaagatcccgtcgacgccgaggtggcaagccaccggctcctggtccgcgcaggctacatccgccgcgccgccccgggcatctacacctggctgccgctgggattgagcgtcctgcgcaaagtggaagccatcatccgcgaggagatggccaacatcggcgcgcaggaagtccatttcccggccctcctgccccgcgaaccgtacgaggccaccaaccgctggaccgaatatggcgagggcctgttccgcctccaggaccgcaaaggcgccgactacctgctggctcccacccacgaggaaatgttcacgctgctggtcaaagacctgtattcgtcctacaaggacctgccgctgagcctttaccagatccagaacaagtaccgcgatgaggcacgaccccgcgcgggcctcctgcgcggacgcgagttcatcatgaaggactcctactcgttcgacgttgacgacgccggcctggacgccagctacgccgcccaccgcggcgcctacctgcgcatcttcgagcgcctgggcctggaagtcattcccgtcaccgcgacggccggggccatgggcggctccaagagcgaggaattcctgcaccccacggacatcggcgaggacacgttcgtgcgctccgccggcggctacgctgccaacgtcgaggccgtcaccacggttgtcccggcggacatcgacttcagcgcggctcccgccgccgaggtccgcgacaccccggacacccccaccatcgacacgctggtggccgcctccaaccagatcgccccccgcagcgaggccgacggcggctcatggactgccgcggacacgctgaagaatgtggtgctcgccgtcaccctgccaaccggagagcgccagctggtagtcatcggccttccgggcgaccgcggcgtggacctgaagcgcgtcgaggcaaacatcggctcgttcctgcccatcggcggcgaaattggcctggaagcggccaacgatgacgacctcaagaagcagccgctcatcgtcaagggctaccttggccccggcctgtccctggacgagcccctgctcggcgcagaaagcccaacgaaactcctgtacctggtggacccccgcgtggtccaaggcacctcctggatcaccggcgccaaccaggccggcaagcacgtgtacggcctggtggccggacgcgacttcacgtgggacggcgtcatcgagtgcaccgaggttcgcgaaggtgatccggccccggacggttccggtccgctggagaccgcccgcggcatcgagatggggcacatcttccagctcggacgcaagtacgcagaagcgctggaactgaaggtcctggaccagaacggcaagcaggtcaccgtcaccatgggctcctacggcgtcggcgtcacccgcgccgttgcagcactggccgagtcgaaccacgacgccaggggactcgtctggccgcgggctgttgcccctgccgatgtgcatgtcgtcgcggtgggcaaaggcgaggagatcttcgcgaccgccgagcggctggcagccgaacttgaggcagcagggctcgacgtcctcctggacgaccggcccaaggtatcgcccggtgtgaagtttggggacgcggaactggtgggcgtccccaccatcctggccgtcggccgcggcctggtggacggagttgtggagatcaaggaccgccgcagcggcgatgccgagaacgtggcggtggacaaggctgttgactacgtggtcaacgctgtccgcaccaactgacgtaacggtggagttcggactcgaatccctcgggctgacaactctccttttgatcgtgctggccgggttcgccgccggatgggttgatgcagtggtgggcgggggcggtctcatccagctcccggccctgctgctggtcccggggatcacccccgtccaggctctggccacgaacaaaatggggtccatcttcggtaccgccaccagcgccgccacctactaccggagggtggggccggaccttaagacggccctgcccatggccgcgatcgccctggcgggcagctttggcggcgccgtcctggcggcaaacctgcccgccagcgtattcaagcccatcatcgtcacggcgctggtcgccgtcgcgcttttcacagccctgaagccggacgtcggcggcatcactgcactgcgccatgacggccgcaagcactatgtggtggcctgcctgattggagccatcattggtttctacgacggccttatcggaccggggacaggatccttcctggtcatcgccctggtctcggcgatgggttacgccttcctcgaggccagcgccaaagccaagatcgtcaacatggccaccaatgcgggggcactgctgttcttcctgccccacgggtccatcctgtggggcgtgggcctgctgctgggggcggcgaacatggccggaggttatctgggcgccaggacggccgtgaagcagggaagccggtttgtccgcggggtcttcctgctggtggtgtcggcactgatcatcaagctcggctacgacgtctggcaggaaaacttcgcctgatattgcccgtcaccggggcctcgtgggcgctggcgctgaggcgtagcatgcaggtatgtcacatggcgacgacgagtacgcccgggccttggcagcagcggtgcggcactccacagcctggcttggcagccttccggaccggcgggtgggaccggtggcggcagcccacgatcttgcagaggcattcggcgggccgctgccccggggtgggatgccggccgaggaagtcgtggacctcctggcaacaacggcagaaccgggcctgatggccatgccctccggccgcttcttcggctgggtgatcggcgggaccctgcctgccgccctggcctcagactggctggtcagcgcctgggaccagaatgcctgccttcggtatggggcacccgccatggctgccatcgaggagagcgcgggcacctggcttctcgagttgctggggctgccgccgggttcggacgtcggcttcgttaccggtgccaccatggccaacttcaccgggatggccgctgcccggtggcggctgctcgcgggcgcaggctgggacctggaccgcgacgggctgtttggggctccccggatccgctgcctggtgggacgggagcggcatgacaccgtggatctcggcctgcgctacctgggcctgggcaagcccaccgtggtggacgccgacagccaggggcgattgatccccgaagccctggacaaggcactcgctgaaggctcgggccccgcactggtctgcctgcaggcgggaaacctccattcgggtgcttttgatcctttccccgaagcaatccgcgttgcccggaagcatggagcctgggtgcatgtcgacggcgctttcggcctctgggcagcggcagcgcccgagctgcggagcctgacccgcgggtacgaggaggccgattcatgggggaccgatgcccacaaaacgctcaacgttccctacgactgcggcatagccatcgtccgggacgcttcagccctgcgctccgccatgggcctgcacaccagctacctggtgcacgacgccgaaggtcccggcgatccgttcgagaaagtccccgaactgtcgcggcgcgcacgcggcgtgccggtatgggcagcgctgaagagcctcggcagcgacggcgtggcagcgcaggtgcggggaatggctgcggctgccgcggacatcgcagcaggcctcggtgggttggacggcgtggaggtgctgaacgacgtcggctacacccaggtgtgcctggcattcggcgacgacgcgaccacccgcgaagtgaccgcgaggatcatcgcggatggcaaggtgtggatgtctggttcccgctggcgggaccgggacatcctgagggtctcggtcagcaactggcatacctcggaggacgaggtccgcacggctgtggacgcggtcaaagccgcattctccgccgtgcacggcaactgaccgctgcaggttgcccgccgccagcctgcacaaggagtccgggcgcagttggccgtgcgcagccggccgttacgcgccgggcgcctggccgggctccggcagcgcatgggctggcggcagcccctcaagggtgtggcctgcaagggtactggcgacccaaagtgaccgcgccaggtctccgcggtggcctggcttcccggcataccccagcgcgtttgcgacctccctggccaggccccactcccgcgcggcgtcggcgtcgagcccggcagcggcgctgaagtccgcgcagcgctgccgcaggccggattcaggctggttcagcggcagctcctgcagccggttccacaacagcggcgccacgccgaattccgcttcgccgatcatgggctgcggatcgatggctgcgaaagcgtccgccgccggcctcgcggctgttgccccagcatccggcctggccaggatgttgaggtaatgcaggtccgtgtggaccaggacgtcccgccccgagcggcgccccaccgcgccccgcgtctggcacacctcgagtgcggcttccagcagccaccgcggaaaggggcggccgagctgttcccagtccgcgggcaggtcgtcgctccactgttccgcacgggcggcgatgtgctcgaattcccgccactgcggccggtcgtcgggaacaaggctcaactgccggacaagtccgccccacacggccgcggcgtcagctagggggatggtacctagggagcgtccggcgtcgagccgttcgaggagcatggaacacgtaccggggtcggctgccagcaggccgacggcgccgtgcccgccccacaacgccaaggcgtgccgctcaacgcgcgcttcctcgtgcgggaaggcgatcttgagggctgcgggccggccgtcctcccggagcaccggcaccaccaccgcgccgtggccgttccacggcaggcagccgggggcgaggtccggcacgagctgccaccgttccagcaggcccgcggcgacgctgggcagggaagcgagccactcccgtccggccgcggtgcgggagtagcgcccggaaaggtccggcgggattggtactgcggttggctggctcatcagtcccagcctaggcgcatcggggccctgccgtttggcgtgcgcgtctccgcggcaggcaggtttttacaccacgcccgtggccccgagcagggtgccaatgctgaaggtggcagcgagtgccagggcgccgcccaccaccacccggaccgccgcccgggttttcgacccgccgccaatccaggcacccagcgttcctgtcagcgcgagtgccaccaggacagctgcgaaggtcaggggaacccggatcccgggcggggggagaaggatcgccagcatcggcaggatggcgccgatgacaaaagccacggccgaggcgaacgctgcgtgccaggggctcacgatgtccgtctcgttgatgttgagttcggctgagaggtgcgccgccagggcgtcgtgggctgtgagctcctcagcgaccttgccggccgtttccgggctaaggcccttggcctggtagatggcagtgagttcggcgagttcctcttccggttcctcggccagctccctgcgttccttgtcgatcagggcccgctggctgtcgctctggctgctgacggagacgtactcgccgagtgccatggacaccgctccacccaccagcccggcagcgccggcggcgaggatggggcccgtttcggaggtggctcctgccacgcccaccacgattgccgcgacggagacgatgccgtcgtttgcgcccaggacacccgcccggagccaattcagccgttgggcaatgtccgttccgtgcggttcggtctccatatggcggcgcagttccgggctcgcagcgtccgtgcctgcaggctgggactgatcgtgtgcatccatgccttcagcaaaccatcagaagcccctgcgggccactctttccggcaatgcaccgccgtcgccgggcgggagtcacggtcgggcgggaccccggcttccggcggacgcaggtgcggggctggccggaagctccgggagctggtcctggtcaagcaggaggccgggaaccggccccacaccgccgttccagtgtgcagtccgccgtgcggcggactgcagggcagcgatcgcccaggcgcgcagcccgccgtcggcccgcgcaatgacatccccgtaggcaggcagcgcctccgattccaggcgggccagtccgtcgccgggcgtcgccaggaagtccgggcccagcacaaagcccggctgctgcggctgcggggtactgcaggcggcaagggcgtacgccgcggcctcggcagccagttcccggtgctgcccaaggaaggcctccgctgccggggcatcgcccgcgccaagccgggggagtgccgcctggtaggcgtacatgctctgctgctcgatggtcacggccgcggacagtgcactgcccagcacagctgaagtgcccgtggaagttggttcctgccctgcaacaccgggcgccggcagaggggacgggcaggcggatgccgtcgcaacgggtgcaggcgccgacgggcccgcagcgggcagcgctgctgagccggaatggggcagcgtttccgcagcgacgcccgccgcggcggcgaggtcctccgcggcgagaagctgggcggtgccggcaccggccagcagacgcgccataccgccgtcgaccttggccgcatccgtgaggcgttgcacaccactggccgagagcgcggaagccagccctgcgaacgtaggctccgccgtcgttgcggccccggcagccggcccggactggccggacggcaggggagtggcagacgccgggacatcctccgccggtgaagaatccgccgtcgaaaggagggcgcgggcctgcagggtcagcaatgtcacagtctggtccgcggcggcggggtttgcgtcgccgcgtgccgcggcaacggctgacaggcgcccggccgcagcgcgcaaatccagcgaatcctgcagggcggccgccctggcctgctcggagatcgggggatccgcgggggccggcggatcagcggggatcagcgagaatcccaggctgagcacaatcagggctgtgaacgaaataacggcgtaccggaaatagcgcagctttgggcggttttccggatcgtcttctttcacaacagaccatggtgtcacgccgccgggggaatctccgccccaccggaccggtaaaatagctacgctagtacacacaacatcatctataagggaggcggcgcggcatcgtgagcaacgcagaagccacggcttcatcagaccaaaccggaacgggcaaggctgaagccgcccccgcacacaacccggaagctgaccggctccgcgcactccttgaacccgcggtccaggccaaccgcctttacctggaggacgtggccatcgtggccggttcccaccgggtggtccacgtcgtggtggaccttccccaggaggaaacaggcggcgtcagccttgacgtcatcgccgacatctccaaaatcctctccgacgtcctggacaacgatcccggagacgacggccggccctatgaccttgaagtgtcctctcccggcgtcgggcgcccgctgacggaaccgcggcactggcaccgcgccaagggccgcatggccaggatcaacgttatccagggcgagaacgtcatgggccgggtcacatcggtggacggtgacggcgtgaccatcgtcccggagatcgccgtgaaaaagggcatgaagcccaagcagggcgagcccataaaacttcctttcgacaggatccgcaacggaaaagtcgagatcgaattcagccacctcaacggggatggtctggaacctggacacaatggaccttctgaggaggcctgatggatattgacatgagcgcactgagacttctggagcgtgagcgtgaaatcccgctggacctcctgatccccaccattgagcaggcgctcctggtggcgtaccacaagtcgcccggtgccttcgaaaaggcccgtgccgagctggaccgcaagagcggccacgtgaccatttgggctgtggagattgacgacgacggcgcccccatcggcgagttcgagcacactcctgaaggcttcggccggatcgctgccagcaccgcacgccagatcatcctgcagcgcctgcgcgacgttgaagacgacaacgtcctaggcgagttcaagggccgtgaaggcgaactggtctccgggaccatccagcagggcaacaacccgcacatgatccaggtcaacctgggttccgtggaggcgctgctgccgccgccggagcaggttcccggggagaagtacatccacggcaaccggctgcgtgcgttggttatagacgtccaccggggctcaaagggcccgtccgtcaccctgtcccggtcacatccgggcctggtccgcaagcttttcgaactggaagtgccggagatcgcggaccgctccgtcgagatcgttgccctggcccgcgaagccggccaccgcaccaagatcgcggtcaaggcaaacgttcccggcatcaacgccaagggcgcctgcattggcgaaatgggatcccgggtccgcgccgtgatgaccgaactgaacgacgaaaagatcgacatcgtcgacttcagcgagaatccggccaccttcatcgccagcgccctctcgccgtcccgcgtgaattcggtcactatcaccgatgaagccacgcgctcggcgcgcgtggtggtccctgactaccagctgtccctggccatcggcaaagagggccagaacgcccgcctggcggcaaagctcactggctggcggatcgacatcgtgtccgacgccgctgctgcccgcgacaactgaacagtttctgacgccctcccggcctcgaatcgcccgcgcagtttcgggcagaaaggccgggaggggctagaatagtaaagaccgcgcctaacggccggcagccgtgcgccttgggcgtgccccattccgttcactcggaggagggccgtccgcggccagcagatatgaacgtcaggaagatgaccgtgccaatagcaagcgggaatcaaccggaacgtacctgcatcggatgccggaagaagggcaagcggaatgagttactccggctcgtcgccgaaggcagcggatcaaacgctgtcctggtggatgaacgacgccggatggctggccggggtgcatggctgcatcccagcgaatcgtgcctggctctggcgttgaagcggcgagcattcggacgtgcccttcggggagcggccggtactgccgccgtcgaacgccggatcacgtcaggcccgagcgttgcacgcgttacggcaactgcaacaccaaccgtccaacctgaaagcgggtcagaaaactgatggaaacccgatgagttcccagcgatgagtgcgcaacgatgacaactttgttgcgctctgcaatgggcccttctgcagcatgtgcggcttgggcccgcagtaagaagtagacggttcgtgcctggctcggtgcggaccgagacaggagaaatgtggccaaggtccgcgtacatgagctcgccaaagagctcggtattacttccaaagatgcagtgacaaaactgcaggaactgggcgaattcgttcgctctgcctcttcaaccattgaggcccccgttgtgcgcaaactgcgcaacgccttccccgacgccgcccccaaggctgcagcaccggcagccgcacccaaggcgaccgctccggctgcagaggcgcgtccctcaacacccgcacccggtccggcagcaccgaaggctccggcctccaaggctgaggcccccgtcgctccggcagcaccggcacaggaggcggctccggcagcccccgctgccagcgcacccgcagctgcggctgcaccggccccggcagctccgtccacgggcgcaaagcctggcgcacggccggcacccaaggctgaaaccccggctgcccccacccgctcaggcggttcagggcagggcggttcagcacccgtcccggcggtcccgccgggcaacaaccccttcgcca

SEQ ID NO: 31 - DNA, 230368 bp, Arthrobacter sp. OY3WO11
tcatgcccctgtgtcgccttgcctcccacgactggtgcaggccgtcccggtgccggcggccgtggtcccggacgccccggtggcgctcccggaaccggcggtcccggtggcggcggcggtgctcccgccggtggtggcttcggcaagggcggccgcggccgcggcggtacccagggtgccttcggcaagggcggcgccggacgtggcaagcagcgcaagtcgaagcgtgcaaagcgccaggaacttgagcagatgagtgccccgtcgctgggtggcgtgagcgtaccccgcggcgacggcaacactgtcatccggctgcgccgcggctcgtccatcacggacttcgctgacaagatcgaggcaaaccccgccgcgctggtgactgtcctcttccacctcggtgaaatggccacggccacgcagtcgctggatgaagagacctttgccctgctgggcgaggagcttggctacaagctccaggttgtgtccccggaagacgaggagcgcgagctgctctccgggttcgacatcgacttcgatgccgaactggaagccgaaggcgacgaagaacttgaggcccgtcctccggttgtcaccgtcatgggccacgtggaccacggtaagacccgcttgctcgatgccatccgcaagtccgacgtcatggcgggcgaacacggcggcatcacccagcacatcggtgcctaccaggtcacccacaaccacgagggcgacgaccgcaagatcaccttcatcgataccccgggccacgaggcgttcaccgccatgcgtgcccgtggtgcgaaggtcaccgacatcgccatcctggtggtcgcagcggacgacggcgttatgccgcagaccgttgaagcactcaaccacgcacaggcggccaacgtgccgatcgtggtggccgtgaacaagatcgacaaggaaggcgccaacccggagaaggtccgcggccagctgaccgagtacggcctggttcccgaagagtacggtggcgacaccatgttcgttgaggtctctgcccgccagaacctcaacatcgacgagctgctcgaggccgttctgctcaccgcagacgctgccctggacatgcgcgccaacccgaacaaggacgctcgcggtatcgcgatcgaagccaacctggacaagggccgcggagcggttgccaccgtcctggtgcagtccggtaccttgcgcgtcggcgacacgatcgttgcaggcacggcccacggccgcgtccgcgcaatgttcgacgacgacggcagcgccctgaccgaggccggcccgtcccgccccgtgcaggtgctgggtctgtccaacgtcccgcgtgcaggcgacaccttcttcgtgaccgctgacgagcgcaccgcccgccagatcgccgagaagcgtgaagcagccgaccgtaacgccgccctggccaagcgccgcaagcgcatcagcctggaagacttcgaccaggcagtggccgacggcaagatcgacaccctcaacctcatcctcaagggtgacgtgtccggtgccgtggaagccctcgaagacgccctgctcaagatcgacgtcggcgaaggcgtgcagctgcgcgtcatccaccgcggtgttggtgccatcacgcagaacgacgtcaacctggcaacagtggacagcgccgtcatcatcggcttcaacgtcaagccggccgagcgcgttgccgaactggcagaccgcgaaggcgtggacatgcgcttctactccgtcatctacgccgcaattgatgacatcgaggcggcgctcaagggcatgctcaagccggaatacgaagagttccagctgggcaccgccgaggtccgcgaagtcttccgctcctccaagttcggaaacatcgcaggctcgatcgtccgctcgggcatcatccgccgtaacaccaaggcacgcatcagccgcgacggcaagatcatcggtgacaacctcaccgttgagacgctcaagcgcttcaaggacgacgccaccgaggtccgcacggacttcgagtgtggtatcggccttggctcgtacaacgacatcaacgaaggcgacatcatcgagaccttcgagatgcgtgagaagccgcgcgtctaaccttggttagtcctgggtgcggggccgttggatttttccggcggccccgcacttttccgccgttgagggggccccgcccctacgacggacggccagcgatctgcgatcgtcggccgtccgtctccggcaggcccgatgccactcccgggccccctcaacggctccaaagtgccgccggaaaacccaacgggagtccgtcgtagactcgccgtaggtgcgtggcaaaaatatccaacgtgcgtggcagcctcaccagaccgccgtcgtacgttccaaatttatgaggagttgttcatggctgatccggcacgtgctgccaagttggcgcagcggattaaggttgttgttgctgaggccctgggccggaaggttaaggatccacggctggagggcattactgttaccgatgcccgggtgaccaatgatttgcagcatgccacggtgtactacaccgtttttggcgaccaggccgtgcaggctgatgctgccaagggactggagaaggccaaaggtgtgcttcggcaggaggttggccggaacattaccgttcggctgactcccagcctcgaattcgtggccgaccagattcccgtggttgcttccaaccttgaggagctgttgcgcgaagccaagaagcgtgacgctgaggtcgccgcactggccgcccaggcaaagcacgcgggcgatgccgatccatacaagagcgacgcgtccgccgatgtggacatcgacgaggacgacttcgacgaagaggaccttgacctcagcggcgacgaagatcttgacgaagacggcagcaagtagctttcagcattgccaaatgcccggaccgcacctgtggtccgggcattttgctgccccgaatacgaccggcattacccgatgccggctttgatcaccttgccttgggtgggatcggcgaaactgaacccaaccgtggcatagagagtctctccacggacttcgactgctgcaggcccgtcgaccgcgaggaactgcttcctgtggccggccgaatcatcgatctcaatgatttcgttgccgaacatggatgcaacgtacacgtcgccgtcgtcagcgattgccaggcccgtcgggctcaggaggtcctccgcccacaccttcgtgctgccggtggaagggttcacgcggaagatggccccccgggctcccagggaaggatcctcaggcccgccaggaagggtggtgacgtaaagccggccgtccggtccgaactccagatccgtcggcaccggttcaaaggcgtattcgtgtcccaccacgcacgcagggacctccacggtggtcccagccatatccacggggatcctggtcccggcaggaatcaccgcgggccggggcggcaggaccgccagcgtggaaacgtcacccgaatccaggtcgacttcaaggatcgcattggcgcctgcatccgcgatgtacgccgtatcgtcccgtattgcaacgccgtagggatgcgagtcgaggcctccctggtaacgggccggcgggaacgcgggccactcggccaggcatgtgtccgcgacgtcgggtccgaagccgtaatgctgggcgccgtccgggttcttttcccgttcgtagctggcgaggtcggcaagatcatggatgtcaccctccgggtcgagggacttcagccagcctttgagggcggccggatcaccgcccccggcacccgcgctctccacgaagtacctggttccatgccgggtttcgacgcctccgacgtcccacccctccgccccctggtagagggcagtggtggttccgtcgtggttgacgcggctgaggacaccggcgaaattctgggtgaccaggacggtttcttcatcgtaagttacggtcaggctgaggggccctaccaagccctcagccaaagtgcgcggcgtcctgtgttcgggctcggaacccgccaccgcgggcccggcaggaatagctatcgccgcagcagcgaggcctgcaacgagggcaaattttgttttcattgggtactccgggttggcgcccttagcgggccggataaggagcctccagcggaggctgtaaatgcggacacccccggcgccagattattcctgcacggttggaatgtcgccgggatttccccctatccgccccctaatgtcatcccctaacggcagccccaatgactaggatctagctatgactgagccgactgacaccgatcacaccgcgaagtacctcgagcaggccgtggagctggccatccggaacgtcgccgaaggagggggaccattcggcgcgctggtggtgaccgccgacgggcgggtgcatgaaggcgtcaaccgcgtaaccctggacaacgatcccaccgcccacgccgaagtggttgccatccgggccgcagcaacggccatagccaactatgacctgcaaggagcggtcctctacgcgagctgcgagccctgccccctgtgcctggcatccgccctgtgggcaaggatcgaccgcgtctacttcgccgccgaccgccacggcgccgccgccgcgggtttcgacgacgcagttttctacgagtacttcgacgggacccggccggatctgttacccgtcactcgaagcgacatcccgtcgtcgcgcgcgccgttccaggcgtggggggactttgccggcaggaaggaatactaggaatggaacctgcactcaccacctgtccagactgcggaaagaccaacagggtccccgcccaggcggcaggccggccccgctgcggcaactgcaaagcggacctgccctggatcgtggccgcgggggatgcggacttctcggccgtcgccgagcagtcacccgttcccgtgctggtggacttctgggctgcctggtgcggtccatgccggatggtgagcccggtgctggacaagctggccagggaacggcccggccggatcaagctggtcaaggtggacgtggacaagtctccgggcctgtcgcgcagattcgatgtacaggcaattcccacgctgatggtgatggttgatggcaaggtggccgcccgccaggctggggcggcccccgcggaggtactgcgttcatggctggacggggcactggcgggaaagggaaactagccccgccccggcggcactcaccggttggctggcccggcagccggccggcactgcttattcagcccggcccggcagcctgcccaggccctccaccaggtcttcctgccggccgcagagggccacgcggacccacccttcaccgatggaaccgaaggcagtccccggggccagggcaacacccgaatctgcgaggaaccggcgcacccagctgcggacgtccccgcccgttgcatgggagacatccgcccacagatagaaggctccctgcgccttgaggtaggggattcccttcgcgtcgagcacggcggacgccgcatcgcggttcgcccggtagtgcccgtgagcgtgctgcacatagtcctgcggcccggtcagggctgcgagcgcagcatactgggacggtgaagcgacgcaggaaacaatcgcctccatcacgttgtccatcttctgcttgatgcccggcgggcagaccagcgcgccgatgcgcagcccggtgagcccgtaggtcttggacaaggtcagcgaggtgaagacacgcgcatcacccggcgtatcgccgtcgaaccttgcggggctgacgtgcggcacatcgtaggtaaaggcctcatagcattcatcggagatgacccagagatcgtgacggcgggccagttccatcagtttccgggtcaggtcctcgcccagcacggcaccgagcgggttggagggggagttcaggaccagcacccgcgtacggtcagtgacgagtgcctcgatgtccgcgggccgcggctggaagccgtggtccgggtacagcgggtagcccacggggacagcgttcagcagccgggcggtcatcgcaaaggtggggtagccggggttggggaccaggacttcgtcgccgggggagagcaggaggctcatggcaaagtgcaggccctgctgtgccccgtccaccacgtacacccggtcggcgccgatgctgtcgatgctgccggggctggtgccggcgcgttcacggaaccgcgccgcgaacgcctcccgcagtgccgggatgccggcgttcggagtgtaattcgtctcatcccggtccaggcacgccatcgctgcctccagcacatgccgggggaccgggaagcccggctcgccaatgctgagcaccagggcgccgggagtgcgccacgcggcctcggtgatttcgcggatctggttgacgggcacgtcgcggacatgggcggcaagctcaggcatgcctgccatcctagctggccctggaaccgcctccggagtgccggtgccagggcgtgggcaagggccgggaccagcgccgatatactgggaggcgtgctttctggactggtgatagtggacaagccgcagggatggaccagccatgatgtggttggccggatgcggcgcctcgcaggtacccggaaagtagggcatgccggaacgcttgaccccatggccaccggcgtcctggtggtggggatcaacaaggcaacccggctgctcacctacatcgtgggcacctccaagacctacaccgccaccatccgcctgggccagtccacggtaacggacgacgccgaaggggacgtcactgccacggccggcacctcaggggtcagcgagcaggcaatgtacgacggcgttgcggcccttacgggcgacatccagcaggtgcccagcagcgtcagcgccatcaaggtcaacggggaacgcgcctacgcgcgggtgcggtcaggcgaggacgtgaagctcgccgcccgccctgtcaccatccaccggttcgaggtgcacgccatccggcgggacccggaggcagacgtcgtggacctggatgtcacggtggagtgctcctccggcacgtacatccgggccctcgcccgggacctgggcaatgcactgggagtgggcggacacctcacggcgctccgcaggacccatgtgggaccctactcactcgaccaggcccgcacactggaccagctggccgaggagctcaacgtcctggaaatgtcgcaggcggcccgggccctgatgcctaaccgcgagctcagcgcagaagaaaccaccgagatctcctttggccggcgcatcgctgccggcgccccggctggaagccccgccgctgccactgccgaccaccccgcagccgctttcgcgccggacggaagcctggtggcactcctggccgatgcgggcagcttcgccaaacccgtgctggtgttcgctcccggcaacggcgccccgccagtccgcaccgtggtggagggctgacggtggacgcgtatttctacatcatcctggtggtcgggctcctgtccacggcggtgtgcctggccgcgggcatcctcaagaaggcgcccaacgatgtcacgatcctgtccgtggccgccgtggaggtcgccctcctcgtctacctggtgggctccgtcatccgggtcgttgccggcgagcccatcgccggcgaggcgtgggaattctggggctacctggtcacggccatgctcctgcccccggccgccgtctactggtccatcctggaacggaccagatggagcaactttgtcctggccgccgtcggcgttaccgcgctggtcatggcggcccgcatgaaccagatctggtactgaagtggaagaagcacccaacgtgaaagaccagcacaccacagccgccgggcaaagccacgccggcagcagcgcctcgaacagccgcaacaccggccccgggcgcctgcttatcgccgtctacgccgtcttcgcgatttccgcctccgcgcgggcgggctaccagatcctcaccaagttctccgaggcgccactcgcgtacctgctctccgcatttgccgccgtcgtgtacgtggtggccaccgtctcgctggccaaggccggaagtacctggttcaaggtttcggttgccgcggtgctggttgaactgctcggcgtgctggtggtgggcgccctgagccttttcgaccccgtccagttcccgcacgaaaccgtctggtcgctgttcggccgcggctatgccttcattccgctgctgctgcccgtcctgggactggtgtggctgtaccgccgtcgcccgggggcgcgggccgctacctgaggccctcttctccggaaccggcggcctcttgccggaacacatgaaatatgcttcactatttcatgtggaggggagtatcccccgaatgcctcgtcgtcagtccggccgcccctgagcggcccggcggggcaggctcccgcagggagccgggaaagacctccagttggtacatctgactggaagcaggtttcccctgatgaacgttcccctatgggcctggctggccgtacttcttttcatcgtcctgatgcttgcccttgacctcttcgcgcaccgcaaagcccatgtgatcggggtacgggaggccgcgttgtggtctgcggtctgggtcgccttcggtgttggcttcggcgttttggtgtggcaggtatacggcgcggagtttggccagcagtactttgccggctacctgatcgagaagtccctcgcagtggacaacgtctttatctgggccatcatcttcacctacttcgcggtgccccgggagtaccagcaccgcgtcctcttcttcggcgtcctgggcgccctggtgttccgtggcatcttcatcgccgcaggctctgccatcatcgccagcgcggggtgggtgctctacatcttcgcggcgttccttcttattaccggctaccgaatgatccggcaccggaacgaccacctggacccggagaagtcccgggtgttgaagctgttccgcagccgcgtacccatgaccgatgacttccacgggcaacgtttcctcatccggcggcggggcgttctcctggccacgccgctgctggcggtcctggtcctcgttgaggtcacggacatcatcttcgccgtcgactccatccccgctatcttcgccgttaccgacgacgtgttcctggtgttcactgcgaacgcgttcgcgatcctggggctccgggccatgtacttcctcctggcggacctcatccaccggttcatctacctgaaaaccggactggcgctcgtcctgatctgggtgggcattaagatgttcctgaagatcgacatctactacatccccacgccgatttccctggcggtcattgcagtaatcctcctcgtgtcggtggcagccagcctgtgggcaacgcggggccaggggcgccgcccgcttcccgcgccggagcgtgcaccgttcgggacagcatcacccgaggaaatggcagccctggaaccgctgtggcgccgccgggaaccaagcagttcccaccacccgtaacaccgaaaacacggagcatccatgacagctgaaagttccatccacagcggccaggaagctccacgtccaggcgggcccgcccggcccgcctggacgttcctcaccaaccacggccatgtcctgctctccgtggcgagggacccggacatccgggtaactgacctcgccgagcgcgtgggcatcaccacccgcgccgccctccagatcctcaaggacctcgaaagtgctggctacctccagcgggcaagggtggggcgccggacccactacaccatccgcccccaccaacatttccggcatcccgcaactgctgcgcaggaagtggacgggctgatccgcctgttcgccgcaccggctccgggggaggggccggcagcggcggctgaacactaacagcctggcccgcggctttcccggcgtccgggcgggcccccgaatgcaggtaatcttagagagttccgcggccggtaccaggcccgaacattgatacttgcaagcggttaaggcgagggtgatggtctacatctggaacgatccgtccgaggtcccggcggacttcggcccatctgttgtcaccatcggaaacttcgacggcgtgcatcggggacaccagcaggtgctctccgaactgatccgcacggcccggatcacaaggtccaaagcggttgtggtcaccttcgatccgcaccctgccctggtccaccgtcccgagtccgcgcctgagctgatcatggggctgcaggacaagctggaggctttgggggagttgggcctggacgccgtactggtcatgaagtattcgctggacctcgccagcctcactccagaggaattcgtggagcagtacctggtggactgcctgcatgccggccatgttgtcatcggccacgatgtacgtttcggccgcggcaactccggcgacttggacaccatgcgggagctcggccggaagttcggcttcgaggtacaggtgatcagggagttcggttctgagggctaccccctgcatgacgacggcggcgaggaccgccgctgttcctccacctgggtgcgggaagccctgcaggagggggacgttgcaacggcgtccgctgtcctgggacgcccgcaccggatgcgcggcgaggttgtccacggcgccgcacgcggccgggcgctcggtttccccactgccaacctggccagcaacgccagcggactcattccagccgacggcatttacgccggctggctggttgaccaggcagggacacgctggcctgcggctatctccgtgggctcaaaccccaccttcgacggcgtcagccgccaggtggaagcccatgtgatcgaccggcccaaagaagacgtggaagacttcgatctgtacggccagacagtagtcgtggaattcgttgcccgcctccggggcatggtggcctaccgtggaccggaagcactcgtggaacagatgcgcctggacgtcgtccaggcacacgaactgctggccaggcgctgaaccggccggaggggcgcccaccagggaaaggcagcaccgtgtccgtcgaaaagaacacccgcaagctggacaagggcatcgtccgcgacttcagctcacggatgagctacgcctcctacctccagctgccaaccctcctcagtgcgcagcagccggtcagcgagcccgagcaccacgatgaaatgctcttcatcatccagcaccagaccaccgagctgtggctcaagctggtcctgcacgaactgcgcagcgcagcagcctggttgcgggccgacgaccttgggtcggcgctcaagggcatcgcccgggtcaagcacatccagaaaaccctgaccgagcagtggtccgtcctggccacgctgacccccaccgagtactcccagttccgcggcttcctgggcaactcctccggcttccagtcgagccagtaccgcgcggttgagttcgtgctgggcaacaagaaccgcaagatgctgccggtgttcgagtcggacccggaagcgcacgccatgctggaggaactacttgcagcgcccagcatctacgacgaattcctgggctacctcgcgcggcagggcttcgacgttccggcgtcggtcctccagcgggacgtgaccaaggcccacgagtacaccccggaactggtgccgctgttcaagcacatctacgagaacgccgcagccaactggggtgcgtacgaggcctgcgaggaactggtggacctggaggacaatttccagctctggcggttccggcacctccggacggtccagcggaccatcggcatgaaggcaggcaccggcggctcgagcggcgctgccttcctgcagaaggccctggaactgacgttcttccccgaactcttcgcagtccggacggaaatcggccaatgaccacgcaccaggggacgcaccgcccgggcaccaaccaccagccggtccacggaaaggcagccatgactttgcagcagcgcgcggaagagctggacagccgtgatcctctggcccactaccgccaccacttcattggcgcggacacccccgtgtcctacctggacggcaactcccttggccggcccctcaagcggaccgctgacgacgtcgccgccttcatccgcgacgactggggaggccgcctgatccgcagctgggatgaacactggctcgcgatgccccaggccatcggtgaccagctgggccgggcagtgctgggcgctgcccccgggcagaccgtcatagctgactccaccaccgtggtgctgtacaagctgatccgtgccgccctcgccgcggtggccagccccgaccgcaacgagctggtcctggacaccgaaaactttcccacggaccgctacctggtggaaggcatcgcgctggaggaggggctcaccctccgctggatccaggcggacccggccgccggggtgaccgttgaccaggtgcgcgaggcaaccgggccgcgcaccgccgtcgtcctcctcagccagatcgcctaccgttccggccacctggcagaccttccggccatcacggccgcagtgcacgacgccggagcgctggtggtgtgggacctgtgccactccgcggggtctgtggagatcgggctggatgcggcgggcgtggacttcgccgccggctgcacctacaaatacctcaacgggggaccgggatcgccggcttttgcctatgtgaaccaccggcacctgccgtcgctcaaccagccgatctgggggtggatgggccgcaaggacgccttcgagatggccgccggatacgagccggccgctgggatccggggcttcctcagcgggacgcccgccatcttcggaatgatcgccatgcagggcaccctggacctgatcgaggaagcgtctatggcggccatccgggaaaaatcggagaagctgacagccttcgccgtcgaggtttttgatgccctgctggctcccctcggggcggagctggcaacgccgcgcgaccccgcccggcggggcagccacatcaccgtggatcaccccgggttcaccaaggcaaccgtggaggcgctctgggacggggacgtcattccggacttccgtgctccgcatggcatccgcgtgggcctctccccgctgagcaccagtttccgggaggtcctgcagggcatggaagcaatgcggaaccgcctccaggcataacgcgggcactgtttcgacaagattaggcaccggccggtaaactgaacgatggatccggctgcagtccgtggcggctggttcctgttgcgtacggcgctgaccggtttcccggttgccagccgcggcagcagacccggcagtgaagtactgacctgggccctcacggcacatcccaaggagatattgtggcacttgacgccgctgtaaagcagtccatcatcaaggaatacgcaaccggcgaaggcgacaccggttcgcccgaggtccaggttgctgtcctgacccagcggatcaaggatctgactgagcacatgaaggagcacaagcacgactaccacacccagcgcggtctgctggccatggttggtcgtcgcaagcgcatgctgagctacctcaagaagactgacatcgcccgctaccgttcgctcatcgagcgcctcggcctgcgccgctagtcacactttggggcggccctttcccccgtggaacgggccgccttcttcacctgaataactaaacaggaggatcaaccgcatcacgcattcgcggtcctcggtagtgatccccgggaacggctccctagaaggcagccccggcccgtgggtctcgatcgatgaccgggtgcagggccagtagacagatgctggctgggttgatgcggctggactccgtaaaacagaaacggaggtgactctcttggagggtcccgaaatccagttctcagaagcagtcattgacaacggccgattcggcaagcgggtcatccgctttgaaaccggccgccttgccaagcaggcagccggcgcagcaatggtgtacatcgacgacgacaccgcactgctgtccgccaccaccgccggcaagcacccgcgtgaaggcttcgacttcttcccgctgacggtcgacgtcgaagagcgcatgtacgccgccggccgcatcccgggctcgttcttccgccgcgaaggacgcccgtccaccgaagccatcctggcctgccgcctgatggaccgtccgctgcgccccgccttcatcaagggcctgcgcaacgaggtccagatcgtggtgaccgtcctggccatcaacccggacgaactctacgacgtggtggccatcaacgcctcctccatgtccacccagctctccggcctgccgttctccgggcccatcggcggcgtccgcgttgccctggttgccgacgaaaacggatcacagtgggttgctttccccaagcactcccagctggaaaactccgtcttcaacatggtggttgccggcaggtctgtgtcgggggccgacggtgacgacgtcgccatcatgatggtcgaagccgaagcgaccgacaactcctggaacctcatcaaggaacagggcgccaccgcccccaccgaagaggttgtctccgagggcctcgaggctgccaagccgttcatcaaggcactctgcgacgcccaggccgatctcgccgcccgtgcagccaagccgaccgtcgagttcccggtcttcctggactacgaggacgacgtgtacgccgccgttgaggccgctgccgctgagaagctcaccgccgtcttccagatcgctgacaagcaggagcgcgacaacgcttcggacgccctgaaggacgaggtcacttcttcccttgccggccagttcgaaggccgcgagaaggagctgtccgcagcattccgctcggtcaccaagcacgttgtgcgccagcgcatcctcaaggaccagatccgcatcgacggccgtggcctgacggacatccgccagctcaccgccgaggttgaggtcctgccccgcgtccacggctcggccatcttcgagcgcggtgaaacccagatcatgggtgtcaccacgctgaacatgctgaagatggaacagcagatcgactcgctgtcaccggtcaagaccaagcgctacatgcacaactacaacttcccgccctactccaccggtgaaaccggccgcgtcggttcgccgaagcgccgcgaaatcggccacggtgccctggccgagcgcgcgctcgtgccggtcctgccgtcccgcgaggaattcccgtacgccatccgccaggtatctgaggctctcagctccaacggttcgacgtcgatgggttccgtctgcgcctccaccctctcgatgctgaacgccggtgtgcccctgaaggccgccgtcgccggtatcgccatgggcctggtttccgaccaggtggacggccagacccgctacgcagccctgaccgatatcctcggcgccgaagatgccttcggtgacatggacttcaaggttgccggtacgtccgagttcgtcacggccatccagctggacaccaagctcgacggcatccccgcgtcagtgctggcagcagccctgaagcaggcccgcgaagcccgcctgcacatcctcgaggtcatcgactcggccattgacaccccggacgagctctccgagttcgcaccgcgcgtgatcgccgtgaagatccccgtggacaagatcggcgaggtcatcggccccaagggcaagatgatcaaccagatccaggaagacaccggcgccgacatctccatcgaggacgacggcacggtctacattggcgccaccaacggtccgtctgccgaggcagcacgctccgccatcaacgccatcgccaacccgcaggtcccggaaatcggcgaacgctacctgggcacggtcgtcaagaccaccaccttcggtgccttcgtttcgctgaccccgggcaaggacggcctcctgcacatctccgagctgcgcaagctggccaacggcaagcgcgtggacaacgtcgacgacgtcgtctctgtcggccagaaggtccaggtggaaatcaccaagatcgacgaccgtggaaagctctcgctcgcccccgtagttgccgaggaagaaggcgccgcggatgagaccgagcgtgcccacgccacggaacctgctgaaggcgctgacgtctagcattccggcttgcgggcacggcctgcaggttgaagtatgaatcggcggggccggtggatgatccaccggccccgccgctgttacgatggcagccagatcccggctgccccttttgaaaggcctcaatgactgttgtacccctgccgcttgagcagaaccaccccggcgataccttggtccacggttccgacggcggctccgaagtccggcgttcggtgctgcccgggggagtgcgggtactcaccgaggcgatgcccgggcaacggtcggccaccattggtttctgggtgggcgtcggttcacgggatgaggcaccgggacagcacggctccacccacttcctggagcacctcctgttcaagggcaccaggcgccgtaccgcgctggaaatcgcttcggccttcgacgaggtgggcggcgagtcaaacgccgctacggccaaggagagcacgtgctacttcgcgcgggtcctggataccgacctgcccatggccattgacgttatcgcggacatgatcaccggagctgtcctggaccccgctgagatggagcaggagcgcgacgtcatcctggaggaaatcgcgatggacagcgatgaccccaccgacgtcgcccacgagcactttgtggcggccgttcttggcagccaccccctgggccgccccatcggcggcacccccgacgccatcagggccgtggcccgcgactcggtgtgggaacactaccagcggtattaccggccggatgagctggtcatcactgcagccgggggactggaccacgccgtcgtctgcaacctcgtggtggatgccctcgaatcggccggctggtcgcttgagtccgacgccgcaccggtggaacgcaggtccaccgaccgcgccctcatcacggggacggcaggcctccacgtggtcaagcgcgccgtggaacaggccaacatcatcatgggctgccccaccatcgtggccacggacgggaggcgctacgtcatgagcgtcctgaatgccgtgctgggcgggggcatgtcttcacgcctgttccaggagatccgggagaagcgcgggctggtgtactccacgtactccttcgcgtcctcgtacgcggatgcaggctatttcggcatgtacgcggggtgcacaccatcgaaggtgcgccaggtcctggagctgctcgctgtggagctggacaagctcgcggagcacgggatttccgaggacgagctccgtaaggccgtgggccagctgggaggcggaatcgtgctggctctggaggacacaggttcccggatgtcccggctgggccgtgccgagctcgtctccggcgagtaccaggacatcgacgaaacgcttcgccagatcaaggctgtcaccgccgaacaggtgcaggaactggcggccgaactggctgcagcaccgcggaccgtgaccgtggtgggaccgttcgaggagactgaaaccttcggcttctgacttccgggccgcaggcttaggatgaacccctgagggcaggtcattgcccgggtgaggggaggacgacatatggaccggccccgcatcaatcctggccacccggcgctggcgaacctgctgggccggtggcggggaaccacacggcttgagtccggcccctggggtgcggaacggacggtggacgccgaaatgacgttcaccctggttgccgcaggctcggccgtggtgcagagctaccggcacaccgagtccgacggcagccacttcgaaggccacggcatcttcaccgtcgatccggaccgccgggatgtcctctggtactacgtggacagcgtgagccctgccccggacgcccctgcgcgctgcacctggcatgacggggacctccaggtggagcgccacaccggagcgggttccatccgccacaccctgcgcgtcacagacggagtcctctttgacgtcgccgaactccgacgggaagaccgcatggacactgatctcggcgaccggatcgccgcagacggggccacagcctcgtacaagcccttcatgacctcccggtaccggcgggagcctggcgcaccacagatgtgatgaggcgcgccgggacgaacttccggaacgcacatccgcgtctgcatcggtatctattttctttcctcggccacgacatgcccggataacgccagcccaggtagaactcgccgaacggatcctgcggcaggtcgcactccgctactcccgggtcttccggaatctcgaattccggcaggtcaacgacgggcggatcctcgccagcatccgcccgtctgccatttaggcgggtgggtcgtgcaggaaccgtgccaagccttcttctgccggggacaatccaatgtaagcgaagtctgcaagcccagcggttgatccattgaggcgcttcagttccggcgtcagttcctccggccagtggggtggttcccagtcctggtgttcgcttttgtagtgtcggccggtgggtgaggtccaaccgggtggttcgtttttggtggcgggtgttggtgtccagccggtggtgtgtctgagtttgtggtgtctggggcagagttgtcccaggttgctgattcctgtggtgccgtcgtggtgccaggcgaggaggtggtctgcctcgttatccaatgaactgttgctgcagccggggaaggggcatttgccgtcccgcatccttagccagttccgcatggctttggtgacgcggtagctggtccgcccgatttccagcggcgccccgtccctcgggtcgacgaggacccggtggaacgagtcggcgccggcggcgaccaggtccctggccatggatggcgggatgggtccgtacccgtcgagcatggcgggctcgtcggtcaggcccatgagggcgaataccacggtgacgagcacctgggcccggatcgatgatgaaggggtgggatccgttcctgcgcccgccccagcgctgttggctgcattgaagtttgtactggtgccgctggtgaggatggctggggagaatttgtcggcccggatctgggtgagggtgcgtggttcgtggggtccttgtgcggcccgggcgagggcgttgaggcggttccagcctgccatggcctggtcggctgggaggtaggccggaccaggccatgccgtcctggtccggcctgcactccacccggcggtctgccacggctttggtgtggcgtttctcgatggattctgcgtggtggcgttcgcgccaggtgcgggccttggccttgaaccggtgcgggggcatttccccgatcgtggcagcggtggcgggtcttggtttgtcggggtcgaggaagtgggcttccagggcggcggccccggcgggatcgagggtggcggcctcgtccgccagggccagggcgtgctgccacgagattattccggcccgcagggacgagagtgtcagcggcagggtcttgtccagggcgtgggacgtggcgaggaacgcgcttgcggcccgcggcccgatggccagcacgcacccgatctccgcggccacagccatttcctgcgcctgcaccggcatcccgggaggggccagggcatgggcggtgtccgcgtacttcatggccgcacgggccttcaggcctgcaagcccagcttcggcctccctggcgccggcgagaatgtccaggctcccatctgctagcccggccaacggatcagcggccgagaacggttccgcaccacacccgtccacctccgcgttgagcacagcaagggcggccttgatgtccgcgaacgccttctctaccgcttccctgcccatgtatccatcatggcaagggggtctgacaatcagggacggagcaaatggaccggcccgaaaaggcgttccctagcccccggcgaacggcggcagcacgtccaccacgtcagccgcttttaacacagctgagtggtcacgcaccgccacttcattgagcaggaagctgctccgggagagaatgcggggcagcgggggagtgccggcaggaggctcagggcgctgcacggaccggacggcgtcgagaaggtccgcaaccgtggcgcccggcgccaggtcaaaagtctcttcctccaggccggcagcagcgcgtgcggcagcgaagtaacgtacgttcaagagattcagcccccgatggcgctcatgctgcggtccggctggacgaagtccggagcatcaagtcccacgtggtccattccgtgggccttcggcttaagccacattgcgtcctgccaccgctgggcgagggcttcatcgcttgcccctgtgcgcaggaggcccagaagatcgaactcctcgcgggaaaacaggcagctcatgatcttgccctctgcggtgatccgggtgcggcggcagtcggagcagaagggttccgtcacggacgcaatgattccaacggttcccagcaccggaccggacccaccatcggaccttgccgtccgccgtcgtacttcaaaacgctccgcgggcgcaccatcacgggcccggggatcggcgctgaggacaaagtcggcggagagcagctggcggatttcggcagcggtgatcatgttccgccgcgtccagccgtggtcggcgtccagcggcatctgctcgatgaagcgaagctcgtagccgcgccccagtgcccaatccagcagggacggtgcctcggcgtcgttgattccacgcatcagcaccgcattgagcttgaccggcccaaggcccgcggcccacgcggcatccactcccgccagcacctggtccaggaacggccggcgggtcagctgggtgaaggtttcctcgtgcagcgagtcaagggatacgttgatccgggtcagtccggcggccttcagggcagccgccttcttcgccaggccaacgccgttggtggtcatggagatcggcaggtccgggtggttgctgcgcagggcggaaatgatgtccacgaggtcgtgccggaccagcggttcgccgccagtcagccgcagctcgcggactcccagctgcccgactccaatgcccacgatgcggacgatctccccagcggtcatcaccgcctgcttcgaaagccactccaggccttctgccggcatgcagtaggtgcagcgcagattgcatttgtccgtcagggacagcctcatgtccgtcgccctacggccatgccggtctgccagccctgccggcgcgtccccggggcgcgcagccggaactgacggcaggggtgcatctgcttccccccgtggctgcggcatgcctagctggacactcatgaattcaggctacgccaccttggggcgcacatcacacacggggttgcgaacgccggcaacagaatccccacggaccggcgccatgcgtattccgcgaacctatgctggaggtgtgagcagctccgagccagggcaggcaacgcaatcagagcaggcacggcaatcaccgccaccaaggcaggcaacgcacgacggcgggccacggcagcctgcgcgggcggcagcagccgccggcgtcgccgcagtggggagcgccgccgtgctgggggaactgctggccggattcttcagtccatcgctgtcacccgtgaccgctgttggcggagcggtcatcgacgccgttcccccgggcgtcaaggactgggcggtaacggcgttcggcaccgcggacaaggcggccctcctggtgggcatgggcctggtgatggctgcactggcggccctggcaggaatcctggagtaccggacgcgctttgccggcgctgcgctgaccggcgtgttcggcatggtgggcctggcggctgtcctgacccgggcccaggccagtgccaacgcggcagtgctggccgtgctcaccgccgtcgtcgccgtacttctgctcaggttcctcattcgcaggctccaggaatgggggacccaagcgctggagcctgcccccagcgccccgccggcacgccgccgtttcctccaggcgctggccgggggagcggtgtttacggcggcagggggcctgctggcgggagcctggcgcggtgcggcagccgttgccagcgaggccaggagccgggtgacgctgccggttcccgcatcaccggcacccgccgtaccagtggacgccgaggccggagtggatggcatgcagccgctggtcactcccaacaaagatttctaccgcatcgacaccgccctgacggttcccgccgtggaccctgccacgtgggtcctcaaagtcacagggctggtggaccgcgaggtggaactgaccttcgccgacctcctggccaaacccctgaccgaacgccacatcaccatcgcctgtgtgtccaacaacgtgggcggagacctcatcggcaacgcccgctggctcggctggcccgtccgcgaactgctggcactggccgggccccgtgccggcgcggacatggtgctgtcaagaagtgcggacggctggactgcaggcacgccgcttgaggtactcagcgatggcagggacgccctgctcgtcgtcgccatgaacggcgaaccgctgcccctggagcacggcttccccgtcaggctggtggtgcccgggctgtacgggtatgtgtcggcaacgaagtgggtcacggagctgagagtcacccggttcgcggacgacgttgcctactggacgccccggggctggtccgagcgcgggcccattaagacctcttcgaggatcgacgtgccccgccccggaaggccggtgaaggccggaacaataatgttcggcggtgtcgcctgggcacagcacacaggcatcgacagggtggaactgcggctgaaccgtggaccctggcggcaggcagacctggcacgaggcatctcggcggacacctggtaccagtggaaactgggcgtggagttgacggaggggcagtatgaagtccaggtccgtgccacggacctcgcgggaggcattcaggacgagcggagccggccggttgtcccggacggagccaccgggctccacacgattagagtggacgtgacaccctgaacgctcgaactgaaggcggaaccatggccagcccgcaaccgcatggaacgtctgcagaggcggagcgccggacggagcaccagcggcatcacgcaaagcaccaggcgaggtccgtggctgaccatgcagcagccgtcactgcgttgctggagccattgaactctgtgcaccggacggaaacgttgcccctggcagatgccttcggccgcggtctggtggcggacgtgcgtgcccccatcagcctgccgcctttcgccaactcccaaatggacgggtatgccatccggtccgtggacgtgcccgacggcggtgcggagttgggcatcatgcctcccgttccagcgggcgtacgtcctgcagcactgcaacccggcatggctgccccgatcatgaccggagcgatgctcccggcgggggccgacgccgtcgtccctattgagcgggccgttccggaccgcttcctgccagccgccgcccaggcaaaggaacacgccaccgtgtggctgccgccggcggcgccaagcacgttcgtccgggctgcaggcagcgatgtgcaggccggcgggacgggactcgctgcgggcaccttcctcggcccggcccagctgggactcctggccgcgctgggcatcccggacgtgaccgtctaccaggcggtgacagttctgctggtcaccaccggcgacgaagtggtggagcccggccgtgagctgccgcccggcaaaatcttcgactccaacgggaccctcctggaagccgccatgaaacaggcaggactgcaggtccgccgtgcaggcatcgccacggacaacccggacgggctcagggcgctgctgcgggaagagggcgcaggagcggacctgatcgtgaccaccggcggggtcagccagggcgcgtatgaggtggtccggcaggccatggcggaccagccggtcgagttcctgcatgtagccatgcagccgggcgggccgcaggggatcggcaccttcgaaggccggcccttcctcgggttccccggcaacccggtcagctgccttgtgtcctttgaaatgttcctccgcccggccctcgccggcctgctgggcgcaccggcgccccgcctgcccgtccgcgcccggctcagccagccgctgacctcgccggggcacaagcaccaggtccgccgcggaaccctcaaggcggacggaaccgtggagttgcagggcggggagagctcacacctgatgcacgcgctcgccggctccaacgttctggtccacgttccggaaggagtggccgcgctcgcggcaggggcggaggtggaagtatggatgctgtgaatgcagaacagaccccgcccgcgctgacgcacctgcgccaggacggcagcgcccagatggtggacgtctccgccaaagccgaaaccacccgtgaggccaccgccaccgccacagtccgcaccaccgcagaagtcatgggcctgctgggctcgggcggcctgcccaagggcgacgccctggcggtgtcacgggtggccgggatcatggccgccaaaaagacccccgaactgattccgctctgccatccgcttcccctgtccaaggtgacggtggactttgaacttggcactgagacggtttccatcctcgccacggttaagacgcgcggcgttaccggcgtggagatggaagcactcacggcggcctccgtggcggcgctcagcgtgtacgacatggtcaaggcggtggacaagcacgccgtcctcaccgacatcaaggtgctggccaaaagcggcggcaagagcggggactggacactgtgagcagccccggcaccctgaatgcccctgaaccccaccgccacggcgacgtgcagggccgcaaggccggcatcgtcattgcctcaacccgtgccgccgccgggatctacgacgacgaaaccggccccgtgatcagcgactggctgactgaacacggctttgacgtgttccccgccatggtggtcccagacggcgagcccgtgggctcagccatccgtgccctcctgacccagcgccccgccgtcgttatcaccagcggcggcacgggcctcagcccggacgaccggacccccgacgtcaccctgccgctgctggaccgcgagattccaggcatcatggaagcggtccgccgtgccggagccgcgaaaaccccgttggcggcgctcagccgcggttatgccggtgcggccgggaccacgttcatcatcaacctgcccgggtcaccgaagggcgtcatggacgggctgacagtccttgacccggtgatcgggcacctttgtgaccagctggaaggcggacatgggcactgaagcagctttcgaggtagtcaacgcggtcctgagcgcggaacccatctccgtggaccaggccatcgccgcggtggagagtgacaccgccggcgcggtggtcagcttcagcggcgtggtgcgcaatcacgacggcggcaaggcggttgagcggctcagctacagtgcgcaccctaccgcccaccaggtgatggccgacgtcgtggcccgccttgcggccgaacagcaggcagcagttgatggcgacggcggcgccaccggcccgtccgcgcagccagtgcggatctgggcagcgcaccggatcggcatgctggaaatcggtgatcccgcgctggtgtgcgccgtgtccgcggcccaccgcgggcaggcctttgccgtgtgttcggaactggtggacaggatcaaggagcaggtgcccatctggaaggaacagttctttgctgacgggaccgtggaatgggtgggggcgggcagctgacgctgctgctccggcgccactgcccgccatcgcccaggcctgttcctgcgaggtaacgcacagtccctggttccactgcctccgggccccgccggtagggttaacggcatgacccaacaactctccaatcccaagctggtggccgtcctgggcgccaatggccgcatgggcgccgaagccgtaaaagccgttgaagccgcgcccgacatgaaacttgttgcggccctggggcggggtgattcgctggaccgtatcaccgctgccggcgcccagtacgttgtggacctgacagttccggaaagcaccgaagcgaacgtccgcttcgccgtcgagcacggcatccacgctgtggtgggcactaccggctgggatgccgaccgcctggccgggctggaaagccttctggccggccacccggagacgggcgtcctgatcgccccgaactttgctcttggctcggtgctcgcctcggcctttgccgctaaggcatccaagtactttgaatccgtggagatcatcgagctccaccacccggacaaggtggatgccccctccggcacggcagtccgcaccgcgcagctgatcgcggccgaacgcagcgccgcagagctgccgccgagcccggacgccaccaccagtgagttggcaggagcgcgtggctgcgaggtcgacggcgtgcgggtccacagcgtccgcctccgcggactggtggcgcaccaggaagtcctgctgggcggttccggcgagcagctgaccctgcgccacgactcctttgaccgtgcatccttcatgccgggcgtgcttctcggcgtgcgcaacgtggctgcccaccccgggctgacggtgggcctggacggctacctggacctggggttctaggccatgggcggactgctggcagggttccggaagaaccgcaccaagatctgggtgggggcagtaaccctgttgctggtcttctacctggtggtgtccttccagcgttccatccttctcctgacggacagcaacctggcggcccaggcaatcggggctgcgtacctggtgctgccggtcattggtgcgtgggccctgatccgggaactgatgttcggggcccggaccgagcaaatggcaaaggtcctggaggcggagggcggcctgccggtggacgagctgccccgcactcccgccgggcggatcgtccgctcggcagcggatgcggaattcgagaagtacaaggccgaggccgaggccgctccggacgactggcgttcctggttccggctgagctgtgcctatgacgccgcgggggaccgcaagcgtgcccgggcttccatgcgcgacgccgtccggctcttccagggcaacgctcccgcctagggttcaggaacgtcaggcccttaccgggcagccctgacgtttcccctgcccgcctggtttgccgcgtgccccagccattcgagaggcccccgccacttcagcagcacgaacaccatgcccacgatgaccgccgtggcggcctgggcgaagtacatcccgtcatcggtccagccggcgggcaggggcttgaggtagaacccggaaaccacccagacgtggaccgtgtaaaggctcagggtcatcgcgcccgcgccgcgcagcggcagcagcaggtccaggtccacccactcggccagccggcccagcaggaggcaggccccgatcacggccacggccacggccgatgtgtgcagcaggtccagggtggttgccgagtgtggcgcggcagacgccagccaccaccaggaaccctcctgtggaatacccgtcaggttcacctgcagcacgctgtccagcggatacccgggggaattcagcagatcctccagggcagcgcggccgccccagctctccatggcggtcacccccagggtcttggccaggacggcaaccagtgaaccggccaccagcaggaccaccggaaccatcgccctgccgagcaccagccggcccacaatgagccccaccaggaggtacgagagccactggaatatggggtagtagccggtgaagaaaaggtcagccagcagccgtgacggggtggcgaggtcctcccaggacgggttatgacccagtttgagtggaggctcggacgccaggagccacgggcgcagcaggtacgccaggacgggggagcccaggatccagccgccggcccacgcacagagccgcttcaggcccatccccaggaagggcaggacacacaggaacagcaccgcgtaatggaccaggatgacagcaaggttgacttccagcccgcccagggtaagtccgacggcggcaatcaccagggcgcgcagggcaatgccgcggcgggcggcggagaggtccgggccctgcaccggcttgtgcttgcccgtggacaaggccaggcccaccccggccaggacggcgaacagcgctgccgccctgcctgaaaacgtgagtccgatccacgtgggggtcaggtcggcggtggattcgaaggtggggagcaggtgggtggccatcatccccagcagggcgaggccacgggccgcgtcgatgccgtggaggcgccccgtgacgggctgcccgccggatttccgggacgttctggccgcattacgggacgtcatgaccagatcgtctcacacctgcctgtgctggaggcgcctgccgaaccttcttgtattcgaatatatgttcgaataagattgccgccatgtacactccaccatccggaagccctccatcatccggaagccctgcatcatccggaagccctgcatcatccggaagccctgcatcatccggaagccctgcatcatccggaagccctgcatcatccggaagccctgccgataagtccggcggtgacgggctcgccaaggccatgagcccgggggtcgtcgactacctgttccgccagttggtggccggccggccacccgaggacgtccagtgggagcaggagggcatcagcctcgccgcccagcctgagggagcggaactggcccggcgcctcgcggagacggacatcgatgccctgacgcccgttgagcttttccactacgtcagggccgcccagcggctgtcgtcctgggtcgaggacctgcgccaggccgccgtcggacggtattgccaccctccggcttaccacccgccggcggaggcatcctgccccgcccggcaccccgcctcctgaccggcagcagcgcactccacctcctggccggcggcagctccggccgtggttcggtgcccgggacggtgtccggaagatgatggcggaaaggggcgcggcgcgcatggccgcgatgcggccagtccgttatttgacgtgcatcacgcccctggcattgtcctaaccagccgcagacagggtaacgttttttccatggctgacacatccgcgcatctccctgcccttggtactcttctgaccgccatggtcacaccgttcaccaaggacggcgcagtggattatgagcaggctgcagcactggcgagcaagctggtggacgatggctgcgacgggctggtggtcaccggaaccacgggcgaaacctccaccctcaccgacgaggaaaacctcggcatgttccgcgccgtcaaggacgccgttggcggccgggctgcgatcatcgccggcacgggcaccaatgacaccgcccactcagtccacctttcccggcaggcagcagccctcggcgtcgacggcctcctcctggtgacgccctactacaacaagcccagccaggccggtgtccgcgcgcacttcgaaaccatcgccagcgccgtggacgtacccgttatgctgtacgacattcccggccgctcctccatccccatcgagcccgacaccatgatccggctggcgcagcacccgaacatcgtggcggtcaaggatgccaaggccgacttcgtcgctgccgcccgcgtcatggccgagacggacctcctgttctattcaggtgacgacggactgacccttccgtggatggccctgggcgccgtcggactcgtgggcgtcacaacgcacgtggctacgcgccgcttccgtgagctcatcgacgccgtcaacgcgaacgatctcagcaccgcccggaagatcaactttgaactcctgcccgtagtgcgcgccaccatgacgcgggttcagggagccgttgcggccaagcagattcttaaatggcagggagtcctgcccaactcgattgtccgtttgcccctcgtggagccggacgaagccgagatcgaaaccatccgcggggatttggcggaagcggggctggtcttttcctgaggagtaagaccagcacccttccgcctggaaagtagtgcaatatgacccaaactgccctcaccggccttgtcacccctccccgcctgccgcagggaacgctccggattgtcccgctgggcggcttgggggagatcggccggaacatggccgtgttcgagatcgacggcaagctgctgatcgtggactgcggcgtcctcttccccgaggaaacgcagcccggggttgacctgatcctgcccgatttctcctatatcgaggaccggctggacgacgtcgtggccgtggtcctcacccatggccacgaagaccatatcggcgctgtcccgtacctgctgcggctccgcaacgacatcccgctggtgggctcgcagctgacccttgccctgatcgaggcgaagctgcaggagcaccgcatccggccctacacgctcactgttgaggaagggcaggtggagaagttcggccccttcgagtgcgagttcgtggcggtcaaccactccattcccgatgccctggcggtgttcatccggacagccggcggcactgtgctgcacaccggcgacttcaagatggaccagcttccccttgatggccgcatcaccgacctgcggcacttcgccaagctcggcgaagagggcgtggacctctttatgtcggactccaccaacgctgacgtccccggcttcaccaccgcggaaaaggaaatcggccccacgctggagcgcctcttcggccaagccaccaagcgcatcattgtggcgtccttctcgtcccacgtccaccgggtccagcaggtcctggacgccgccgccaagcacaaccgcaaagtggccttcgtaggccgctccatggtccgcaacatggcgatcgccgaaaaactcggctacctggacgtcccgccgggcctcatcgtcgacatcaagaacatcgacaacctgccggacaaccgcgtggtgctgatgtccaccgggtcccaaggcgagcccatggcagccctgtcccggatggccaacggagaccaccgtgtggtggtgggcaacggcgacaccgtcatcctggcctccagccttatccccggcaacgagaacgccgtcttccggatcatcaacggattgctcaagctgggtgccgacgtgatccacaagggcaacgccaaggtgcacgtctcgggccacgccgcggccggcgagctcctgtactgctacaacatccttgagccgctgaacgcaatgccggtgcacggtgaaacccgccacctgatcgccaacggcaagatcgccatcgaatccggcgtcccggaagccagcgtcatcctcgccgacaacggcactgtgatcgaccttaaggaccatcgggcagacgtggtgggccaggttgaagtcggctttgtctacgtggatggatccagcgttggcgaggtcaccgaggccgacctcaaggaccgccagaccctgggcgatgaaggcttcatctccatcatcacggtcatccaccgcgctaccggcaaggttgtgtccggcccggagatccacgcccgcggcgtggcagaggatgattccgtgttcgacgagatcatccccaagatcaacgctgcgctggaggaagctgtcctcaaccacgcggaccacaccagccaccagctccagcaggtagtccgccgggtggtgggcacgtgggtcaaccgcaagctgcgccgcaagcctatgatcattccggtggtcctcgaggcctgacaccggccgccgctaccggcccgcgttcccgtgcccaacgggaccgcgggccggaggcctttaagggccgcgaaccagggaccggcggcacccaaatccccggaattccggcccaactcgggtaccgtggctagtatggccactcgtactacttccgcgcccaatggatccagcaggggccgtgccggcagcaaaaccggcagctcctccggcggcggcgccggttccacggccgccaagtccggccgtgccggtggctccacgagcaccgcacgcacccgccagcttcccgccgtcgagcaccaccagccgtggctgctgcgcgtggtgggcggggcctggctgggcctcggccaccttgtgggcggaggggtgcggcgcatcggccatgacgtcagcgatctgccggcagaggaccgccgggacggtgcggccttgttcaaccttgccctcgggatcttcatcgccaccttcgcctggtggggcctcaccggctggttcccggacgccgtgtatgccgtagtcaacgggacgttcggctggatatcactcctgcttccgctcatgctgtttgtctgcgcgttccggctcttccgccagccgtccgacggccggggcaacaacagggtgggcatcggcttcctgatcatgacctttgccggctgcgggctggcacacatcctgggcgggcagcccaccgttgcccagggctttgacggcctccgccaggcgggcggaatgctcggattccttgccgcttcgcccttggccgccattcattccgctgttccgttggtgctctactccctgctggcattcgtctcactgctgatcatcaccgccacgccgttcactgcaatcccgcgcaggctgcacgccgcctacgaacacctcatgggcatcgacctgctggatgaaccggaccgggacaagcacgatcgcagctacctggaacggacccccgccgcaccccccaagaacgccaaaaagaagaagcggcgcttcttcggtaaggatgaggaggacgacgccggcctggaaggctatgtaggcgacgaagccttcgagcacgccgtgatcgacgacggcgacgcaaagggaggagcggaggcgcgtccggcgcctggtgtccgccgccccacccaggcggagatcgccgtcgaaaagatcaaggccgcccagggactgggtgcaggcgccccgtcttccccgggggaaaatgccaccgaagccatcccgatgatcacccccggcatggctccgcctgccgcaaagccggccgccgcgcccaccgtgccctccaatccggtggcccccgctccgccgccggttcccatcccgcagcgcaccgagcagctgtcgctcgccggcgacgtcacctatacgctcccggcatcggactacctgacccccggatccatcccgaaggagcgcacggaagcgaacgacgccgtcgtcgctgccctgaccgacaccctccagcagttcaacgtcgatgccacggtcaccggcttcagccgcggccccaccgtgacccggtacgagatcgagctggccccgggcaccaaggtggaacgggttaccgcactttcaaagaacatctcctacgccgtggcgtccagcgacgtgcgcatcctcagccccatcccgggcaagtccgccatcggcatcgagatccccaacaccgaccgcgaaactgtctccctgggcgacgttctccgcagccagaatgcccgccggacggaccacccgatggtgatgggcgttggcaaggacgtggagggcggctacgtggtggctaacctcgccaagatgccccacctgctggtggccggtgccaccggtgccggtaaatcatccttcgtgaactcgatgatcacctccatcctgatgcgctccacccccgatgaggtgcgcatggtcatggtggaccccaagcgcgtggaactcaccgcatacgagggcgtcccgcacctcatcacgcccatcatcaccaacccgaagaaggcagccgaggcgctccagtgggttgtccgcgagatggacgcccggtatgacgacctcgccaactacggcttcaagcacattgacgatttcaacaaggctgtccgcgccggcaaggtccagccgccggtggactccaagcgcgtcatccggccctacccgtacctgctggtgattgtggacgagctcgccgacctgatgatggtggctccccgcgatgttgaagactcgattgtccgcatcacccagctcgcccgcgccgccggcatccacctggtcctggctacccagcggccgtccgtggacgtggtgaccggcctcatcaaggcgaacgtgccctcacgcatggcgttcgccacctcctcggtgaccgactcgcgcgtggtccttgaccagcccggggccgaaaagcttatcggccagggtgacgccctgttcctgcccatgggtgcctccaaggccatgcgcgtgcagggtgcgtgggtcacagaatcggaaatccataaggtggttgagcacgtcaagggacagctccaggccacctaccgcgacgacgtcgccgccgaagcgcccaagaagcagatcgacgacgacatcggggacgacctcgaggtcctgctgcaggccaccgagcttgtggtcaccacgcagttcggctcaacgtcgatgctgcagcgcaagctgcgcgtcggcttcgccaaggccggacggctgatggacctgctggagtcacgcggagtggttggcccctccgaaggctcaaaggccagggacgtcctggtgaaaccggacgacctcgcgcccgtccttgccgccatgaagggccaggaagccccggcagcacccgactcgcagaccgccgcgctgagtgataacgccaacgccaacatcgcccagggcggctacgccgaagatttggtggccgcagacctggaccagcggaagcagagcgtcgaatattacgacggctcggattccccgcccggcggctatgacgacgaggacggctccgaagacgcctggtccctgaccgggcgctagcccggggactgtagcctagaaacgtgactagcaccgatgcaaccgccgccggcccaggccgtgccggggtctggaaccttcccaacatcctgaccatgatccgcatcgcactggtgccatttttcgtctggttcctcatcgcggacgcccccgggctgcgcagtgaggcaggcgtgtggcgctgggcggcggtccttgcgttcgccgtcgccatctacacggacaagctcgacggcgatatcgccaggagccggaacctcgtgactgacttcggcaagatcgccgatcccattgcggacaagctcctcatcggttcggcgctggtcatgctgtccgtcctgggcgagctgccgtggtgggtcaccctggtgatcctggtccgtgaatggggcgtcacggccctgcgtttctttgtgatccgctacggcgttatgccggcctcccgcggcggcaagctcaagaccgttgtccagaccgctgcgatcttcctctacctcctgccgctgggctcttttgccccgtggctcgtgtgggtggcgttcgcggtgatgatggccgccgtggtgatcacggtgtggaccggcgtggagtacgtggttgaagcactgcgaatccgggccaagggaaagctgcaggcgcgcaacgatgaaggccaggagcccgcatgacaaaccttcaccatttgtccgccgaagcggtccgcgaggcgctcgacgcgggccggaccgtggccacagccgaatcgctgaccgccggcatggtgtccgcagtcctggcggacacccccggtgcgtccggcatcctgcagggcggggtgattgcctaccagaactccgtcaaggaaaaggtgctggacgtcccgtccgtgctcttggcgcgcgtcggatccgtcgacccggacgtcgccgcggccatggcggcaggagcccggaccgtcctgggcgctgacatcggcgtctccaccacaggcgttgccgggccggaggcgcacgacggaaagcccgtgggcaccgtctacgtgggcatagccaccgcagcaggaacagcggccttcgaatacgccttttcgggaagccgtgccgagatccgaggacaggcttgcggggcggcccttgaaaggctcctcgaagccctgtccggatagcgcccggtaccccgaagttactgggcgtatagttgccgggaacaaaagccggtaccgattagttattacattgtgtcgcttccggagagcggaggcgcctaggatgaaatgaccacgacggttcgcctgagggcggacctgaccaatgagggagcaaggcgatacagatggtaaagcagcccgtatccgtaaacggcgttgtccgctggaaggatgtgggcctcgccgatcagggcaagagcgaacagaaggagcgcaagatggttgtacttcgtcacgaaattggtgatgtcctgcgcgatgtccgccagcgtcaggggcgtacgctccgtgaagtttcgcacagcgcccgtgtctccctgggttacctcagtgaagtggagcgcggccagaaggaagcatcatctgagctgctgtcctcgatctgctcggccctggatgttccgttgtccagcatgcttcgcgaggtgagcgacagggtggcggttgcagaaggcgttgccgttccggacaccgttccccaggagttctcccagcgttatggccgcgacctcgagcgcgacctcaacactgaacttaacgacgaactttccacgggccttctttccggcgcccggtaaggtcccgccggaaggcggctcccggaatgtagcaaacactaaagcccccggccacggccgggggcttcagtgcgttccggctactgaccttccacggtggacgccgggccatccttcgggaagccgtcgcgttcgtaggtggagttcagcttggccatacagcgggccagttcctccagttcctcaaccggccattcgcccaggcgttcgcggaacacctgccgacgggcgtcctggacctgatgcatcttttcctcgcccttgggtgtcagccggatcgcctgcgcccgtccgtccagggggtcagcctccttggacacgagccccaggctctccaggaaagcaatctgccggctgacggacggcttgccgacgccgatgttcattgccaggtcggtaaggcggatcggcccctcccggcggatcaccgtcaggaggccgtacgccgccggttccatgtccggatggacctggcgggaaagctggttggagatcgaccgtgcgcgccgccaaaagagactgatctggtgttccacgttctgcaccgctgcgtccacggtcgcctcgtcgtggcggccttgcagggaggggacgtcaggggagttgctcatggcaacaattctagtgcgcgggatcatgagagacttttctggtgcgaatcagcgattattggcgacttatggacgacgaattcggcgccgggtactcgcgggtcctcagcagcagccttgtcctggcaggggtgggcgggcgcaccgcggaccaggcgcttgcagcaggcatagagccccgcagggtgtggctggccgtctgcgacgtgcaggatgtccccgccgagcgccggctgggccgggacatcaagccccgcacagactagcggctttctcctgacacgccgcgcgattgttcgaatacctgttcgggtaaagctatgcttttcatagcgggttatccacatagccgccctcacccggccggaatgtcagtgggtcccagtagcgtcagagatgaccaataaacggccgctgaggccactccaaagcgagaaagcattagaggtgtgaaccatggcggcagccccggatcgtgcaaaagcgctcgaagcagcgctggcccagatcgacaagcagttcggtaaaggctcggtcatgcggctcggcgatgaagtccgggctccgatcgaggtcattcccaccggatccattgctctggatgttgctttgggaattggcggccttccccgtggccgcgttgttgaaatctatgggccggaatcgtccggtaagaccaccgtggccctccacgccgtggccaacgcccagcgcctgggcggcatcgccgcgttcatcgacgccgagcacgcccttgatcccgaatacgccgcgaagctcggtgtcgacaccgacgcgctcctcgtctcccagccggacaccggcgagcaggcactggaaatcatggacatgctggtgggctcgggctccctggacgtcatcgtgatcgactccgtcgcagcgctggtgccgcgcgccgaaattgagggcgacatgggtgacagccacgtcggcctccaggcccgcctcatgagccaggccctgcgtaagatcaccggccggctgagccagaccaagaccacggcgatcttcatcaaccagctccgcgagaagatcggcgtcttcttcggctccccggaaaccactaccggcggtaaggccctgaagttctacgcctccatccgtatcgacgtccggcgcatccagaccctgaaggaaggtgccgattccgttggcaaccggaccaaggcgaagatcgtcaagaacaagatggccccgccgttcaaggtggccgaattcgacatcatctacggccagggcatttcccgtgagggcggcatcatcgacatgggcgtggagcacggcatcatcaagaagtccggctcctggttcacctacgacggcgaccagcttggccagggcatggagaactcccgcaggttcctccgtgacaaccctgagcttgctgccgaactcgagcgcctgatcaaggaaaagctcggcgtgggcgtcaagcctgcggagccggagtccaaagactccccgaagctgaaggccgttgacgggttctagccgttgaccggcttcgacaatccgcgtccccgccgggcaaaagccggcgggcggcgcggagtttcacattgcggcgcgttccaggacggtccggatcccggttcttccgttgccggggacgcagagccggatccggtgtccgttgcgcagaacatcgtgtaccggcaactgaccgcgtcggccaaaagccggctgcagctcgcccaaaaactcgccgaacggaacatcccggacgacgtcgccgaggcagtgctggacaggttccaggaagcccgcctgatcaacgacgccgactttgcggacatgtgggtgaggagccgctcccagtcgcggaaactggcgaagggagccctccgccgcgaactcgcggaaaaaggcatcgaccaggacaccgccgccgcagctttggaacagctgacggatgcggatgaggaagccgccgcacggcagctcgtggagcggaagctccgcccgggaacggatttccaggaccgggcggcaagggacaaggcaaccaggcggctggcgtccatgctggcccgcaagggctatcagccctcgcaggcgttccggatcgtcaacgaggtcctggagtcctgcgcgggacccgacggtgccaacccgtaaaaccggtacccttaacaggtgagtttgaccatcccttcccccttttccggtaccggcccctctgcagaagctggtggtgctccgcaatccggtggccccaagccccgcacctaccaggtgcggacgttcggctgccagatgaacgtccacgactcggagcggatggccgggatgctggaggacgcggggtatctgccggcagacggtgagcaggccgacatcgtggtgttcaacacgtgcgcggtcagggagaacgctgacaacaagctctacggcaaccttggcatgctggctccggtgaaggcagcaaaccccggcatgcagattgctgtgggcggctgcctcgcccagaaggacagggaaaccatcctgaagaaagccccgtgggttgatgccgttttcggcacccacaatgttggcgccctgcctgccctgctggaccgcgcccggcacaacagcgaggcgcaactggaaatcctcgagtcgctggatgtcttcccgtccacgcttcccacgaagcgggactccgtctactcaggctgggtatcgatctccgtgggctgcaacaacacctgcaccttctgcatcgttcccgccctccgcggaaaagagaaagaccgccggccgggagacatcctggcggagatccaggccctggtggacgacggcgccatcgaagtcacgctcctgggccagaacgtcaactcctacggtgtggagttcggcgaccggcaggcattctccaagctcctccgggcctgcggggacatcgaaggcctggagcgcgtccgcttcacgagcccgcacccggccgccttcaccgacgacgtcattgacgccatggccgagaccctcaacgtgatgccgcagctgcacatgccgctgcagtcggggtcggacaaggtgcttcgggacatgcggcgttcctaccgctccagcaagttcctggggatcctggacaaagtccgcgagaaaatcccgcacgcggcaatctccaccgacatcattgtggggttccccggcgaaaccgaggaggacttccaggcaacacttgatgtcgtggagaagtcacgcttcgccaccgccttcacgttccagtactccaagcgccccggcacccctgccgctgacctgccggaccagctgcccaaggcagtggtccaggaacggttcgaacgcctgaccgcactccaggaccgcattgctgcagaggagaaccagcgccagctcggccgccgcgttgaggtcatggtcacggcgcagtccggacggaaggcaggggagacgcacaggctgtccggccgttcgcaggaccagcggctggtgcacttctcggtccctgagggtgcgcccgctccgcggccgggagacctggtcacggtgaccatcaccgaggccgccgctttccatctcgtcgccgatcccaccctggaggattacagcctccgccgttcccgggccggcgacgcctgggacaggtcgcaggcagattcctgcggagcacccgcaccgggggctggtgccggtggcaagggcgtttcgctgggcatgccctcgttgcccgtccgcacccgctgaccggtgggctcaccgcctgtcatcgccgtcgttggccccaccgggtccggcaagtctgacctcgccgtcagccttgcccttgaactcgacggcgaagtcatcaacgccgacgccatgcagttctaccgcggcatggacatcggcaccgcaaaaatcactgaggctgaacgcaggggagttccccaccacctgctggacatcctggaggtaacccaggaagccagtgtgtcgcagttccagcagcaggcgcgggagctcatcacggacatccatgcccgcggcaagcgcgccgtcctggccggcggttccggcctctacgtgcgggctctgctggacgtcctcgagttcccggggactgatccgctggtgcggcaacggctggaagccgaactcgctgcgcaggggaccgcggtgctgctggagcggctgcgggaggtggatccggtgtccgccggccgcctgtcggatgaccggaggatcatccgggccctggaggtccaccagcttaccggacggccgttcagctcctttatgccgcagcgcgagtacttccagcctgccgtccaggtaggcctggcagtggaccgcgaggtgcttcgggaccggctcgcccgacgcgtccacagcatggtggacgccggcctcctcgcggaagtcgaacggctggatgcccgcgggctgcggcagggcaagaccgctccccgcgccctggggtactcgcagttcctgcgcgttatcgacggcgaatgttccgttcccgaggccgcggaggacaccatcgtggccacccggcagttcgcccggcgccagctgacctggttccgcgccgacccgcgcatccactggctggactggcaggatccggccctggtggccaaagcagcggcgctctcccgtttttagggctgcaccgcccggccggtacccttggaaccatggacacaaccctcgcagaaaccaccgagccggccttccgcaccctgagcgggctccgcttttccaaggggcacggcaccggcaatgacttcgtcctggtggctgatcccgagggcgtccacaccatcacggccgaagcagtggctgccctgtgcgaccggcaccgggggattggcggggacgggctcatccgggcggttccctcgcgcttccttccggagggccgtgagctgctggccgccgccccggatgctgagtggttcatggactaccgcaacggcgacggctcgctgtccgaaatgtgcggcaacggcgtccgcgtgttcgtccatttcctccgtaccgaaggcctgatcgaactgcccgacggcggtgccctggccatcggcacccgcgccggggtcaagaccgtggtgcgtacgggcgacgactacgccgtggacatggggccgtgggagttcatcttccccggggaagctacggccaaggccatggattcgctggtgaccgcggagggcctggaggttccacgccccgcactgtcagtcagcatgggcaacccgcacaccgtcgttgccctcgccgagctttccgaactcgccggaacccgcctgttcaccgcgcccttggtagaccctgccccggccaacgggaccaacgtggaattcgtggttccgtccgagccgctggtgcacgacggcgtcggctcggtgacaatgcgggtgcatgaacgcggcgtgggggagacccagtcctgcggaacaggtgcctgcgccgccgcagtggccatccgccactgggcaggagcggaagccccggactcctggcgggtccacgtccctggcggcgtggtgggagtcaagtttttcgctggtcccgcaggtcacgagcatgtggagctcagcggtccggcagttattgtggcaaccgggacgctttcctgaccttgaggatccggaacgacttcgacgtcgcttcccggctgacgctgaacgattcgtccagctcagctgcaagccaccgctgaagcgagtccgcccccaggttcttctgcaccaccagccaggccgtcccgcccggagccaggcggggcagccacagcgtcagcagggagtgcagttcgtccttgccgatccggatgggcggattggaccatatcgtgtcaaagcgcaggtcgggatccactgcgtcaggggtgctggccgtaacgttggccagccccaatgctgcggcgttctcgtttgtcagcgcgatgcagcgctcgttgacgtccacagcgtaaacccgggcggacggcgccttgagagccatggtcagtgcaaccggcccccagccgcagccgatatccaggaggttcccctgcggtgccggcgcgggtacctcgctgagcaggatggccgtgcctttgtcgataccgtcagggctgaagatgccggaggaagtctgcagcctgcgcgtttgccctgccagttcaacagtcaggggcttgcgggtgaaagggccggcgggtgttgcgctgaaataatgtgcggactccataactggccagagtagttccccttgcagcgtaaagggaaaccgcgggtatggccctctgctaggctggagggcatgttcctgatcttcgagtaaccggcacgggccacgcccgtcccatagcctgccctcaagcggcagcatgtcccacccagcgacgcaggttctctgaaccttccgctgcgtgcaccggaccaagcggcctcgtttgctccggtcgccggaccacactcgaaagtcagcctcctgctgaacttatcgccgttttccggctgctttcttttcgccgcgtagccacacgcggcacgtctgccagcgctgccgtccgcagcgccggcccggcaagccaggaggcttggatgaccgaaggccgtcagcccagcgcgaatacttcccccaccaccagcaatcggcactattctggaactgccgaatcttcaaaggagaccatgaccagccagcccaacaccggatcagatccagccgcccaggacatgagtcccgaggaaatccaggctgtcatcgaccggattctctccaaggacgtacctgccaggaaccccagcacgcaaagcggcgatgcgaagagcagcgacggaaaggcagtattcggcaaagcccaggcaatttcccgcctggacgaagaacattcaacgtacgacggcgaccagcaggacctcgaggaacgccgcgccctgcggcgcaccgcaggactgtccaccgaactcgaggacgtcaccgaggtcgagtaccggcagctgcgccttgagcgcgttgtcctggcagggctctggtccgaaggtacgctggccgacgccgagaactcgctccgggagctcgctgcccttgcggaaactgccggatccgaggtccttgacggactggtccagcgccgtgacaagccggaccccggaacattccttggctcgggcaaggcgcttgagcttcgggacatcgtgatgtccaccggcgcggacaccgttgtggtggatgccgagcttgcaccctcccagcgccgaggcctggaggacatcgtcaaggtcaaggtcatcgaccggacggctttgatcctggatatcttcgcccagcatgccaagagccgcgaaggcaaggcccaggtggagttggcgcagcttgagtacctcctgccgcgcctccgtggctggggcgagtcgatgtcccgtcaggccggtggccaggtgggcggcgccgcggccggcatgggttcgcgcggtcccggcgaaacgaagatcgagctggaccgccgccgtatccggacccggatggccaagctgcggcgggagatcgccgcgatgaagccggcccgtgagaccaagcgggccaaccgccgtcgtaattccgtgccgtccgtggcgatcgccgggtacaccaacgccggcaaatcctcgctgctgaaccgcctgaccgacgccggcgtcctggtggagaacgccttgttcgctacgttggacccgactgtccgcaaggcggaaaccgcggatgggctgggttacacgctcgcggacactgtgggctttgtccggtcgctgccgactcagctggtggaggcgttccgctccacgctggaggaagttgccgacgccgacctgatccttcatgtggtggacgtctcgcacccggaccctgaggggcagattgctgcagtccgcaaggtcttcagcgaagtggatgcccgcaaggtgcccgaaatcatcgtgctcaacaaagccgacgccgctgacccctttgtggtggagcggctcaggcagcgcgaaccacggcatgtggtggtgtccgcccgcacggggcagggcatcgcggaactgctgaaggccatcagcgacgccattcccaggccaagcgtcaagctggagctgctcatcccgtacgaccgcggagacttggtcagcaaactccacgagtccgacgccgagatcatcagcgtggaccacgtggagcaaggcacgcgggccgtggtgatggtccgggaaggctttgcggccgaactggaacccttcgtcagcaatgactgacctcgtggccccggaagccacggagacggccggcgagcagttcgtgatcgaactgctcgaccgggccgttgccggcatgggcggacaaagccgtgagggccagcacgagatggccagggaggttgcccgtgcgctgggaacgggggaccacctcctggtccaggcggggacgggcaccggaaagtcgctggcctacctgatacccctcatcgcacacgccctggaaagcaacaagcccgccctcgtgtctacggccacgcttgcgctccagacgcagatcgtgggccgggacctgccccggctgctcaaggccatcactcccgccctggacaggcccgtcaaggtggccctggtcaaggggcggtccaactatgtctgccggcacaagctggaaggcggctttcccagcgaggaaccggcggaaggccagctgttcagcctgggcgaggacaccagcgtgccgcacttcgcagcagccgtgggcggcccctcgtcgcagctcggcaaggaagtggtgcggctgcgggagtgggcggagaagaccaccacgggcgacagggatgagctgctgcccggtgtcacggaccgtgcctggcgccaggtgtccgtaacgtccatggaatgcctgggcgcccaaaagtgccccatggcggcagagtgcttcagtgaactcgcccgccaggacgctgcggaggccgacgtcgtggtcaccaaccacgccatgcttgcagtcagcgcctttgaggggctggcggtcctgcccgagtatgacgtggtggtggtggacgaggcgcacgaactccaggacagggttaccggtgcggtgtccggccagctgtcggtggccatggtgcacgccgctgccgccggtgcccgcaagcacaccgccatcaccgttgacgcgctcaacgctgcggccgcaaacctggagctagccctcgccggcgtgccgaacggactgctgcccaacggactgaatgacgaacagctggactgcgtggaccagttgcgcgacgcctgccgggccgccctctcggattcgaagggggacagcactacagcgcccgacggcggcaggcagcttgcgcggtcccgcctgatgctcatcctggaactttgcgaacggcttctcgctgcccgggagaaccgcgaagtagtgtggttttcccgcgccagctcctttgatcccgcgcaggggttttccccgccggatgaggcagcgccggctttgatcaacatcgcgcccctctccgtggccgggcggctgcgggaaggcctgttcgccggacacaccgttgtgctgacctctgccacgctggccatcggttcagcatttgaacctgccgcgggcgggctgggcctcgtgggtgagggtgctccccgttggaagggcgtggacgtgggttcgccgttcgactaccccaaacagggcatcctctacgttgccgggcacctgcccaagcccggcaggggcgcatccccggaagcgctggatgaacttgaggccctgatccgtgcttccggcggcggcgcactgtgcctgttttcctcccggcgcgccgcagaggaagcctccgaagcactgcgccccaagctgggcatgacggtcctctgccagggcgattccaccatgaccgccctcgtgaagcagttcgccgatgagcccgacacctgcctgttcggaaccatgtccctgtggcagggtgtggatgtcccgggcggttcatgccggcttgtggtgatagaccggattccatttccgcggccggacgatcccctcatgacggcgcgctcccgggccgtggcccaggcgggcggcaacggctttatgtccgtttcggccacccatgccgccatccggctcgcccagggcgcaggccggctgatccgctccaccggggacaagggagtggtggctgtacttgactccaggctcgccaccgagcgctacgccgggttcctccggggagcgctgccgccgttctggtccacaactgaccggaagacggcgatcgctgccctggagaggctggccggggaaaacgcctgacgccctggccagggccgggcctgtaggaagctggccctgcgcatagctggtctgcccagggtggatccagccagcgctgcgcagggccgggtctgccctgggctatttgttctgttgggctggttctgcctgggccaggagcgggcgcctacagcgagcggagtactgacacgaccttgcccatgatggtggcgtggtccccgaggatgggctcgtactgggtgttctgggggagcagccaggtgtggccgtcacgctgccggaacgtcttcacggtggcctcgtcgtcgaggagggcagcgacgatgtcgccgttggccgcgtccgcctggcggcggaccaccacccagtcgccatcacaaatggctgcatccaccatggaatccccggccaccctgagcatgaacagttcgccctggcccaccagttgccgggggagcggcatgacgtcctccacctgctggtcggcaaggatggggccgccagcggcgatgcggccaacgagcgggaccatcgcggtgtccagagcggtgggcagctccgtgacggtggcgccgcgggctgagcgtcctgctgatggctggctggccggcttggccgcaccgccgtccagggtcaggggcatgagtacctccatggcgcgcggacgcttcgggtcacggcggaggtagccgagtttttccagttgggccagctggtgcgtgacgcttgaaaggctggccagtcccaccgtgtcaccgatctcccgcatggacggggggtaaccgttctcgttgacggagcgctggatggtttcaaggatctttttctgccgtggcgtcaggcccttggcggtcctcttcggttgcgcggttgccctgcccccggcggctgctgctgccatattcgccaatgcctttcggtgtccgccggacccctccgcggccatgccctggaggatcccgccccataatgtcagaccctgctgatcgactgtccgggtggttgttctttcgttcaaaactaggccagccacactgctttttcaaacatttgttctagcgagtctcgacaatgttcgttgataggtgctaaaactgaagaagcaaagttcgaacatatgttctactgcgaaccccggccattcgaagatggcgccgggaagcccctggcggggcgcggagcagaacatccgggcagcacagtatggtccaggagggctcagttcatgtcagctacatctgtttcgcggggttcacgtccacagctgctctcggtgcagcaacttctgtcccggcctgaagagcggcagccggaacagccagcaccccttccgcccctgcggctgacccgccgcggccgtattgtgctgatcgggattcccctggttctgctggccgccctgctgctctcactggcaggcttcttcaactccccggcgaaagcctcagactctgctgcggaccttcaggcgacctccgcggtcagtgtgacagtccagcccggccagtcgctgtggggtatcgccgccaccgttgcgccggagcgcgacgcacgcgatgttgtggcggacatcgtgcagctgaacaacctgtccgcgggcgcggtcttccccggacagcaactgttcgtccccgccgactgagctgtcaatgccggcagagtccggaccagcagcggtgcggctccatcgaatcagccggggttgcacgccgacggcgaacaggaagccgtcacattttccggcgtccggcaggggcactaaactgttcaggtgaatgaccagctagaacgcctgaaccggcttcccctccgcagcaacctccgcgggcttaccccttacggtgcgccacagctggacgtccccatcctcctcaacgtcaacgagaacacgcatggtgttccggcggacgtgcgggctgccatcagcgcggcggtgaccgaggcagccgcaggcctgaaccgctacccggacagggagttcaccgagctgcggaaggcgctggctgagtacctgggccacggcctggatgagaccaacgtctgggccgccaacgggtccaacgaggtgctccagcagatcctccaggccttcggtggtcccggacgcacagcgctcggctttccgcccacgtactccatgtacccgctgctggccagtggaacggacaccgaatacatcgtcggtgagcgcgctgaaggctatgggctcagcgctgaatccgcagcgcggcaggtcaaggaactgcagcccaacatcgttttcctctgttcacccaacaaccccacagggacggggctggggctggatgtcgtggaggccgtctacgaggccggtgaagcaagccagaccattgtcatcgtggatgaggcctaccacgagttcgcacacgacggtacgcccagcgcactgacgttgctgcccggccgggagcggttgatcgtgtccaggaccatgagcaaggccttcgcgctggcgggggcccgcttgggctacatggctgcagcacctgaagtcgccgatgcgctgcgcctggtccggctgccgtaccacctctccgccatcacgcaggccaccgccctggccgccctccagcaccgcgaggcgctgatggcggacgtggaagacatcaagaagcagcgggaccgcatcgtctcggagctcacgcggatgggcctcaagcctgcagcgtcggactccaactacgtctttttcgggggactggagaacccgcaccgggtctggcaggagctgctggacgccggagtgctggtccgggacgttgggattcccggccacctccgcgtcacggccggaactgagaccgaaaccacagccttcctcacatccctggaaagcatccttgcaagccaggccacgcttcccgcctagactggaagcagcggcgctggacgccctgaaccaccccttctgcccaaaaggaacaacgcatgagtaccaccggatcgaacgtggctgcggcccgcactgcgcgcatggaacgtgccaccagtgagtcgtccgtgctcgtggaaatcaacctggacggcaccggtacttcggacatcgacacgtcggtaccgttctacgaccacatgctcacagcgctgtgcaagcactcgctgattgacatgaccgtcaaagccacgggcgacatccacatcgacgtccaccacacagtggaggacgttgccatcaccttcggagaggtgctgcgcaccgcgctggggaacaaggccggcatccgccggtttggcgaggccactgttccccttgacgaggcccttgcccacgccgtggtcgacgtgtcggggcgtccctacctggtgcacggcggcgagcccgccggccaggagtaccacctgatcggcggccacttcaccgggtccctcacccgccacgtcttcgaggccatcacgctgcacgcgggtatctgcctgcacatgaacgtcatcgcaggccgcgatccgcaccacatcgtcgaggcccagttcaaggcgttcgcgcgcgcactccgtgctgctgtggaaccggatccccgtgttgaggggatcccctcaaccaagggtgcgctatgagcggccaggtcctgcgggacggtgccatcgtggatccctcggcctcccggaagctgccctcacccgagggcaaacccaccgtcaccgtcctggattacggttccggaaacgtccggtccgccgtccgggcgctggaacgggccggcgcggaagtcatcctgagctcaaagcccgaggacgtcctgaacgccgacggcctggtggtccccggagtcggggctttcgaaaccgtgatgcgcgaactcaaagcggtggacggtgtccgcctcatcggcaggcgggtggccggtggacgcccggtcctgggcatttgcgtgggcctccaggtcctctttgaggccggagtggagcacggcaccgaggctgaaggcatgggcgaatggcccggcaaggtggaactcctgccggccgaggtagtgccgcacatgggctggaacaccgtcaaggtgcccgaagggtccaagctgtttgccggcgtcgaaaacgagcggttctacttcgtgcactcctatggggttcaggaatggaacttcgatgtcatccagccacggatggccgcgcccctggtcacctggtccgagcacggcgctccgttcattgccgccgtcgagaacggcccgctctgcgccacccagttccacccggagaaatccggtgatgcgggcgcgcgcctgctccacaactgggtggaagccctgcgcaggcccgctgccggcggccaagccgacaacactccggctgacggcgcggcgccggcttcggaaggcggcaccgcctagatgtggtccgttgtcctgatggggcttgccggcgtgctcgtcggcggcgccctgtctttcaggcagcagcacaagccgctctggacccagatttcgttttatgttcttgcgggcatgtcgctgctcgccgcctacctgctgacgctgccgggcaactgaccgcggcaggccatcctgcccaccaccctgaggattcaccatgaccactgcaactgaccttcccgttctcgaactgctgcccgccgtcgacgtcgtcaacggccaggccgtccggctggtgcagggggaagcgggcagtgagaccagctatggaacgccgctcgaagcagcgctgaactggcagcagcagggagctgaatgggttcacctggtggacctcgacgcagccttcggccgcggctcaaacgcggagctcctccgcgaagtggtgggccggctggacatcaaggtggaactctccggcgggctgcgtgacgatgaaaccctcgaagcggcgctggacctcggcgttgcccgcgtgaacctgggaaccgcggcgctggaaaaccccgagtggacccgccgggccatcgagcgctttggtgacaaaatcgccgtcggactcgacgtccgcggaaccatgctggccggccgcggctggacgaaagaaggcggcgacctctgggaggtcctgggccgcctcgaggaagccggctgcagccgctacgtggtcacggacgtgacaaaggacggcaccctgcaggggccaaacgtggaactcctccgccagatggtggagaaaacgggcaagcccgtggtggcctccggcggcatctccagcctcgacgacctgaaggtcctgcgctccctggtgcccctgggtgttgaaggtgccatcgtgggcaaggccctctacgccggcgcctttacgctgcccgaagccctcgacgtcgccggccgccgctaagggcgcacgccggcatggccagcaaggaatcaggcactccgtcaccccgccagctgccggggcatatcgctgcggcgctggcaggtgccggcggcgccacggactccgcagggcagccctgggcgggccggagcctggctggcgacgacgccaggatccacaacttcgagaacgacgacgggacggccagcgctgactaccttgccgccatagcggcactccgggagggaaccggtgacgaggcgggcgtcgtcgcctcgctcgccaccgcacgggtgttcatcccgattgttgcccagctcgcggaggaagcggaaggccaggacggcctgcaggccgacaaacaggccgacatggcgctggtcacgctcaaagccgccgacggcaggaccgcaatgcccgccttcacctccacggctgccctgtccgcctggcatccggacgcccggcccgttgctgtgtacgccgcccgcgccgccctcgcagccgtctccgaaggcgcagagctgctggttcttgacccgggctccgccttcaccttcgtggtccggcgcccggccgtgtgggcgctggcccagcaacagcagtggacgccgtcctacaaggaccaggaacttgctgcggaaatgggcagggccgccgccggcttcgctgccgtccggaacatcgaactggtgcccggcaggggagtggccgcccgtgccgccgatgggaccgtagcagcaggcggcggcgccggacctgaactccaggtggtgctctaccttgaagacgggctcgatgccgcgggggtccaggagctggtggccggactccagggccaatggtcccggaatgtattgtttggggagcgcgtcgactcgatcgacatcaagttgaggcgtgcagaccactagccggcagccagcggggtgatccccggccactgcggcagacctaaggatcgctccgtgaatttcgctctctaccgggagttgctcgccgtccggcctatccgccggctgctgctggtgggcatggttgcccgcattccccactccgctgccggggtactgctgaccctccacatcgtcctgaccctggaccagggatacgccgccgcgggcgctgccgcggccgtcatgaccatcggcattgccgtgggtgcaccgtggcgcggcaggcgggttgacacggtgggcctccggacggcactcatcccttccgtgatctcggaagcggtgatctggtctgttgttccgcacgtgtcctaccagtggctccttccgctggtgtttgtgggcggcctgctcacgctccccattttcagtgtggtgcgccagtccctgggcgtgctggctgacggcgaccagcgccgtacggccttcgccctcgatgcgatcagcactgaggtggtgttcatgatcggtcctgctgcaggcgccatcgttgccaccagcggtttcacggtactgggcctcaccattgtgggggtctcgacgtcgcttgccgggctgttcctcatgtggttcaacccgccaacccgaagcgcggtgcagaccgaggagggcgaagtggatcagcgccacgccgctgaagccgccgtggtttcagccgcccctgcccacctccaggaggcggcggccgaactggtgcctgcgggcgcaacacgccgcggaccgggcctgcgcggcaaggtggcccacaacttcgcctggttcaccgccaccgtggcggccgtcttcgctgtggcggcaggggcgggcatggtgctgagcggaaccgacgtcggcatcgtcgccgccctcgaaacagggggccgccaggccgaaatcggcatcattttcctcttctggtgcgccgcgtccgtggtgggaggcctgatctacggggccatgcaccgcccggtctcgccgatcctcctgctgctcggaatggcggccctgaccatccccatggggtttgcgcacgatacctggtcgctcgcgctcgtctcaatcctgccgggactgctctgcgcacccgtgctgtcctccgcatcggaaaaagttgcggacctggtagccgaggaacgccgcggggaggccatgggctggtacggctcggcactgaccggcggcgtggctttgggtgcaccgctcgcgggtatcttcatcgacggcacggggccatccggaggcttcgttgcggtgggtgttgccggcgtcgtgctctgcttcgcgggccttgtcctccagcagcgccgccgtggcagaatcagcgcctagtaattcccagcccagcagccgagtttttgtccagatatgccggcttccgaggcgataaagtctgcatatctggacaaaaactccattaaatgcgcgacggcgggacgacctgtgaaggccgtcccgccgtcgtcgggggtattgaaaaggctgtggtggtcgcgtcagttaaccgccccggtgtacttctcgcccgggcccttgcccggggcgtcggggatcagcgactcttcgcggaacgccagctgcagggaccgcaggccatcacgcaagggtccggcatgctgggaaccgatctccggggcggcggcagtcaccaggccggccagggcggtaatcagcttgcgggcctcgtccaggtccttcagttcctcggcattgtcctcggccgccagccccagcttcactgcggccgcactcatcaggtgaacggccgctgtggtaatgacctcgatcgccggcacctcggaaatgtcgcggatctcctgcgagacatcgccggcggcccctgcctcatccgccgctggctcgaaaacgtatgaattactgtctggggtgctcatactggtaagcttgacacagaccgactggatgtcgttatttcagagattgttcaaacgatcaaggttcccaccggcgctccacagcgctgacgggaattttttctgtaagatggcatgcagtttgcaagcggagttctctcccacccgcgccagccgctgttccgaatgttttggaactcaaggttgccgggtacctggttgggcacggccccggcatgagccgaagctgtgtgcgcagtcccttcgtgggacctgcatccgatctttcagaggccttcgattgctccggcaattgggggccttctctatttgccggattccacaacaacaacaggagctttaacattagcgagccaagaatcaatgagcgtatccgcgtccccgaggtgcggctggtcggccctgcaggtgaacaggtaggaatcgtccgtattgaggatgccctgcgtctggctgccgagtccgaccttgatctcgttgaagttgcacctcaggcgaagcctccggtgtgcaagctgatggacttcggcaagtacaagtacgaggccgcggtcaaggcacgcgaagcacggaagaaccagacgaacaccgttctgaaggaaatccgcttccgcctgaagatcgacacccacgactacgagaccaagcgcgggcacgcactgcgcttcctcggtgccggtgacaaggtcaaggccatgatccagttccgtggccgcgagcagcagcgtccggagatgggcatccgcctgctccagcgcttcgccgacgacgttgcggaagttggcgttgttgagtccagcccccgcatcgacggccgcaacatggtcatggtggttggtccgctgaagaacaaggcagaggccaaggccgaagcccgccgcgcgacgcagcgagccgaggcaaaggcggagaacgaggccaaggcttcgggccgcgttgacacctccggcgatgatcaggcacccctgacccagtcgctcgcggatctgctcccggaggggttcgccatcaacaccgagccggaagccgaagcacctgtgcaggagccggcccccgtcgtcgaatccgccgcagccgaagcaccgaagcaggaggcccttaaggccgaagctccgaagcaggaggcccccaaggccgctgcaccgaagcaggaggtccccaaggccgccgctccgaaggcggctgctgctcccagggcagcagagcccaaggcggctccggcaccgaaggctgctgcagagaagcctgctgcggccgctccggccgccgcgccgaagcctgcggcagtgcctgctccaccgaagccggtggccaggcccgctgcgccgaagcctgccgcacggcccgcccccaaggcagcgccaaagccggccggcaagaagaccacttagtccacagctgccggaggtcgccctccggcagtcagcaaccagcacgccgccccgaggggcagctgcgcgatagaactgcaggcccagcctgcggaacgtaaggagatcggttcccatgccgaagatgaagacccacagtggtgccaagaagcgcttcaagctgaccggcagcggcaagctgcgccgccagcaggccaaccgccgccactacctcgagcacaagtcctccaggctgacccgccgcctcgccggcgacaagatcgtcttcaagggcgacgccaaggtcatccggaagatgctcggcatctagtttccaagttctttgactgaccaccacctggtgtaagtcacctaccaaaaagccttctcaggccgccgggactaccggcagtagatgcttgggagcagaattttcgaaggagtacgcacgtggcacgtgtgaagagggcggtcaacgcccacaagaagcgccgggttatccttgaacgcgcaaagggctaccgtggacagcgttcacgcctgtaccgcaaggccaaagagcagctgctgcactcgtttgtgtacagctacggcgaccgcaagaagaagaagggcgacttccgccgcctgtggatccagcgcatcaatgctgcgtcccgcgccaacggcctcacctacaaccgtctgatccagggcctgaaggccgctgaggttgaggttgaccgccgcatgctcgccgagctggccgtttccgacgccaacgctttcgcagcgctggtcaaggttgccaaggactccctgcctgccgacacctccgccaagaaggtcgttgcctagcaactgactgttcccgccagggacggttcaaggaccggtggcagcagccactaaagttcttatatgaacgaaaccgggcgcccgcaagattttccactgtccaatccccgagctgatcgggtgagggacgtggcaaaacttgccgggcgcccggcccgtttaaagcgcggacagttccttgccgaagggccacaggcagtgcgggaagcgctccggctccatcagcagcggttggccgatggccagcctggggtggtcaccgaagttttcgccagtgaaagctgcctggaccggcatccggaattcgaggaactgtcccagggagtcaatgcccgcctggccacggatgaagtcctggctgccatggcggacaccgtcaacccgcaaggcatcgtcgcggtctgccgtttccttgacgttgccctgcaggaagtgctcgacgccgggccccgcctgattgccgtgctctgccaggtccgcgaccccggcaacgccggaacagtcctccgcgcggcggattcagccggagccgacgccgttatcctgacggcctccagcgttgacatttacaaccccaaggccgttaggtccacggctggttcgctgttccaccttccggtggtgctgggggtggacatcgacgaacttgcggccgcctgccgcgccagggggatcggcgtcctggcggcggatggttacgggaccctcaacctcgataccctgcaggacgagaacgcccggcgccggctgaccggcgaaggtccggcatccgagtacgccctggagcagccaaccgcctggctgttcggcaatgaggcccagggcctgtcgcaggaggagcttgcgctggcggaccaccgggtggccgtgccggtgtacggttccgcggaaagcctcaacctggggacagcggccacggtctgcctctatgccagcgcgcgttcgcagcaccttccggttcaggtaactggctagcagtcgcggcttaaacatataagggctccggttcaccggagcccttgtttgttgatgttcttcctgcgagcggatcagggtgcgcgggtggccttgccgcgaccagtgatagctccgtaaatgccggccacaaccaggccgccgacgatcgcgagaatccaggtgccgaggtcgaagaaggcaagatcgcccttgttgaacaggaggcttccaatccagccgcccacgatggcgccaacgacgcccagaaccaggctggtcacccagccgccgcctacccgtccgggcataacagccttaacaatggcccctacgatgaggccgagaataatccaagcaagaaaacccatgtctcctccttaaagtgaccgggatctcatggtcccgatgtggctcaagctaacatacgggccccgtaaagtcagcaggcttacaggcgggtgaccccgtatgccggcgggtagggcggccgtttgtatcgccgcgggtgaaccagcactccagggatcaggtggccagcggcctcttccgctccagcagtccgctggccatggcgacgccgagccccagcagggcgaggacggcacctaccagcgcgggggcggtgtagccccagcccagggcgatcaccagtccgcccaggaatgccccgagggcgttggctacgttcagcgccgcgtggttcagcgatgatgcgagcgagggggcgtccggggacgcgtccaaaagccgggtctgcagtgcagggatcagcatggacccggaagcgcccaccacgaacaccatgacataggcggaccaaggccactggacggccacggcgtacaccaccaaggctacggcgatgccgggcagcaccttgtagagggtgcccatcacggacctgtccgcaatccggccgcccacaatattgccggccaccatacccagcccgtacagggccaccaccaggggaatcaacgaggacggaatgcccgccaccatggtcatggtgtgggcgatgtaggtgtaggtggcaaagaagccgccaaagcccacaatgccgatcagaatggccagccacacctgcaggcgtttgagcgcacccagttcacgccggatgctcgcatccgggtgggcctcgtggaaggggacaaacttccacaccagggcaagggtcagcaggccgatcagtcccacaaggataaacaggagccgccagccgtaggtctgtcccatccaggtggcaaacggaactcccaccacattggaaatgctcaggccggccatcaccattgagatggcccacccccgccgcgtgggtggaaccagggaggcggcgatgactgctgccaccccgaaaaatgcgccatgcggcaggccggcggcgaagcgcgaaagcagcattgttccgtaatccggggccaggaatgatgccaggttggccaccgtgaagaacatcatcagtccgagagccaggtgcttgcgggggagcttggcacctactgcggccagcagcggggctcccacgacgactcccagggcgtaggccgagatgaggtggcctgcttccggcgtggaaaccccaaggccctgctccacttcccttagcaggcccatcatggtgaattcggtgaccccgatgccaacaccgcccatggcaagggcgacgatggccatggccacgttggtggatcgggcgggggctgccgtggacgtttggaggacgctgctcataagcctgcttttcgaaggatgaaagtggtggtggaccagtgccacggcagtggggctgatgaagtccggaccctgcaaacaacccggaaaagagaaacagtattcccgtggaatgaggatatttgcagctggtcctttcattgtcccccatagaatgggccggtgaatggactgatacaggtggtaggcggagccgtcgtggacagcctggcggaaccctccatgctgctggtggcgcggcgcagcgctccggagcagttggcaggactttgggagttcccaggcggcaaagtggaacccggcgaggaaccggaggcggcgctggcccgcgaactgctcgaggaactggggatcggcgtccggctcggcgctgagctcccgtcgcaggttccgggcggctggccattgaaccaccgggcaagcatgcgggtatggttcgcggaaatttcccacgggcagccgaagccgctggaggaccacgatgaacttcggtgggtggcgctggagaaccacagcggcgtcctggacctgccgtggattcccgccgacttcccgatagtccgggccctgcttgacgcggtcgccgtcagggcaggaagcggactgtcctagaagagcgttgcctgccccgcggtagcagcattgcccccgatagcagctttgccctcggccgctgccgcctgggggatgatgccttcgggatactcggcttcctcgccgcggggatcgtcctccagacccctgtggctgaagccggacgtgttggtgaaaccgtggcgggctttgaagtaccggactttgcccgcaagccacgagcggtattccttggacgcgtacgaacctgtcccgtagagccggcggtaacggcccgccagcccgggatggttggcggcaatccacttcatgaaccactccctggtacccggcttgaggtacagggctccggccgtgacgccggttgcccccgcggcagccaaggacgcaaatagcgcgtcaagggcctcgtcgctgtccgaaagccacggcaggatgggcattgccatgacgccgcagggcaggccagcttcacggaggcgggaaacgagcttgaggcgtgcccggggcccgggcgtacccggctcaatggcctcggacagcgcttcgtctgtcattgccagggaaatgccgatgcccacgggcacctgggcagccgcgctcttgagcaggggaatgtcccgggcaagcagggtgcccttagtgaggatggacagaggagtgccggactcagcaagtgcggtgatgatgcccggcatgagctggtagcggccctcggcccgctggtaaggatccgtgttggtacccagggcaacctgcgggcgcgtccacgatggcttggccagttccttccggaggacctctgccgcgttgactttaaccaccacctggctgtcaaagtccagcccggcgtcgaaatcaaggtaggtgtggctcttgcgtgcaaagcagtacacgcaggcgtggctgcagccccggtaagggttgatggtccattcaaagggcatccgcgagccggcaggcaccttgttgagcaccgatttggcggtgacctcatggaaggtaatgcctgcgaactcgggggtcgtgacggagcggaccagtccggccaagggaagcaacgcgggggacgtgtccgcagccgtttccgcgggccggggcatcagtgcttgggcatcccatctcatgccgtccattcgaatctatgttcgaataaaagtcaagcatggagtgcagaagccggctggtccccagcacggggtacacctaggtgccggccaggagttcccactccacggttactgccgcgtccaccacggaattgccggcctccacgctgagggattcaacggcagcagcccgctgcatccggggcagcggcactggaccctggactgcgccttcctcggctaccgaaagcacgcgtcccagccgggccgaggcaagctgcgcgtactgcctggcggtgctgagggcgtcaaaccaggcggcctcccgggcgagtgcccgcacagccgcgtcatcgctgaaggtgagttcgacgccgttcagccggacgtcgctcccgcccgcatcaacggcttccgagatggcggctgaggcggaacccggggcccgcagcttcacggtgagggtgctggctgcgacatacccggtgacccgttgtccttcgccttcccgccaggcgaggtccgcgcggacgttgaggcccgacgtgcggatgtcggagtcggcgaccccatgcctgcggaaggaggcagtaacggcggccaggccggctccggcgcgcgtgtaggcttgccccaccgaatcggcccggcactccacgccgatcgaaaccaccgtaaggtcaggggcggcttccgccgagccggctcccgtcacgcggaccgtgccgggggaggcgttggtgcgggcggcgcccccacccgcctcatcggcgtcgtacgcagtggccatgggtcaaacctccacttcagacgggcggcggcgtgaggaccggcgccgggttttgtgtgctggatatccgccggcttccagcccggcgtggcgctcaaagggattgctcgtccccgggttgccggtgcgcaccagcgaccaccctgcggcgaggaaatacaggggaaggaacggcgcgcccaagcagtaggcgtactgggtgcagtgcttttcctcgtggcccagcagggcggggcgggacaataactcagtgccggtgcagcgggacagcaccacgttgcctacggtgaaagctccggcgaaaggcagccgcggcctgtacccggaggcgaggatcaggccgcgggggccgctgctgatccgggtgcgcgcggcgagggccacggcgaggccgaggacagtgctgccgttaaccaggttcgcaacctgccgcagtctctgcgcagcggtgaggcgcttttggggtcccgggcgccgcggcactgtcatgaggctatggtagccggagccttcaattagactggagggcagtggccgccggttcagccggtgtgcccggacctggtcattgaatgaaccggaatgcacagttggcattggggacattcatccatgacctgccagtggacggacgcgccgccgggaaaccgcgcagggctgccccgttcaccggcagccacgactcgtagctaagaacagtagatgactgaaaccttgccgggcgccgccatcccgaaccccacggatgaagccgccatcactgccgctgtagaccaggccgtcgccgccattgccggcgcgggtacccttgatgagctgaaggcggtgcggctcgcccataccggcgagaagtccccgctcagcctcgccaaccgtgagataggcaagctgcccaaggaccagaaggccctcgccggaaagctgatgggcgcatcgcgcggacgggtcaacaaggcgctcgcggaccgtacggcagagctggaagcggaaaacgacgcccggatcctgctggaagagacggtggacgtcacggccgcgccccgccgccgtcgtaccggtgcccggcatccgctctccacgcttcaggaccgcgtggcggacatcttcgttggcatgggctgggaaatcgctgagggaccggaagtcgaatcggaatggttcaacttcgacgccctgaacttcaagccggaccaccccgcccgcgaaatgcaggacaccttcttcgtggaaccgcccgaagcccacctgctgatgcgcacgcacacctcgccggtgcaggtccgctccatgctcgaacgcgagctgcccatctatgtgctgtgcccgggcaaggtgttccgcaccgatgaactggacgccacccacactcccgtgttccaccagttcgaaggccttgccatcgacaagcacctgagcatggcggacctccgcggcacgctcgagcacttcgcacggcaaatgttcggcgacgaagcccagatccggctgcgtcccaactacttcccgttcaccgagccgtcagcggagctggacatctggcaccccggcgccaagggcggcccgcgctggatcgagtggggcggctgcggcatggtcaaccccaatgtgctccgggccgccggcatcgatccggacgtgtattcaggttttgccttcggcatgggcatcgagcgcacccttatgttccgcaacgaagtgggggacatgcgcgacatgattgaaggcgatgtacgtttcagcgagcacttcgggatggagatctaacagtgcgtatcccactttcctggctgcgtgaattcgcagaggtaccggccggagcaacggcagaagacgtcatgaccgaactggtcaaggtcggttttgaagaagaggacgtccaccgtcccacggacaccctgcaggggcccattgtggtgggccaggtcctgagcctggtcaaggaaccccagacgaacggcaagaccatcaactggtgccaggtccgcgtggttcctgaaggtcaggagcagaccctcaccggcgacggcatcgacccctccggcgtgcagggaatcatctgcggcgcccacaacttcgttgagggcgacaaggtggtggttaccctcccgggcgccgtgctgccgggcaacttccacatctcggcgcggaaaacctacggacacctctccgcaggcatgatcgcctctgtccgcgaactcggcatcggcgaggaccatgacggcatcctggtgctgtcccgcatcgggctggaccccgaaatcggcactgacgccatggagctccttggcctctacgaccaggctgccgaaatcaacgtgacgccggatcgcggctacgcgttctccatccgcggggttgcccgcgagtacgcccacgccaccggcaccaccttcacggatcccgcgtcccgcgtcaccgctcctgcggagctttcgggcggctacggagtcaagatcaatgacgatgcccccatttacggcaagcccggatgcgacaggttcgtggcccgcaccgtccacggcgtggacgccacaaagcccacgccgccgtggatggtttcccggctgcgccttgccggcatccgttccatttccctgccggtggatatctccaactacgtgatgctggaactcggccagcccacgcactgctacgaccaggacacgttgtccggggacatcgtggtgcgccgggccctggccggcgagaagatcaccaccctcgatggcaaggaacgcgccctcgacgccgaggacctgctgatcacggacgcctccggaccgatcggcatcgccggagtgatgggcggcgcggcaacagaggtgggggactcgacgtcgaccgttctggtggaggctgcgcacttcgacgaggtgtccattgcccgttcccggcgccgccacaagctgccgtctgaagcgtccaagcgctttgagcgcggcgtggactggcacgtggccggcatcgccgcccagcgggtggttgacctgctcgtcgaactggccggtggaacggcggaccaggccggaagcgatgtggggaccgccccggactccgtcagcattgaacttccggaggccttcgctgccgcccgtgtcggcatcgacttcaccgaagagcagatcgtcacgtccctggaggaccttggcgccgcggtggaaaagaacgacggcggctggaccgttacggcccccagctggcggagtgatctggaaaccaaggaggatctctccgaggagattgcccggctggtgggctacgacaagattcccgccacgcttcctgtggcgcctcccggtcgcggcctgacgcgggtgcagcagcagcgccgccgcctgatccaggcgctggcggatgcaggcctcaccgaagtcctgtcctaccccttcgtgtccaaggcggccaatgacacgttcggtgtagccggacaaggggcggaccggaccgcggtcaagctcgcgaacccgatcagcgaagagcagggcttcctgcgcacgtccatcctgccggggctcatcgaggtggccaagcggaaccattcgcgcggtttccgcgacctggcactcttcgagtcaggcctggtgttcctgcccggcggcacggtaggcactgcctccatcccgccgctcggcgtcaagccctccgatgaggtgctggacgggctgtacgacggcgtcccggcgcagcctttccacctcgccgcagtgctcacgggacacgattccccggcagcggccggccatgcgccgcggccgtgggactgggctgacgcgctggacctcgcccgggttgccggggacgtccttggcgtggaagtcctggtcagtcagggcagccaccaggctttccatcccggccgtgcagcccggctgtcactgcgcaatggtgaggtggtgggctacgccggtgagctgcaccccaagctgctggcggcatcggatatgcccgcccgctcggttgcactggagctcaacgccgacgcgctgttcggcgccgcgccggacgtgatcgtggcccgccacatctccacattccccgtggccacccaggatgtggcgctcgtggttcctgctgaagtccccgccgacgacgtcctggcggccctgcgcgaaggtgccggtgaactgctggaggacgtggcgctcttcgacgtctacgcaggcaaaggcatcgaggaaggcaaaaagtccctcgcgttcgggcttcggttccgcgccaacgaccggacgctcacggcggacgaggcatcagccgcacgggaaggcgcggtggcactggcggccgagcgcttcggcgccgtccagcgttgaccacaagcacgcatcaatagggaaggtccccgcagccacagggctgcggggacctttccatatctccagttgctgtcctacggaaccaggatcacctttcccgtggtgcgccgcccttcaaggtcgcggtgtgcctgggcagcctgcaccaaggggtaccgggcgccgatccggaccttgaggctcccgtttgccgctgccgcgaagacttcaccggagcgccagcggcgctccgcggcgtcccgcaggtagtgccccatggtgggcctggtcaggaacagcgagccgccggcattcaggcgctggggatcaacgggcggaaccgggccagaggcagcgccgaagaggaccagcatccccctgacgcgcaaagcggccagtgagccgtcgaacgtgtccttcccaacgccgtcgtacactacgtcggcgccggtaccgctggtaatgtccctgacccgctcagcgaagccctcgtaccgcagcacgtggtcggcgccggcgtcgcgcgcaagctgctccttcgcgtccgtggagacggtggtgatgacttccgccccgcgggccttgagcagctggatcagcagcaggcccacgccccccgcgcccgcgtgcagcaggacggtgtgccccggctccaccttgaaagtggagttcatcaggtagtgggtggtgatgccctgcaggggaagcgcggcagccgtcaggtcgtccaggccgcgcggaaccggcagggcggcggcctcatcaaccagcgcatagtccgcgtagcaattgatgccttccgccgtggccacccggtcgccggggacgaaccccgtgacgccgtcccccaccgcttcaatggtgccggcggcttccgacccgggggtgaacgggaaggggaccttgtaggtgccgctgcgtttgtacgtgtcgatgaagttaacgcccgctgcccccaccttcaccaggagctggccgggcctcggaacaggccgctcaatgtcctcgtaggtaaggacttccggtccgcctgcctgacgtgcgacgattgcgtgggtcattgctcacctttcccggtcccggcgtttccggctccggctgctgccaccatcctagggacagtccacggaagccccatagcgggcaccttccactgcatgcataaatatcggcatcagtgaatacttttgctgtatggtggtggtcatgactatttctgttgcagtgtccggtgccagcggatacgccgggggagaggtcctgcgcctcctggccgggcatcctggcgtcaccattggagccatcacagcccacagcaatgccggttcccggctcggcgaactgcagccccacctgcacgggctcgcaagccgcatcctcgaagacaccaccgtggacaacctgtccggccacgacgtcgtcttcctggccctgccgcacggcgcctccgcggagatagcagcccagctgccggcagggaccgtcgtcatcgacgccggcgcagaccaccggctggaggacccggcggcgtgggaaaagttctatggttccgcccacgccggcagctggccctacggcctgccggagctcccgggccagcgcgaagccctcaagggcgccaaccgcatcgccgtgcccggctgctacccgacgtcggccctgctggctttggcgcccgggttcgccgccgggctcctccagcccgacgacgtggtcatcgtctctgcctccggcacctccggcgcgggcaaggccgccaaggtgaacctcatcggttcggaagtcatgggctccatgagcccctacggcgttggcggcggccaccgccacacgcccgagatcgaacaggggctgtccaacgccgcgcgtgaacaggtcacggtgtccttcacgcccaccctggcgcccatgagccggggcatcctcacgacggcgacggcgaaggtcaaagccggtaccacgggggagcagctgcgccaggcctggaccgacgcgtacgacgacgaaccgttcgtccacgtcctcccggaaggccagtggcccgccacgaagtccgtgcaggggtcgaaccacgccgccatgcagctggcgttcgattcccacaccggccgggtgatcgttacctgcgccatcgacaacctcaccaaagggaccgccggcggcgccgtccagtccatgaacatcgccctcggcctggcggaaaccgccggccttgacctgcagggagttgccccgtgaccgttaccgccccccgtggattccgggccgccggcgtcaccgccggactcaaagcctccggcaaaccggaccttgccctggtggtgaatgacggcccgtccaaggccgccgccgccgtcttcaccagcaaccgcgtcgccgcagcccctgtgcactggtcccgccaggtggtgtccgacggccgcgtggacgcggtggtcctcaactccggcggagccaacgcctgcaccgggcccgctggattccagaacacgcacagcaccgccgaaaaggtggccaaggtcctggacatctccgccacggacgtttttgtgtgttccaccggcctgatcggcgagcagctgcccatggacaagatccttcccggcgtggaggctgcggctgccgcgctgagcactgacggcggccccgaggcagcgaccgccatcatgaccaccgactccgttcccaaggcggcgctgttcatcggcaccgatgcggacggcgaggaattcgccatcggcgggatggccaagggtgcgggcatgctggctcccggcctggccaccatgctggtggtcctcaccactgatgcggcagttgacgcggaactgctcgacgtcgtcctccgcgacgccacccgggtcacgttcgaccgggcagactcggacggctgcatgtccacgaacgacaccgtggtcctgctgtcctccggtgcctccggcgccgtgccgtcagccgaggtcttcggtgccggcctgacccaggtctgcgccgaacttgcgcggaagctgatcgccgacgccgaaggtgccagccacgacatcgccatccgcaccttcaatgctgccagtgaagcggacgccgaaaccgtcagccgttccgtggcccgctccaacctcttcaaggccgccatcttcggcaaggaccccaactggggacgggtgctgtccgccgtcggcaccaccgacgccgtcttcgaacccgaccagctcaacgtggccatgaacggcgtccagatctgccgcaacggcagcatcggcgacgaccgcgggctggtggacctggagccgcgcgaggtcctggtggaaatcgaccttcaggccggcgacttcgaggccaccatctggacgaacgacctgacccacgactacgtgcacgagaacagcgcctactcgagctgacgaaccacttgagccggccccaccggcgcccggcaaccctggagacatttcctgatgaacacacgcacccgcgaaaccacgtccatgcttgacgcccaaagcaaggcgggcacgctgatcgaggcgctgccctggatccagcgctttgccggcaccaccatggtgatcaagtacggcggcaacgccatggtcaacgaccatctgcgccgtgccttcgccgaggacgttgttttcctgcaccacgtgggcatccaccccgtggtggtgcacgggggcggtccccagatcaactccatgctggcccggctgggcatcgagtccgagtttaagggcggcctgcgggtcaccaccccggaagccatggacgtggtccgcatggtcctcaccggccaggtgggccgcgaactcgtgggcctgatcaactcccacggcccctacgccgtgggcatgtccggtgaagacggcgggctgctgcgcgcggtgcgcaccggcaccgtcgtcgacggcgaagaagttgacctgggcctggtgggtgaagtggtgggcgtgaacccggaaggcatcctggacatcctcgccgccggccgcatccccgtgatttccacggtggccccggagatcaacgccgatgggttcgcagccgacggcagcgtccagaccacgggacaggtgctcaacgtcaacgcagacaccgcggccgcagccctggccgaagcgctcggggcctccaaactggtgatcctcaccgacgtcgaaggcctctacgccaactggccggacaagacctcgctgatctcctcccttaaagcatcggacctgcgggcgctcctgccctcactggaatccggcatgatccccaagatggaggcctgcctcaaggccatcgacggcggcgtggaacgcgcacacatcgtggacggacgcctggcacactccatgctgctggaaacctttaccaccgcgggcatcggcacccaggtggttcccgacgaggagacgaacgcatgaacgaaactgttgacctgagtccggcggacgaaaaagacgccaaggcttccgtgatgaccggaatcggaagtggctccgagtggctcgcccggtactccagctccctcatgggcgtgtttggcaccccgcagcgcgtcctggtccgcggtgccggctgcctggtctgggacgccgacggcaaggagtacctcgacctgctgggcggcatcgccgtcaacgcgctgggccatgccaacccgttcgtcacgtcggtgatctccagccagttggccacccttggccacgtctccaacttcttcaccagccccacgcagatcgcgctggccgaaaagctcctggccatcactgacgcccctgccggttccaaggtgttcttcaccaactccggcaccgaggcgaatgaggccgccttcaagctggcccgccgcaatacgggcggcagcggcgccaaacggaccaaaatcatcgccctcgagggggcctttcacggccggaccatgggcgcccttgccctcaccgccaaagaggcctaccgcacgccgttcgagccgctgcccgccggcgtcgtgcacatccccttcggtgacgtggaggcactgaaggacgccgttgacgagaccgtggccgccgtcttcctggagcccatccagggcgaggcgggcgtgcgccccctgccgcccggataccttcgggccgcccgcgagctgaccgccagggtgggggcactgctgatcctcgacgaggtgcagaccggcatgggccgcacaggaaagtggctggccagcgaggatgccgggatcatgcctgacgccgttaccctggccaagggactgggcggcggcttcccgatcggtgccctgatcacgtacggcccggagacatcgtcgttgttggctgcgggccagcacggcaccacattcggcgggaacccggttgcgacggcggcagccctcgcaacgctgcacgccatcgaaagccagcacgtgctggccaatgcctcagccgtgggtgagcacctgcgctccgcgctggccgtcctgccgggcgtcaccgaggtccgcggcgaaggcctcctgatcggcttcgacctggacgcggacgtcgccccggcagtagtgcaggccggccttgatgccgggttcatcgtcaacagccccggcccgcgcaccatccgcctcgcgccgccgctggtcctgaccacggcgcaggcagacaccttcctcgacgccttcccggcaatcctccaagcagctaaggacgcccagtgacaccagcagccagcaccacccggcacttcctcaaggacacagacctcagccccgccgaacaggccgaggtactcggcctcgcagcccggatgaaggcggcgccctacagcgtccagccatacgccgccgagggcagcagccgcaagacggtggccgtgatcttcgacaaaacctccacccggacccgggtctcgttcgccacaggaatcgcggacctgggcggcaacgccctgatcatcaacccgggggaggcccagatcgggcacaaggaatccgtggaggacaccgccaaggtcctggagcggatggtgtccaccatcgtctggcggaccggcgcccacgccggcctcgtggccatggcggagaactccagggttccggtgatcaacgccctgtgcgacgattaccacccgtgccagctgctggcggacctgctggccgtgaaagagcacaagggcgaactcaagggcctcaccatgagctacctgggggacgccgccaacaacatggccaattcctacctgctggccggagtcactgccggaatgcacgtgcggatcgccggcccggaaggctacctcccggcggaagacatcgtggccgcagccgaggaacgcgcagcagagaccggcgggtccgtgcttatcaccactgacgcggcagaggctttgaaaggggccgacgtcgttgcaacagacacgtgggtgtccatggggcaggaggcggaaaaggaagcccggatgcagctgttccgggagtacgccgtggacgaggccgccatggcacaagctgcggaagacgccgtcgtgcttcactgcctgcccgcctaccgcggctacgaaatctctgccggcgtcatcgacggaccgcagtccatcgtctgggacgaggccgaaaaccggctgcacgtccagaaggccctgatggcctggctgatgcaccggtcgggcctggccttcgtcgacggactcgcacccgttgaaggcacaggggagagcacgttctagtgtccgcccaaccggcgtcgccgggctccagcccggccaccaagacggcccgccaggcgcgcatcaccgccatcctgacgggggagtccgtgcgttcccaggcggagctggcagccttgctggcggacgacggcgtgcaggtcacccaggcgacgctgtcgcgggacctcgtggaactcggcgccgtccgggtccgcggcaaggagggcgtgctggtgtacgccgtacccggcgaaggcggcgaacgggccgccaggagcggggtgagccaggagatcctggatgcccggctggcccggctgtgcagcgaactgctggtcaccgcggaggcgtcggccaacattgccgtgctccgcacaccgcccggggccgcaaacttcctggccctggccatcgaccattcggtgatgccgtccatcctgggcaccattgccggggacgacaccgtgctgttggtggcccgggacccgcagggcggccgggacctcgccgccaggttcctgcagctggctgaagaagccgggcaataagcttgaagacaacatcaacaaaccccaattacaaggagcattcgaagtgactgaacgcattgtgctcgcctactcgggcggcctggacacctcagtagccatcggctggatcggtgaagccaccggcgccgaggtcatcgccgtggcggtcgacgtcggacagggcggcgagtccctggaaaccatccgccagcgcgccctcggctgcggcgccgtcgaagcctacgtggccgacgcctccgacgagttcgccaacgaatactgcatgcccacgctgaaggccaacggcctctaccagggccactacccgctggtgtccgccatctcccgcccggtcatcgtcaagcacctggtcaaggctgcccgcgaattcggcgccaccacggtggcccacggctgcaccggcaagggcaacgaccaggtccgcttcgaagtgggcatccagaccctcggcccggacctgaagtgcatcgccccggtgcgcgacctcgccctcacccgcgacaaggccatcgccttcgccgaggagaagggcctgccgatcgagaccaccaagaagaacccgtactccatcgaccagaacgtctggggccgtgccgtggaaaccggctacctcgaggacatctggaacgcccctaccaaggacatctacgactacaccgccaccccggagttcccgccggcaccggacgaggtcgtcatttccttcgaagccggcgttccggtggcgatcgacggcgtcaaggtcaccccgctgcaggccatcaaggagctcaaccgccgtgccggcgcgcagggcgtgggccgcatcgacgtcgtcgaggaccgcctggtgggcatcaagtcccgcgaagtctacgaggccccgggtgccatggccctcatcacggcccacaagcacctcgaggacatcaccgtggagcgcgagcaggcccgcttcaaggccaccgttggccagcgctggtcagaacttgtgtacgacggccagtggttctccccgctcaagcgctccctggacgcgttcatcgaggacacccagaagtacgtcaccggcgatatccgcatgaccctgcacggcggccaggccatcgtcaacggccgccggtccgacacctcgctctacgacttcaacctcgccacctacgacaccggcgacaccttcgaccagtccatggcgcgcggcttcatcgagctgtggggcatgtccgccaaggttgcctccggccgcgacatccgggtcgcgggtcagtaagtggtgtccgctacaaacgaaggtgcgctgtggggcggccggttcgccggcggccccgccgacgccctggcggcgctcagcaagtccacgcacttcgactggcggctggcccgctacgacattgccgggtccaaggcgcacgcccgcgtgctgcacaaggccgggctgctggacgacgccgagcttgaaggcatgctggccgcactcacgcagctggatgaggacgtggcgtccggcgcctatgtgccggcggagtccgacgaggacgttcacggttccctggaacgcggcctgatcgagcgcgccggaacccagttgggcggcaaactccgcgccggccggtcccgtaacgaccaggtggccacgctgggccgcatgttcctgcgggaccacgcccggatcatcgcccgcggtgtcctggccacggtggatgccctggtggagcaggccaaggcgcaccaaggtgttgccatgccgggccggacccacctgcagcacgcccagccggtgctgctcagccaccacctcctggcccatgcctgggcgctgctgcgcgatgtgcagcggctccaggactgggacaagcgggccggcgtctcgccttacggttcaggagccctcgccggctcctcgctggggctggacccggaggcggtggccgcggacctgggctttttctccgcctcccacaactcgatcgacggcaccgcttcacgcgacgtcttcgccgagttcgcctgggtgtgctcaatgatcggggtggacttgtcccggatctccgaggaggtcatcctctgggccacgaaggagttctccttcgtcacgctgcatgactcctactccacggggtcgtccatcatgccgcagaagaagaacccggatgtggcggagctggcgcgcggcaaggcaggccggctcatcggcaacctgaccgggctgctggccaccctcaaaggcctgccgctggcgtacaaccgcgacctgcaggaggacaaggaaccggtgttcgacgccgccgacaccctggagctcctgcttccggcggtctcgggcatgatcgctaccctgaagttcaacaccgaacggatggaatcgctggcaccgcagggcttcgcgctggccactgacattgctgagtggcttgtccgccagggcgtacccttccgggaagcccacgagctttccggtgcggccgtgaagcaggccgaatcccgcggcgtggagctgtgggacctgacggacggggagtacgcggccatctcggagcacctcacgccggaggtccgcaccgtcctgtccacggagggctcgctcaacagccgcaactcccagggcggaacggcaccggccgccgtcgaacgccagctggttgcgctggaggccgagcttgccggggtgcgggactacgcggggtaaaacgctttctcacttaatgcaaagtttctggcaacgctcctgcacccggtgcaggagcgttgccggttttcacgcatcaagtgagagaatgtcggccggatggggcccggctagcatggtgcaatgagcgaaccttttcgcaggcaactccgcgcgcttcccgatttcccggatacgctgccggcctttcacccggagagcgtccccacggatcccgctgagctgttcaggcaatggctgggcgaggcgctggcggcgggggagcggcagccgcatgcgtgcagcctggccacagcgggcggcgacggcaaaccgtcgtcgaggatgctgatcctgaaaaacattgacgacgacggctggcacttcgccacgtcccgcacctcacgcaagggcagggaactgagcgccaacccgcacgctgccatgaccttctactggccctcccagggccggcaggtccgcgttgccggggccgtcgtcgaactgtccgccgaggcctccgcgcaggactgggcggagcggccccgggcggacggcagcaccaacccgcactggcagctctacgcccttcggcccgctgagatcgagttctggcaggccagccacgacggcaaccatgtccggcaccgtgtggcacccgacggctcacccctgggctaggctgtcgccatgacagctcccgcaccagacgtactgcttccggcgctccacaaggccgccgctgacctggcggccgacgttgccaggttcagcgactctgacgtacaggcaccctctgccctgcccggctggacgagggggcacgtgctggcccatctgaccggaatttccaacgccatggcccggcagcttgagtacgcggcgcgcggagaggccgtggagctttacgacggcggcatggaaggccggaacaaggccatcgacatggcagcgggccacgatgccgccacccacctcgcggacctcaccgccgcactggaccgggcgctcaaggccttcgacgcgctgcccggcgtcaaggattcagcggccaaccggaccggctggtacgcccccatcaccttccgcgggggcgtggtcctggacggcggactggcgctgtggcgggaactggtcatccacgcgtcggacctgctgacggggaggggcccggaaacctggagccggccgttctgcgagcaccttttcgatttcctggcggcccgggtccagcccgacgacaagctcgtgctgcagccactggggctccagccggtcagcattggcagcggcaaccggtccactgtcatcagcggcatgatcaccgatatcgcagcgtggctcgccggccgcgagccgacgctgggcagcctgagggcctcggccgcggctgacggcgtcaacctgcccgagctgctgccgtggccttccggaacccccgccgccagcaggaccgacccgaagggctaacccgcttcgcgcgccagcaggctctgcttgatgggaagcccccaccggaaaccgcccagggagccgtcagtccggatcaccctgtggcagggcacaaacagcgcggcagcattgaaggcacaggcgctggcggctgcccgcacggccctgggattgccggcgagctccgcgtactgggtataggtgacgggctgtcccggccgcaccagccgcaggacgtcccaggcgtggacccggaaaggtcctgacagctgccgcacgggaacgcccatcgccggcatcgggtcaccggcgtagaaggcttcgacggcggaggagatttcccccagcccgctgacaggttccagcgttccgggccggagggacggatggatctgcccggtcaactcaccagggttgtctgtccatccgctggagattacgacgccgtcctgggcgaggatggtgaacggaccgtctggggtggtcatctgaagcagctgggccttcatcggttcgccttctctgctggtctggggtcttggttcgtgggtgccgttgctgtgcgcctgcgcggaccggacgcagcctgggctgccgcccgccacaggtgcattgtggcgtatgagcgccaggggctgacttcccggaagtccggtgtgcacgccgcggtcccgtccccgagggcacggatcccgttccgcacggctgcgtcgttggccaggaaaacatccggggcaccgaggatgcgcatggccaggtatcccgtggtccatggtcccacgccgggcagcggaagcagtttggcggccaggctttccgggctgtctccatagccaaagtcgagcccgccgtccgccatagcagcagctgcggcgaggagggccccgatccgccgttggggtccgcgcaggaccgccgagcctccgccggcgatttcggccggggtgggaaacatccagtccagcccctcgccggggcttcggcttggacgtccgacggcggccagctgggtgagggcggtccgcgccgctgccacggtaatctgctgcccggccatggcccggaccagcatttccgccggatccatggcaccgggcatcctgatccccggagtgcccgcaactgcggcaacgagcctggcatcccctgccagcgcactgtcgatggccacaggatccgcgtccaggtcgaagagccgacgcacccggctcaacagggccggcaggtccctaaggtccaccgcgccgatggtgagggtcagcggccggcccggagcgccggcgtcgtaatccacccggaacctcgcatcaccctggggcagccgcagcgtgcgggcataagacgtgggcgttcccgcttcgatcccggggatggcccggacggccaggaaggtgaaaacgccgggattgaaaggttcacggtagggcaggttgagggtgagggcggtggagccggcggaggctttcggatgcctcgcggtgcggagcgcggtgggagtcatgccaaaaacctccgccatggtttcgttgaactgccggacgctgctgaacccggccgcaaaggcgacgtcggcgagcttcatggaggtggaaaccaggagggtccgggcagtctgcgcgcggccggcccgtgcaagggagaggggtcccgcgcccagctcctggctgaggatgcggttgagctggcgggaggaatagcccaggcgggccgccaggccatcgacgccgtccctggtgaccacgccgtcactgatcagccgcatggcgcgcccggcaatatcctgccggaggttccaggcgggtgtcccgggaaccgcctccggcaggcagcgcttgcaggcccggtagccggcgtcgtgcgctgccgcggaggtttcataaaaggtgacgttggaggctttcggagtcctggccgggcaggacggacggcaatagatgcccgtggtccggacggcagtgtagaactgcccgtcgaaccgggtgtcccgggcgtcgatcgcccggtagcgctgccagaagtccattcctccatcgtgccagccctcccatgccagggctagcggaaatcggacacggccgtggcgcctccaacacctgaatggcggggcggcggcgccggcgttggatagagtctggccatgagcacaaatccgctgacggccggtcagccgctgcgggagttcctttccggagacgcccgccagctggcgcccctgctgctgggcgccgtcctgacccatgactccagggacggtgcggtatcggtccggctcaccgaagtggaggcctacctgggccccgaggattccctgcacccggatcccggatcacacacctaccgcggttccacgccccgcaacgcacccatgttcggcccggccggccacctgtacgtctacttcacctacgggatgcaccattgcacgaacatcgtgtgcgggcctgaaggcacggcgtccgccctgttgctgcgggcaggggagatcgtggacggggtggagctcgcccggcaccggcggaccacctccaaaggcccctccgatctggcgaaggggcctgcccggctggccaaggcgttgggcctgacgacggcggacagcggccgtgatgcgctggcgccgccgttcgggctggtccttccgtccgggccggcagggcccgtgagctccggcccgagggtcggtgtctccggcacaggaggaacggaccagtactcgtggcgcttctggatcaccggcgaccctaccgtctcccagtacaaggcagccaagccccggggcgccaagccggatccggcaacgtttcacgggcgttaacggaaatggttgtagaatggtaggtctgtcttttgcgataggggaacgttagatgctcgacgccgatttggcccacgaacgcgactatgtagccggcttgtacgcacggctggaagagctgcgcgaggaaaagcgccgccagctggcgcaggtccgccgggccggggctgtgggcaccatgcagaacgtctccgagcgcgacgctttcgctgctctctacgaggaccggctggcccagctggatgcggtggatgaccggctggtcttcggccggctggaccttgactccggcgaagcgcagtacatcggccgcattggcctcaccaccgaggacctgcaacggctcatggtggactggcgcgcgcccgaggccggccacttctaccaggccacggcctttgaccggcagggtgtgcgccgccgccgccacctgatcctgcagggccgtgaggtcaaggccattgaggatgacgtccttgacgccgggatgctggccgacaacgaatccctgcagggcgaaggcgccctcctcgctgccctgaactccaaacgcaccggccggatgtccgacattgtcagcaccatccagtccgagcaggaccgcatcatccggtcatcaatctccggggcgctggtggtgcagggcggacccggcaccggcaagactgccgtggccctccatcgtgcggcctacctgctttatacccaccgcgaccgcctcaagaccgccggcgtgctgctggtgggcccgtcgtcgtcgtttatgaagtacatcgaaagggtgctgccctccctgggcgagaccggcgtcgtgatggccagcgtgggacgcctcatgcccggcatccatgccgtgccggaacctgacgccgacgttgctgccatcaagggccgcctggacatggcaaccgtggtggccaacgccgtggccaaccgccagcggattcccgcggaagaccgcatcctggaggtcgacggccgcaggctggtgctgacgccgcgccaggtccgccgtgcccgcgagcgtgcccgctccaccggcaagccgcacaacgaggcgcgcgtgacgttcgtcaagatcctgctccgcgaactcacagaacagatgaccgagctggtggaagccgggaacatcggcaacaacgcagaccgctcctacttggcggaggatgtccgttccgcacgggatgtacggattgcccttaacctctgctggatgcccatgacgccggagaagctgatctccgagctcttcagcaaaccggccgtgctcgaattctgcacaccgaatatgtctccaggtgagcgggcactgctgcagcgccccgccgacgccccctggaccgagtccgatgtgccgctgctggacgaggccgccgagctgctcggcgaactggacccggccgcggggcgtggacttgcccagcaggagcacgaccgtgcccgcgatcttgccaacgccaagcagaccctggtgaacatgcaggcggcaggggtggacccgttgatgtccgcagaggaactggccgaacagaaccaggagcaggaaacgcggcaaaccgccgcagagcgagccaccagcgaccgcacctgggcatttggccacatcgtggtggatgaggctcaggaactttcacccatgcagtggcgcctgctggtccgccgctgccccctgaaatccttcaccattgtgggggacatcgcgcagaccagctcggtggccggcgccaattcctggcagggagcgctcgcccccatgttcggggaccgctggcagttggaggagctgacggtgaactaccggacgccgtcccagatcgccgaagccgccgtccggatggccaacgcggcggggctggtggtctcagcgcccaaggccgtccgcgaagggcgctggtcgcctgtcatcgatgaggtggatcccggccaggtagtcagccgcctggttgaggtcctgccggaggaactggatgcgctcgacggcggcctgctcgccgtcattgctgacggacacttcctgccggaagccaccgccgccctgcgcgccgcccatgggcgccgggtgggcacgggtgccggcagctacgagcaggacatcgtggtgatcagcccccgcgaagccaaggggctggagttcgatggcgtcgtagtgcttgagccgtccatgatgctgaaccatgagcacggcaaagtgggggacctgtacgtcgcgatgacccgggccacccagcggctccggctgattgcctcggaaccggtgccagcggggatcaagcgctgatccggcgcgccgcatactgctaacttagaaggcgtgccagaacttatcagcctcgaatcgcagcagaacgaccccacttttgccaacatttggcaggaactgaagtggcgtggacttgtccacgtctccaccgacgaggcagagcttgaaaaactcctcgccggcggaccggttacgtactattgcgggttcgatcccactgcgccgagcctgcacctgggaaacctggtccagctgctcgttatgcggcggctgcagctggccggccacaagcccctcgggctcgtgggtggttcaaccggcatgatcggcgacccccgtcccacggccgagcgcacgttgaacaccaaggacaccgtggccgagtgggtgggctacctccaggcgcaggtccggcgcttcctcagctttgagggtgacaacgcagcgcagatggtcaacaacctggactggacggcgccgctgagcgccatcgatttcctgcgcgacgtgggcaagcacttccgtgtggggacgatgctccgcaaagacgcggtggcctcacggctgagctcggatgagggcatcagctacaccgagttcagctaccagatcctccaggggatggactacctccagctctaccgggattacggctgcatgctgcagaccggcggctcggaccagtggggcaacctcaccagcggcacggagttgatccgcaaggtggagggcaagagcgtccacgccctcgggaccccattgatcaccaacgcggacggcacgaagttcggcaagagcgagggcaacgccatctggctggacgccggcatgtgcagcccctacgccttctaccagttctgggtcaacacggcggacgctgacgttgtggaccggctgaaggtcttcaccttccttaccagggccgaaatcgaggagctttccgttgctgtggctgaacggccgttcgcccgtgaaggccagcggaggcttgcctacgaggtgacgtcccttgttcacggtgtggaagccacggagaaggtcatcgcggcatccgccgcacttttcgggaacggtgacctgaccgcactggacaagcccacgctccaggcggcaacctccgagcttccctttgccactgtgcaggtggacgagatgggcattgtggacctgctcgttgcttccggcctgtccgacagcaagtcggcggccaggcgcaccgttggtgagggcggggcgtacgtcaacaacgagaaggtgtccgaccccgaagctgtcattccagagtccgaactgctgcatgggcagtacctgcttctgcgccgcggaaagaagaacctggccaccgtggaggtcctggttccctaggctcttccgccgcttcacaaagcccccagcacgctcctccgcagccgacttgcacggccgcgggggagcgtgtaatgttttctgagtcgccgccgctgaagcggaaaaatagcgacaaacccccaccaaaaagtgaagcaacttcagcatgtgcggaagcgcagaacgaagaaatgcttcactttatgatgggcggattcattccacagagtgaattccgggaaaacaaccggatttgcaaagtgaaaatgaatgaaataagattgaaacatcgcagcgaagaaatacgaaataagaattcgtggaaatgaattgtttcgggaatattcgaatgtgtctgttgtttgagaactcaatagtgtgccaagtttgttgataccaattgttttattgattggttgttttggctgggcctgtccaccccgtggattgggtctggtttttacagctggtttcaaattttgtgcagcctttttgtcccgttttcccggggctgggggttgtgtctgttcttcaacggagagtttgatcctggctcaggatgaacgctggcggcgtgcttaacacatgcaagtcgaacgatgatgggagcttgctcctggattagtggcgaacgggtgagtaacacgtgagtaacctgcccttaactctgggataagcctgggaaactgggtctaataccggatatgactcctcatcgcatggtggggggtggaaagctttttgtggttttggatggactcgcggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccggcaaggctaaaactcaaaggaattgacgggggcccgcacaagcggcggagcatgcggattaattcgatgcaacgcgaagaaccttaccaaggcttgacatgaaccggaaatacctggagacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagctgtcgaaggtgggactggcgattgggactaagtcgtaacaaggtagccgtaccggaaggtgcggctggatcacctcctttctaaggagcacctacaggtcactgccgcgtgtatgcggggtgtgtggtttgtcaggagtatatgcccgttgcgcagacgattgttctgcggcgggtgctcaagggtggaatatcaatgaatagcggctgccggttctttccggtgctgagtacggttctccttttggggggttcctggaaaggtgctggtgggtgcgggtggtttagtgtttggcacactgttgggtcctgaggcaacagggccgcgggttctgcctcctttttgtggggtggggttgcgggtttgtttgtttctggtttcctggctgcaaccgatcacacggttgttcctgttttggcgggttcgtgtgtggggtgtgtggtacggggttgttgtttgagaactacatagtggacgcgagcatcttttataagaagcaatttccaagaatatgaacctggatctgttgttctgtctttcgggatggagcagtggttttcgtggttctctcgaaaattagcgtttttgatcttttgtggtcaagtttttaagagcacacggtggatgccttggcattaggagccgaagaaggacgtaggaatctgcgataagcctgggggagtcgataaccggactgtgatcccagggtgtccgaatggggaaaccccgccagggacgcgagttgcctggtgacccgcatctgaacacatagggtgcgtggagggaacgcggggaagtgaaacatctcagtacccgcaggaagagaaaacaatagtgattccgttagtagtggcgagcgaacgcggatcaggctaaaccgttccatgtgtgatagccggcgggcgttgcatggtcggggttgtgggactttccgtactgtctctgccggggcagtggggtgtgatgtgcaggcataggtgaacggtcttgaaaggccggccagagagggtgttagccccgtaaccgtaatgttgtgtaccgcccggatgagtatcccaagtagtacggggcccgagaaatcccgtgcgaatctgtcaggaccacctgataagcctaaatactccctaatgaccgatagcggaccagtaccgtgagggaaaggtgaaaagtaccccgggaggggagtgaaacagtacctgaaaccgtgtgcttacaatccgtcggagccagtctgattctggtgacggcgtgccttttgaagaatgagcctgcgagttagtgttacgtcgcgaggttaacccgtgtggggcagccgtagcgaaagcgagtctgaatagggcgttgcagtggcgtgatctagacccgaagcgaagtgatctacccatggccaggttgaagcgacggtaagacgtcgtggaggaccgaacccacttcagttgaaaatggaggggatgagctgtgggtaggggtgaaaggccaatcaaacttcgtgatagctggttctccccgaaatgcatttaggtgcagcgttgcgtgtttcttgctggaggtagagctactggatggctaatgggccctacaaggttactgacgtcagccaaactccgaatgccggtaagtgagagcgcagcagtgagactgtgggggataagcttcatagtcgagagggaaacagcccagacccaccaactaaggcccctaagcgtgtgctaagtgggaaaggatgtggagttgcgaagacaaccaggaggttggcttagaagcagccatccttaaaagagtgcgtaatagctcactggtcaagtgattccgcgccgacaatgtagcggggctcaagtacaccgccgaagttgtggcattcagatattagctaagcccttgtggttcaggcgtctggatgggtaggggagcgtcgtgtgggcggtgaagtcgcggtgtaaaccagcggtggagcctacacgagtgagaatgcaggcatgagtagcgaaagacgggtgagaaacccgtccgccgaatgatcaagggttccagggtcaagctaatctgccctgggtaagtcgggacctaaggcgaggccgacaggcgtagtcgatggacaacgggttgatattcccgtaccggcgaaaaaccgcccatgctgaacaggggatactaactgcccgagacctgcctgacaccccttgtgggtgaagggttttggtggagcgcaggacctggatcctgggaggcaagcgtattaacaggtgtgacgcaggaaggtagccaagccgggcgatggttgtcccggtctaaggatgtagggcgaacggtaggcaaatccgctgttcatgatgcctgagatctgatgggacccccgtttggggggatttggtgatcctatgctgccgagaaaagcatcgacgcgaggttttagccgcccgtaccccaaaccgacacaggtgatcaggtagagaatactaaggcgatcgagagaattatggttaaggaactcggcaaaatgcccccgtaacttcgggagaaggggggccccaaccttgatacacccacgcggtgtggaggggatcggggccgcagagaccagggggaagcgactgtttactaaaaacacaggtccgtgcgaagtcgcaagacgatgtatacggactgactcctgcccggtgctggaaggttaagaggaccggttagccgcaaggcgaagctgagaatttaagccccagtaaacggcggtggtaactataaccatcctaaggtagcgaaattccttgtcgggtaagttccgacctgcacgaatggagtaacgacttccccgctgtctcaaccataaactcggcgaaattgcagtacgagtaaagatgctcgttacgcgcagcaggacggaaagaccccgagacctttactatagtttggtattggtgttcggagtggcttgtgtaggataggtgggagacgttgaagcccggacgccagttcgggtggagtcatcgttgaaataccactctggtcactttggacatctaacttcggcccgtaatccgggtcagggacagtgcctgatgggtagtttaactggggcggttgcctcctaaaaagtaacggaggcgcccaaaggttccctcagcctggttggcaatcaggtgtcgagtgtaagtgcacaagggagcttgactgtgagagagacatctcgagcagggacgaaagtcgggactagtgatccggcggtacattgtggaatggccgtcgctcaacggataaaaggtacctcggggataacaggctgatcttgcccaagagtccatatcgacggcatggtttggcacctcgatgtcggctcgtcgcatcctggggctggagtaggtcccaagggttgggctgttcgcccattaaagcggtacgcgagctgggtttagaacgtcgtgagacagttcggtccctatccgctgcgcgcgcaggaaatttgagaagggctgtccttagtacgagaggaccgggacggacgaacctctggtgtgtcagttgtactgccaagtgcaccgctgattagctacgttcggatgggataaccgctgaaagcatctaagcgggaagctcgcttcaagatgagatttccatacaccttgtgtgtgagaggcccccagccagaccactgggttgataggccggatgtggaagcgaggactaacgactcgtgaagctgaccggtactaataggccgataacttacaccacacactcttttcgtgaacggattcaaaagacgttcacaccaggaaagggtaaaaagataaacaagactgcttgcgtccactatgtggttcccaaccaacaaacccgccacgggcatgttgcgtcagggaacataactgaataacaacaccacactgccccaacaagggcagaggaacatgttgtaaccacacaaaacttcccacccgggcccaccagcccgggacgggtaaaaaggttacggcggtcatagcgtgggggaaacgcccggtcccattccgaacccggaagctaagacccacagcgccgatggtactgcacccgggagggtgtgggagagtaggtcaccgccggacacacattagagtagggccctgacaacaaagtcagggccctactgctttaaccacacccgggacccccgcacttgatacaccctttcccggcatcccctcccactcaatgccggccccccgcggaccctctcccacttgatgccgcccccggcggaccctctcccacttgatgccgcccccggcggaccctcttccacttaatgccgccccccgggcgatcctcttccacttaatgccggcccccgggcgatcctctctcagtagatgccgctttccggacgatcctctcccacttcctgccggcaataaccccccccacccccacggcgagtgagagagcgtcccgggaaacccgacatcaagtgagacagcatcccgtaaaagcctgcatcacgtgagagagcatcccaggaattcccgcatcaagtgagagagcgtgtgaatattcccacgatgcggccgactgggcttcgcccgtgctgctcttcggggcgtctcctctagaattgatgaagatgtacggacttcgaagcgcttgatttcgggttgcgtaggaaacgaaacacggatacgagcggctgcagttgcgccagtggtcagctcataacaggaggatccacatggctgagcacaacggcggcaaccgcggcggaaacgaccgcggcggattccgcggcaacaataattcaggcggggatcccaggggttttcgctcccgcagcaaccgtgagggcggcgattcttccggacgtccctccagcggcggtggcgagcggaagccctttggtgaccgtgaccgtaagcccttcagcggtggcggtgagcggaagccgttcggtgaccgtgaccgtaagccgtatggcgatcgtgaccagaagccttttggtgatcgtccgcgccgtgacggcgagggtgaccggcgcggcagcggtggcggtgagcggaagccctttggtgaccgtgaccgtaagccgtatggcgaccgggaccagaagccatttggtgatcgtccgcgccgtgacggcgagggtgaccggcgcggcagcggtggcggtgagcggaagccctttggtgaccgtgaccgtaagcccttcagcggtggcggtgagcggaagccctttggtgaccgtgaccgtaagcccttcagcggtggcggtgagcggaagccgttcggtgaccgtgaccgtaagccgtatggtgaccgggaccagaagccttttggtgatcgtccgcgccgtgacggcgagggagaccggcgcggcttcggcgggggagagaaccggaagccgttcggtgatcgcagcgaccgtcccggccgcggcgaccgccaggaccgcgcacctcgcagtttcgatcgtggccccagccgaggagatgccggtccccgcacctttggacgcgaccgccaggaagaccgccccgttcgcgaacccaacgcccgcgacctccgcagcgcgaaccgtccggaccgggaaaggtctccgcagattgatgaggacgtcacgggcaaggagctcgaccgcgccacccagcaccagatcaagacgctcgaagcaaagagtgcggaatgggttgcccgccaccttgtgatggccggccggctcatcgatgaagaaccggaactcgccttccagcatgccctcgctgccagccgccgcggcggcaggctggccgcggtccgcgaagccgtaggcctgaccgcttatgctgcaggccattacggcgaagctctccgcgaattccgcacctaccgccgcatcagcggttccaacgtccaccttccggtcatggctgactgcgagcgtggattgggacgccctgaccgcgccctcgacgtggccaggtccgaggaagcccaggacctggacgctcccggcaaagcagaactcgccattgtggcagcaggtgccaggaccgacctggggcagctggacgccgcggtagccgaactggaaatcccgcagctggacatcaaccgggcgttctcctacagcccccggctgtttcgtgcgtatgctgacgccctcgccggcgtgggccgcgacgctgacgccgagaagtggcggaagcaggccgtggtggccgaaaacgcgctgggccaaggcgtggacgaagagcccgacatcattgacctcggctgggacgaggaggaagaggcaaaggaggaagcagagcgccgccgcctgctcgaccgtgcatcgcaggcatccgacgctgcccccaaagccgcatccaactccggcgccgctgacggaatgcccgccgcgcaggccgcagagctggacgcttctgagccccgggacgctgagctgaacgccgcagagcagcaggacgccagcatcgatgaccaggaagctgactacttcgtctctgacgacgccgagtcagacgaggactcggtggaacaggacgagctggaatcccctggagtcccggaggacggcgctgccgacgaacaggatgattcgtccgctgaggagtaccaggaccagcaggaccgccgggaagactgacgaatgaccgacgttcccctgatctccctgttcgatgcactcctggcggacctggacggcgtggtttacgccggtccgcacgccattcccggtgccattgagtcgctgaagcagctctctggcattggcgtgggcctgggatacgtgaccaacaacgcgtcgcgctccccggcccaggttgctgcccacctccgcgagctcggggcgcccgccgaggaccaccaggtggtcagctcctcacaggccgccgcggatctgcttgcgtccttgctggctcccggttcccggatcctcatcacgggcagcccggcccttgccgccgagatcgaacttgtcgggctggtacccgtgtacagccaggacgagggcccggtagcggttgtccagggctttaaccccgagatcggctggaaagacctggccgaggccacgtacgtggtgaacgccggagccttgtgggtggccacgaacacggacatgtccataccgcaggcccgcggcatcgcgccggggaacggcacactggtgcaggccgtggcagccgccacagggcagacaccccgcgtggccggcaaacccgaggcaccactcttccactccgcagccaagcggctcggggccgaacggccgctggtggtgggggaccggctggacaccgacatccttggcggcaacaacgccggcttcgccaccgtggcggtactgaccggcgtcgacacccgacagaccatcctggccgcccgcgccgcggaacgcccggactacatcatcagcaacctggcggacctgcaccagccgtacccggatgtgacgcaccacgacggcacatacgcctgcggcgcagccacggcgcgtgtggccaacggtgcggtgggcattatcggcagccaggacagcctggactcctggcgcgccgcgtgcgcagcctggtgggcggcgacgcctgacgcctcctcgccccaggctcccgagctggtgtggctggatcactagactggtggaatgactgagctgaccgaaccggaatccgcagcagcccagccatccccggactggcccggcatcagggatgcgggagtgacggataccgtggtggcacaggcactggcccggctggaggcactgccggaggtcccggtggccgaccacgaaaacgtatacaacgaactccacgacgaactgctggccgcgctgaacacagttcccaacaacagcgcgcccacaagtgcggtcccgacgaacggtcccgcctgatgccggtacgcctcgaccaggctttggttgcccgcgggcttgcaagatcccggacacacgcagccgccttgattgccgagggcaaagtcacgtcagcaggacaggtcttggccaaggcgtcccttcaggtggacgaggacaggctcctcgaagtcgaccatgacgagcgggacacctacgtaagccgggccggacacaaacttgccggcgcgctggacgccttccccgggatcacaccggaaggcaaaaggtgcctcgacgccggtgcttccaccggcggcttcaccgatgtcctgctgcggcgcggcgccgcgcacgtggtggcggtcgacgtcgggcacggccagctggtgcagcggctgcgggaggacacccgcgtggaagtccacgagggactgaacgtccgctacatgtcgccggaggacatcggcggcacggcggaactcaccgtggccgacctgtccttcatctccctcaccttggtcgtccagccgctggcactgtgcaccgaacccggcggggacctggtgctgatggtgaagccgcaattcgagatcggcaaggacaggctgggacggacaggcgtggtcacctccgagcgggaacgccgcctggcggtggagaaagtagcccgcgcagcgctcgacgccggactggacttgtgcggcttggaggtcagtccgctgccgggccaggacggaaatgttgaatacttcctgtggataaaacgcaggatcagccaagacttgcctaagatcgaagagcgggaggcagcggctgctgccttgctcggacgaatctggccgaaccactagagagcggaacctgatgagcaggcgtgtactggtccttgcccataccggccgcgaggactcgctgaaggccgcctgggaagcgtgcgccctcctgcacgcctcaggcatcgtgccggtcatgcaggaatccgaacttgcggacatggaacgtttcttcggacacctggcacagcccgtggaggtcctccacgaccacgtccagctcccggatgttgaactggtgatggtccttggcggcgacggcaccatcctgcgcgccgctgagctggtccgggaagtggacgtgccgctgttgggcgtcaaccttggccatgtgggcttcctcgccgaaagcgagcgggcggacctcgcccagaccgtcgagtggatcgccagccgcgagtacacggtggaagagcggatgaccatcgatgtccaggtgtgggtccgcgggcagaagatctggcacacgtgggcgctgaacgaagccgccatcgagaaggccaaccgcgaacgcatgcttgaggtcgtgaccgaagtggacgagcgtccgctcacgtcctttggctgcgacggcatcgtgctggccacccccaccgggtccacagcgtacggcttttcggccggcggccccgtggtctggcccgaggtggaggcactggtcatcgtccccatcagtgcccacgcactcttcgccaagcccctggtggtttcgccacggtcaaagctcgccgttgaggtccttggccggacggatgcccagggcgtcctgtggtgcgatggcaggcgctccgtggacctgccgcccggagcccgggttgaggtcacaaaatcagccacgcccgtgcggctcgcacgcacccaccagacgccgttttcggcccgcctggtccgcaagttcgagttgccgatccatggctggcggggaccggtacccaaggcggatgccatacacaccggccccatacccatcgtcaggacaccgcggcccatgcctccgctccaggtgccccagccggaccagcccggcgatgacaacgatcccaccaccgcaaagtgaagccatgcttgaagaactgagaatccgcgatctcggcgtcatcaccgacgcaacgctgccgctcgggcctggcttgagcgtggtgacaggcgagaccggtgccggcaagaccatggtggtcaccgccgtcgggctcctcctgggtgcgcgctccgatgccggagccgtcaggagcggcgcgaagagcgccacggcagaggcagtgctgaagctcgacgccggccatcccgcgattgccagggcattggaggcaggggcagatacggaggaggtcgacggcggcgcggagctgatccttgcccgtcgcctgggctccgacggccgcagccgtgccttccttggcggcagggcagcgccggtgggcgtccttgccgaaatcggcgagaccctggtggtggtccacggccagtcggaccagatccggctcaagggagctgccgcccagcgcggcgccctggacaagttcgcaggtgaatcgctggccggtccgctggccgcttaccaaaacctctacaaccactggaagtccagccaggccgagctggacagcctccgcagcgctgcgcgtgacaggctgcgtgaggcagaatccctgcagaccgccctggccgaaatcgatgaggttgatccgcagccgggggaggacgaagtccttaaggcggaagcggtgaagctggccaacgtcgaggagctccgcatcgccgccagcacagcccaccaggcgctcatcgccgaggacttcggtgacgagggggacgccaccacgcttgttgacgctgccaagcggacgctggagcacgtggccgagcacgacgccgagctggggtccgcagccgcgcgcctggccgaagtgggcttcctgctgaacgacatcgccaccgaactggccagctaccaggccggactggataccgaaggccccgaacggctcgcagaaatcgaggaccgccgggccatcctggccaagctcgtccgcaaatacgctccgaccatcgacgaggtcctggtctgggcggagaacgcccgcgtgcggttcgatgaactgcaggacgactccacccggatcgaaaagctggacgccgaagtggtccaggcagaggcagacctgaagaagcaggccgccgccatcagcaaaatcagggccaaggcagcgaaggacctctccgcccgggtcagcgcggaactgaaggcgctggccatggctgatgccacgctggtcatcaatctcgagcccggtggccagctgggaccgcacggcgcggacgagatcagcttcctgctgcagccgcattccggtgcccccgcccggcccctcggcaggggcgcctccggcggtgaactgtcccgcgtgatgctcgccatcgaggtggtgctggcggccgtggacccggtcccgacgttcgtcttcgacgaggtggacgccggcgtgggcggccgcgccgccgtcgaaatcggccgcaggctcgccatgctggcccgccacgtccaggtgctggtggtcacccacctgccgcaggtggccgcgttcgcggaccagcacatcaccgtcaccaagacctccgtccggggagccgacggcggaaccgccaccgggttcacgtccagtgatgtccgcctcctcgacggtccggaaagggtccgcgaactggcccggatgcttgccggccaggaggactcggagtcggcgcaggcgcacgcccaggaactgctggacgacgctaaactcctgccccagggggcctgaaggcgggccccgtgagggctacgcgtgccggccgccccttgatcggcggccagccgaggggcaaacttggacgtttggggacagtgccggcgatccgtggaaggctcaaatgatgataggctcgaattccgtggtgcagcgatcaaattcccgtgtaaattcccggttcccgggctcatccaagacgaccaaacacatcttcgtaaccggtggtgtggcgtcctcgctcggtaagggactgacggcatcaagcctcggtcatctgctgcgcgcacgcggcctgtctgtgactatgcagaagctcgatccctatctgaacgtggatccgggcaccatgaaccccttccagcacggcgaggtcttcgtcaccgacgacggcgccgagacggacctggacatcggacactacgagcgcttcctcgacgagaaccttgagggctccgccaacgtgaccacggggcaggtgtactcaacagtcatcgccaaggaacgccgcggcgagtacctcggcgacaccgtccaggtcatcccgcacatcactgatgagatcaagcgccgcatgcgcctgccagccgagggcaagaacgccccggacgtcatcatcaccgaaatcggcggcaccgttggcgacatcgaatcccagccgttccttgaatcggcccgccaggtgcgccaggacatcggccgcaccaacgtgttcttcctccacgtgtccctcgtcccgtacatcgggccgtcccaggagctgaagaccaagcccacccagcactccgtcgcagccctgcggtccatcggtatccagcccgaggcgatcgttatccgctcggaccgcgaagtgcccgaagccatgcgggaaaagatcggccggatgtgcgacgtcgacatcgacgccgtggtcaacgccgccgatgcccccagcatctacgacatccccaagaccctccacacgcagggcctggactcgtacatcgtgcgtgccctggacctgcccttcaaggacgtggactggaccagctgggacaagctgctcgaagccgtacacaaccccaagcacgaggttgagatcgcgctggtgggcaaatacatcgacctgcctgacgcctacctgtccgtgacagaggccctgcgtgccggcggtttcgccaatgacaccaaggtcaagatccgctgggtcccctcggacgaatgcgaaacccgcgagggtgccatcaaggcgctcgacggcgtcgacgccatctgcgttcccggcggcttcggcatccgcgggcttgaaggcaagctcggcgccctgaagttcgcccgcgaaaccaaactgccggtcctgggactctgcctgggcctgcagtgcatggtcatcgagtacgcccgcaacgtggtggggctcgagggcgcttcctccagcgagttcgagccggactccaagtacccggtcattgccaccatggaagagcagctggagttcgtggaaggccgcggcgacctcggcggcaccatgcgcctgggcctctacgaagcaaagctcgacgccggatccgtcatcgctgaaacctacggcaagaccaccgtcagcgaacgccaccgccaccgctacgaggtcaacaacaagtaccgcgaccagattgccgccgcaggcctggtcttctccggcacgtcccctgacggcaagctcgttgaattcgtcgagctgcccgcggacgtccacccgtactacgtggccacccaggcgcaccccgagctgagctcgcgtcccacccggccgcacccgctgttcgccggtctggtcaaggcagcactgaagcaccaggagggctccgacacggccgccactgcggattccggtgcaaccgaggccctgcagtccggtacggtagccgctaagtagttccaacagaaaaaggacggcgcgatgcccggtacacctgaaaccaaccctgctgcgaagcaggtttcggatgcaccgagcccgcgccgtcttttgtctaccgagaaggtctacgaaggccggatctgggacgtggtcagcgacagcttccagctgcaggaaaccggagaagcactcacccgcgactacatcgaccaccccggggcggtagccgtcctgcccatgaacgctgccggcgagatcctcctcctcaagcagtaccgccacccggtgggcatggatctctgggagatccccgccggtctgctggatattgaaggtgaggacttcgtggtgggggccgcccgcgaactggccgaggaagcggacctcgccgcggggacctggaacgtcctggcggacttcttcaactcaccgggctcctccagcgaggccatcaggatctacctggccagggacctgctcgacataccccaccacgaacgccacgagcggacggatgaggaagccgagatcgagttccactggatcagcctggacgacgccgtggactcggtcctggcaggccggctccacaacccgtccgccgtcgtcggaatcctggccgccgccgccgcacgcgccagcggatttgaagggctccgccccgcagacgcaccctggccggcgcaccccagccagcgctgatggttccccctccctccgccgaactggcctccgcagagccggctcccgccgaggcagccccggcagagccggtcagggacgccgcacgtcccgcgccgcccacggcgatcgaccgcggcatcaccgactacctgcagcacatgggagtggagcgcggactggcggccaacaccctgtccgcctaccggcgggatctcacccgttatgcccggtacctctcggcggccggctgcgcgcgcccggaggacatcacccgccatcacgtcacgggatacgtccgggcgctgggtgacgggtccgacggcggctccaccctgggcgtcaggtccgccgccaggactgtggtggccgtccgcggcctccacaagttctgggctttggaaggcttcacgcccactgaccccgccagcgaagtccacccgcccatgcccggcaagcggctgccgaaggccatcagcgtggatgaagtcacgcggatcctcgaagcggcgggaacggacacagcaacgggtctgcgcgaccgggccctcctcgaattcctgtactccaccggagcgaggatcagtgaggccgtgggcctggacgttgacgacatctcactggaggctgaggcctccggcccggccatcgtgcggctcttcggcaagggttccaaagaacggctggtgccccttggctcctacggggcccgggccctggaagcatacctggtgcggggccggcccctgctggcagccaagggaaaaggcaccccggcgttgttcctgaacgcccgcggcggccggatcagccggcagagcgcctggaccatcctgaaggccgcggccgaaaaggcgaacatcaccaaggacgtttcaccccacaccctcaggcattcctttgccacccacctgctcgaaggcggcgcggacgtccgtgtggtccaggagctgctgggccacgcctcggtgaccaccacgcaggtgtacaccctggtcactgccgataccctgcgggagatctacgccgccgcgcatccccgggcgctgggctgagcatggctgctgcggttgccctctgtttcctgcttcgcgaggttgacggcgtatcccaggtgctgctggggctgaagaagacgggctttgggcgcggaaagattgtcggcatcggcggccacgtggaaccgggcgagagcgacgcggaggccgcgatccgtgaggtgcgggaggaagccgacgtcgggctccgccacgaggaccttcgggacgcgggcgtcatccggttcgtgttccctgccaagcctgagtgggacatgagcacgcggctgttcacagcggtgcgctgggacggcgagcccacggaaagcgttgagatcgccccagcctggtttgataccgccaccctcccggtggaacggatgtggcaggacgccgaccactggctgccggtggtgctggaaggcgggaaggtcaacatcgttgtgaccatggacaacgacaacgaggccgtcgcctcctccgaaagcctcctcttctgaagcgaccggatctgacacgactggacagtgaagaacgacggcggcgcggccaccttggaaggtgaccgcgccgccgtggctcacaggccgtcgtcgtgctttccgcaggggcgggggttacgccaggtgccgttcctccggaccgacgtattcgctcagcggacggatcagcgagttcgagtccagctgctccatgatgtgcgccgtccagcccgtgatccggctggcgacgaacaggggagtgaacgtctcggtgtcgaagcccatgaggtggtaggtgggccccgccggatagtcgaggttgggcttgatggccttggcttcttccatggcggtctcgagcccctggtacaggcccaggagttccggcctgccgtagtgcgcaatcatcttgtccagggccgccttcatggtgggcacccgggagtcgccgtgcttgtacacccggtgtccgaaccccatgaccttcttcttgtgggccagggcgtcctccatccatgctttggcgcgcgctgccgcttcctccagtgattcctccggccggatgccgatctcatcgaaggtatgcataacagcctcgttcgcaccgccatgcagcgggcccttcagggccccgatggcgcccgtgaccgctgaatgcaggtccgagagcgtggaggtgataacccgtgccgtgaaggttgaggcgttaaaactgtgttcggcgtaaaggatcatggaaacgttgaaggcctccaccacttccggcacctgttcctcaccgaaggccatccacaggaagttggccgagtagcccaggtcgtcacggggcgccaccggttcaacgtggcgtcccgccgcgtgccggcggcgctggtcataggcaaccacggccggcatcgctgcgaacaggtccacggcctttgccatgttggcttcccgcgatgaatcctccgccaatgggtgccgggcacccatgacagaggctgctgtccggcacacatccatagggtgggagctggtgggcagggcgtcgattacctgcttgaccaccgggtccagggcccgaccggcccgctcccgcgcggtgaattcggccagctggtccgcggtgggcagctccccgttccagagcaggtacgcgacttcctcaaagctgcaccgtgccgcgagttcctggaccgggtagccgcggtacagcagcgaattggtgtccgggttgaccttcgagacggacgtgtagtccactacgacgcccgcgagaccctttttgatgtcctgttcagccatgctgaaactcccttgttcctgtcgcctttcggatgccggccggggccggcggtggtcctttagtgctttccggggacctggaaattgaagaccccggtgtcaaaacggttgtaggcctcgtagtccacgagatcgtacagccgcgcccgggtcagcatgctgccaacctgcgcctcctgcgttccctcagccttgatcgagtccagcgtacgctcagcagcgcccatggcactacggagcagtgtgaccggataaatcaccatgttcacgcccacagctgccagctggtccaccgtgaagaggtcgctcttaccaaactccgtcatgttggccaggatgggcacgtccacggcatcgcggatggcctggaactcgtccagggtggccattgcttcggggaagatggcgtccgcgcccgcttccactagtgcttttgcccggtcctgtgccgccgccagtccatccgtggcgcggatgtcggtgcgggccatgatgaggaagttcgggtcgcggcgggcgtccgcggcagcccggatgcgtttggtggctgtctccaggtccactacgttcttgccgtccaggtggccgcagcgcttggggttgaactggtcctcgatgtgcagcccggcaaggccggcgttctcaagttcctgcacggtgcgcgcaacgttcatcggttcaccgaacccggtgtcggcgtccacgatggcgggcaggtccgtcatgcgggcgatctgcccggcacgggtggccacttctgtgagggtggtcaatccaatgtccgggaggccgaggtcgttggccagcaccgccccggagatgtagacccccgcgaaccctttctcctcgatcagccgggcggagagggggctgaacgcgccggggaactggtggatggtcccggaggccaggagttcccggaaccggaccctcttctgctcaggtgtagtcctggagtacagcatcagaacagtcccttgggcgcggcggcgaagtcgatgacgccgggggcggcggtgatgttcagctggtccagctcaccggcggcgagttccggcagccgctcggcggctgccaggaaccgttcgatttcggcttcctccaccagcccggcggcgagggtgcggaacttgttgatgtactgctcgcggccaaagggcctggcgccgagggggtgggcatcggcaaccgcgatttcgtccttgatgaccgtgccgtccgtcagggtgatctccacggagccgccgaacgctttctcggcaatgttgagggagtggtagcggcgggtccactcggggtcttcctcggtgctgaccttctgccacaggtccaccgtgtccggccgtccggcgcgttcgggggagtaggagtccacgtggtgccaggcgccgtcctgcagggccaccgtgaagatgtaggggatggagtggtccagcgtctcccggctggccttgggatcgtacttctgcggatcgttggcgccggagccgatgacgtagtgcgtgtggtggcttgtcctgatcaagacggacttcacgttcgccgggtccgtggcttcagggtgctcgcggttcaatttccgggccaggtcgatccaggcctgcgcctggtactcggcggagtgttccttcgtgtaggtgtccaggatggcgcgctttgcttccccggcctccggcagcggcaccatgtaggaggcatccggaccgtccagcatccaggcgatgacgccgtcttcaccttcgtagatgggcaccggagaggtctgtccgcgcatggcacggtctgcggcctcgacggccatctttccggcgaaggccggtgcgtgcgccttccaggtggagatctcgcccttgcgggactgccgtgttgcggtggtggtgtgcagggcctggccgacggactggaagatggtctcgacgtcgagacccagcagggtgccgatgccggcggctgccgacgggccaaggtgcgccacatggtcgatcttgtgcttgtgcaggcagattgccttgaccaggttcacctggatttcgtacccggtggtgatgccgcggatgaggtcctgtccgctggccccggtgtgctgggcaactgcaaggatcggcgggatgttgtcgccgggatgggagtagtcggcggccaggaaggtgtcgtggtaatccagttcccgcacggcaaccccgttggcccaggcggcccattccggtgacacgcgctcgccgatgccgaagactttggcgccctggccgccggtgctggggccatgagccagggcctgggcccgggcagccacaatcggcccgcggttcagcgaggcgatggccaccgaggcgttgtcgatgacccggttgatcaccatgtcggccacctcgggcgataccgcgacggggtcgctggcgaccttggcgatcttgtaggcaagctgatcctcgcggggcaggttttcctcgctcctgtaaacccggacgtggtgttccttaaccatggtgctccttgtggtggggtgagtgcgtgttcttgacgtgcgaaaggcttcggtgcagatggaggatgggtggcggcctcggccagccgggggttgccggcggcgatcgcttcggcgatggctgcgtgctcggcggctgcggctgtgagccgctgcgcatcgtcggctgccaggcggcgcacgcgcaccaggtgcacgcgcaggccgcgcatggcctgtgccaggtaggagttggagacggcggcatcgatggcggcgtcgaggcgcccggcaagatcgtagtaggcgtgccggccggggtcgctgctgtcaataagggccggagcttcgaggagctccttgtggagctggaggaaaacgccgggatcaccgcgtttggctgccagcgctgcggctttgcattcgagggtttcgcgaagctcgaagagttcgtcgatgtcatcgagcgaaacgtcggtgacgacgacaccgcggctgccggccgtcgtcgtcagcccttcggcggtaagccggctcagcgcctcccgcagtggagttcgtgagacaccgaggcgttcggactgctccacctcggcaagcaccgtgcccggcaggaggcgccactcggtgatgtcgtcgcgtagggcggcgtaggccctgtcactggcgcgcatcgttgcctccttcggtaattgaccccctcagtgtatacagaggatgtttttttgccaatgaaataggtctaggacccaaatttctcgcatatatgtatacaaaacccttgtttcgccgccggacccccggctagcatggcggctacacaacgtcgtggatgggaagcactttcatggtcaccagcagctatcgggaaagctacgaagaaagccttgggaaacccggggagttttggctcaatgcggccgcaaaggtttcctggtcggtgccgccccggcgcgcgctggactcaagcagggctccgctccacacctggtttccggacggcgtcctcaacacctcctacaacgcgctggaccgccacgtggaggccggcaggggggaccaggacgcgctcatctacgattccgccatgctcggtacccgccagcgcttcacttacgcggaactcaccgggctggtggcacgctttgccggcgccctccgcaaccgcggggtgggcaagggggaccgcgtggtgatttacatgccgatgattcccgaggccgccatcgccatgctggcaacagcgcgactcggagccgtccattcggtggtattcggcggatttgccccgaaagaactcgcagcacgcatccgcgacgccgctcccgccgtcgtggtcacggcctccggagggatcgagcctacgcggcggattgaatacctccccgccgtcggggaagccctccagctggcgggagtgccggacctccccgtcatcgtgcgggcccgggagggcttcgctgccacagcggcggaccatggctggcatgactgggactcggacatggccgctgcggaacctgccgcacccgtggacgtcgcggccacggacccgctgtacatcctctacacctcaggcaccaccgggacgcccaaaggcgtggtgcgggacaacgggggccacgccgtggcgcttagctggaccatggaaaacatctacggtgccgctccgggggacgtcatgtggaccgcgtccgatgttggctgggtggtagggcactcctacatcgtctacggcccgctgcttgccggtgcaaccacggtcctctatgaaggcaaaccggttggaacgcctgacgccggcgcgttttggcgcgtgatccaggaacacggagtcaacgtactgttcactgcccccacggcgctccgggccatccggaaggccgaccctgaggcattgctgctgcggaactatgacatctccagcctccgcacgcttttcacggcgggggagcggctggacacggacacgttccactgggcctcccggtcggttggcgttcctgtggtggaccactggtggcagacggagacgggctgggccatctgcgccaatccccgcggcctggaagaactgcccatcaaggcaggttcgcccagcgtgcccatgccgggatttcggctcagcatcgtggacggccttggcgtggaagtggcacccggcatggaagggaacatcgtgctcgggctgccgctgccgcccgggaccctggcgacgctctggggcaacgacgaacggtacgtctcctcctacctgcaggctttcgaggggtgctacgccaccggggactccggctaccgggacgcggacggctacgtgttcgtgatggggcggaccgacgacatcatcaatgtcgccgggcaccggttgtccacgggcgccatggaacaggtcatcggacagcatccggccgtggccgagtgcgcggtgatcggcctggccgatcccctgaaaggccagcggcccagcggctacgttgtgctcaaatccggggtggaggtgtccgaggacatcctggccaaggacctggtggcgatggtccgccgggacatcggcgctgttgcggacttcaagcacgtgacggttgttgatgccctgcccaagacccggtccgggaagatcctccgcaagaccatgcgccagattgccgacggcgaggagtacacggtaccgtccacgatcgaagacgccggggtgattgaccagctgattgggaccctccgtcccggcgcgagcgggccatagcggcgcctggagtcaacgcccgctccagcggtactcgttttccggccggcccggtgttccgtagcgggcagtcctggagaccgtgccggcgtcggccaggtactcaaggtaacggcgtgcggtgacgcgggacatgcccagcgcgtccatgacttccgtggcggacacggcgccgctgtgttgcctgacaaactcctgcaccgagcccagggtggaagcggagaggcctttgggcaggggcagttccgacggtgcccgcaggcttgcgaaggcctggtccacttcgctttgggatgctccggcctttccggagccggcgtttgggcccgcgagttgctgccggaactgccggtagctttccagcttgtcggcgaacgtggcgaacgtaaacggcttgatcaggtattgcaccaccccgatggccacggcgctccggacgatcgccagctcccggacggcggtgatggcaatgatgtccgccaggatgccggccgcccgcatccgccgggcgatgtccaggccgtggaggtccggcaggttcatgtccaggaggaccagctccaccgggttgcccgccgccgagagctctccgagcagccgaagggcggactggccgtccggcgcgattccggccagctcaaagcccggcagccgcccaatgtaggctgcgtgtgccgccgatgcgatggcctcgtcctcaacgacgaggacccggatgttgctcacggtgtgtgctccttttgcggggacgctgctgcgggtaggaatacttcgaattttgctccgcgacgtccgttgatggtcagggtaccgcccagccgctgcactgcctgccggaccagggccagcccgatgccccggccgccgggcccggaaggcttggtactgaagccgtggcggaaaatgttgtccgccgcctcagcgtccaggccggcgccggaatcgtggacggcgatgtccagcccctcctcatccgactccaccgtcagctccacgcgccggggcgggggagcatccgcagccgcatcgatggcgttatccagcagatttcccaggatagtcaccaggtcctgcacagccactcccgccacggtacctgaacccagcgtggcaacatccagctggaccccgcgttcgtgggcttcagccaccttgcccatgaccagtgcacccaggaccggttcatcaacggagctgaccatgtcatccgtcagctgctggctcagttccaggtcccgggtggcgaaatccagggcttcctgtgtcctgcccagctccaggagcgagaccatggtgtggagcctgttggcgtgttcatgggtctgggcgcggagggctccggagagcgtccgcatggtttccagttcgttgcccagtgcctcaatttcggtccggtcgcgcagcgtggccacggtgccgtagacctgcgttttgccgcgcgtccccggggaaccgggcgcctttgccggcccctggttgactaccaggacgcgggaaccgtagaggatgatttcgtccttggcagtccgcccggactcgaacaggtcccggagcacatcctcaagcggcagttccgcgagcgacggcggccgggtggggtccttgctcccggcgccttcgaggcccagcagttccgccgcctggtcgttgtacatcaccacgcggccccttgtgtcgatgaggatcaggccctcccgcaccgagtgcaggacagattcgtagtaggcgaacaactgcgacagttgctccgggccccagccgcgcgtcacccggcgcagataccggcccagcagccaggatgccagcgagcctcccaccagcagggcaaggccaatagacagcagggcgggcagtcgcccggcgaaggcgacgtccactgtgcggaccgtaacgccgactgccacgagcgccttcacgtcacctgcctggtccttgaccgggacaatggtccgtacggacgggcccaaagtccccgccgtcacctccgtaaactgctcgccccgcagtgcggcatcaatggaaccaatgtacggccggccgatttcctcgtccctcggatgcgtccaccgggtcctgtccggagccatgatggtgacgaagtcggcatctgctgctgccataacgttcctggcatagggctgcagggaggcagtggggtctggactggccgccgcctccagcaccagcgggctggccgcgatcgcggcagcgatccccgccatccgccggcccgcttcatcgtaggtccggtcccgggcatcaacgaaggtggccgaaccaacgacggcgataaacaccaccacaattaacaggttcgctacgaagagccggcgggcgatactccaagggtggatcacgtgtacctcccgacgccctttccaggcgcaatccttgagaaagcatgagcgccgcgaccaatatgaacgcaacggtgagctgggtcacggcgtgcccaatgatggatatcacaccggatgacgcgttgagcccagagactgtgccgcagcgtctatcagattatccatataaggagacacatcatggcttctcaacgaggagagtcgcttgacaccgtgaagacgcggcgcaagggcatcgacaaatcgcactacctctacattgcggtcatcgccgccgtcatcctcggcgccgtggtgggcctcatgttccccgaagtcggcaagtccctcaagccgctcggcgacggattcatcaaactcatcaagatgatgattgcgcccattatcttctgcaccatcgtcctgggcatcggctctatcgccaaggctgcaacggtgggcaaggtcggcggcctggcgctgggttacttcgtccttatgtcgacgttcgcgctcgccatcggcctggttgtaggcaacctgatccacccgggtgagggcctgaagcttgcgccttacgaccccaccaagaaggcggaggttgacagcaccgtcgccttcctcctcggaatcatcccgggcgacattccggtccttccgaccctctttgccgccctcctcgtaggtttcgccctccagaagatgggcccgcagggcgcaccggtactcaaggccatcggccacggccaggccctcgtcttccgcatcctcatcatgatcatgtggcttgcccccgtgggcgcattcggtgccatcgccgccgtcgtgggagctaccggtttccaggccatcgtgagcatgttcaccctcatggccgccttctacatcacctgcgcactgttcatcgtgatcatcctgggcggtctgctcaaggtggtcaccggcgtcaacatcttcaagctgatgaagtacctgggccgcgaatacctgctcatcttctccacctcctcctccgaagctgccctgccccgcctgatcgccaagatggaacacctgggtgtctccaagcccgttgttggcgtcacggtgcccaccggctactccttcaacctcgacggcacggccatctacctgaccatggcatccctgtttgttgccaacgccatgggcacgccgctggatcttggcgcacaggtctccctgctgattttcatgatcattgcctccaagggtgcagccggtgtcaccggtgcaggtcttgcaactctggcggccggcctccaggcccacaagccggaactgctgggcggtgtgggcatgatcgtgggcatcgaccgcttcatgtccgaggcccgtgccctgaccaacttcaccggcaacgccgtggccaccgtgttgatcggcacatgggtcaaggagatcgacggcacccaggtcaaccaggtgctctccggcgaactgcccttcgacgagcagaccatgatcgccggccacggccacaccgagccggcagccacggaaaccgacgcgtcccgcgtcccggccgccgtctaggcaccacgccaggcgcacgccaggctcgcaacagtttcaacgcagcagcccccgcagccctggccgcgggggctgcttcgcgccccgaaagaaaccaaccttcgacctcagctagagggtcaaggctcaacatggggggaaagtcaagttccgccgaataccgtgtcggtcgctgtaaccttgggaggaagaaggaacggcgctggcatccagcggcaggaaatcaccgtcatcgaaagtgtggatagatacgtgagcagcgaacagggttcggcaactctggagggcacggaatttgacctggacaacgcggtgatgggccccacgggacgcccataccgggagttcccggaaccggcaccgctgtcctcccatggtccggcgcgtgtgatcgccatggtgaaccaaaaaggcggagtcggcaagaccacctccaccatcaacctcgcggcagcgctggcggagttcggccgccgggtgctcctggtcgatttcgatccccagggtgcgttgtcggcaggcctgggcgtgaaccctcatgagctggaccttacggtctacaacgtgctgatggaccgcaaggtcaacatccgcgatgccatccaccagaccggcgtcgaaaacgtcgacctgctgccggccaacatcgacctctccgcggccgaggttcagctcgtcaatgaggtagcgcgggagcaggtcctggaccgtgccctgaagaaggtcgaggacgattacgacgtcgtcctcatcgactgccagccgtccctgggcctgctgaccgtcaacgcgctcaccgcggcgcacggcgtcatcatcccgctgatctgcgagttcttcgcccttcgcgcagtggctctgctcgtggaaaccatcgacaaggtgcaggaccgcctcaacccgcgcctgcaggtggacggggtgctcgccacaatgtacgacgcccggaccctgcacagccgtgaagtcatcacccggctggtggaagccttcggggacaaggtcttcgagaccgtcatcaagcgttccatcaagttcgccgatgccacggtggccgctgagccgatcaccagttacgccggaaaccacatcggtgcggacgcctaccggcgcctggccaaagagctgatttcgcgcggcggcgcaccctagccaggacgtggccgaatccaagcccggcttcgaggtacggctggccaacttcacgggtcccttcgacctcctgctggggctgatcgccaagcaccagctggacattaccgaggtggcccttgccacggtgacagacgaatttatcaagtacatccgtaacctgcagaaactgggcggcgaatgggcgcttgatgaagccagcgagttcctggtgattgccgcgacgctcctggacatcaaagctgccaggctccttccggccggtgaggtggaagacgacgaggacatggcactgctcgaggccagggacctgctcttcgcccggctcctgcagtacaaggccttcaagcacgtggccggtctcctgggtgaaacactgcaccaggaagccatgcgctttccccggcaggttgccctcgaggagcatttcgcggccatgctcccggaacttgtgtggaagcacaccccggaacagtttgccgcgctggcggaaactgcgctccggcccaagacgccgaaacccaccgaagtggggctgacccatctccacggcggcaatgtcagcgtcaaggagcaggccgaaatcgtagggctgcggctccagcgggaatcgccgctcacgttccgggccatcatcgccgacgccgagtccacccttgtggtggttgcgaggttcctggcgctgctggagctgttccgggacaaagcggtgtccttcgaccagctgtcaccgctggcggaccttgccgtccactggaccgccgggagccggcagtggtccgcagacaacctaagcgaagagttcgaggagcagctgtgaccaaggaagccacggaaggcacgcacctgggggaggaggacctcgaaaagctcccgggcggggccaaagctgccatggaggctgtgctgatggtcatcgaccagccagccacagaggaggaactggccgccggccttggcctgacagtcgaaaaggtcagcgcgctgctgtccgaactgcagggcgagtatagcggctatactgttaaagccccggatatggatcaagccagccacgctggtttcggctcccgcccccggggttttgaattgcggaatatcgccggcggctggcggatctactcccgcacggacttcgccgacattgtgggcaagtatgtgctggaaggccagactgccaggcttacccaggcagccttggaaacgctcgcggtcatcgcgtaccggcagccagtctccagggccagggtttctgcaattcggggcgtcaatgttgactctgtggtccggacactcgcccaacgcgggttgatcgaggattcgggaacggatccggaatccggggccatgctgtaccggaccacatcgtatttcctggaacggatgggaatcggctctgtggccgagctgccgcagttgtctccacatcttccgggccttgacggcatcgcggattactacgacgccgaagggatctaggcagtttcgcgctgcctgggcaagagtatttatcagggcagattatttctgcacggctggttagggttgtctctggacacctttccggccaaacaattgaaggacgggtcatgacacaggcgggacgccagggttcaccacgtaacagctcgggacgcaacaatccccagcgcagcacctcccagggtggcaagtcagcgggcgggttccgcggcggtgccccgaagcggggcggcgggttcggcagcgaccgcccgcagcgcgcacccaagccgcgcgaggaacgcttcatcgatccggatctggcttcggacggcgcccagcagggccgcagtgccgcagatccaaaggccgccaggccttcctcgcggaagcctgcagcgcgcaaacccggagccaagaaggcgccgggcacgccaggcgccctcaagccgaagccgcgcaccggcgcgcccggcgccgcagcctcccgtgcgttcggaagcgaacgcttcggccagaacctggggccggtccgcaggccttcacgcaagaagggcccgcgcggcgacgttccccagtcggaactccacgacgccgacggcgtgcgcctgcagaaggtcatggcctcagccggcgtcgcctcccgccgcgtctgcgaggagatgattgccgagggccgggtggaagtggacggacaggtcgtcaccgagctcggcgtccgggttgatcccaagaccgccgtcatccacgtggacggcctgcggatccagctggatgagaacctcgtctacatggtcttcaacaagccgaagggcgttgtctccaccatggaggatcccgagggccggccgtgcatcagcgatttcctcaagagcaacaagaacaccggcgaacggatgttccacgtggggcgcctcgacgtcgccaccgaggggctgctcctgctgacgaacgacggcgaactggccaaccgcctgacgcacccttcctacgaggtgcccaagacgtacctggtgcaggtccgcggtcccttcccgcagggcatcggcgcacagctcaaggaaggcgtggaactggaggacgggtttgcgtccgtggattccttccggctcgtagactccacgcccggccacgtgctgatcgaagtggtgctgcactcgggcaagaatcgtattgtccgccgcctcttcgacgccgtcggcttccccgtcctgcggctggtccgcgtcaaggtgggccccatcggcctgggtgaccagcgccagggcagcatccgcaacctcggcaagcaggaagtcgggcatctgctggcatccgtagggctctgaggcatgtccgccttccacagccagggccgcgggcacctggatggtccggtggtggtcctcgggaccggcctgctcggcaccagcattggactgggcctgcgcggacggggcattccggtgttcctgtccgacccctcgcccaccaaccaggcggtggccgtggacatcggtgcgggccggccgctgccggaactgggcagcgctgtcccgcagctggtggtggttgctgcgccgcctgacgttacggccgatgtcgtggaaaaagccctgtcggattttcccggctccgttgtggtggacatagccagcgtcaaggcgggcatcctggacaacctgcggcgccgcggcgtcgacctgtcccggtacgtgggcacgcaccccatggccggccgggaaaagtcaggcccggtggccgcccgcggcgagctgttcacctcgatgccgtgggtggtgtgcccgtcagaggaaacctctggcgccgccctccagacggcccgttccctggcctcggacctgggcgcagttgtgtcccggttcacggccgacgagcacgacgaagctgttgccctggtatcccacctgcctcaggtcatgtcctcactgctggcgagccggctccagggcacgcctctgcatgctctgtccctggccggcaacggcctgcgggacgtcacgcggatcgcggccagcgacccgtccttgtgggtccagatcctcggcggcaacgccgcgaaagtcgtggaaatcctctacggcgtccgggatgacctcaaccgcctgatcggaacgctggagcaccccacggctccgggcgcgcggctggacctcgcgcagctcatgagcgaaggcaacgccggccaggcacgcatccccggcaagcatggggggccgccgcaggcgtactcctggctcaccgtcctggtggacgacaagcccggacagattgcccggctcctcacggaaatcggcgagatcggcgtcaaccttgaggacctccgcctggaccactcgtccggccaaaacgtaggtatggtggaaatctccgtgttgccgaacaagcatgaccacctgatcgaagcactcaacgaccgcggatggcgggtactccagtaatgacacaggaacttctcgataccatgcctgcgctgcgcgtcggccggccgctggtggttgccattgacggcccgtccggctccggtaagtccagcgtcagcaaggaagtggcccgcaggctcaggctcgcctacctggacactggcgcgatgtaccgtgccctcacctggttctgcgtcagcaagggcatcgacctcgaagactccgcagcagtggagcaggccgcacgcgacctggtcctggaactgagcaccagccccctggaggagtacgtgcgggtggacggtgttgacgtcaccgacgccatccgggagcccgccatctcctccgccgtcagcgccgtggccaccaccctgggggccaggaccgagctgatccgccggcagcgggaactgatcgaaaagcaccaccgccgcatggtggtggaaggcagggacatcactaccgtcgtcgcgcccggggcggaagtccggatgctgctcactgccagtgaggaagcgcggctgcgccggcgtggaatccagctgggcggcacccagaacgccgagcagctggcggcccaggtgacccatcgcgatgccaaggactcctccgtggtgaacttcaccaaagccgcttccggtgtggtgacgctggattcgtcggacctcgacttcgaccagaccgtcgccgcagccctggtgatcgtcacaaaggtcctcaaccgtgactgaacgcgccgccaccacctcccggccgggtgttccctccggcctgaccatggcgtggagcaggccggtgggctggatcctcgaccacgtggtgtaccggacaaccgtcacgggcaaggaaaatgtgcctaccggcggacccgtgatcttcgcgggcaaccacatcagcttcctggacggcccggtcatgttcggcgcctcgccgcgtcccatgcacatcctggtcaaacaggagatgttcaagggcttcctcggccaggtgctgacagcttcgggccagctgccggtagacaggcgcggcgaccggaccgcgctgcagcgatgcaaggaagtgctcgacgccggccggtgcgtgggcatcctccccgaaggaaccaggggaagcggggcagcggccgacatcaacggcggcgtggcctggctggccctgaactccggggccccggtggtccccgtggccatcctgggcacccgcaggggtgacgagcacctggattccgtgccgcggcccggcaggcgcttccacgtcagcttcggaaatgccctcacccttgcccgccgggcaggggaaagcgggcgtgcttcaatggacagggcggcgctggacatccgcgccgcgctggcagggcacgtccaggactccattcaactcagcgggcagccattgcctttcgcagatgcccgccaagacttaacagcagtagccgggacgccggcagatgaccactaaggacagtgcaatgagcgatacgactcaaactcccggccacttcggcgccggcgaagacgaatacacgcccacgggcacggaccaggtggccgaacggctggctgccatcgacgacgacgaggcagagctccgcgccgcgtccctccgggcgggcctggaggactatgacctcgacgaggaagacgccgcactgctcagcggcgaatacggcgacgaggactttgacggccccgttaagctcgatcccgtcctggccatcatcggccggcccaacgtgggtaaatccacgctggtgaaccgcatccttgggcgccgggaagccgtggtggaggacacccccggcgtcacccgcgaccgcgtcatgtattccgccaactggaacggacgcaacttcaccctggtggacaccggcggctgggagcacgacgcccgcggcatccatgcccgcgtagcagagcaggccgagatggccgttgagctcgcggacgctgtgcttttcgtggtggactccgccgtcggggcaaccgccaccgacgagggcgtcatgaagatgctgcgccgcagcaagaagccggtcatcatggtggccaacaaggtggacgactttgcccaggaggcggactccgccaccctgtggggcctgggctttggtgagccctacccggtctccgcgctgcacggccgcggcgtggcggacctgctggaccacgtgatggacgtgcttccggaattctccaccatcgagggcctggaacgctccggcggaccccgccgcattgccctgatcggccgccccaacgtgggcaagtcctccctgctgaacaagctggccgggactgaacgcgtggtggtggacaacaccgccggcaccacccgcgatccggtggacgagttcatcgaactcggcggccgcacctggcgcttcgtggacacggcaggcatccgccgccgccagcacatggcgcagggtgcggactactatgcctccctccgtacgcaggccgcgctcgaaaaggcggaggtcgccgtcgtgctgctagccgtggacgaggtcctcagcgaacaggacgtccggatcctgcagctcgccattgagtcgggccgcgccctggtgctggccttcaacaagtgggacctgctcgacgacgaacgccggcgctacctcgagcgtgaaattgagcaggacctggcccacgtggactgggcaccccgcgtgaacatctcggccaagaccgggtggcacaaggaccgcctggttcctgccctggatttggcgctggagaactgggacaagcgcattgccaccggccgcctcaacgccttcctgggcgagcttgttgccgcccacccgcaccccgtccgcggcggaaagcagccgcgcatcctcttcggcacccaggcctccagccgcccgccgaagttcgtcctgttcaccaccggtttcctggaccccggataccggcgcttcatcacccgccggctgcgggaaacgttcggcttcgagggcacgcccatcgaggtcagcatgcgcgtgcgcgaaaagcgcggcaagaagcgttaattgcgacacaccttgggggctgatcaccggaaagtgtcacaggcacccctccggatcgtgtaagctcttctaggtggttcggccggactgctgatgaaaaccttcgggtttgagttcagcggagaacggcggaaccagcgggctgtagcgcagcttggtagcgcacttgactgggggtcaaggggtcgcaggttcaaatcctgtcagcccgaccaacaagcggaagcgccggagatgctctccggcgcttccgctttttgtgtgtggttacttgaggaacttcgaggtccttcggtcagccaggatcttgcccttcgtctggcaggtggggcagtactgcagggacgtgtcggcaaaggaaacctcccgcacggtgtctccgcacaccgggcaggcttgccccgacctcgcatggacgcgcatgtggctccgcttcacatccttgagatccttcggcggtttgccgctggcctccgccagcgcagtgcccaggacgtcatggatggcgtcgtacagcacctggactgttccccggtccagggatttggcggtggcgaacggcgagatacgggcagcatgcaggatctcgtcgctgtaggcgttgcctatgccggctatcacgccctggctgcggaggatgcccttgatctgctgggaactggagccaaggatctcagccagcatgtcggcgtcgaacgcttcactgaacgggtccgggcccagcgtggcaatgcccggcacctcctggggatcccgcaccacataaactgccaggctcttcttggtgcctgcctcggtcaggtcgaagccgcgcgggcctccggggccggtgaaggcaaggcgggcggcaatgtgccctttgcccattttcagctggccgtcggtgggggagtccgtgaagcggacccagcctgccctggccaggtggaagacgaaggaaattccgccggtgtcaatgctgatgaactttccgaagcgccgtacacccgtcacggtcctgccctcgagggcactgaaggggggatcggctgtcttgagtacggcaaaggacacgatctgcactttggaaacaacggttccctgcaggtggtcgtccaggtagccggccaggccggaaacctcggggagctcaggcatccgtcacccgccgtccctggcgtggccgctgaccgtgcgtgcgctcatgcgtcccatcttgtcagaaaccccggcgaacgccccggcagttgtgcctatactttcaacgcggcccgttcccgggccgcgttgacagtggtgttcgacccgatgaaaggcccctgatgagcaacattcccgaagatctgtcctacaccgccgagcacgagtgggtcaccgcccccaatgccgacggcgtggtccgggtaggcatcaccgactttgcccaggacgcactcggggacgttgtctacgcccagatgccggaagtcggcaccaagattacggcaaacgaagttgtcggcgaggtggagtccaccaagagcgtcagcgacatctacgcccccgtcagcggcgaagttgtgggccggaacgagtccctggacaccgattctgccctgatcaacaccgatccctatggtgacggctggctgatcgagatcaagctttccgaagctgacgccgtcgactctttgctcagtgcatcggagtacgaacagcaggtaggctaaagctaaccggaatttccggtccggcccggggcgaagccagaatgtcttcgcacgtcagcggccggatcggtagccggttccggacctgcgctgcaggcccggaggacatatgttggctgcaggcctgacggccgcagcggaaagaggaggagtccatggctggccacacacagaaccctgccgacggggaatacggctcgggtgcggccagggagtcggagaccacctccatccacctcaccccggtgagggatgagcccacgattacacccaagctttcgctggacgagcgttcctcggtagaggcgctgccggctggatcggcgctgctggtcgcccacagcggccccaatgccggcgcccggttcctgcttgactccgatgtcaccacggcaggccggcacccggacgccgatatcttcctggacgatgtcacggtctcccgccgccacgtcgagttccgccgcacggcacgcagctttgaagtggtggacaagaacagcctgaacggcacctacgtcaaccacgaccgcgtggacagcgtggagctcaagtccggcagcgaagtccagatcggcaagttccgcctcaccttctacctgagccctgccaccgctgcaggccgcggctgacccggggaccactgcctgtggcaatggcacaaccggaacgccggggaccccaggtcctcaacatcggggaagtcctcgcacagctcagcggggactttcccggcatgactgcgtccaaaatcaggttccttgaggaaaaagggctgatcaacccccggcggactcctgccgggtaccggcagtactccgacggcgacgtcgagcggctgcgcttcgtgctggccctgcagcgggaccagtaccttcccctgaaagtcatcaaggattaccttgacgcgatcgacaggggggaacgcccggagaacctgccgcccggcgtcgttgtttccccccgcatcgtctccgacgagctggcggctgaactgcagagccggggacgcaagctcaccgaggaacagctccgcactgagtccggcgccagcgtgccgctgctgcagtccctcctgagctttggcttgatcagccactccaacgggcagttcgacgagcacgccctccaggtggcccgggcctgtgtccagctggaaagccacggccttgaaccccgccacctgcgccccttccaggcggctgccgaacgggagtttggcctggtggaacgcgcggtggcgccgctggcgtcccgcaaggacgccgcgtcccaggcgcgcgcggccgaggccgcccgcgaaatcagcgacctctgcctcaccctgcaccgggctctggtgcaggaccatatctcacgcatggacatctgatgattgaagtcgagattgtaggcgttcgcatcgaactgccttccaaccagccgctggtcctgcttcgggagatgcacggtgagcggcacgttcccatctggatcggtactcccgaagccagcgccatcgccctggctcagcagggcgtagtgccgccccgtcccatgacccacgatctcctggtagacgtggtggaagcgctggggcactcggtggtcagcgtcaacatcgtggcggtggaggacaacatcttctacggccagctccagttcgagaacggcaccacggtgagttcgcgggcgtccgatgcgcttgcggtggcgctgcgcgcgaagtgccggatctggtgcgcagactcggtcatggatgaggccggcgtgcgcatcaccgagcacgacgagggcgaggacaccgagtcaggccccaccgttgacgaagagcgcgaactgcgccggttccgcgagttcctggacgacgtcgaacccgaggatttcgacggctaaggtcacgttaaggttaaagttgaggatgaatctttcgacacgcctcgtgaaaccccccaaggtctttgaccttgcaggccgccgggcctaacgtcgaagtatcaagttcccattgcttacggcagcctcgcaagtcacactggaaagtgcgccccgcgaaaattacatgcatggtcttcatgcaccgctgctccagtagttacccgggagcgcatgacaaggaggatccaggtgagtcccaaaggcgaagcaggcgggcttaagcagcccacggctggtgttgctgtgccggcgagcggtgcccagggcctcctgtttaccgaggaccttcctgtgctggacgaggacgccggctaccggggccccacggcctgcaaggctgccgggatcacctaccgccagctcgactactgggcccgcaccggcctggtggagcccgcggtccgcggcgctgccggttccggttcccagcgcctttacggcttccgcgacatccttgtcctcaaggtggtcaagcggctcctggacacgggggtttcgctgcagcagatccgcagcgccgtggagcacctgcgggaacgcggcgtcgaggaccttgcccagatcacgctgatgagcgacggcgcgagcgtctacgagtgcacctccgccgatgaagtcatcgaccttgtacagggcggacagggcgtcttcggaattgccgtgggacgggtctggcgtgaagtggaaggcagcctggcatcacttcccagtgagcacgccgccgaacagtcctttccggacgacgaactgagcaagcgccgcgcagcccgcaaaatcagctgaggcttaactgataaggggccgtcctccatatggaggacggccccttatcagttaaacggacgtgagggctcggtgcctaccgggcgcggctgcgcaggccgcttcccactgccatcagatttgccagcaggtcatcgaagagtgccgcagcggactttgcggagtcgccgggccagtggtgaacggggtgggcggcgccctggatctgctgccagttggcctgctcggggatccgggggctcaggaggaggtcgccgaacatggattccatttccgcgagccggtaggtgtgttcggaggatcctgaccgcacccggtttgccacgatgcctgcgggggagaggttgggggcgaattcctgccggaaaagctggatggcccgcatggtccgctcggtgccggccaccgagaacaggccgggctcggctaccagcgccaccttgtcgctggcagtccaggccatccgggtcaggccgttgagggagggcgggcaatccaccaggacaagctggtagtcgccgccggtggccagtaccgacgagagcctgcggaggtcccggcggcgcaggtccggacggtcataaattcccgtgtaggcggatccgacggcgacgtccaggactgcggggccggagccgctggccggggtgcgcgccgtccagctgctgcggaccacgttttccgccaggttggcacggcgggggctcttgagcatccggccgatatccagctgttcgccgggctgtacgcccaaggcagtggtggcatctgcatggggatcaaggtccaccaccagcgttctgatgcctgcggccagcgccgcagacgccaatcctgtggtgacggaagtcttgccgactccacccttgaggctgctgatgctgactacttgcacttgagagaccaaaacctaacgccggatgccgtgttgggggtaatgtttgctccggcagtgccgaagccggacggtcctgccgccctactcatcatatgttgatgcgtcggcgaatcctgctttattgggcgtcggcatggcaccggctgtgctgcagggcggtttccgcccgcggtggtaaaaagggttcgtgacatgacggggaaatctgtgacggtggccacaaagatttgtgtttgtccttgtaggtcctagacactgtgaccactcaccgatccacccgcaatgatgcaggagaagtatgttttccaaagttctggtggccaaccgcggcgaaatcgcgatcagggccttccgcgccggctacgagctgggcgccaagaccgttgccgtcttcccccatgaggacaggaactcgatccaccgccagaaagcggacgaggcctacctgattggcgaggagggccaccccgtccgggcgtacctggatgttgacgaagtagtgcgggtagccaaggaagccggagcggatgcaatttacccgggctacggcttcctttccgagaacccggaccttgcccgggcagccaaggctgccggcatcacttttgttgggccgcccgcagaggtcctggaactggcgggcaacaaggtggcagccctgaaggctgcccgcgacgccggcgtgccggtcttgaagtccagcgagccgtccaaggacctggacgaacttatcgccgctgccgacgaaatcggcttccccatcttcgccaaggccgtcgccggtggcggtggccgcggcatgcgccgggtggacacccgggaagccctgccggaggccctgcagtccgcaatgcgcgaagccgatgcggcgttcggcgaccccaccatgttcctggagcaggcagtcctccgcccgcgccacattgaggtgcagatcctggccgacgccgagggcaacgtcatgcacctcttcgaacgcgactgctccatccagcgccgccaccagaaggtcattgaaatcgcgccggcccccaacctggacgaaggcatccgccaggcgctttaccgggacgccgtcaagttcgccaaggcactgaactacgtcaacgccggcaccgtggagttcctggtcgacaccgtcggtgagcgtgccggacagcacgtcttcattgaaatgaacccccgcatccaggtggagcatacggtcacggaggaagtcaccgacgtcgacctggtccaggcacagatgcgcatcgcctcgggcgagacgctggcggacctgggcctctcgcaggacacggtgcacctcaagggcgctgcgctgcagagccgcatcaccacggaggaccccgcgaacggcttccgtcccgacgtcggaaaaatcaccggttaccgctccgccggcggtgcaggagtaaggctcgacggcggcaccgtttactcgggtgccgaaatcagcccgcacttcgattccatgctggtgaagctcacctgccgcggcagggactacccggccgccgtcgcccgtgcccgccgtgcgctggcagagttccgcatccgcggcgtctccaccaacatctccttcctgcaggcagtgctggacgaccccgacttcatcgcaggcaacgtcgctacctctttcatcgacgagcgcccgcagctgctcaaggcgcgcgtctctgccgaccgcggcaccaagctcctcacctggcttgccgaagtcaccgttaataagcccaacggcgaactgactgttcactccgacccggccagcaagctgccgtcggtcaaggacaagcaggctgcacccggctcccggcagaagctgcttgagctgggacccgagggttttgccaaggcgctgcgcgaacagaaccccgttgccgtcacggacaccacgttccgtgacgcacaccagtcgctgctggccacccgggtgcgtacccgcgacctggtggcggccggccccgcggtcacggcactgctgccggagctgctgtccgttgaggcctggggcggcgccacctatgacgtggcgctcaggttcctgggagaagatccctgggacaggctcgctgccctgcgccaggcccttccgaatgtgtgcctgcagatgctcctccgcggccgcaacaccgtgggctacacgccctacccggaggaggtcaccgaggccttcgtcaacgaggccgcggcaaccggcatcgatatcttccggatcttcgacgccctgaatgatgtaagccagatggctcctgccatccgggcagtccgggcaaccggaaccgctgtcgccgaagtggccctgtgctacacggcggacatgctggacccggaagaaaagctctacacgctggactactacctggagctggcgcagaagatcgtggacgccggagcccacatcctggcgatcaaggacatggcaggcctgcttcgtcccgccgctgccgcgaagctcgttgcggccctccgggaacggttcgacctgccggtgcacctgcacacccacgacaccgcgggcggccagctggccacgctcctggctgccgtggacgccggtgtggacgccgtggacgttgcctctgcttcgctggccggaaccaccagccagccgtcggcttcggcgctggttgcagcactggcccacacccctcgcgacaccgggctgagcctggccgccgtgagctccctcgagccgtactgggaagcggtccgccgggtctacgcgcccttcgaatccggcctgccgggccccaccggccgcgtgtaccagcacgaaatcccgggcgggcagctgtccaacctccgccagcaggccatggcgctgggcctgggcgaacgctttgaagccattgaggacatgtataccgccgctgaccgcatccttggccgcctggtcaaggtcacgccgtcgtcgaaggtggttggcgaccttgccctgcacctggtaggcctgaacgcggaccccgccgacttcaacgagaacccgcagaactacgacatcccggattcggtcatcgggttcctgtccggcgagcttggcgaccctccgggcgggtggccggagccgttccgcaccaaggccctgcagggccgcagcgtcaaggtccgggacgtggagctcagcgccgaggacagtgctgccttgaagtccgattccaagacccggcagcacacgctcaaccggctgctcttcgacggtcccaccaaggactacctcaagagcgtggagacctacggcaacatctccgtcctggatacgcgcgactacctctacgggctgcagcgcggcgcggagcacgagatccagctggagaagggcgtacgcctgatcgcttccctggaagcggtgtcggagccggacgagaagggcatgcgcaccgtcatgtgcacccttaacggccagtcccggcccgtcgttgtgcgggacaggtccgtggtcagcaacgtcaaggcggccgagaaggcggacccgggccagcccggccacgttgcggcgcccttcgccggtgccgtcaccctgacggtcaagcagggcgatgacgtcaaggcaggcgacaccgttgccaccatcgaggcaatgaaaatggaggcgtcaatcacgacgccggtgggcggcaaggtttcccgcctcgccgtctccgccgtcgaacaggtggaaggcggggacctcctgctggtggtcgagcagtagccggagcagctgagaaaaaacgagagggtcccccgtcaggagggccctctcgtttcgttgcggtagtggttgaggcagggtccggtcctttgcgtgctattccccccgcccccgctgaggcagcttcgcggcgagcggggggcgcggggccccttttacgcacgctgccggaccgggccctgcctcttagcggtgcctgctacgaacgcggtgcggcgtacatttcctcgatcacggtctcgaagtctttcatcacttgggcccgcttaaccttcatggagggagtcaagtgccctgatgcctcggtgaagtcggcggggacgatgcggaacgacttgatcgcttcggcctgcgagacggaggtgttggccgcagtgatcaggtcctggactgccgccttgaccaccgggttgttcgcggcgtccgcaatggaggtgtccgcggggaggttgtggcgttgcagccagccgggaagggcttcctggtccagggtgaccagcgcgccgatgaacggccggttgtctcctactaccagcacctgagagaccagcgcatccgcgcggatctggtcctccagcaaggccggaatgacgttcttgccgccggcggtgacaatgatttccttcttgcgccccgtgatccagacgaacccgtcctcgtccaggcggccgatgtcgccggtccgcagccacccgtcgtcgaacgtctcgccggtgaggtcgggccgctggtagtagccacgcatgacgcagacgcccttggcaaggatttccccgtcctcggcgatcctgaccgagttgccgggcaggggcttcccgacggagccgatcttgatcagggacggggtgttcacggatatgggggcggtggtttcggtcaggccgtatccctcgagcacctgcagcccgatgccctggaaaaagtggcccaggcgttcgcccaggggaccgccgccggagactgcgtgggccacgtgtccgcccatggccgcccgcagcttcccgtaaacaagcttgtcgaacagggcgtggcggagcttgaggcccagaccgatgcggccgtcctgccgtgccttggagtacgcgatggcagtatcggccgccttgtggaagatcgctcccttcccgccgtcctccgccttggtcagtgcggagttgtagaccttctcgaagacgcgcggcaccgcgaggatgaacgtgggctcgtagctctggaggtctgccaggaggttcttgatgtccggggtgtgggccaccgtggtgccggcagccattgcaaggaccgagataaagcgggcgaagacgtgcgccaggggcaggaacatgatggtcttcgcgttttcatggacgatttcgccaatgatggccagcgcgttgtccgacaactcgacgaagttgccatgcgtgagttcgcagcccttgggcctgcctgtggtgccggacgtgtagatgatggtggcggtatcgcgcagccctgcggccttcctgcgggcctcaaggtcgtcgtcgctgaccccgcggccggcttcgcggagggcatcgagaccgttgccctccagctgccagacatgctggagcgaggtgagtgcttccgccgtcacggcctggcggatgatgtcctcatggtgggccgcctcgccgaaggcggccacggcgccggagtcaccgaggttccacgcaacctgggagggcgaggacgtttcatagatgggaacggagacagctccggcgaaccagatggcaaagtccaccagggaccattcatagcgggtgcgggacatgatgcccacgcggtcgcccgctcccacgccgctggccatcagtcctttggcaagcgccctgacgtcagccaggaaatcagtggcggaaatgtcctgccaggctccggaggcgtcgagccgcgaaaagagtgccgggttgctggccttcgctgcctgccgcagcacaaggtcggtgatgttggtctccggtgggacaacaacaagaggcggaacactgaattcgcgcactatagctcctttgatatccgaggtcccgcgcaggggtatgcctaaagactagtacgcccatgcgggaccatgcagtaactaaagttactggtcggtaactttgccgtcaacgctgccctccgacatgtcggcggcaactctgcctgtccgcgcgctgccgtcgattatgcccacctagaatggggaactatgtacgcaccgccccccggcaagcagcccgggcccctgagcagacctgccccctggagggcgcggcccacctcgcaccgggcagggacacggcacgacggcggaggcttccgtgagcatctgcgcctgggccgcaagggcctcgccattggaatcgacatcggcggcaccaaggtggcagccggcgtcgtggatgccgacggccgcatcctcagcgaagctcgccgtgccacgcccggcagcgacccccgggccgtggagcaggtcatcgtggagctggtggaggaactgggcagggggcaccggatctggtccgtgggcatcggcgccgccgggtggatggacctcgacggcggcacggtgcttttcagcccccacctggcctggcgcaatgaaccgctgcgggcaaacctgcagcagctcctgcgccggcccgtactcctgaccaacgacgccgatgccgcggcgtgggcggaatggcgctttggcgcggggcagggggaagaccggctggtatgcattaccctgggcaccggcattggcggtgccatggtgatggacggcagggtggagcgcggacgcttcggcgtggccggcgagtttggccaccagatcatcatgccgggcgggcaccggtgcgaatgcggaaaccgcggctgctgggaacagtatgcgtccgggaacgcgttggggcgcgaagcccggatccttgcgcgcgcaaactctccggtggcgcaggacctgctcgcggctgtgggcgggcggaccgaagcaatcacgggcgcgattgtcacggagctggcacttgcgggcgacccggcgtgccgcgagctgctcgaggaagtaggggaatggctcgggctggggctcgccaacctggctgcggcgctggatccgggacttttcgtcatcggcggcggcctgtgctcagcaggggacctgctggtggagcctgcccggaaggccttcgcccgcaacctgacggggcggggtttccggccggccgccggtatccagctggctgcgctcggtccgaatgcgggactcatcggagccgccgacctgtcccgcgtcagcagccgggcgcgccgctgacggcacgcgctctcctccggcgctgaccagggggagcgcagccgggggagagccggccgcgctagacgcgtgcgccgtcgtcgttctcgtctttttcctgcggaagcttcatgatcaggtagacggttcccaggacgaacgcagccacaatagccacgatggccaggagcggggcggaccgccagaacatcacggacagcaggagcgccaccggtccgcccacggcggcaagccaggcaagcatggtcaacggatctgttccggccaggctgggcggttcctccgggacgaatgcaccgtcatccgggtccacatcgtagtcgcgggggccggaagggaagcctgcctcgacgccggcacccggactttccgctgaggcctgccgttccgccgcggacaattccgcggggactgtgcccgcaaggcccagcgggtcgaagtcgcggaacgcgggcggccttccgcccggtgctgcagcatcctggcgcggcgccgcatccggagcgggatcggcggaagttcccgtgccggcggcgctgcccgtgcctgcatcgggggagccggattcaaggcgggccacgaggtccagccagacggcgtcgtccgggttcgcgccctggtcctgggatccggggtcaggcctgttcatggggcgtggcctccaggttcgatgctgcacttgccgtcggccgttccggatttccgccggaaaccaccgcccggatgaactccacggagccctggaagatctggtcggcgtcgttgtccagggtggccacgtggtagctgttttcaagactgaccagatccaggggtgcgtgggtcagtccccggcggagggcctggatgctggagtcggataccacgtggtcaacggtggaccggtagacccggacgggagcggtgaccctgggcaggatcctgatggtgtccttgaacagcttgttgagttcatgtgcggcagctaccggggttcgcgaataggcgccttcgtccatgccctctttaaggatgtcgtttccaatcgccggcgtacttttcatgaccagcttcaggatgccggcgaggggcgcgcgcggatcgtcaatgaccagccctgggttgacaaggaccaccccggccacaggccgggtggcagcgatcctcagggcaagcgctccacccatgctcaatcctgccgaaaagacgtaatcgcagctggcgtccagctccaggtacgcgtcgtccagggcgccgtgccactgctgccacctcgtgcgggcgagttcctgccagctggtgccatgtccggggagcagcggcatgcgcacggcgaagccggcgccggccagggcctgggcccaggcacgcagcccgtgcgggctgccggtaaacccgtgcgagaggaccacaccgatgcggggcccctcgccggtgcagctgctgctaaaggggctgtggtccaggctggaggtcatggagtctccaatgcggtgttctggcgggcgagggtgtggaagaaagcactggatttcgcaaagatctccggcgcgtccacgtccagcgtagccacatgtccgctgctgtggaggtccaccacctcagcgaggtggctgccgaggccttttaggagcagcgcaagggacgtcggcggtaccacggcatcggtgcgggacttgaagacctggaccggcaccgtgacttggggcaggccgcgggccgctgcgccaaagagcttcttcagctcgtgcaccgccgccaggggagtacgcgaatagtccccgtcattggtgactgccgccgtcgcctgttcctcctctatggggagggttgtccgctggaagtacttcagcactccgatcacccggacccgccggtcgtagaagctcaggcccgggttgaccacggacaccccggcaacggtgtgccgggaggccgtcagcagcgcaatggctccgcccatggagagcccggccacaaagcatgtttcggtgttgcgcgcgagatccaggtaggccgcctcgaagctgcggtaccagtcggtccaccgcgtcctggccaggtggcgccagtcagtcccatggcccggcaacagggggacggtcacggcgtaaccctgggaggcgaggtgctcggcccacggcaggacactgagggggcttcccgtaaagccatggcagatggcgatgccgatccgcgcattgggcccgtgtccgggatagctgaaagcggcaggaggggacgggatgctgctttcgctcatgcctccatcgtgtcactgttccggacaaatctcactagagtagggttgcattgaactgctggccaggcccgacgcggggcctgcacgccgccttccggagaggtttctcacgtgttctattgggtcatgaagcggatcttcctcggtcctgtgttgaagctccttttccgcccctgggtcaagggactggacaatattccggctgaaggcccggcgattattgcctccaaccacctctccttttctgattcgatctttatgccgttgatggtccgcaggccggtggttttcctggccaaatcggagtacttcaccggcaccggtatcaagggcaggctgactgccctgtttttccgcctgaccaaccagttgcccatggaccggtccggcggagctgcctcggcagcgtcactgactgccggcatggaggtcctcacacatggcggactgctgggcatttatcctgagggcacgcggagcccggattccaggctctacaggggcaaggttggcgtcgccaggcttgcgctgcaggccggggtccccgtgatacctgtcgccatgatcggtacggacaaggtccagcccattggaaagcggctgccgaatatccgcaggatcggcatgatcttcggcgagccgctggacttcagccactaccgggaccaggccgaggaccgggacgtccagaggaaagtcaccgatcagatcatgttcgaactgatgcggctctccgggcaggagtacgtggacgagtacgccgcagtggtaaagctgcggctggccggcaaggccgtcgaacctgcggctcaagccgagcccctggcatcgcccgctcctgattccggcagtgccggggagccttcgcccggcgacggcccgggcggctcttctgatgacacacgaaaagcggacgacggcggtgctgccgccgcaggctgagcgggttatgacgcggcggtcccgaagcgtgacagtgcggtgtcccggggacctgcgcgaccgctagtcttagatggtgactgagctatctgcaaaacccgccttttcgctgtccagcaccgcccagagcggagcagccgattaccccggacttgataactggcgggacctccccgtttcccagcagcccagctggcaggaccgggacgtgttcgatgcctcggtgaaggaactctccgtccttcccccgctggtttttgcgggtgaagtggatgtcctccgcgaacggctggccgctgctgcccagggcaaggcattcctgctgcagggcggtgactgcgccgaaacctttgaggccgccacggcagacaagatcagcgcccgggtcaagaccatcctccagatggccgtggtgctcacgtacggtgccgccatgcccgtcatcaagatgggccgcatggccggacagttcgccaagccccgttcgtccaatgacgaaacccgcggcggcgttaccctgcccgcctaccggggcgacatcgtgaacggttacgagttcactccagagtcccggggccacgatgcctcccggatgctccgcgcctaccacacgtccgcttccacgctgaacctgatccgtgccttcacgcagggcgggtttgcggaccttcgttcggtgcaccagtggaacaagggcttcaccgagaacccggcacacgcacgctacgagtccctggcccgcgacatcgaccgcgccatcaagttcatggcctcctgcggggccgacttcgaggccctgaagcgggtcgaattctttgccagccacgaagcactgctgctggattacgagcgggcgctgacccggatcgattcacgcacgggattcccgtacgacacctccgcccacttcctctggatcggcgagcggacccgcgaactggaccacgcgcacgttgacttcctctcacgggtgcggaacccgatcggcgtgaagctgggcccgtcaaccaccggggatgacgcccttcgcctgatcgacaagctggatccggagcgcgagcccggccgcctgacgttcatcacccgcatgggggccggcaacatccgcgagaagctgcccgccgtcgtggaaaaagtcaccgcgtccggcgcgcaggtgctgtgggtcacggaccccatgcacgggaacactgttacgtcccccaacggctacaaaacccgcaatttcgacgacgtcattgacgaagtgcgcggcttcttcgaggtgcaccacgcgctggggaccgttcccggcggcctgcacgtggaaatgaccggcgatgacgtcgcagagtgcctcggcggcgccgatcccgtggaccaggacgcgttcctggaccgttacgagtcggtctgcgacccgcggctgaaccacatgcagtccctcgaaatggccttccttgtggccggagccctggcaaagcactaggcgccgcacacttgttacctggcagtggtgtggccggcaggtccggctacaccaccgtcagggtaatgaccgatccctccggaacctccttgttaaccggatcctgatccctgacggttccgaagaaaccgccgaggatattgttcaccttcacgtcgaaaccgagctggcgcaatgcctgttcggcttctttggcctgcttgccaatgtaactggggacttccaccatccggggtcccttggaaacggtcagggtcacagtgccgccgcgggtgagtgttccctccgccggtgcctggctgaccacagcgcctttggggatgtcgcggctggagacttcctcgtcggccacatccgcctggagtccggctgccgtgatggcatcaacagcatcgtcttcgtcctggcccaccactaccggcacggggataggctcgggtcccttggaaaccaccaggctgacgggcgtaccgcggcggacatccgtgcccgcagcggggtcctgcgacaggactgtgcccgcgggcgcctgctcattgaactgttccgtcacggggcccagtgccatgtccgcagcgttgaggccgttcttggcttcctccagggtgccgccggccaggacgggcagcggaaatagctgggggcccttggaaacaaagagggacaccggctggaacttgcggatttccgcgccctcggcgggctcgctgcccaccaccaggccggaaggcacgtcgtcgtcgaacacgtccctggttgtggaccggaagccggcgtcgctgagcagctgctgcgcctgtgccacggtcttgttggcgacggaagggatggaggcggctgcgcccggacccattccgaaaaaccagcccgcgcctgtcgccaggagggcggcaatcaccaggattatcacccacaggacgccgcggcgccggggatttccttcccgaagcgtccgtgcgggggtggctgcggcacgggcccgtgccttctcatcctccttgtcagctttgcgctgggcgcgtttgcccagcaccggaggagggggagcccatgcctggtcgtcgtcaggtggtgaaagggtgcgcccggaatgaccggcttccggacctgaaggctgtatggcggaccgggaccggcccggcggggacggataggctggcccagccggctgcccgtaaggcatcaccgttgtgggattgttggtgcggccgatgacctcggtgggatgctggacgtgcccggtgtcattaagtccggcgccataaagcccggtgtcgttggatccggcaggttcacgggatggcggaggacccgggggcggggaaggaatccggagcggggcaagctgttggggtgcggtcacagtgccgccggcggcagccgcgggcggacgcaggtccagttcagcatctgtgaggttggtccggatgtgccgcagttcctggagcagggcgttcccgtctaccggccggttctcggggtcgttggctgtgcaccactgcacgagctcgtccacctcggcggccaaacccgggatcagggccgagggcggcccgactgtcccgttgacgtgctggtacgccacctggatggggacctcgccgtcgaacggctgccgtcccgtaagcatttcgtacagcatgatgcccagggagtagatgtcgctgcgcgcgtcagccggcctgcccaggacaagttcaggggagaggtaggcgaccgttccgatcagggcgccggtgctggtggcggtggtaacggcacgggccaggccgaaatccccgatcttgatccgtccatcgtccgagatcagcacattttcaggcttgacgtcacggtggatgaaaccggcggcatgcgcggcaccgagcccctcaacaaccgggtcgatcaatgccagtgccaggcggggcggcagtgcgcccttctcgttaattaggtcacgcagggtgtggcctttgatgtattccatgaccaggtaggccgtgcggccgtcgttcccctggtcgaggactcccaccacatggggatgggacaacctggcagccgccttcgcctcccggccgagcctgcccaggaagttgtcgtcagcggagaggtgtgggtgcagcaccttcagcgccacgtcccgctccagccgctggtccgtggcaaggtaaaccgtggacatgccgccccgcgcgagcttggaccgcacggcgtaccggttgtccaccagcgttcctacaagagggtctgactcgtgttcctgcaccctacgatcctaatgcccgcaacggaacgggcccgaacccttaccggtccggacccgttcaaaatttactgtccccacggtgtgcgggcggcggcagcagctcagccgaagcttttctggtgtgccttgatggccgccacataggccttggtgtcgtcgtacatgccgtacttgctcacagagtactggccctggtagtagccggcgatggccgtgtccttgtccttgctggtggccaggagttggcggatgattgccaccccggcggtggcgttgtcataagggtccagcaggttcagcttgcgtcccaccaggtccgaagcccactggccggaggtggggatgacctgcatggttccgatggcgttggccggggaaacagcccgctggtcgaacccggattcctggtgcgcgaaggccagggcaagggagggttccacgcccatcctgcgcgcggcatctgccacgatgttccgcatttcagcgcgggagggcacgggggaggcgttcagcagcgccttgttctcgttggcggagctgaccactgcagcagggtagttgaatcccaggaatgagcttgggaccagaggcgttaccgaggcggccggctgcggagcggcaggctggccgttggccccggggatggccagcttgttacccgggtagatgacactggtcatgcccaggcggttcgcggagagcagctcggagagtttgacgccatgccgggacgcgatcgcggagagcgtgtctccggctttgacggtgtaggagccggaggccggggccacaggtgcagcgggagccgatgtggacgccagcccgcccgcgacaggagccgcggcgggcccgggagccgcatcaccggcacccaccttgatcttctgccccgggtagataacggagcgcatgttgaggttgttccacgagaacacatcggccagacccacattgtgccgggcagcgatggcacccagcgtgtcaccgggcttcaccgtgtacgtggccccgcctgccggtgcggctgcaggaccggccggagcgggcgcggcggagggcgctgccggtgcagcggccgaacctgagagcttgatcttctggccggggtagatgatcgtgttcgcctgcaggttgttcagcttcaggacctcagccgtgttgagcccgaattttcctgcaatggcactgatggtgtcgccgcgggcaatcgtgtactccgccggcggctgcggctgtgccggcttgaaggcagaggggatcgccgtcgacaccgacgctgcagggataactgccgcagtggccgccgtggcctgggctttcatggccgctgcaagcgtccccggaatggcgcggaccggctgctcggcagcggctggctgggccagggccaaggatgacaatacgaccgctggcagcgctgccgtcgttgcggcgagcataggcaggctcggcttggggggctgcttgtgcgagcgggacatcgtcatggaaagaatcctcttctcaactgcgggcgcgggcggggatgccgctaattccgatactactgttactgctgttaatactgttacaaatgtggtcaatgagaatctctcacggattgtggattagcacaagaattccgggaacagctgcaaggaagaattttgggagtgtccgcaggtcaatgggtttcgccgaaggcaccaactaggcggcaaggtgcacgccgtggcaaccttgatccgtgagtaatgtagaaaaccttgtgggcgaatggttgcccttgcccgacgtcgcccgtttactggatgtttccatcacaaaggtgcacagcctgcttgatgaacgtgccctggcggcgctgcgggttggtgaacggagaatcaggtcggtgcctgcagcttttattcaggacggccaggtggtggacagccttaagggaaccatcgttgtcctgtctgacgcggggtattcggacgaggacctgatcgtatggctctttaccgcggatgagtcactgcgcgggcggcccatcgatgccctgcgtgaaggccggaaaacagaaatacggcgcagggcccagaccctcgcctggtagttcctggcccggcacttcgcctagcctgcttttaaacccctaggaggcccggctgaccgtcgcttcagccagccgccgaagggcagttttgggcaactcgaccagggggagtgcctccagggcttcgaaggcggcagcgccgaattcgctgatgaggacctcggtggccgccagcgccccggactcttcaataatccgccgaagttcgctgacgtcttcctccgagaggtccgggctcccaagcctggcgtcgataaaggccgcctcttcggccgttgcctggtccatggccagggcaaccagcacagtgcgtttcccttcccgcaggtcgtcaccggctggcttgccggttgtcagcggatcgccaaagacgccgagcacgtcgtcacggagctggaacgcttcccccaggggcagcgcaaacgccgagtagccccggagcagttcatccgaggctcccgcgagggctcctcccagcgccagcggatgttcggtggagtacttggcggacttgaagcggatgatggactgggcccgcgagacggcgcctgcgcggtccctggcgggcccggcaacttcttccaggatgtccaggtactggcctgccatcacttcggcccgcatgaggttaaagatcagcctcgctctgctgcctgctgctgcccgctcgccaatgtccgtgaaggcttcctcgctgaaggagaggcagaggtctcccgccagaatggcagctgcctgcccaaagcgttcgctgtccagcgcccagccctgtgagccgtgcagctccctgaaccgtcggtggacgcttggtccaccacgccttgtgtcagaccggtcgatgatgtcgtcatggatcagcgcagcggcctggaacagctcaagggctgcccctgccgtcactacctgctgggctgcagtttctccaccggcaccccgccagccccagtagcacatcagcgcgcgcaggcgcttgccgccggtgaccaaattggaaattgaacccatgatcggatcaatgtccggcgaaatggcggacatgactgattgccgcgaggccaggaacccggtcagttcgccggccaccgccgccacgaagtccgcctgttcgtgcctgagctgctcggccgccgtcacttggcggactcagctggcacgttggcgccgatggtgaaggtggaaactccagcagcttcaactaccgagatattgacggtctcgctgtccccgcggagaaagtccctggaagctactgcccctacggcttcgccgggtacggccttgaagccctggccttcaagcgccttgacgtagaaatcgaggactgcggcggtgggggccgccacggtacctaccagtgcggcagtagcggggaccgacgctttatcaaaactgctcgataccactgtggcccccggcataaggggaaggagctgctggggaaagccgtccaccagcgcgccgacggtggcggaggtgttgggcgaagcggaagggctgggggaagccgtgacggtggacgcggcagttgccggcgtcgatgcggaggcggaagggtccgggcttgctgacggagttggactgcaggctgcaagtgccatggctgcgccggcagctagaactgccgcgcctgctggcttgatgtttccaaagaccgtcacagggactttcctcctggtgttgatgccggattcagccttcagtttagtcagtacaaaacggctaggattgcagccgtggggcccgaacgtaagaaccagccacccggagcggtgcttccgggacgtcggcgcaagtgcatcatgcacgtggacatggatgccttttacgtctccgtcgagctgcggacgcgccctgatctccgtggcaagcctgtcattgttggctttcccgcggaccgttccgtggtcctctctgcctcctacgaagcccgtgcgttcggtgtgaaatcggccatgccgatggccgtggcgtcccggatgtgcccgcaggcggtcatcatcgaaccgcgccacaagctgtactacgaggtgtccgcccagctgatggacatttttgggtcagtcaccgaactcgtggaaccgctcagcgtcgatgaagcgttcctcgacgtcacaggcgccatacgccgcctgggggcaccgcggggcatcggggagatgattcggcgccaggtagcgtcggagctgggcatcactgcgtccgtagggatagcggaatcaaagttcgtggcgaagatcgcgtcaacccgctgcaagccggacggactgctcctgattggtcccgacgaaacggtgccttacctccacagcttgccggttggtgcgctgtggggcgtaggcgccaagaccgcggatgtcctggcaaagatgggcatcaggacggttgcggacgtggcagcaacgcctgtgtccaccctcaaaaggatgctgggtgctgcgggtgagcatgtccaccagctgtcgtggggcattgaccaccgtgcggtgactccggtccggctggagaagagcatcggtgccgaagagacctttgccgtcgacacgggcgacgacgctctgctccaccgtgaactcctgcggctctcccaccggacggctacgcgcctgcggagttccgggatggtggccaggaccattgccctgaagttgcggttcgccgatttctccaccatcacccgcagccggacggtccagacgccggtggacagtgcccagctgatttattcagtagcgctccagctgctggaatcggtgggggacaggaccatgacggtgcggctcgtgggcgtacgggccgaacagttggaggaagccgcccgcacctcgctgcagctgagcatcgaccggagggacgagaactggcgcgcggccgaacaggccctcgacgaggttgcgcgcaaattcggcagtaaatccgtccttccggcccgcctgatggagccaggaaccggccctgaataatggcccggttgcagcaaccggggttcccggataagtcattgccgtctttcagaacagccctcaacaaactatccttagatatacatagtttttgagtgactggacttactgccggaccctcttggacatgctcccgctcctgcgacggcgcgcctggttaccgactttttgccaatgtgggcagggcgggaacctcttaggcacaacagccgttaacggtgcagaagtagtggctgggatcagcccggacgttggcctacaaaaggaggtcgtgatgccgctgtcggagcacgaacagaagctgcttgagcagctggagaagcagcttcacgaggacgacccgaagttcgcaaattccatggggtcagacccagggcgttcatggtccacgaggcacgtggtgattggcgtcctctgcgccttggctggtgtcttcctgttgctcgtgggcgttactctccaaaatatctttgtcggagtactgggcttcatcgtgatgggcggcggcgtctacttcgccaccatgcgcagcagtgcagccgcgaagccgggatccaagaccggcagccgaaagccgggcaagcagaagaactccttcatgagcagcctcgaggagcgctgggacgaaaggcgccggggagaaccctgaacatccgggggctgcccacgacggcatctccacttccctccccataagggggtaaacgcgaaaagacccgcctttggcgggtcttttcgcgcttaagcccgccttcgtcctgacgtccctcctttgccggagcctggccggaagtgccaccgcgttcagtcctttggccgtgccctctttcaggagccgcgaaccacccggggctgaaattcctccactttccaccaccgcggctaaatccgcgcccattcagcgttcttctcccacaaagtggaggccgcgacaccctgtttgcgttgactgtgggggaaagtggagtaatgtggaggacataagagggtagttgcaacataggggatgtgcagttcctgacatcggacaggcggtgggccaatgtttcttggcactcactcgccgcgtctggatgaaaagggacggattatcctccccgccaagttccgtgaggaacttgccagcgggctggtgctcacaaggggccaggaacgttgtatctacgtcttcagcgagaacgaatttgcgcgggtccacgagcaaatgcgggaggcaccaatctcctcgaaacaggcgcgggactacatccgtgtctttctctctggagcctcggacgaggtacctgacaagcaggggcgcgtaaccattccaccggcgctccgggagtatgcaggcctcggcagggagcttgccgtcatcggcgccggttcccgggccgagatctgggacgcccaggcctggaccgaatacctcgcagagaaggagacggccttctctgaaactgatgaccccatcccgggcattctctgaccggggggacagcaggcagtttcttggatgagatctccagccgcccatcggctggccatcctggctcacttccccggagccaggctggcggacgataggcgcggatggggatctggttccagaagcaccaaaggcaacacccgacggcgagaaaggacgaggcatgaacgaacacccgaagcccacgtccgaacgccatgtgccggtccttcgggaccggtgcatcaatttgttggcacctggattcgaggccgccaggctgcgcggggaaaccccggtagccgttgacgcgaccctgggcatgggcggccactccgaggccatgctgcagcgttttcccgacctgcacctcatcggcatcgaccgggatgaagaagccctggccctcgccggcgagcggctggccccgttcgccgcccgcaccgacctggtgcatgccgtctatgacgagatccaggacgtcctggccgaccttggcgttcccgaggtccacgggatcctgatggacctcggtgtctcctccctccagcttgatgaacgcgaacgcggcttcgcctactccttcgacgccccgctggacatgcggatggacacaagccgcggccagacggcggcagacgttgtgaacaactactccgaagaggaactggtcaggattatccgcaagtggggcgaggaaaagttcgcaggccggatcgcaaacaggattgttgcctcgagggccaccaagcccttcgcaacaaccggggaacttgtggaacagatccgctcggtagtgccggcgtccgcagcgaaatccggcggacaccctgccaagcggaccttccaggctctccggatcgaggtcaacgaagaactcgacgtcctggagcgtgccgttccggccgcagtcgactccctggccatgggcgggcggattgttgtcatgtcttaccactccctggaggacaaaatcgtcaagggcgtcctgcaagcacgttccaaatcctcggctccgcttggattcccggtggagctggaagagcataaggccgaactgaaaaccctgaccaaaggcaccgaggtgcccaccgccgtcgaaatcgccgaaaacccgcgtgctgcctctgcaagactgcgcgcggcggaacgaatcagagccaggagagctgcatgagcaccgctgccgtcaaggactttcccgtcgtttcaggcagctcggcggccggcaggaattttcccgtccccggcgacggacggaaggcccgcactccgctgtccgtggtgcgcaccgtaccgcggaagcgccgggcaccgttcgtcgtgctgtgcttcgccatgcttgccctggcgctgattgccgtgctggtgctgaacatctcggtatccaccgcccagtaccagctggtggagcttcgggccaagcagagtaccctgaccaagcagaaccaggacctcacccagcaggtacagaacttcgaagcaccccagaacctggccgcgaaagccacggaacttggaatggttgcctccaccgtcaagggccagatcgatttgtccactctttccgtcaccggcaaggcgacgcccgcggttaagggcggtgctgcgggagcggttatccccgcgcccgccgtgcccgggcagctgatcgtggtcccgccggcaagcaagggagaaccgctggaaagccgcaagccggctgaagcggctgctcccgcagcccagggtggtgaagccgcggatgctgcggcgtccggcgcggcaaccccgggtgctgcggccccggcagccggtgatcccgctgccgccgcggctgccgctgcagcggccgccgttgagctccacggaggatccgtccccgcgccggaacagaaggtgcccggacagtaatacggcaggtctggcaggcatcaaggtcaaacagcaaggaaaatcacggtggtgcagaggaccggcaaggcaaataacagcagggtgcccaacgccaccaagcgcttgcgcctgggccttggcatcatgctgacgctcctgctggtggtgggcggaaagctcttcctggtccaggggctcgacgtgggaggtatggccgaggccgccctgaacagccggatgaagcagacagtcctcccggcggaacgaggcagcatcctggactcccgcggtactgtgctcgccaacagcgtgatccgctacaacgtggtggtggaccagcgggtcaacaccaaaacagagacattcaagcgcctggacgacgccaaagagaaactagtggacgtcagccgggagcaggggctgacggaactggcagccgccctcggcatggaaaaggacgcgatccgcgaggccgtcaccgggcagcagccctactacattgtggccaaggacgtgaagccggacgttgaggaccgcatttcgcagctccagattcccggcattgtgaccgagggcgtcagcaagcgtgtctacccgaacggatccgttgctggcggcatcatcggtttcctccaggacggcaccaccggccaggcggggatcgagcagacccaggatggactcctgaaaggtgctgacggcaagaggctcttcgagatcggtgcagacggcctgcgcatccctgtcggcgtggatgaactgactccgcccgaggacggcaaggacgtcaagctcaccatcaactcggaccttcagtacttcgcacagcaggccatccaaagccagacggagaaactgaacgctgaatggggctccatcattgtgatggacgccaagaccggagatttggtggccatggcggacaccaacgcgccggacccgaacgaccccggcagggtggccgcgaaggaccgtggtgtccgttccgtcaccgcggcctacgagcccggttcggtgcagaagatgatgaccgtggctgccctgattgaagagggcaaggcaagcccgctcgatgaattcacactggacccgacctacacggtgaacggccagaccttcagcgactcttttgcgcacggcacggaagagcggacgctcgccggcatcctgggctactcgatgaacaccggaaccgtcatgtccgggcagcggctgagcaaggaacagcgctatgactggctgaagaagttcggcatcggcgaagctccggacattggcctgcctgccacggcctccgggatacttacgccctggcagcagtgggacggccggcaggaattcacagtcctgttcggccagggcgtctcccagtccaccctgcagaccgtgcgggcattccagtccatcgccaataacggcgtgatgctgcagccgcgcctcatcgactcgtatgtttccgcagatggaaccgaggaaaaggttgcgcctgcggagccacgccagatcgtgtcggagggcaccgcccagcaggtgcaggacatcctggagagcgcggttaccgagggccagatcaaggacgccggaatcgacggctaccgggtgggggcaaaaacgggtacgtccgagtccccgtgcgacgacggcaagtcaggtttctgcggctacaccgcctcgatcgtgggcatggcccccatggatgatccgcggtttattgttgaggtggtacttcagcggcccaagggcagcatctacgggattaccaacgggccggtcttccggtcggtcatgagccaggcactgcggacctacaacgtccagccgtccacgggtgaaccggccaggctgccccagttcgccaagtaatatcccggcagcagccgcagcagccccggctgtttcggctgatccacgccgggcacggtccactagcaccatcggagatcccttgtcagagttcaacgcgtccgatcagcgcccagccccgcaggaagcggctccacaggaagcggcccggcaggcaacggccccgcagggaccgggcagccaggcacgcttccgcccctcggctgtggaggcggtccggctggaaagcattggtgaggcagtcggcgtcgttattccgggagcctcggcggatgtggcggtgaccggcatctcgctgaactcccgcacggtggagccgggcgacctgtacgtggccctgcccggcgccgtccggcacggcgcagacttcgccgcccaggccattgaagcgggagccggggctgtcttgacggacgacgccggtgcgcgcctcatggccctgtcctccgacacggcggtacctgtgctggtggttgatgccccgcggaacgtggtgggtccgctctccgccatgatctaccgcagcgggcaggacaccgccccgcagttgttcggtgtgacgggcaccaacggcaagaccaccaccacgtacttcatcacttcgctgttgcgctcccttggcaaaaggaccgggctgatcgggactatagagatcctggccggcggggagcccattcccagcctcctcaccacaccggagtccccggaggtccacgggctcctggcgctgatgcgtgaaaaggaactcgacgccgccgccatggaggtctcctcccacgccatctcttaccagcgggtggacggagtgctgttcgacgtcgccggcttcaccaacctcacccaggaccacctggacctgcaccacaccatggaggactatttcgccacgaaggcggagcttttcacgcctgcccgtgcacggaaggccgtggtaacggtcgacgacgagtggggccgccgccttgccggcagcgccgggattccgatcaccaccctcagcacctccagggcgaaccccgccgactggaccgtcacggaaaccgtgccccgcgggctgggcacggagttcaagctcagcgggcccggcggtaccgtcctgacggtccacacggggcttcccgggagcttcaacgttgccaacgcagccctggcggcagtaatggtgctcgccggcggcgtggacgcagcaacgctccaggctgcgctcgacgccggcgacccgtttaccgtggccgtgccgggacggatgcagctggtctccgaacagcccgccgccgtcgtggatttcgcccacaacaccgacgcgctggcccgggcgctggaagctgtccggtcaccggaaccggactcccgattgatcgttgtgttcggtgctacaggccagcgtgaccagggcaaacggccggccatgggcgccatcgccgcccggatggcggacaccgtgatcatcaccgacgacgacccccacgacgaggacgcggccgccatccgcgccgatgtccttgccggggcccgggaggcccaggagagggaaaagctgccctgtagcgtgctggaggttttcccccgcggcacagccattcagcgcgccgtggaactcgcccggctgcacgacaccatcctggttgccggccgcggccacgaggtgtggcaggaagtgaagggtgtgaaccttgcgctcgacgacagggtggagctgcgcagcgccttgacagccaggggattcaacgttctccaagacgaccggatagagtcctagaccgagatgattgcatttactgcggcggagatcgccgatatcaccaaagggcgcctggacgccgatcctggaatcacgcctctgtcggtggtcacggattcccgcgaagccgcacaggggtcgctctacgtagcgaaacccggcgagtacgccgacggccacgacttcatagcggacgccttcgcagccggtgccacccttgcgctcgtggaacgccccatagccggccctgacggtgccccgtacccgtccatcgttgttcctgatgccgtgctcgccatgggcgcactcgccgcggaggccgtccgcaggatccgcgccgcacgtgctgcggcaaacggcgaactgacagtcatcggcatcaccggctcggcagggaagaccaccaccaaggacctgctcgcaggcatcttctccctgcacggcaacaccgtggcgccgcggggctcctacaacggcgagatcggagtgcccctcacggtcttcaccgccggaacggatacccggtacctggtcatcgagatgggcgcaacaggcgttggccacatcagttacctcgcagacatggttaagccggacatcggcgtggtccttggagtaggaactgcacacgccggcgaattcgggggagtggacaacatcgccctggccaagggcgaactggtggaagcccttgcagcctcaggaaccgccgtcatcaacctcgacgacgaccgggtggcggccatgcgcgcacgtacctcagcgtccgtcgtcggattctccgccgaagggcggcccgacgccgccgtgcaggcactcaatgcggacaccaacactgacggcaacccggaattcgacctcctcctccccggagaagacacgccgcaccacgtcagaagccgtctcatcggcgcccaccacaccggcaacctgctggcagcggcagcagccgcccgggccgcaggaatctccggcgcagacatttccgccgccctcagcagccaggcggctgccagccggtggcgcatggagcgcaccgagagggcggacggcgtgaccatcatcaacgacgcctacaacgccaaccccgaatccatgcgcgccgcgttgcgcacgctcgccgaccttgggcagggcaggcgcacctgggcagtcctgggcgccatgctggagctcggcgaggattccatccgcgagcacacagccgtgggcacccaggtggtgcggctcaatatttcccggctggtggtggtgggcagggaagcccgcgcgctctacgtatccgcagtccaggagggctcctggggggacgaatgcgtcttcgccgagaccgccgacgaagcctatgaactgctcaacgccgaactcgaacccggcgatttggtgctcttcaaatcgtccaacagcgttggacttcgccatttgggcgatcggatagcattaccccgacaaaccccgcaacccgccgatgaaaggagcactctgctgtgattgcacttttgatcggcgccggaatggccctgttgttcgcgctggtgggcacaccgctcttcatccggctcctggtgcgccgcggctacggacagttcatccgcgacgacgggcccacctcccaccacacgaaacgcggcacgcccaccatgggcgggaccgtggtggttgccgccgtcctcttgagctacggcctgacccatctcatcatgctgatggtgaacccggcttccccgggcccctcagcgtccgccctcatcctgctgttcctgatggtcggcatgggacttgtggggttcctggacgacttcatcaagatttcgcggcagcgcagccttgggctcgatgccaaggccaagctgattctgcaggccgccgtcggcatcatcttcgccatcctcgccctgaacttccccgacgaggacggcctcacgccggcctccaccaagatttccctggtgcgcgacctgccatggctggacctggctttcggcgggacggtgctgggggccatcctcttcgtcatctggtccaacctgatcgttaccgctgcaaccaacggcgtgaacctcaccgacggccttgatgggcttgcggccggggcctcggtcatggtgttcggcgcctacacgctcatgggaatctggcagagcaaccaggcctgtggttccccccgcgaggcgggcagcggctgctacctggtgcgggaccccctggacctcgccctgctggcagccatcatgagcgcggccctggtgggcttcctctggtggaacacctcgccggccaagatcttcatgggcgacaccggctcgctggccatcggcggtgccatcgcgggcttcgccatcctttccaggaccgaactgctgctgggcatcatcggcgggctgttcgtcctgatcacgctgtccgtcatcatccaggtgggctacttcaaagccactgggggcaaacgcgtcttcaagatggcgcctttgcagcaccactttgaactccaaggttgggccgaagtgactgtggtggtccgcttctggatcctcggtggactcttcgtcgccgtgggcctgggaatcttctacgctgaatgggtcgtgctgctgtgaccgtttccccacgcctccagaacctcgtgagctgggactccgactggtccggactgcgggtggtcgtcaccggcattggggtctcagggttcgccgctgcggatacgctgatcgaactcggcgcccgggtggtggttgtggacgccgccattagcgacacggcgaaagcccacgccgacaccctgaaaatcgtcggcgctgcggacgtcctgctgggcgaggacgccgtcacccgcattcccaggatcgacggcgagctgcctgagctgattgtcacgtcgccggggtggcgtcccgaccaggccctgcttgccgcggcagcacgggcccacattccggtgtggggagatgtcgaactggcctggcgcgtgcgcgtgcgggaaggccgcaagaccgcggactggcttgccatcaccggaaccaatggaaagaccaccacggtggggctcaccgaatcaatgctgcgggcggccgggctgaaagccatcgcggtaggaaacgtgggtacgcccatcctggacgcgctccgggatccggtggaatacgacgtcctggccgtggagctttccagcttccagctgcactggtccgaatccctctcgccggtagccagcgtctgcctgaacgtcgccgaggaccacgttgactggcacggatcctacgattcgtaccttgcggacaaggccaaggtctatgaacgcacccagaaggcctgcctctacaacgcggagcagatcgaaacagagcggatggtggaaaacgccgacgtggtggaaggatgccgcgcggtcggattcaccaccgtcagccctgccgtcagcatgctcggagtggtggaagggctcctggtggaccgggcgttcatcgaagagcgccgggacagtgcagcagagctggcctcgatggccgaccttggcgcgctggcgccccggcacacggtggccaacgccctggcagcagcaggactggtgcgcgcctatggcatcgagcccaaggcggtccggcagggtatccaggactacgtgccgggggaccaccgcatccagccggttgcccgccacaacggcgtcctgtggatcaacgactccaaagccaccaacccgcacgcggcatcggcctccctggccgccttcagcaacgtcatctggatcgccggaggcctctccaagggcgtgacctatgacgacctggtgcgggaacacgccccccggctcaaggccgtggtactcatcggagctgattcctcagcactggcggacgccctccggcgacacgcgcccgatgtccccgtgatcgggacggccccgggtgaaactgaactggtgcagactgctgcaacagacggcactgaggccggttctcccgccgccgggaaaaccgtcatgtcccgtgcagttgcgtcagcagcccagctggccgcatccggcgatactgtgctgatggctccggcagctgcttccatggatcagttctcttcctacgctcaccgtggtgacactttcatcgaagctgtccgcgagctggtggaagggcaggcccagaccggcgaggagtaacaatggtcagcacgcccacacgcccgcccgcccggaagcaggcaggcaagccgcgtcccggctcctccgcatcaccggtccggcccccggccgctgccggcacccggctgcgcgccgcctaccgcaaattctggtcggcgcttgaggggaccggaacgtccaggaacggctccacctactacctcatcctgggatccaccctcgcgctgacggccatcggcatcatgatggttctctcggcctcgagcgtggagtcgatcgccgccggcaaatcgccgtacggggatgccctgaaacagggcatgttcgccgcaatcggcatcttcaccatgttcgtgctgtcccgcatcaacgtggtgtggctcaagcggcttgcctggcctgccatcatcgccgccgtcgtcctccttggcctggtccagctggtcggcgcggaagtcaacggaaacaaaaactggatcgaccttggcggcatcaccttccagccgtccgaagcgtccaagctcgccctcgcgctttggatggccaccgtcctggcccggaagggaaagctgctcagccggtggcagcacgtcgcggtcccggccgtcccgatggccatcatcatcgttggcctggtcctggtgggaaacgacctcggaaccgccatgatcatcatgatgatcacggctgccgcactcttcttcgccggggcaccgctctatctcttcggcattgccggcctggccgcagccgccgggacggctgtcatggccgtcaccagctccaaccgcatgtgccgcatcacctcatggtggaccgggcagtcctgtgccgacggcatcgacgccaactaccaggccacgaacggcctgtacgggctcgcctccggcggatggttcggcgtggggctgggacaaagccggcaaaagtacagctggatccccgaagcccataacgacttcattttcgccatcatcggtgaggaactcggactggtgggaaccgtcgtcgtccttattcttttcgccatcctgggcgcggcaatctaccgggttgtagtggcacaggaggacatgttccaccgtgtcctcgccggcaccatcatggtgtggctgctgggccaggccacggtcaacatgtccgtggtgaccggtctcatgcccgtcatcggcgtgccgctgcccttcatctcctatggcggctcggcgctgctgatgtcgctctgcgccatcggggttgtgctttcgctggccagggaacagatggccccggcgatccggcccaagcggatgctcaagttcaaggccaagccggcgcggaaaaacgcggaccggaagaaaactgcaagaaagcgtacctagccctccatgaccaccaagaccccgtccatcgtcctggccggcggcggaactgccggacacatcagcccgctgctcgccatcgccgcggcactccgcaacgcctccccggaagccgccatcctcgccgtcggcacgccgtccgggatggaaaccaggctggttcccgccgcaggggtggaactggccaccatcgaccgggtgccgttcccgcggcggccttccgcggacctgctccgcctcccggccaggctggccggggccgtacgccaagccggagcaatcctggacacagccgccgctgatgtcctggtgggagttggcggctacgtctgcacgcccatgtacctggccgcccgcaaacgccggatccccattgtgatccatgaggccaacgcgcgtcccggactggcaaacagggtgggcgccctgatgacacgccgcgtcgcggtagccttcgccaacaccccgcttcgccatgccaggcacgtgggaatgcccatgcgcgccgagatctcgggcctggacagggcagccgcgcgcaccgctgcccgcgcggcccttggcctggatcctgcaaagcctgctctgatcgtcactggcggatcctccggcgcccaaagcatcaaccgcaccattgccgccgctgttgaccggctgtcggcggcaggtatccagaccctgcacatcaccggacgcggcaagaccgtcatggacagcgacggccggcagcttgccgcaaaggactaccgtcaggtggagtacgtagacggcatggagcttgcctacgctgccgcggatgtgttgctggcccgctccggtgcggccacggtctgcgaggttgccgccgtcggcgtccccgctgtgctggtgccgctgcccatcggcaacggtgagcaggccctgaacgctgccgggttggtggctgccggcggcgcactgctggtgaatgaccgcgacttcacccccgattgggtggaccgcgaactgatcccgctcgtcacggaccagccgcggcttgccgccatggccagcagttcctaccggcttggaatccgaaacgccgatcagcgcatggctgacctcatcctggaagcagcagcatcatgaaccacgccaccgtccccagcctcgagtcgctgggccgcgtccacttcgtgggaatcgggggcgtcggcatgtccgccgttgccaggatcatggttgcccgcggcgttccggtcagcggctccgacgcgaaggacctgccggtgatggccgacctcgccgctgcgggtgcccgcatcgccgtcggatatgcctccgccaacctgggcgatgcacaaacggtagtggccggatccgccatccgcccggacaaccccgagcttgttgccgccagggaagcagggctgcccgtgctgcaccggtccgaggccctggccgccaccatgggcggcgacacggtggtcacagtggcgggcacccacggcaagtccaccaccacatccatggtcacggtcctgctgcagggcgccggactggacccttcattcgccatcggcgccaatgttcccgcgctcggcgtcaacgcagcgcacgggagttccggaatctttgtggccgaggctgacgaatccgatggctccttcctcaactaccggcccaggatcgccgtggtcaccaacgttgaaccggaccacctcgaccactacgggactgccgaggccgtttacgagtcctttgacaggtttactgcgttgcttcccgcggacggcgtgctggttgcctgcgcggacgacgccggcgcgcttgccctcgctgaaaggacgcggacgaggggcaacacccgcgtggtgctctatggaaccaccgagggggccgacttcgtgctgcacgacggcggtcccggcgacgtcgcggtctccacggcctccgggcgctatccgctggcgctgcaggtgcccgggcgccacaacgcgctgaacgccgcggccgcgttcgccgtcgcgcttgaacttggagttgaccccgcagcggccgcagccgccttggcgcacttctccggggcctcccggcgcttcgagctcaaaggcgaggcccgcggagtccgcgtgtttgatgactacgcccaccaccccaccgaagtccgggccgccctcgccgctgcccgctcggtcgccggcgcgcacaaggtgcacgtcctcttccaaccccaccttttttcccgcacccgcgagttcgcgcaggagttcgccgaggcgctcaacctcgccgacacagccctggtgctggatatctatcccgcgcgtgaagatcccattccgggggtgaccagccagctcatagccgaccacctgggccatggaggacgcctggtggccgccggcgacgccgtctccgcactgacggccgccgccacgtcaggtgacattgtgctgacggccggcgccggcgatgtcacggcgtacgggccgcagatcgtcgaggccctgcgtggctagcacccgccgccccacgtacaattccaccggccgcccgggccgctccggcggcaccggtggaaatccgggcaacggtggaaagaacggacccgctgcagacgacgtcatctcggcctcccggagcgttccggagccggatctcgaggggggcggcacgtcaaaggagccggcaaaaccgaaacgggccggcattcccggcctgggcaggggcaggaaggcggaaccgcccgcggcagccgcggagaatgttctggcctttccggagccgaaagggaagcgccgcaagcggactgtcctcgccgtagccggaacgctcattgccctcgtggccggcctcctggcagcggccatcttctctcccgtactggccgttgacaccatctccgtttccgggacgcgcctgctgacgcctgcccaggtgcaaaccgcgcttgagcccctgcggggaaagcccctgccgcaaatcagcgacgacgaggtggcgaggctgctggagcccctggtccaggtcaaatcggtctccgcggaagcccggccgccatcagggctggccgtggcagtccgggaacgggtgccggtggcactggtcaagcagggggagcagtaccagctcgtggacgtcgaaggtgtccagctggccgccaccgccgatccggcgtccgtctccctgcccgtcatcgacggcggggcgggagccatcggacaggatctcttccgcgcgacggctgccgtcctcggcgcccttcctgcggacgtcctcgccaggctttccaacgcctccgcccagtcggtggacgcggtggaacttaagctcgtggatggccagaccatcatctggggcaacgcgggggagaaggagctcaaagccaaagtactggcggcactcctcaaggttcccgccgatcctaagaaccccgtcaaggtttacgacgtcagcgtgccccggcatccggtgacgcgctgaccgctttatttccggtattaatccgacacgcggagccggttattgaatgtggcaggcagaggaaataccgtcgtcacagacaagagttacttgacataactataaccttcaactcgaaggttaaggttgcaaggttcaagctctacatcagttttcgcaataagacacgaacaagggacacgtaacgtggcagctccgcagaactacttggccgtcatcaaagtcgtcggcatcggcggcggtggcgtaaacgcagtcaaccgcatgatcgaggtcggcctccgcggtgttgaattcatcgccatcaacaccgacgcccaggcgctgctgatgagtgacgccgacgtcaagcttgacgtcggacgcgagctgacccgcgggctcggtgcaggcgccaacccggaggtgggcaagcaggcagccgaggaccacgctgacgagatcgaggaagtgcttcgcggcgctgacatggtcttcgtcacggccggcgaaggcggtggtaccggcaccggcggcgctcctgtcgtcgcccgcattgcccgttcactcggtgcgctgaccattggtgtggtcacccgtcccttcactttcgagggccgccgccgtgccggttccgcagaggccggcatcgacgcccttcgggacgaggtggacaccctcatcgtgatccccaacgaccggctcctgtccatcagcgaccgcaacgtgtcggtcctggacgccttccgctcagcagaccaggtgctcctctcgggtgttcagggcatcacggacctcatcaccaccccgggcctgatcaacctcgacttcgcagacgtgaagtccgtcatgcagggtgccggctccgccctcatgggcatcggctctgcccggggcgaagaccgcgccgtcaaggccgccgagctggccatcgcgtcgccgctgctggaagcgtccatcgacggcgcccacggcgtcctgctgtccatccagggcggttcggacctcggcctgttcgagatcaacgaagccgcacgcctggtccaggaagtcgcccaccctgaggcgaacatcatcttcggtgctgtgatcgacgacgccctcggcgacgaggcccgcgtcacagttattgctgcaggcttcgacgacgtcaaggccacctcgccgtccatggaccagtcgcagccccaggtcgctccccagcggcccgccgcgccggcagcggcccccgctccgtcgcaggcaccctccgccggaaaccaccaggtgcacgtccagcctgtccacgcaggcgtaggcgcagcaggtctcagcaactgggggcagcagcgcccgtcggccgtccctgcggactccggcttcgacgtggatctgccctccgtcgtggaaccggaccttaccggcagccgctcggatgacctggatgtccccgacttcctgaagtaggccgcagcttgttccattggcgggccgagatccttcccggggtctcggccgcttttacggacagcggagcgggcaacctcgcactgcacgtgggcgatgacccaggtgccgtgcagcggcggcgcgaagagcttgagaccgctgtgggaatcgaaccccgcggcctgcggttcatgaaccaggtgcacggcaccacggtggccgtgatggaccgggggagcagcacgccggaagcagatgcgatggtctcgcgttcccagccgctggctgtcatggtggctgattgcattccgcttctgctggcaggcacgtccgcggacggtcctgtcctggccgccgtccacgccgggcggccaggggtggccaacggggttatccccgccgccgtggacgccatggaatccctcggagcttcgggcatacgcgcctggctcggtccgtccatctgtggctcgtgctacgaggtgcccgctgcgctgcgggacgaggtggccgcggcggtgcccgcaacttggtccactacgtcctggggaaccccggcgctggaccttccggccggcgcccgcagccagctggaagacgccggggtcggcgttgaatacgccggtccctgcaccctggaaacaggctccctctactcctaccgccgcgacaccggcacggcccgtttcgccggcctggtctggtgccatgactgaccccgcgttgaacgacgccggtgcaggggatccgcgcaccgccgagctggccgggcggctcgaagcagtccggcgccggattggcgtggccgcggcagcggccggcagggccggcaggctgccgaccctgattgtggtcaccaagttccatcccgcggaggacatccggcggctcgccgccctgggagtcaccgacgtgggggaaaacagggaccaggaggccgcggggaaagcggaaatcctggccgactgcgggcttacctggcacttcgtgggccagctgcagacgaagaaggcaaaatcggtggtccgctacgcttcggctgtgcattcggtagaccggccccaactcgtggatgccctggcgaaggcaatgcagaacgagcgcgccgccacggcagggcgcgcgcctctggactgtttcatccaggtcagcctcgaggacgacgccggtgcgcaccgcggaggtgccgcgcccggggacgtgctgctcctggcggaccggatagcagcagccgatggcctgcggctggcaggcgtgatggcagtggccccgttgggcgcaccgccggagcccgccttcgaaaagctggccggagtctcggcgcggctggtggcgcaccacccaggagcttccgccatctccgccggcatgagccaggacctcgaagccgccatcgcgttcggggcgacacacctgcgaatcggttccgatattctcggatcgcgtcccgcggtggggtagcgtcggagctattgcaagtgatgggcgggggacttcaatgctgtcaagtcattgggcggcccgcttacgggacacgattaggagtcgaccatggccggcgctctgcgcaagacaatgatctatcttgggctcgccgacggcgatgagcattacgagtccgagcaacagacaacacgtaaggatgaggacgaaactatggaagctgaccgcgaggagcgccgtgcacctgcacccgtccgtgaggtcagccgcgaaacgtcctacacccccgaagaggaataccgcgccccagtgacccccatcaaacgtgcggcctcgagccgcgaagagaccagcgggcttcgccagatcaccaccatccacccgcgctcctacaacgatgccaagctcatcggtgagagcttccgggacggcattccggtgatcatgaacgtgacggacatgggcgaggctgacgccaagcgcctggtggacttctccgccggactcgtcttcggactccgcggaagcatcgagcgggtgacgaacaaggttttcctgctgtcgccgtcatacgttgaagtcataggtgacgacaagaaagtcagcgaaacgcaggcaagcttcttcaaccaaagctgagcttcgggcagtatgcggatgccaggcagggacacctgtctggcatctgtgttgaaatagacgggacacatcggcaggaagccgcggtacacagatgaacatggagatatgagttaagtcatgggaattgctttcggacttgtctatctcgcgctgctcctgttcttcgttgccctgatcatccgcctggtcttcgactgggtgcagatgttcgcccgggaatggcgtcccaggggcgtcgccctggtggctgcccacgcggtgtactccatcaccgatccgccactgaaggtactgcgccgggtgatcccgcccctgcgacttggcggcatctccctggacctgggcttcctggtgctgttcatcgccgtcagcattgcgatgggaatcacaaggggcctggcctgatttaccccctttagacctcgcagcacagggtggacccgtccgggaacagctactgtgaagcgaagaaaactcacgtttgacaccgcagtgttgaattagagtaaccagaccaaatttaggtaccgtagttttgacggccggaaggcctactgactaactagaccagtgaggtgaccagatggctttgacgccagaagacgttgtcaacaagcgctttcagccgaccaagttccgcgaagggtacgaccaggacgaagttgatgacttcctggacgagatcgtcgtcgaactccgccgcctgaaccaggagaacgacgagcttcgcaagaagctcgcggaagccggatccagcgttccggccagctcggctgccgctcccgttgtggagaaggtccccgcgcccgtcaaggccgacaaggacgaggcccgcgaaaaggcggaaaccgaagccaaggctgccgaagccagcaagaagaaggacgtccagccggccgccgctgcagcccctgccgcctccacccccgccgccgtcgcaacgccttccgccgagtccgcagccggcctcctggccatggcccagcagatgcacgaccgccacgtggccgacggccaggcccagaaggacaagatcatcgccgaggcgcagatcgaagccagcagcctggtcaacgacgcacaggagaagtcccgcaagatcctgggcgccctcgagcagcagcgttcggtcctggagcgcaaggtggagcagctccgcggcttcgaacgcgattaccgttcacgcctgaaggcctacatcgaaggccagctgcgcgaccttgatgcccgcggttctgtggctacgccggaagtcagcgaagccaactagtccgtcaaagcacgtattctgaaagccggtggctgaggattcctcggccaccggcttttggcattgacacctgttgtacgaatgaaagcaccatgactgacgaacttgctgcggatcccgcacgccctgtcccacccgcaccgcgcccgcgccgggcggtgctgctctcggtcttcgccgggttcgcccttttcgcctacgttctggaccagctcaccaagctttgggtcacttcaagcatggtggagggcgaacggatccccgtgttccctcccctcctgcactggtacttcatccggaactcgggcgcggccttttccatcggcgaaaacgtgacctgggtgttttcgatcatcatggccgcggtgtccgtggcgattctcttccaggtccgcaagctgggctcggtctggtggtccctggcgctgggcctgctcctgggcggggcgctcggcaacctgaccgaccggctgttccgggaaccctccttcggcatgggccacgtggtggactttatccagctccccaatttcgccatcttcaacatcgcggactcggcggtggtgtccgccgtctccatcatctgcatcctgacgctgcgcggcatcaccctcgatggaagcaggctcacccctgaacgcaaggacaagtccggcgatgcctgaagcgacgcctgagcagattatcgttgccgacgaatacgggggaacccgtgccgacgccgggctcgcggcccttctgggcatttcgcggtcccttgccgcgtccctccttgcagagggccatgtggagagcaagggcaaagcgctgggcaagtcggcaaagctggtggcgggcgatgtcctgaaggtcagcatgccggaacggcgtgacccgctggaagtcgtggaggaagttgtggaaggcctgaagatcctgctggatgacgaggatttcgtcgtcgtcgacaaaccggtcggcgttgccgcccacccctcaccggggtgggtgggtccgaccgtggtgggaggcctcgcaggggccggctaccgcatttccacctccgggtcgccggagcgggcgggcatcgtgcaccggctcgacgtcgggacgtccggtgtgatggtggtggcgaagtctgagcgtgcctacacggccctgaagagggcgttcaaggagcgcacagtggacaaggtctatcacgccgtggtgcagggcctgcccgatccgctggcgggaaccatcgacgcgcccatcggccggcacccggggcatgactggcgcttcgcggtgatcgaggacggacgtccgtccgtcacccactacgaagtcattgaagctttcggcaaagccagcctggtggaggtccaccttgaaacgggccgcacccaccagatccgcgtccatttttccgcgctccggcacccctgtgccggagacctcacctacggcgccgatccgcggctggctgccaccctgggcctgacgcggcagtggctgcacgcccgcgaactggggttcgaccaccccgtgacaggggagcgcgtccgggtcaccagcgactacccgcaggacctggcctatgccctggaagtcctcgggtccgggcaggcctagcgctttcgccacctgtccggcgcatagaatagtgcggtgacttccagcaatgactcgtttgtccatctccacaaccacaccgagtactcgatgctggacggcgccgccaggctcggtgagctgttcgacgagaccgagcggctggggatgcccgcacttgccaccaccgaccacggctacctcttcggcgccttcgacttctggaagaaggccaccgacaaggggatcaagccgatcatcggcgtcgaagcctatgtgactccgggaacggcccgcagcgacaagagccgcgtgcgctggggcgaggagcaccagcgcaaggacgatatctccggcggtggttcctacacccacatgaccctgctcagctacaacaacgcgggcatgcggaacctgttccgggcatcctccatcgcctcgctggacgccgtgttcggcaaatggccgcggctggaccgggaactgctcaatacctactccgagggattgattgccaccaccggctgcccctccggggaaatccagacccggctccggctgggccagtaccgtgaggcgctggaagccgccgcggagttccgggacatcttcggggccgagaactacttctgcgagctcatggaccacgggctggacatcgaacggcgcgtcacaggcgacctgctgcggctcgccaaggacctgaaccttcccctggtggccaccaacgacctccactacacccacgagcacgacgccaaggcccacgaggccctgctggccatccagtccgggtccaccctcctggagcccacctacgacaacggtggttcacgctttgctttctccggcagcggctactacctgaagtccccgcaggaaatgcgggaactgttccgcgatcacccggacgcctgcgacaacacactcctcatcgccgagcgctgtgaggtgtccttcaacaccggcgccaactacatgccgcgcttcccctgcccgcccggggaggacgagacgtcctggctggtcaaggaggttgccacggggctcgagtaccgctatcccggcggtgttcccgacgacgtccgcgcgcaggcggactacgagctgggcgtcatcacctcgatggggttccccggatacttcctggtggtggcggacttcatcaactgggccaagaacaacggcatccgggttggtcccggccgtggttccggtgccggttccatggtggcgtacgccatgcgcatcacggacctcgacccgctgcggcacggcctgatcttcgaacggttcctcaacccggaccgcgtctccatgcccgacttcgacgtcgacttcgatgaccggcgccggtccgaggtcatcgactacgtgacccggaagtacggcgacgaacgcgttgccatgatcgtcacgtacggcaccatcaagaccaagcaggcgctgaaggactcctcccgcgtgctgggctacccgttcagcatgggcgagcagctgaccaaggcgctcccgcccgccgtgatggccaaggacattccgctcgcggatatccagaacccggaagccaagcgctacggcgaagcgggagacttccgccagctcatcagcaccgaccccgaggctgcgaaagtcttcgagacggcactgggcatcgaggggctgaagcggcagtggggcgtccacgcagccggcgtcatcatgtcctcggacccgatcatcgacgtcatccccatcatgcgccggatccaggacggccaggtcattacccagttcgactaccccacgtgcgagggcctggggctgatcaagatggactttctgggcctgcggaacctgacgatcatttccgacgccctggaaaacatcaagatgaaccgcggcatcgacctggacctcgaatcgctggaactggatgacgccccgtcctacgaactcctggcccgcggcgataccctgggcgtgttccagctggacggcgggcccatgcggtccctgctcaagctgatgaagcctgacaacttcgaagacatttctgcggtgctcgccctgtaccgtcccgggcccatgggtgccaacgcgcacacggactacgcgctccgcaagaacgggatccaggaagtcatcccgatccaccccgaactgaaggaaccgctcgcggagatcctcggcggaacctacggcctgatcgtgtaccaggagcaggttatggcggtggcgcagaagctggccggctactcgctgggccaggccgacatcctccgccgcgccatgggcaagaagaagaaatcggagctggacaagcagttcgccggcttctcccagggcatgcaggacaacggctactcaatggaagccgtcaagacgctgtgggacatcctgcttccgttctccgactacgccttcaacaaggcacactctgccgcctacggcgtgatctcctactggaccgcctacctcaaggcgcactacgcgccggagtacatggccgcgctgctgacgtcggtgggggatgacaaggacaagtcggcgatctaccttaacgagtgccgccgcatgggcatcaccgtgctgccgccggacgtcaacgagtccgccctgaacttcaccccggtgggcaacgacatccgcttcggcatgggcgcaatccgcaacgtgggtgtgaacgtggtggaggccatggtggccgcccgcgaaagcgagggcgcgtacacgtccttcaaggactacttgatgaaggttccggcagtggtctgcaacaagcggaccatcgaatcgctgatcaagtccggcgccttcgactcactgggccaccaccgccgggcgctggccatgatccatgaagaggccatcgactccgtcatcacactcaagcggaacgaagcgatcggacagttcgatctcttcgccgggttcgatgaagccgaatccgagtcatcgctgagcatcgagatccccgacctgccggagtgggagaagaaggacaaactttccttcgaacgggacatgctcggtctctacgtctcggaccatccgctgcagggcctggagggactgctcagccagcacgcggagatgagcatcacctctgtccttggtgaagacgggccacaggacggcgcgatcatcaccattgccggcatgatcacctcgctgagccggcgcatcgccaaagccagcggcaacgcgtacgcccgggccgaagtggaggaccttggcggttccatggaagtcatgttcttcggccaggtctacggacccatcgcctctgtcctcgcggaggacctgattgtggtggtcaaggggcgcctgcagaagcgcgacgacggtgccatcaccctgaactgcatggagttgtccgttcccgacctcagcgaggggctcaacggcccgctggtgatcaccatgcccacctacaaagccaccgaggctgtggtcacggaactgggcgaggtgctccgcacacaccgcggcaactccgaggtgcgcctgcacctgcagggcgacacgcggacggaaatcatgggactgccggtccacctgcgcgtaaaccccagcccgtcactgttcggcgacctgaaggtgctgctcggcccggcctgcctggacgcctaagctgccccttacaaaaggacgacggcggaaggacgacggcggaaggcacgtcccgtcgtcgtccgcgggttgtgtgggactgctagatctcgtagtccagcgggacgggctggccgtacgcgccgccgtggtacagcaggggtgaggcctcaccgcccacctggccgtccaccacctggaccaccaccacggcgttattctcgaaggacagccgcatctgcacctcgccgatcagccagccggccacgtccttcaggatgggcaccccgtgcgggccggcttcccagtggtcgccctcaaaacgattgccggccccagcgaaccggtcggccagctgcatgttctcgaggcccagcatgtggacccccaggtaggtggtgttggccacggccggccacgacctggagctgcgggccatgttgaacgtgaagcgcggaggctgcgcggagagcgaggccacggaggtggcggtgaagccgtagggctggtcctggtagttcaccgtgatgatggcgacgccggcggcgtggcgccggaacatctccctgaacgtccgctcgaacggaacgtcattagttgtcacggaaactcctggtggctggaacgtcgggtacgggtgctctccttcaagggtatggctctgccgtgccggcagtgaattcctggcaggcccgggtccggcgatgaacgccgcttacatttgttaaggtttgttgcatgacgaaagccacccgccgcacacgcccgcggctgccttgggcgatgctggcggtcccggcagcggcaggtgttccgctgggcatcctttggtggctcctggcgcccgggggcctgaacctgatcaccagggacccggccttcggcagcggaaccaatccggatgtctggctgccgcgggacctgacgctggccggactgctggttcttgccggatgcttcctggccgttgtcctggcggacaaaaaacggccggatccgcaggcggacctggtggcgggcctggcgggagccctgtgcggggcagcgctggcctggcaggcggggctgatggccgctcaactgtgggcgcctgcggttgatgcatcagcaaacgccagcattgccttttcgctccgtgcctggccggtgctgctcctgtggcccgccgccacggcagtctcggtttttgtgctggaacttctcgacctcatgggccggaagccggcggcggaacacgagagtcgccggacgctgtggcagggccagtaaaataggccagtgaccatttcttcggagaactccgccagcccagccgccaccgccgccgtggacttccgcaccgttgacctgcgtggccaaagcctcaccctcgccggactccgggccgccgtgccgcgtgcccagggccagaccgtggccgatgccgaggcgaaggtccaggacatcatttcggctgtccggcagggaggtttcgaggcgctgggcgaactcgcccggcgttttgacggcgtggcgcaggaccaccccctggttccccgggaggccctggcctccgcactggaggagctggacccgtccgtccgcggcgcgctcgaggaatccatcagccgggcccgccgattcgctgacggccagcgtccgcgcaatatcgaggtacagctcggcgacggcgcagtagtggcgcagaactgggtgccggtggcacgggtggggctctacgtcccgggcggcctcgccgtctacccctcctccgtgatcatgaacgtcgtcccggccctcgccgcaggagttcagtccatcgccctggcgtcccctccgcaaaaggaatttggggggctgccgcaccccaccatcctcgccgctgccgcgcttctgggcatcactgaggtgtatgccatcggcggcgcccaggccatcgccgcgttcgcctacggtgttccggcaacggaggccggtccggcgctggagccggtggacgttgtgaccggaccgggcaacatctttgttgccaccgccaagcgtttggtcaagggcgtggtgggaatcgactcggaggcgggcaccacggaaatcgcgatccttgcagactccacggcccagccccgcctggtggctgccgacctcatcagccaggccgagcacgaccccaaggcagcatccgtgctgatcacggattccaaggagctcgccgccgctgtccgtgccgagctcgaccggcaggctgcggccaccaggcactccgcccgggtccgcgaggcgctgtccggcccgcagtccggggtggtcctggtggacaaccttgaacaaggcattgcagcgtgtgacgcctacgcggcagaacacctggagatcatgacgcaggatgccccgggcatcgcggccaggatccggaatgccggtgccatctttgtgggcgactacagccctgtcagcctgggggattactgcgccggctccaaccacgtcctgcctaccagcggcactgcagcattttcgtccggcctgaacgtgaccacgttcctgcgggccatccaggtggtgaactacacccgtgacgcgctggcggaagtcagcggccacattgtcagcctttccggggccgaagaccttccggcgcacggggatgcggtgaccgtccggttctcctgaatcagtccaccgtgccgcatgtagtggtggcaaccacaacatgtagtacttacacgcttgttattagcgtgagcggggacgtaaactgggagacggcgcaggcgcgcctgcagaaggttggcctgcacagaagcctggcccgcacagaaggtgggccggcagaatctgcctgatgatttagttccgcttgcacacgtcctgggagagggaggcacgatgtactgtccgttctgccgcaaccccgattcccgggtggtggacagccgcatggcggatgacggctcggccatccggcgccgccgccagtgcccggagtgcggacgcaggttcaccaccgtcgaaaccaccagcctttccgtgatcaagcgctccggcgtgggcgagcccttcagccgcagcaaggtgatcaacggggtgcgcaaagcctgccaggggcgtcccgtcagcgaggacgatctcgcgctgctggcgcaggaagtcgaggagcagatccgttcctccggcgccgcggaaatcgacgcccacgaggtaggcctggtcatcctcggacccctgcagaagctggacaaggttgcctacctccgcttcgcgagcgtttaccaggccttcgaatcccttgaggatttcgagagtgccatcgccctgctccgccaggaagaacaggacgcccggggcgttgccacgaagggcgccaagacctccgagaagagccccctgtaaactccggtggcggcagcggaggggaagccgaagccgccaccggcactccggtccggggtattgccggacggaagaaacgtgtcacctgcgggtgcaactcccgagccggcggacggcctcctgccacactccagcggaagtccgcgcccgccgtcgtccgttataccccaccctggcaacaccgctccggcggcaccagcggaatggtcaatgacgtccgcatctcctgtgcggccagcgaaccaagcaatgccgtcaccgaccccgcggctgccgcccttggccggtgccgccccggtccggggcggcaccgattccatggctactttgcgagcttgtgctttaacgcgatttcgatcgccgcgcccacgatgccggcctcgttgcggaggactgccggcacgatcggcgtgcgcagccgcaggttgggcaggtactcgtcagcgcgcttggagatgccgccgcccacaatgaacagttcgggcgagaacaggaactcaacatgcgagaagtagcgctgcagcagcacgctgtactcgtcccaggacaggccatcgcgttcgcgggccaccgcggaagctttggtttcggcgtcgtggccgtcaatttccaagtggccaagttcagcattggggacgagcttgccgtcaaagatgaaggccgagccgattccggtgccgagcgtgatcaccaggaccgtgcccttgacacccgcaccggcgccgtagcgggcctcagccaggcctgcggcgtcggcgtcgttgataacctcaacgggccggcccaggcgggcagtcaggagcgcatcgatgtccgtgttgagccagctcttgtccacgttggcggctgagtggaccacgccgtgctggatgatgccggggaaggtcacgccgacgggggagccggcagcaggcgcctcgggccgggcggacagctcggaaaccaccagcgccacggcttcggcaactgattcaggcgtggcgggctgcggggtggggacgcggaaccgttctcccagtagtttgcccttcttcaggtcgactatgccgcccttgattccggtacctccgatgtcgatgccgatcagcggggcgttcttgttcgacttctcgtccttcttggccaatgggtttccgttcgtggcaggggcgggcagggtagcggcggccggtggcgtggccgggaattgatgtccggtcaggaaccggggtggggtagggccatggtatgtgcgtcgtggtggtgcccggctgggcagggctagggcagcgtgaggatttccgcgccggagtccgtgaccagcagcgtgtgctcgaactgggcagtgcgcttccggtccttggtgacaacggtccagtcatcggcccacatatcccattccacggtgccgagggtgagcatcggttcaatggtgaagaccatgccggcctcgatcaccgtgttgtaggcaggtgccgcgtcatagtgcggaatgatgagcccggtatggaaggcttcgcccacgccgtgcccggtgaaatcacggacaacaccgtagccgaagcgcttggcataggactggatggccctgccgatgacgttgatctcccgtccgggagccacagccttgatcgcccggttgagtgactcccgcgtgcgttccaccagcagccgggattcctcgtccacgtcgcccaccaggaaggtgtagttggtgtccccgtggactccgttgatgaaggcggtgatgtcgatgttgaggatgtccccgtcccggaccactgtgctgtccgggatgccatggcaaatgacctcgttcagggaggagcacagcgacttcggaaatccccggtagccgagggtggacgggtaggcgtggtggtcaagcaggaactcgtggcccactttgtccagctggtcggtggtgacgccgggctggatatgcttgcccacctccacgatggcctgcgctgcgatctttcccgcgatccggatcttctcgattgtttccggggacttgacctccgagccggtgaatttcgccggtgcgggcctgccgacgtactccggccgggggatggacgccgggacgggacgctgcggacctatggttcccggggtgagggtgccgatgggtgcagtcgaggcaagggaagacatagattgatcatataaggcagtgcagaacgcctaacaaccggaagccgcgcgcggcctgcgtaagagtttaagttacgcgggtcacgccgcagctttcccgccgccggaacgaggagcaccgatgactgagtactggtacaacgtcaatacgcatgagattgaagaggaccggctgtccgactggagccagctgatcggaccgtacaaaacgcgggaggaagccgagcacgcactggaaaaggtgcgggcccgcaacgaggtctgggaaaagggcgacgacgactgacagccgggcgggcaggctggccgggtgccggcctgcctgccctgtgggcgccgctgctagaacgagtgttccggcccggggaactgtcctgacctgacatcctcgccatactgagtggccgcgtccagcagggtgctgcgcaggtccgcgtactgcttgacgaacttggccatccgcccgccgcgcagcccggccatgtcctgccagacgagcacctgtccggttgtttccttgcccgcgccgatgcccacggtggggacgggaacagccgcgtccacggcggctgccgtcccggcggggaccatctccatcagcacgcagaaggccccggcctcagcgagggcgaccgcgtcatcgataagccgctgcgcatcgtcgccgcggccctgcacgcggtaaccgccgagcgcgtgctcgctctggggggtgaaaccgatgtgtgccatgaccggaatcccggcctggaccatggccttcaccgtgggcgcatagtaggcgccgccctcgatcttgacggcgtgcgccaggccttccttgaggaaccggacgccggcgccgactgcctgctccgcggacacttcgtagctgccgaacggcaggtcggccacaatgagagcgcgtttggcgctgcgggctacggcacggcagaggggcagcagttcgtccaccgtgaccggaaggctggtctcgttgccgaacacgttgttcgaggccgagtcgccgacaaggagaacctcgattccggcagcgtcaaaaatttcagctgtgtactgctcgtaggcagtcagcatggcgaacttggtaccgtccctcttggcctgctgcaggtggtggatgcgcaccttgggcggcttccgctgcggcgcagcctcagccgcagctgcctggcccggcccgctgccgtagggggcggggacgtcggcggacatgctggaatcggagctgttgcttgaagccatggcatgagcgtagtgcgggagccgctgtcctagctaccgcgggccggaggctccacgggtgataagggtcatagggcccggcctgcggcggggtcccgacggtgcgcactgcccgattgcgcggctcaaatccaggggacgggcgttaacgctgtgttacgcacggcgcaggcttcaacatcggcgccgaatgcttagtacagtgttggtgaactgctgccggcttccctttactgcgggcccggagcatggacgttgaccggagaagaggccatcatggaccgccagcaagagtttgtcctgcgcacaatcgaagagcgcgacgtacgtttcgtgcgcctgtggttcaccgacgtcgtgggttcgctcaagtccgtggcacttgcccccgccgaggttgagggtgcgttcgaggaaggactgggcttcgacggttccgccattgaaggccttgcccgggtgttcgagtcagacatgctggcccagcccgatccctccaccttccagatcctgccgtggcgcggcgagacggaacagacctcgcgcatgttctgcgacatcctcaccccggacggcgaaccgtccgccgcggatccccgcaatgtcctcaagcggaccctcgccaaggccgccgacatgggctttacctgctacacccaccccgaaatcgagttctacctcctcaagtcccaggaacccggcccggacggcgccccggtgcccgtggacgagggcggctattttgaccatgttcccggcggcgtggcccaggacttccggcggacagcggtcaccatgctcgaatcagtgggcatctccgtcgaattcagccaccacgaggccggccccggccagaacgagatcgacctgcgctacgcggacgccctgcagaccgcggacaacatcatgaccttccgcaccgtcatcaaggaagtggcgctgcagcaggggacctacgccaccttcatgcccaagccgttcaccgcccacccgggctccggcatgcacacccacttctcgctgttcgaaggcgacacaaacgcgttctacgaggccggcgccgaattccagctctcaaagaccgcccgccagttcatcgccggcatcctcaagcacgcgcccgagttcaccgcagtgaccaaccagttcgtgaactcctacaagcgcctctggggcggcggagaggctccgagctacctgagctggggccacaataaccgctcagccctggtgcgggttccgctgtacaagccgggcaagggccagtccgcacggatcgagtaccgcggcatcgattccgcagcgaacccatacctggcttacgcggtcctgcttggggccggcttgaaaggcatcgaggagggctacgaccttccggccgcggccgaggacgatgtgtggtcgctgagctcggccgaacgccgtgccatgggacacgatccgctcccggccagcctccacgacgccatccggaccatggaagactcggagctcatgccgcagatcctgggcgagcaggtgtttgagcacttcctgcgcaacaagcgcgccgagtggcaggactaccgcctgcaggtgacgccctacgagctgcagcgcaatctcggcatcctctaggcggcgggcgtgagcctggcacgccgcctcattgcggctggattcagcgacctcgacaagggggagcggttccttgctgcgccggaactggaggggctggaccaggacaggctgtttgcgggcctgcagatggcagccagcccggacaccgccctgcagtccctggtccgcctgatcgaaaagcacccggcgctccgggacctggccgccgccgaccccgacaccagtgaaccgctgtaccgcgtcctgggcgcgtccgaagccctgggggagttcctgatccggcatccggaacacctgcaggccttccacgtccgcaccagccccgagccattgcagtccgatcctgccgccctgcgcggggtcctcctgcagtccgtgggggcggacccccgcgcggcccggcccgtggcagccagcacaggaaatgacgcgtacgcggcgcttcgcacggcgtaccgcaggggcgtggtggacctcgccgtcaaggacctgtgctcggctgatcccctggacttcctcccgtcagtgggagcggagcttgcggaccttgccggcgcagccatcgaagcggccctagcggtctcgcgcgctgaggcgggtgagcagtacggcgccggcgacgttgccgacgtcggccttgccgtgattgggatgggcaagtgcggcgcccgcgaactgaactatatttccgacgtcgacgtcatctacgtggtggaccccggcgccctggatgacgcgaaggcgaacaccataggaactgcgctggcgagcggaatctcccgcgccatctcctccgttgcgcgtgaaccgggcttatgggaggtggacgcgaaccttcggccggaaggaaagtccggaccactggtccgcacccttgcctcacacgagtcgtactatgcccgctgggctgaaagttgggagttccaggcgctgctcaaggcccggaccattgccggcgacaccaaccttggccgccgctacgaggaagccgtggcgccgctgatctggagttcggcaagccgggacggattcgtggaatcggtgcaggctatgcgccgccgggtgaccgaacacattccggctgcggaggagcagcggcagatcaagcttggccgcggcgggctgcgtgatgtcgagttcaccgtgcagctgctccagctggtccacggcaaagcggacgagacactccgacggcgggacaccacctccgccatcgcggccctgtcagcagggggctatatcggccgttcagacgcggccgccttcgacaatgcctaccgctacctgcgcctgctggaacaccgcatccagctcttccagctgcgcaggacgcacctgatgcccgttgccgaaccggcgctcaggtcgctggcgaaagccgtgctgggccccttctccaacgagcggccccatccggacgcgctgctgtccacctggcagaaaaccaagcgctctgtccgggaactgcacgagcgcatcttctaccggccgctgctcaacacggcggccaaactcagcagtgaagacgccaagctgacgccggaagcagccgagggccggctcgccgccctgggataccgggacccgaagggcgccatgcgccatatcgaggccctgaccgcaggggtcagccggcgcgcagccctccagcggcagctgctcccgatcctgctcgactggctggctgaaggcgtggacgcggacgccgggctccttgcgttccggcgcgtcagcgaagccctgggaaccacgcactggtacctggggatgctccgggactccaatgcggccgcagagcggttgtgccacatgctgtccaactcacggctgattgcggatctgctggaggtttcgcccgagtcggtggcctggctgggccaggacaaggacctggcgcccgtggggttcgatgcccagtggcaggaaatcacctccaagatgtcgcggcatgcggatccggagagcgccatgcgcctcatccgcctgatccggcgccgtgagatccttcggatcgccgtcgccgattcagccggcctgctggaccaagaccaggtggggagggccctggcggacacggaccgggccgcggttctgggcgccctgcgtgtggcggagggcatcgtctccgccaacgggccgctgaagaccaccgtactggtggttgccatggggcggcagggcgggcgcgagatcggctacggttcggacgcggatgttatgtacgtgcacagggccctgcccgggttcagtcccggggaagcgcaggagcaggccacccggatcgtcaataaggtctccaccctgctgacccagcccctgaagccggccattatggcggagcgggtgctccagatggacgcggacctgcgccccgaggggaaaaacggggccatggtccgttccctcgactccttcgccgaatactaccggcgctggtcactcatctgggaggcgcaggcactgctgagggcccgtcccatggccgggaatgacgacctggccaaggacttcctggaactcatcgaccccatcaggtatccggaatcggttgcggacaccgacgtgagggaaatcaggcggatcaaggcgcgcgtggagtccgaacgcctgccccgcggcgccgaccccgcgcgtcacctcaaactgggccggggcggactgagcgacgtcgaatggcttgtccagctcctgcagctgcagcacgccggcagccacccggagctgcggaccacatcaacgctggaagcgctggacgctgccgcgcggctcggcctgctcgcacaggaggacgccggcctgctggccaccgcctggcggcttgccagccggatccggtccgcgaacgtcatctggagcggcaaggcctcggaccttctgccgtcgtcccggcgggacctggaagccgtcgcccgctggtgcggatacgaaccggggcaggcagcggcgctggaggaggattacctgcgggtcagccggcgggcgagggccgtcttcgagcgggtcttctacggacagtagccggcaggaggtggcagggacggctgacgcctgtcagggcccggtgctaggttgggcgcatggctagccaactcttcctcaacctgcccgtccaggacctccaacgctcggtcggtttcttcacggccctgggcttcactttcaaccctgacttcacggacgaaaacgccacgtgcatggtggtcaacgagaacgcgtacgtgatgctcctggtggaggcgtacttcaagaccttcaccacaaaggaggtcgccggcaccaagggttcagccgaagcaatcatcgcctactccgtggacagcagggaagccgtggaccaggcagtgcagactgccctggccaacggcggctccgcgtcccaggatgcccaggactacggctttatgtacaaccacagtttccaggatccggacgggcacctctgggaggtcttctggatggacccggctggcccgccggacgcgtccccttcagaggaagcttctcccggaccgcagtcctgagcggcatgggcacgggcgtctggctgatctcgctccaggacctcgacgacgacgcccgcgccatccacctcgaggcagttgccggactcgaagtgggcccagggcaggacaggtttgttggcgatccgctccgcatggccctcaccgggcttgccgaggaatcacgccggccctatgttatcgagtccgccggccgggccgtcggcgtcctgaccctgcaggccgcggcggcgcgcctggcaggctggccggacgaccactctgcgtggctcctcaggggcttcctgatcgacaggcacgaacagggcagggggctcggtccgctcgcggcagccgctgccgtatccgccgcccaaaaactctcggccaggcaccacaccggggaggccggcgtcgttctttccgtcaatgaagcgaacgctgcgggcctgtccgcctaccgccgggccgggttcgtggaccggggtcagtacaccggcgggcaggcgggtccgcagcggatcatgttccgcagtttttgaccacaatgacataacaggcggcgggccgcattgcgctgagaaagcgattgcccgatcatgtggaatggcggtgttcttcaaccttgttggggggagggctgaaactggtcttcgtcccggggggcattcgtcagggggtccggctcccggtctcagcacgtctggagccgggctcccaccttcgggccacacgcgaaaggcggccaccggtataccggtggccgcctttggtgtctcaggagacggtgatgctagacgccgtagtagagctcgaactcgtaggggttcgggcgcagggacagcgggcggatctcgttttcgtacttgtactcgatccaggtgtcgatcaggtcctgggtgaacacgccgccggcctgcaggaactcgttgtcctcgcgcagggcctccagcgcttcctcgagcgtgcccggagccttggggatgtccttggcttcctcggcggggagctcgtagaggtccttgtcgatcggggccgggggctcaatgcggttgcggatgccgtcgatgccggccatcagctgggcagcgaacgccaggtacgggttggaggaggggtccggagcgcggaactcgatgcgcttggccttggggttggagcccgtgatcgggatgcggatacctgcggagcggttgccctgcgagtagaccatgttgaccggagcttcgaagcccttgaccaggcggcggtaggagttcaccgtcgggttggtgaaggccaggacggcggaggagtgcttgagcaggccgccgatgtaccagcgggcggtgtcggacaggccggcgtagcccttctcgtcgtagaacagcggctcgccgccgttccacagcgactggtggcagtgcatgccggagccgttgtcaccgaagaccggcttgggcatgaacgttacggacttgccccaggcgtctgcggtgttcttgatgacgtacttgaacttctgcaggtcatcggcagcgtgcgtcagcgtggtgaacttgtagttgatctcggcctggccggcggagccaacttcgtggtggctgcgctcgacctcaaggccggcttcgtccagggcgacacacatggcgtcgcgcaggtcagcctgcttgtcggtgggggaaaccgggaagtaaccgcccttgacgggggtcttgtagccgaggtttccgccttcttcctcgcggcccgtgttccagtgggcttcctcggagtcgatcttgtagaagctgccctgcggggaggactggtactgcacgttgtcgaacacgaagaactcagcttcgggagcgaagaatgcggtatcggcaatgccggtggaggccaggtatgcttcggccttctcggccacgccgcgggggtcgcggtggtacggatcgcccgtgcgggggttgacgatggagaagttcagcgccagcgtcttctccatgcggaaggtgtccaggaacgcagtggtgacgtccgggatcagttgcatgtcagattctgcaatgccctggaagccacggatggaagatccgtcgaagagctggccgttgatgaagaagtcagcgtcaacgctcttggccggcacgttgaagtgctgctggacgcccgggaggtcggtgaagcggatatcgacgaatttaatatcttcgtccttgatgaacttgaggacttcgtccgcagtcttgaacatctatgctcctaacgcatatgtaatatctggctggcaagccagctgatccagcgcaatccgaagcgcagggaaacgcagtttccctgctgtaagtaccctgctggtattacctgccctgtactgcctggcggcggattgcttgaaactggtaacagcctatggacgcggcatttcccgtccgtgtccgcattgtttcgggcaggttacatagtgccctgatatggcaacgctatcttccgtccactctgtggtctaaccccatccacagtgtggtcggcgggaagtcgctaagcttgagccgtggtagatcgtaaagacatcggctcctggctctccggacccgacacatcgggcatctcgaaatatccgggcgagcggctgggactgcccgagtcagggccgggctccatggcgcgggccggccgcaggatcgcggccatcatgatcgactggggcatcgcgctgctcatcagcaactttgctttcgggggcgatccgtgggccaccctggcgatcttcgccgtcgaacagaccctgctgataggaacccttggctacagcatcggacaccgtgccatgggcatccacgtggtgaaggccggcggcggtcccgctgggccgcaggccgcgctggtgaggtccctgctgctttgcctggtcatccccgcggtcattttcgaccccgaccaccgcggccttcacgacaaggcgatggacacgctgctggtgcggcgctagacggagctggcttcccgaactgccgtggtgccctgcgatgcccgtgcggcgtccaggtagtcccgcttgtctgcccagcgctcgaacaggaccgtggcgaacggaaaaacggcggagatgcctgcgaacagcgccacgacgaagggccaccgctgcagcttccagagggcaagggcggcgatgccatagcccacgaacagtgcgccgtgtatgggtccggcaacctggacgccgatttcggtggtgccggcaatccacttgaagtacatgccgataaggagcgccgcccagctgaaggcttcggcgatggccaagatccggaatgcccggatcacggctgttttcttgaagatcacgatactgtcctctcctgccgtgaaagcggcaaagaaacgccccggctgccggccggagccggaaccggggcaggttcaaaaactagcgtccgcggttgggacgtgccttgtaggggtcgatgcccttggggatcgggagacggttgcccagtgaggcgatgcgcttggacactgcgttcacctcaagcttggtcaattcctttttgagcttgcccatcttcttggctacctcgctgatgggcacctgcccctcgccccggccgctttcgatgacgtggacagtgacgttcggcaggatgcgcgcaaggcgtttgcgttccgcgtccagcagcggctttacccggtgcgtggggccttcgctgacgaggacgatgccggggcggccgatagcgcggaagacggcgtcctgcgtccgcgggttaaccgcaacaggctgttcctcggtgatccagccgcggcggagcgttcccagtgcggcgccggaagcgccgggctggttctcgatctgggcgaatgcggcgcgctctgccctgcgggacaggatgaacgtggcgccgagcaggcccaaggggatgccgatgatcaggccggtgatccagttatccagccagtagcccaccaggaagctgacagccacgacgccaaggaataccagcagcatgagccacggaaccatggggtcatgacggcgggtcatggtgaagacttcgcggatctgcttaagccggctgggcttcttggccttcgcttctttcggcttgcgggagaagaggccacgcttgactgcgctggagccagacggagtggagttgctggaatcaggggatttcgccatagtgccttaattctacgtgaccaaagccgaaggaccggcaccggattattcgggtgccggtccttcggggacgctgcgtttcgttcggaactgcagatcagtggtgtgccgcgatgagtgagctggcttcctggcgggtgctgccggaggactcgatgtgggcgagttcggcggggatgtcccagcctttctttcgcatcgcggtggcccagagccgcccggcgcggtaggaggaacggaccagcggcccggacatgacgccgaggaacccgatctcggtggcctcgtcctggaggtccacgaattcctgcggcttgacccaccggtccaccggcaggtgccgctcactcgggcgcaggtactgggtgatggtgatcaggtcgcagccggcctcgtgcaggtcccgcagggcctctgagatctcctcgcgggtctcgcccatgcccaggatcaggttggacttggtgaccatgcccaggttccggccctgcgtgatcacatccagggaccgctcgtaccggaacgccggacggatccgcttgaaaatccgcggcacggtctccacgttgtgcgcgaacacctcgggttttgaatcgcagatcgctttgatgtgttcgggtttgccggagaagtccgggatcagcagttcgacgccggtgccggggttcagctcgtggatcttccggaccgtctcggcgtacagccacacgccctcgtcttcgaggtcgtcgcgggccacgccggtgacggtggcgtagcgcagctgcatcgcctgcacggagcgggccaccttggtgggttcgaacatgtccaccggggagggcttgccggtatcgatctggcaaaaatcacagcgccgggtgcactcggacccgccgatcaggaacgtggcttccttgtcctcccagcactcgaagatgttggggcagccagcctcctcacacaccgtgtgcaggccctctttcttgaccaggttcttgagctggacaaactccgggcccatctggaccttcgccttgatccactccggcttgcgctccaccggaacagcagaattgcgctgttcaacgcgcaaaagcttccggccttcaggtgccaatgtcacagtagagctccttcgggggtagcgaccagggcgtcttcattcttgcgcagttcttcagtaatgcgggacacgaggtcagccgggccgacgtcatagccggtttcctgggcgatggttgtcacgccggcgtcagtgatgccgcaggcgatgatctgggaatagggggtgaggtcgttgttgcagttgatggcgaacccatgcatggttacgccctcatgcacccggatgccgatggcggcgatcttccggtccgggcccttgctgtccgcggtgatccagacgccggccctgcccttgatgcggactgcggtgattccgtaatcggccaacacagcgatgatcacggcttccaggcgttccacatagtcgcggatgcctgcccggttcttcagcttgataatgggatatcccaccagctggccgggcccatgccatgtcagttttccaccccggtccacgggcaccaccggcgtgccgtcgaagggccgttcatgatcctcggtccgtttgccggcagtgtagaccgccgcgtgttccaggaggaggacagtgcttggggctacccccgcgaccactttgtcgtggagttcgctctggatctgccagccacgggtgtagtcgacaaaatcgggagcaagacccagctgtgaaaactcaagagtcatggcatccagcttagaccccgtggcgttccgtgcccggtttagtgcttaagctcacccgccagccagaggcacgtcacacgcactcccactgtggcagcacgctgccgcgtggcctgtggataacttctgcacggcgaacgggattcggctagacatgtcgtatggaaatttcgcaggttcccgaggtgcccggcttcgccgtgggacgcatgctgggccgcggagggagcgcgacggtctggctggccagggaaaaccggaccggccgggactttgccctcaagtgcttccaccccggcaagggcggtccagccggcggtgaaccgctgaccggggacgcggtccggcgtgagatccgcatcctgtcggtcctggaccaccagcacctggtcaaagcacatgacgccatccgccttccgggactgccggaagacggcacggccctggtgatggattatgctcccggcggctccctggccgccctggtggccagccgcggaaggctgagcgttggcgaaacggtgacggtgctgacacccatcgcccaagccgtgggatacctgcacagcaagggattcacccacgcggacgtctcgccggggaacgtcctgttcaccggccagggcaaacccttgctgtccgacgtcggcatcgcgcgtatgctgggcgaccccggctgtgctgcagcgtcaggaactccaggcttcgtggacccgtcaccggtggacgcagtgcgtggcctgcaacccgaaagggatgtcttttcgacggcggcgctgggctggttctgcctcacaggccaggctccgccaaggacctcgggccggccgccgctgccgctcctggtccccgacgttccgcgggagctggcggctgcgctggaagcaggcctgaacgaggaccggcgtgcccggcccaccgccgcggcgctggcaacggccgtctaccgcagcgcgtcgccccggccacttgacctcgcggcctccgtccatcccacggtgattccggagctgttgacccgccggcaggattcggcaacgtcccggccgcgggcagctgcggaaaagtacaaggccgcaggcaggtggatcgccactgccaggtggtcgggcctgcccttttccgggccgcgcatgccgttcccgcagtccgtcaacgaacgccgcacctccgccgggaagcatgccggcccagcacatgttggcacagcagatgttggcagtgcgcaagccgccccagcagagtttgtcacagcagatgccagcacagcacaacccggcacagcagatgccggcacagcacaacccggcacagcagatgccggcacagcacaacccggcacagcagatgccggcacggcactgcccggcctggctcacatgggcaggggacggcgccgttcgtccctgcggcgccgcgtgccactgttgcgcgggatcctcccatcgtccgccgtggtagtggtggcggccgcggcgtggtggcttgcgggagctacgggactgccggccggaccaggtcctgcgtcagagtccgtcactgcgccggagtccgtcgtggggcaggaacccgccagcggacagggtcccgataatccggcgggtgggactgaggcacatgaaacggcggcaagcgaaacagcgaaagccttctccggcgcctcaaccgaaagtggcggaagcgaaaagggagcagacaagaacagccggggcgatgctagtggcggccctgcggtggccaggcagcaggcgcgggcgtcggaccccatccaggctgtccagggcctcgctgccctgcgggacctggcgttcagcacaggagagctcggcctgctggacgaggtgaatgcggaaggttcgccggcagctgccgccgatgggcggacggccgaacggcttcgcagctccggccacgtcctcgccgggttttccagcacccttgcggacctccgtacggaggacggtgccacagccacccacgccgtggtgcaggtgcgctccagttcttccgcatatgcggagaggaatgccgggggctccatcgtaggggagggcccggccggcaccagccgccagctccggctggtcctcgtggccgtggacggcacatggcgcatcagtgaaatcctcccaggggactgatcctcgcgggtccggtccggttttcgtgcgaccggttttcccggtccgttgcccgttgcccgttgcccgttgcccgttaccggtaccggtaccgtttccgcccgccgtgccgcttcgcctgtgccgcttccgcccgcacatgggacttccggcgaagcgtgcgtggcggagcctctgcctgcctagtccttgccggcaacccactgggcggcctgtgccaccgtggggtgctgccacacgaacctggcctccaggagcaccgcgggttccatacgctggctggaaaggaggagttcctccgccagatcacgcatcagcagccgcagcacaggggccggaacccgcagggctgccggccggtgcagtgcacgggcaatttcccccaccagggtgctcacgtcagcctgctcgggagcgcagaggttcacgggcccgctgaccggtgactcaagcagaaagaggaatgccgctgatacgtccggcagggtgacccagggccagtactgccggccgcttccgagcggtccgcctacgcccagccggatcaggggcagcagcctgcccagcgcgccgccagaccggctgaggacaacgcctgtccgggtagtcaccacccgcacccctgccggagccgaacgggccgcgtcctcccactcaacgcagatccgcgacaaggttcctgatcccggcggtgcggattcccggaggacggtgttgccggcgtcgccgtagtagttcgagccggactggctgataaagaccgggggcggggaatccaattgccgcatcgcgtgggtgagcgtccgcgtggagccaacccgcgaattgaacagctcctccacccgtttgcgcgtccagggccggtccccgattccagcgccggaaaggttaaccacggtatccgccccggccagcgcctgcggatccaggtccccggccgcgggatcccacctgatctcggacgcggaggcagggtcccccctgacgagggacacgacgtcgtgtcccgccttcgtgaaggtgtctgacatggaagtgccgaggagcccggaggcgccggccatgacgatgcgcatggtccatctcaccacgccgcagcgccggcggcacctcccgacaggccgcaggagggttgactatgatcgaacgatgaccttttccagctacttccgtttcccgcatctgcacggcgatctggtcaccttcgtggccgaggacgacgtgtggatcgcgcccctgggcggcggccgcgcctggcgcgtctcggcactccaactgcccgcccgcaacccccgcttcacccccgacgggaagcggctggtgtggacggtggtccagggaacggcgccggaagtggtatcggcagaagtcgacggcggcgggtaccggcagctgaccttcttcggccacagcacaacgagggtgaagggtttcactgccagcggttcggtggtggtcaccagcgcgttccgccaggccgaaggcaggcacacgcacgcctacagcgtcccgctggagggcggctgggccgaggagctcccgtacgggccggttgagtccgtcgcctttggccccgaggtgggtgacgagcggccagtggtggtgggcagcgtgctgtcccgcgaacccgcctggtggaaacgctaccgcggcggcaccgcgggaaagctgtggatcgacgccgacggcaacggggagtttgaacgccttgtgccggagcttgacggcaacctcgccgatcccctgtgggtggacggccggatcgccttcctttcggaccacgagggctacggcaacctgtattcggtccttcccagcggaaaggacctgcgccggcacacggaccacgaggacttctatgtccggcatgccgccaccgacggcaaacgcgtgattttcgaatccgccggcgagctgtgggtactgcacgatctcggctccgacgccgtgcggttgaacatcacccttggctccgcctcgcagtctaggcgtcctgccctgctcaagaccgccaagcacctcggtgcggcagtacctgacacgaccggttccgccagtgcaatcgaagcccacggcaccatccattggctgcgccacaaggacgggccgtcccgcatcatcgaggcgacgccaggtgtccgcgcccgcctgccccggcccctgggggacggccggattgcctacctcgccgaccacgagaatgtggaggcgttgtacatcaaggacatcgcggcgcccgtgccgcatgccgggattgccggcacggacgggagagcggcgccgggtgccgccgcagcccgcagcacggcggacgttcctgtgccggtcgccgcaggtaaggaagaagctgtggtgctgccgcaaccggtcccggctgccggagctgccgcgctggccgggaaggctgcgccagccgggaacgctgcgctggccgggaacgccgtgcctgtccacgcctcggatgagcaggccgacgtcgctcccgaagcaggcacctccgccgcggaagcacaggcacttccggctgcaacccgcatcgactttccgcgtccctcgcgggccagcgccctggaagccagtcctgacgggcaccggctggccctcggcacgtccttcggcgaggtttacgtggcggacacccgtacgggtgaactgacgctggtgtccagcatcggcgagggcacggttgccgacctttcgtggtcggcggactcgcggtggctcgtatggtcagagccggtcacatccttcggctcccgcagccggctgcggatggccaacgtggcaaagccgggttccgtcccggtggatgtcacggatggccgcttcggagacaagtccccggcgtttaccccggacgggaagttcctggcgttcctgtcgaaccgcagcttcgaccccgtgtacgacggacattccttcgatctctccttccccagccccatcaagccgtacctcgtggcgctcgccgcggacacgccgtcgccctttggtcccgcggtggactccgaggcgggggaagctgcagggggagacgggtcggcgcaggaggcggaaacggcagcaccggacgtccgggtggatgccgagggactggcccaccgggtcatcaccgttcccgtgccgcagggtaactacacttccctgaaagcaactgagggagccctgctgtggctcgactgggccctcgccggggtcaccggcgacggcaaggccagccaggacgacaaggacgcccggcccagcctggtccggttcgaccttggacggcgcaagcagaccacgcttgtggacgcgctggacagcttccggctgtcaggggaccgcagcaaggtggtgctggtctcggacaagcaggtcaccgtggtccccgccgatgccaaggcggatgaggaatccgggaagctggtcaaggtggacctcggccggatccgcgtcatgatggaaccgctcagtgtgtggggccaggccttcgacgaggcgtggcggctgcagcgcgatttcttctggaccgaggatatggccggccaggactgggagtccatctaccgccgctaccgtcccctggtggaacgcctgggctcgcatgatgacctggtggacctcctgtgggagctgcacggcgaactgggaacctcgcacgcctacgtccggccggcgcttgtcacggagaacggcagccacggccagggcaggctgggcgccgacctggcctacacgtccggcggatgggaaatcacccgggtccttgccggcgagtcctccgacccgctggccacgtcacccctgaccagacccggcgtcggcggcaaggcgggggacatcctgctcgccatcgacggcgtaccgctctcggaaaacgtcaccccggccatgcagcttgtcggagccgcagggcgcgccgtcgaactgaccctcctgaacggtgctgcgcacggagccgcagcaggcacccagcgccgcgtcgccgtcgtgcccgtcaaagacgaggagcgcctccggtaccaggaatgggtggcctcgaaccggcgcaccgtccgtgaagcgtcagcgggcacattcggttacctgcacatcccggacatgatggcgaacggctgggcgcagctgcaccgggaccttgacaccgaaacggcgctggacggactgatcgtcgatgtccggcgcaaccgcggcgggcacacctcgcagctggtggcagagctcatcggacgcaaggtcaccggatggagcatgccgcgcggggagaagccgcggacatacccccatcacgcgccgcgcggcccggtgatcatcctggccgatgagtttgccggctcggacggggacatcattactcaggtgtcgaagctgaggggaatcggaccggtcatcggaacgcgcacctggggcggggttgtgggcatcgacaaccgcttcgcccttgcggacggcaccggcgtgacgcagccgcggtacgccacctggttcggcggcggggtgggctggagcgtggagaactacggcgtagacccggacatcgaggtcacgttcccgccgcatgcctacgccgcgggccgggacccccagctggagtacggcattggcgcgctgaaggaaatgatccaggaactgcccacggaccgtccgccggcccgcgaaggctaccgccggctgcgtcccgctccgctgccggcacgccgccaggggaagtagcccagcagcaaaagaagcatttgtaaaaaagcgcagcgcagcaaaaagccctgcccggccgggatggccaggcagggcttttcgctattgccggttcaggactccagggtcgcatccagggtgatatcaatgctggccagggcgccggacacagggcagcccaccttggcctcgcccgcgatcttctggaactcctcctcggaaatgccggggatcctcgcggacatggtgaggtggctgccggtgattcccgtgccgggaacaaacgtcacgtcggccttggtgcggacttcctccggcgtgtggcccgccttatcgagctcgttgctgaaggccatggagaagcacgcggcgtgggctgcggcgatgagttcctccgggctggtcttgccgttggccgcttcggtgcgggccttccaggtgacgtcgaacgtgcccaggcctgaggtggccaggctggtggtaccggaaccttccgtcaggttgccgttccatactgcgtttgctgaacgtgttgctgccatgttcactcctcaggtcgatgtgtaccggggcaggccgctgcctgggccccgccgtgttccatcctagggacaacacccgcggcgtgcaccggctgtccgctgtcagaggattatgaccggggcgtgagacgacgacggcgacgctcccgcatgcgggagcgtcgccgtcgtggtttcggcgtggggctgctactgccagagcgtcgcgatggcgatgttcagcagcgcgagtccgcctacgccgtgcgccaggcctgcgctgatgtcctcgcccttcttgtatttgcggcggccaatgaaggcgagcacgccaacggccagggccacagcgaacttaatgccgagcttgaagtaattggcgtccatgtccagggccgggataagccccatcagggcgacgccggtcagcagctggagcatggcgccgtcgaactggcgggggtggacggtgggcttcttcatctggccgatccagatgccgacgatcatggcggcgccgacgatatgcaggaagaccacgatgttatagacgatgttcatgggaccagtgtagccattcgttctaccgggcgtagtaaggaggcgggggacgcctggtgccccgtccgccgtgcttcccgggcgggggcccggagcagcaacaggagtgttaaacgacgacggcggtgcaggccgtccgggagtgatcccgccgttgcctgcaccgccgtcgtgtgcgtccgggtgttacagccccaggtccgcttcgaaggcgccttcttcaaggcgtgccttcagggtctggaggaaacggccggcgtccgcgccgtccaccaggcggtggtcgtacgtcagggaaaggtacatcatggagcggatggcgatcgaatcgtcaccgttctcatcggccaccaccacggggcgcttgacgatggcgccggtgccgaggatgcccacctgcggctggttgatgatcggggtgtcgaacagggccccgaccgagccgatgttggtgatgctgaacgtgccgccggacagctcgtccgggccgatcttgccgtcgcgggtgcggccggcaacgtcggcgatcttgcccgccagtcccgcaaggttcaggctgccggcgtcggaaatgaccggaaccagcaggcccttgtcagtgtcgacggcgatcgccaggtgctcggcgttgtggtaggtgatctcctgcttgtcctcatcgtaggcagcgttgagcttggggtgctgcttgagggcctccgcgacagccttggcgatgaacggcaggaaggtcagcttggtgccgttctgcgcctggaaggagttcttggcgcgggcacggagcttggcgaccttggtcatgtccacttcgtggacctgggtcagctgcgtggagacctcgagggattcgcgcatgcggcgggcgatgacctggcggatgcgcggggccttttgggtggtgccgcgcagtgaggaagcagcctggcccgcggacgcggaggctgccggggcggacgctgccggtgctgcaggcgcggcggcgggagatgcctctgcctcggctgcggcgatgacgtcctgcttgcggatgcggccgccgacgccggtgccggagagggaggtgatgtccacgccgtgctggttggccagcttccggaccaggggagtcacatagccggactcggagccgcctgctgacggggcagcttcttcggaagccggtgcagcagcctggggagcgggtgcagccttgggtgcctcctgcttgggtgcttcctgggcgggagcggcctgcggtgcgggtgcttcagccttcggtgcttcggccttgggctcttccttggccggtgcctcggtggaaggggcttcggccggggcggcagcagcgcctgaaccgattacggcaaggacggatcccacttctgcggtctcatcctcgttgacgcggatttcctggagggtaccggccacgggggagggaatttcggtgtcgaccttgtcggtggaaacctccagcaggggctcgtccacctccacggcgtcgccaacagccttgagccagcgggtgacggtaccttcggtgacgctttcaccgagggccggcagggtgacgtcgtggctttcgccgccggccgccggtgcctcgggtgcggacttttcctgcgcaggtgcttctgcgggggcaggcgcctcggtggagggagcttcggcgggagccggcgcttcctcggcagcaggggcctcttcggcgggagcctcttcggcgggcgcgccgccgccggagccgtccccaatgcggaccaggggagcgccgacctcggcggtctcgtcctcggccaccaggatttcctcaatcacgccagctacaggagaggggatttcagtgtctactttgtcggtggagacttcgagcagcggctcgtccacctctacccggtcacctacctgcttgagccagcgggtgacggttccttcggtgacgctctcaccgagggcgggcaagttaacggattcagacatgtcgtccccgttctccttattgatctttagtgcggatgattgctgcctgttggccagcctagtgcacccggcattccgtgccgggtgcaccaggcccttgggttttggggagactagccgtgaagcggcttgccggcgagtgccaggtgggcttcgcccagggactcgttctgggtggggtgggcgtgcaggagctgggccacatcctccgggtacgcttcccagttcacgatcagctgggcctcgcccacctgctcgcccatgcgggcgccgatcatgtggacgccgaccacggggccgtccttctgccggaccagcttgaccaggccggaggtgcccaggatggagctcttgccgttgcccgcgaggttgtattcctgggtctgcacctggtcctcgccgaacttctccttggcggccttttcggtgtagcccacggtggcgatctcaggctcggagtaggtgaccttggggatgttgatgtcctcgaccaccacaggcttcaggccggcgatttcctcggccacgaagatgccctgctggtagccgcggtgcgccagctggacgccggggacgatgtcgcccaccgcgtagatgttgccgacgcccgtgtggaggcgctcgttggtgatgacgaagccgcggtcaatggtgatgcccgcttcctcgtagcccaggttggcggtgacggggccgcggcccacggcgaccagcagcaggtcggcctcgaacgtcttgccgtccaccagggtgaccttgacgccgtcgtcgttctgctcgacgccctggaagaacacgccggtggagaacttgatgccgcgcttcttgaaggcccgctcgaaattcttgacgatggtggcgtcctcgttggggaccagcgagggcaggccctccacgatggtgacgtccacgccgaaggacttccacaccgacgcgaactcgacgccgatgacgccgccgcccaggatgatggcgctcttggggatgaagtccatggtcagcgcctggtcggaggtgatgaccttgccgccgagctccaggccgggaagggtgcgcgagtaggaaccggtggccaggacgatgttcttgcccttgtaggcggtgccgttcaccacgacggtgtcggtgccctggagcttgccttcgccctcgatgacggtgatgcccttggacttgatgagtccctgcaggcccttgtacttgccggcgatgatgccgtccttgtacgcgttgacggcgttgatgtcgatgctgtcaagggtgacgttcacgccgtacttggcggagtcgcgggcgtggtcggccagctccgccgagtgcaggagggccttggtggggatgcagccgttgtggaggcaggtgccgcccagcttggccttctccacgaggccgacggtgaggccaagctgtactgcccggagagcggcggcgtatccgccgctgccgccaccgagtaccaggatgtcgaattcttgcgcagttgcctgatcggccactaaaacgctccctcgcgtgaacgatgacgcggtcctgcgcatcatctggtcttggaacttgcactgccgtgattatgccagcaggccaattctcttgcatttgtgactaccgtggttcaccttagcgaaccacttatccatgctccaccctggcaccacgtttgtggagcgcttgtgtcgagtgtcacgcggctttgtggcacagggatcaccggtcccgcaaagccgcgtcacagcacgtcggaggccgccaaaggggtcaggcggcagccaagatgtcctccacgtatgccaccagggtccggaccgtgcagcccgttccctgcttgtgcgtgtagccataggggctcccgttattaaaggagggcccggcgatgtcgatgtgggcccaggggatctgttccccgtccttgcccttacccacgaactcccggaggaaaacggcggcggtcatcatgccgccgtggcgttcgccgatgttggcgaggtcggcgacctgcgaatcgaggctgggccgcagttcctcgggcagcggcatgggccacacgagttcgccggcgcggtccgctgccgccttgagtggcgccgtcacgctgtcggatcccatgatgccggcggtccggttgcccagggcgatcagctgcgcgccggtgagtgtggctacgtcgatgatggcgtccgggtgctcgcggctggcggcgacgatgccgtcggccatgaccagccggccctcggcatcggtgttcaggacctcaacggtcttgccgccgaacatggtgaggacgtcggccgggcgggaggcggcgccggagggcatgttctcggcgatgcagagccaggcggttgccttgaccggcaggccgagccccgcaagggccaggacagtattaaggacgacggcggcccccgccatgtcgctcttcatgtcgcccatgccgagggctggcttaatggagatgccgccggtgtcgaacgtgatgcccttgcccaccagcgcaatctttgaggttgccttggcaggggagtactccaccttcaccaggcggggctggcgtgccgagcccttgcccacgcccatgatgccgccgaagccttccttctcaaggcgcttctcgtcccagacggtcactttgacgggcagccccttggcgagctccttcgccgcctcggcgaaggtttccgggtaaaggtggctgggcggctggttgaccagggaccgggtggcgttgacggccctgccgatcagcgcggcccgcttgaggaccgcgtccagttccttctggccggccagttcagtgaagatcacggcgttgcggacggggtccttcaggccgtccttggaggaccggaactcgctgaaggaataggcgcccagcgcggcaccctcagccacggcctcgacgtcggcaagggacgccgtcgggaatgccagggcaacggttgccaggccggcgagctggcggatggcggagcccgctgcacgccgcagggcttcccctgccagtggcttcgaggctgataccttgcccaccccggccaggaccagaacgcccgcaccggtctcggggaggcccgggaggcgcaccagctggtccgccgcgcccgtgattccgagggccttgagggaatcagccagcgcctcggcggaccgggctgtcagcgggttgtccaggaggacgggtccgtccgcaccctgccccacacctatgacgacggcgtcactggggcttttcttcaggtcccgcgagagggtactaaggttgatttcagtattcttgaccacgcggatcagtcctcgattctcgaaagatgttcgggcaggggtgcatgttcggcgctctgccatggttccccgggtaccgccgttcggaacgcagtccgggtgcctgcgggcccgcctggcaggccagttccgatcgtagcccgtccatgtctgagctggtgaatttcgtgagaggtgcgccacagccggcgccggaatgcccggctgtcccggggcgttgtacagaatgtccacccgcacctgtgaaaggaacatgccgtgcttgaacggatctccggctccctgctggaccccgatgcgctctatgcgagcaacattgagctgttccacagccccgaactccgcgggctgaacctggtgatgggctttaccggcttcgctgacgccggccacgtggtgaagcagatcaatgccgaactgctggattccctcgacaccgagccggtggccgtttttgatgcggaccagctcattgactaccgctcgcgccggccgcacctgacattcgtggaggaccacctccaggattaccaggaaccccggctggccctgtaccggctgaaggacgggctgggtaagcctttcctgctgctggcaggcttcgaaccggacctgcagtgggagaggttcgcacgggcagtggtgggcatcgtggagaagctggacgtgaacctggtgacctggatccactccatccccatgcccgttccccacaccaggccggtgggcgtgacagtgcacggcaaccggcctgagctgatcgagggcatctccgtctggaaacccacggtggaagtccccgccgccgtgggccacatcctggaactccgcctggtggaggcgggacgcaacgtggccggctatgtcatccacgtgccgcactacctggccgaggcggaataccccaccgccgccgtcgcaggccttgaatacctgggcgccgccacatcgctgatgttgccctcggacaggctccgcgaagcaggccgcgaggtaagccgccagatcgcggagcagatcgacgcctccgaggacgtccagcaagtggtgtcccggctggaggtccgctacgacgaaaaggccgagggcacggtccgccgctcgctcctggcggacgagaacgatgagctgcccaacgccgacgacctcggggctgccgtggaggcgtacctggcccgggagaacccaagccagtaaaggccgcggctggcgcccgggcataatgaagtggtgactgcaccccgcgcctggctgatctggaccattggaattttcgggtacctggtggccgtggcgcagcgcacgtcctttggcgtggtggggctggaagccacggagcgcttccaggccagcgcgtcagcgatctccttcttcacagtcctgcagctcctcgtctatgcaggcctccagattcccgtgggcctgctcgtggacaggttcggctcccgtgccatgatcgccggcggcgcagtgctcatgggcctgggccagctccagctcgccttcgcagacagcattcccgggggagtggccggccgggtcctggtgggggccggtgacgccatgacgttcatttccgtgatccgcctgattccgctctggttcgctcctgcccgcgtgccgctggtaacccagctgacgggcatgtccggccagctcggccagctgttcagcgttatcccctttgccttcgtcctgcatctcgctggctggaccccggcgttcctgatgctggccgggatgtcagccctcgccgtcgtcctgaccctggtgctgctgcaggacgtcccgccgggaaccgcgcgcccccacgcgcagcaggggctgcgggctacgggggcctcactcgcccgggcctggcgacagccggggacgcgcctggggctctggagccacttcaccatccagttcagcggcaccgtgttcgccatgacctggggctacccgttcctgctctccggccagggcctggacgccggaacggttgcggccctgatggccctctacgtcgccgccgcgatggcggtggggccgttcatcgggcgcttcgtctcccgccatccgctgcggcgttccaccatggtcctgctcatcgccggcgcaaccgcaaccgcgtgggcggccgtcctgctgacccccggccgtgctccgctgtggctcctggccggtcttgtggtggtgctcgccgttggcggcccggggtccatgatcggcttcgactttgcccgcaccttcaacccggcgcaccggatcgggacggcgacgggtatcgtcaacgtgggcgggttcattgctgcccttgttgcgattttcctgatcggcctcgtgctggacatcctgtttgccagcggcttttcccagggcgtcctttacggcctggatcctttccggatcgccctgagcgtccagttcctgctgctggggttcggggcagcagccatgctcgtatgccggcgcaaagtgcggcggcagatggctgcccagggtgtggttgtgccaccgctgcgcagcgcactggcccgccagcggcgcgagaaccttgcccggcggcgcgggtcctcactcccggaagggtgacactggtcctccacaggccgggtttccccacataagggcgggttgcccacatagccgcgttccgtccttacccggtgccggcgggcatcggaggctggagccatgacttctccagaccacctgacagtccgcagcccggaagacatcctgggcttcattccgcactcgctcggatattggccggcgcagagcctcgtggcgatgaccctgcagggtacgaggcttggcgctaccctgcggctggacctgccgggacgcgaggtcctggctgcaccggcaaaattcctgcaggccgtccggcgctacctggaagcggacaaggaagctgacggcacattgctggcgttcttcaccagcaacagcagcgcgtcgtggccgtccccgtacgacggcctgctggccggcctggactccatgctggaaagggccgggatgccagtccgggaggcctggtacgtcggcgacgatttctggcgggaggcctggtgcatggatgtgtcctgctgcccgctccccggccggccagtgcagcagatccgtgacagcaccctgaacgcagagatggtgtaccgcggaagcagcgttggcccgcagccggaggagcaggcaccgtccgggtctacggtttcaagcctttacctggctgccgtcagggaggctgaaagcgcgtggtccgcgcaactggaccttcgccgggcgagcaggccgcagttcgacgcagtcctcaggctctggtgggacctgctgaaccgcccgcagggggaggcctggctgcacgaggcggatcgcgacggattcctgcgggcatcgctgctggtccccgcctaccgggatgctgtcctgatgatggcggcagcgggcacacaggctgccgaagccggtgccgggcagttggggctcttccgggatgaatgcctcctggaccctgtggcgccccaggctcagctggcggggatggtggcgccccaaggggacttgttgggcgccggggcgtccgcggacgggctgcagggcggagcggcgcaggaagaactgtgcggggaggtactgcccggcgcgggcatgcccgcctatggcgacgtcctgatgggcgtggccccggccgtcccggactgggaacggctcaacgccctggacctggtccttgaccaacttgccgcagcgggcggacgggctgcggctgcatcgttcacggggagggggtggattgcctggtgccgcggccgcggctcctatgcggcggccaatctccggcaggcccttgatgcggaacccgggtaccgcctcgcggaactgctgctggaactggtccggcgcggaacactctgcggctgggcggcacggagggaggctgcctggcagaagttcggcccggacgcggcgtgaccgctgccgggggccgggggagcggcggcggacgggcaggaccgcgggtccgccgcgggcgggtgagtcacgggaaggcccgattcggggaaaacatgagacaatggaggccgagacccggttgggtccgtgtattgagcgcacattggtgaaccctgcggggaacataacagcggctccggcagttgtcttaacagactctgcaggccgtggtggcgcttggttttcaccacggacttgacagggtcatagtggtgttgcccgtatggtgattccacagaccaccgctagaaaggttttctgtgaccccgtcttccacgaagaaggaccccgccgcccaggacgaactgtccgccgaggagaagcaggctgcgaccaacgccaagcgtgcagctacgcgggcagccaacaaggcgtcggccggagcggctgcagcggacggcaagcccgagcccaagaagcgcggccccaagcccggtgccaaggcagcagccgcaaagtccgctgccggtgacaccgacgacgcagaagaagttgaggaagacctcgacgacatcgtcctcgaagggcctgaagtcattgaggaggacgccgaggccgatcccgccaaggcagttgccggctcaggcaagggcttcgtctactcggacgctgacgacgacgacgcgcctgtccagcaggtcatgtccgccggagccacggccgaccccgtcaaggactacctgaagcaaatcggtaaggtggcactgctcaacgccgagcaggaagtggaccttgccctccggatcgaagccggactgttcgccgaagagaagatcaatgcggacgacggttccatggacccgaagtacaagcgcgagcttgaattcatcatccatgacggcaagcgcgccaagaaccacctccttgaagccaacctccgcctggtggtttcgctggccaagcgctacaccggacgcggcatgctgttcctggacctgatccaggaaggcaacctgggcctcatccgtgcagtggagaagttcgattacaccaagggcttcaagttctccacctacgccacctggtggatccggcaggccattacccgcgccatggcggaccaggcccgcaccatccgtattccggtccacatggtcgaagtcatcaacaagctggcacgcgtccagcgccagatgcttcaggacctcggccgcgaacccacgcccgaagagctcgcgctcgaactcgacatgacccccgaaaaggttgtcgaagtccagaagtacggccgtgagcccatctcgctgcacacgccccttggcgaggacggcgactccgaattcggtgacctgatcgaggactccgaggccgtcgttcccgcggacgccgtgagcttcacgctcctccaggaacagctgcattccgtcctggacaccctgtcggagcgcgaagccggggtggtggccatgcgcttcggcctgaccgacggacagccgaagactttagacgaaatcggcaaggtctacggagtgacgcgcgagcgcatccgccagatcgaatcgaagacgatgtccaagctccgccacccctcgcggtcgcaggtgctccgggactacctcgactaaagcaggatgagctggaaaagcggcccgccggctgccgtgcccctcacgggcgtggcagcgggcgggccgcttttccattcccggcaggatgcgcgggagcagggcgtggccgcgccaggacggcgcccgtacacggcgcctaagcgggccgaggcttaaaagaattgggaccccaccttccggtggagtcccaacagcttggggaagctagtcgatttctacggctgccttctcgtgaagcttgcccgtttcatcgtgccagtcggagctcaagggcttcagggtcgcctcaactgcacgggcgtggtggccgcagaagagcagctcaccgccggaggactccaatacaacccggacataggcctgagctccgcaacggtcgcaccggtccagtgcattgagtgtgcggtctgccactgctgttgtcatgtcggcctccttagtagatcagtacgtctatataaccagcattcgtaacaaaaccatcgcaaggatggggcaagttcgctgtgcgcgtatccgcaatgtcggctcaagaacgtccaagcagcctgcgcacgccctgacgtggtgcggtccacaccctccgccaggtgtggcagccggaccgcaggcgccgcgccgactaccctagaggaagcgatcccagcccgctgttttacgtccctgaaggagctcaccaccagtggcaccaagttctgattacactgcccggcacctgtctgtactggagggccttgaggccgtccgcaagcgcccgggcatgtacatcggttccaccgactcccgcggcctcatgcactgcctctgggaaatcatcgacaactccgtcgacgaggcactggccggtttcggccacgacatcaaaatcatcctgcacgcggacaactccgtggagatccacgacgacggccgcggcatccccatcgacaaggaacccaagacgggcctgacgggcgtggaggttgtcttcaccaaactgcacgccggcggcaagttcggcggcggctcctacaccgcctcgggcggcctgcatggtgtgggtgcgtccgtggtcaatgccctgtcctcccgcctggacgtcgaagtggaccggggcgggaagacctacaaaatgtcgttccgccgcggcgaacccgggcgcttcaaggacaccgggtccaaaacggaccccgccgcacccttcgccccgttcgttgacgactctgtcctggacatcgccggcaaggccaagcgcggcgtcactggaacccggatccgctactgggcagaccggcagatcttcaccccggacgcaaagttctcctacgaggaactcgccgcgagggcccggcagacgtccttcctggtgcccggcctcaaactgacggtccgtgatgagcgaaaagtcccggggacacccggcgagtccggtccccacgaggaggtgttccaccacgacggcggcatctcggaattcgtcgaattcctcgccgcagatccggcagtcaccgatgtgtggcggctgcacggctccggaaagttcaaggagacggttcccgtcctggatgaccgcgggcacagccagcttgccgaggtggagcgggactgtgaagtggatgtcgcgctgcgctgggggatcggctacgacagcacggtccgcagcttcgtcaacatcatttccacgcccaagggcggaacccaccagtccgggtttgaacaggccctggtgaagacgttccgcaaggccgtggaaaataacgcccgcaagctcaaggccggcaacgacaagatcgagaaggacgacatctttgccggactgacggccgtcctgacggtgcggcttgcggagccgcagttcgaaggccagacgaaggaaatcctgggcacgtcggccgtgcgcgccatcgtcgccaaggtggtggaacgggagatcagcgccaagctcagctccgcgaaccgcaatgacaaggcccagtccgccctgcttctcgagaaaatcgtcagcgagatgaagtcccgcatctcggcccgcgtgcacaaggagacccagcggcgcaagaacgcgctggaaacttcctccatgcccaccaagctggccgactgccgcacggacgacgtcggacgctccgaacttttcattgtggaaggcgactcggcgctcggaaccgccaaactggccaggtcctccgacttccaggcgctcctgcccatccgcggcaagatcctcaacgtccagaaagcgtccgtgggggacatgctctccaacgccgagtgcgccgccctgatccaggtggtgggagcaggatcgggccgcagcttcgacctcgccgccgcccgctacggcaaggtcatcctgatgacggatgccgacgtcgacggagcgcacatccgcaccctgctgctgaccctcttcttccgctacatgcggcccatgatcgaggagggccgcgtgttcgccgcggtcccgccgctgcaccgggtggaggtcatcaacgcgggccaaaaagccaacgaaatgatctacacctactcggaggcggaactccacgtcctgctgggccggctggcgaaggagggcaagcggtacaaagagcccatccagcgctacaagggcctgggcgaaatggacgccgagcagctggcagagaccaccatggacccccgccaccggaccctgcggaaggtgggcatcgagaacgccaagcaggcggaggagatcttcgacctcctgatgggctcggacgtttctccgcgcaaggacttcatcattgccggcgcctcaagcctggaccgggagcgcatcgacgcctgacggcagcaggggaaggacgacggcgggactcagcccagcaggccgggcaccacgagcagggcggtgggcagggcaaggagcagcaccgatcccgccacgactatgctgcggatgggcgccggcagctccggccggggcgagagcagcctgctgacccgtgaggcggtggtccgggcggagtccgcgccggacgtgccggcagcggtatcaagcccggagagcgccgggctcgaggcctccgcgcggaggtccacgccgccgctgttcccggccgagccgctggccacaatggcgatggccttgatcagcgtggccttgctctcggtcttgagcgcgacgtcgtcggccagcatctcgatcagggagttaactgattcctgggcgaggcgggtggtcggcagccagggcagtgcctgccgccaggcggcgaaggcccacagcagcaggtggtggcgctggctcaggtgggcgttctcatggatcaggaccgcacggagttctgcgggctcaagggccgccatcaggccatcagagaggacagtgacggaccgtgcgccgccgggaaggcagtaagccacgggggagttgtggctgatgaccagggttccggtcccctcggcggacggtgaggccagcagggacagcagtacgcggtgccgccgccgctggcgctcgatcttgtagtaggtcagcagcagggtgaacaccaggtgggcggtgagcagcgccgccgcggacagggcgaagatgtgccagaagcccagggccgtggtgggggcgttgtgcagcaccatgccggccagcgcccgcaggcctgcgatcaggttgtccccaatcggttccaggccatacacgagcattgcgccgatcatggacagcccgccggccagcgctatcgcctgccacaagatcatggcggtgaacggtgagcgggctggccactgcgcgcgtgagaggaggacaggcaccggccacgccaggactatcgcaaggaccgccagcaggtacgaggcccagaacatggtccgctagctagaggtggccaagcagcttgcgcagagtctctgcttcaccttcggatacggacccgataaagcgggccagcactgcctcgcggtccggagccgaccccagtacctcgtgcatcagctcggcggtgtggtcctcgcggctggacactgcctggtagcggtgcggacgggtgccgcgttcgcgctccaccaggcccttcttctccagccgggacagcacggtgagtaccgtggtgacggcgagctccttgccctcgtggccggctgcgccgccctgcccggccgatgtctgcgcgagcctgtcccgcagcgtgttggctgtggctgcttcctggcccgcccagagcagatccatcactgcccgttccagttcaccaagactagccattgcacttttcctttgttccccgcgccaccgccgccgggcggaggtggctgcatgctgtgtttgaactacaacctccaatttacccggttttcccgagactttctacgttgggtagaacacgtggcgtgacgcggcccttgcctgccgtggcggggcagtggaagctggtttttacaccgctgccgccgttgttctacactcggtagaagttggagttctacaaaacgtagaagatctgcattcgctgacacgagggaccgccttggacgctatggacgcgctggaaatcgcacgctggcaattcggtatcaccaccgtttaccacttcatgatggtcccgctgaccattgggcttggcctggttgtcgcagtcatccagaccgcctggcaccgcacgggcaaccccgagtacctccggatgaccaaattctggggaaagctgttccttattaacttcatcatgggcgtagccaccggcatcgtccaggagttccagttcgggatggcctggagcgaatacagccggttcgtgggcgacgtcttcggcgcgcccctggccctcgaggcactgctggccttcttcgtcgaatccaccttcctgggactgtggatcttcggctggaagcagctcaagcccggcatccacctggcgtgcctgtggatcgccgtgatcgggtcagtcttctccgcctacttcatcatcgtggccaacagctggatgcagcaccccgtgggcgtggagatgattgacggccggccggtcatgaccgatgcgtgggccgtcttcaccaacaacacggcactggttgccgttccgcacaccctcttcggcgccctcgccgttgccggcggcttcctgctgggcatcgcctggtaccacctctggcgcaggctgcgcgacggcgtcgacacggtgggtgccgacggcaaggtcatcccgggcgaatcggcggacatcccgggccgggaccgcgacgaccacaaggtctggctccggtcccttcgcatcggcgcagtggtggccatggtctccttcgccggcaccgccctcaccggggacctccagggcaagctgatgttcgaacagcagcccatgaagatggccgcagcggaagccgcctgccatgacggcaccggcttctccgtcctgagcatcggcaacctcggttcacaggactgcgatgacatcgttgccctgattgaagtaccgggcatcctctcctacctggcgaagggcgacttcaccaccgaggtccaaggcgtcaacagcctcctgccccagtacaaggaggcctacgggacccatctgccggacaaccccatctacggcgaacgtgccggccaggaaatcgactaccttcccgtgatggaggtcacctactggggcttccgcatgatgatcggattcggcggactcgccgccctggcagccctggtggcgctgtggatcacccggaaggggaccgtgcccgaatcccggtggctcatgcggctagccgtgttcggcatcctggcccccttcggcgccaacgctgccggctggatcttcaccgaaatgggccggcagccgttcgtggtggcccccaacccggatcccagcggcatcgaccaggtgtttatgttcacggcggccgcggtatcgcccggtgtctccgccggggaactgctggcctcgctggtcaccctgacggcggtctatgcagtcctgctggtggttgaggtcaagctgctggtgaagtacatccgcggtggagtggtctccgccatgccggagctggtccaggcgccggttgacgaaaacgaggacgccaccccgggagccggtggccccggcggcggcaaacccggcgacgacgtcctggcattcgcctactaagccgcgcacgaaaagcagaggaaacaaagaaatggaactgctgccaaccgtctggttcattgccattgcggtgctgtggaccgggtacctcttcctggagggcttcgacctaggcgtcgggatgctcatgaagcttttcgcccgcaacaacacggagcgccgtgtcctgctcaataccatcggtcccgtctgggacggcaacgaggtctggctcctgacggccggcggcgccacgttcgccgccttcccgctctggtacgcctccctgttctcggccctctacctgccgctgctggtggtgcttgttgccctgattttccgggcggtggccttcgagtaccggggcaaggtggacaccgaccggtggcgtgcccgctgggactgggccatcgcgctgggatccttcttcgcggccttcggcgtgggtgccgcgctggcgcttaccaccactggcctgcctttgaacgccaatggtgaccgtgagggaggcccgctggcctggttcagcggatacgccgttctgggcggcctcgccgttgtgggtttctctctgatccatgcgctggctttcctggccctcaagaccgacggcgacgtgcggcaccgggcacggacatggttcgtgcgcctgcttcccgttatgctcctgcccatcgcggcgtgggcactcagcatccagttcctggaagggaagccctggacctgggcccttgtcctgctggctgttgccgccgcagccgcagcctgggggtgggcccgcaagggagcggagggcaaggctttttccgcccttggagctttcctggcactgggatcggcctcgatctttgcggcggtgttcccggtggtgctgccctccaccctcaacgaggcctttgacctcaccatctccaatgcctcctcctccgactacaccctgggactcatgagcatcgtggcggccttcggccttccccttgtcatcgcctaccaggcctggacctactgggtgttccgccgccgggtcagtgcagcgcacatcccggaggcccacagcttcctgccggccatcgccgccagggctttcacaacgaagggctgacatgcggccaagtttccctcccggtccggccacccgttccgccgtctacgtgctgggactgctggcagccctgaaggccctgtcgctggtcctgatgggccaggccgtggcctcggtgctggccggactggtggcgggagacccggactgggcaggccaggttaccctgggactggccggcgtggtgctgcggtccctgaccgtctggggacaggcagtcgctgcccggcgggcggcccttggcatcaaggaggagctgcgtgccgggctgctcgaacgggcgctgcgcaacggcgccaggggaaccggccccgccgacggcgggcttgccgtcctggcaacccgtggactggatgcgctggacaactactacacccagttcctcccggccctggtgaactgcgcggccatcccgctgctgctgggagcacggatcctcttcgcggactgggtcagcgcagtggtgattgtcctgacggtaccgctggtgccgcttttcatggtgctcatcggccggtacaccgaggacaacgtccgtgaagcgcaggcggccctcggcaggttgtccgcccacatgctggagctggcaaaaggcctgccggtcctggtgggcctcgggcgcgccacagcgcagcgcaaggccctcgaagagatctccgaggaataccgcacccgcaccatgggaaccctgcgcaccgcattcctctcagcgctggcactggaactgatctccaccatctccgtcgcggttgtggccgtgttcatcggcgtccggctggtgcacggggacatgccgctcgaggccggcctgctggcactgatcctggccccggactgctatctcccgctacgggaactgggcaccgcccaccacgccagcgacgacgggcgggtggccctcgcggaaaccaacgcggtcacggaggcccccgaaccccggccgctcccggcagccaaagcgggacggcccggtgcccctgtctccgtcacggacctgaccgtgagctacagcggaaggccgggccccgccgtcggcccgctcaccttcaccgcggcgcaaggcaggatcactgccctggacggagccagcggcgcaggaaagagcacagtcctcggcgtgctggcgggaaccattggggacggagccggcaccacggtcaccggcactatccggggcatcgaccgcagcgcgttggcctgggtgccgcagcatccggtcatgctcgccgaaaccgtcctggacgaggtgctgctgtacctctccggggacatcgagggctcccggggccaggccgggatggaagccgaagcgcgcgcatgcctggcccgcgccgccgcaggccacctcgcccaccagcaccccgccgagctgagccccggtgagctgcggagggtggcactcgccagggggctggcccggatcgaggcaggggccacagtgctggtgctcgatgagcccaccgcgcacctggacgacgcctcggccatggtggttgaagacgcgatccgccacctgcgcggacgtgtcaccgtgatcctcgtggcgcataacgggcgcacccgcaacctcgctgaccacctggtgccggtggctgcccacgcggagccagtccaggcaaagccagcccgggccggggaacgaaacctgcgggccaatgcactggccacagccgccgcgccggagcaatcctggccgaaacaagggcgtgccgcggacgtcccagcggaggctgggctggcatccggccctgctccggctgccggcacccgtgccggtgcaacctccagcggggccgcaggcacccgccaaacagcccggctcctcgcagcgctcctggcgccggtccgtggcaagttcgcagcggctgccgtcgtgggcaccctggcggccatcttcgccgtcgccctgtccggcctgtccggctggctgatcatccgtgccagcgagcagccgcccatcctgtacctgctgacggccattgttggcgtgcggttcttcgggatcgggcgggccgtgctccgctactgcgagcggctccttctccacgacgcggtgtttgccgccctcacccgcctccgggggcggctctgggagtccctgagccgcagggccctcgccctccgccggctgctgcagggcgggaacgtcctgggaacggttatcgacgacgtcgataccgtccgcgacctcctgccgcgggttgtgctgcctccggtgaccgcgctcgccgtgtccgcgctggccctggccaccacctggctgctggtgccggacgcggtcccggccgtcctggctgccgccgccgcgagcctgctcctggccccggccgtggcgctgtgggcagaccgcaaatccgccagtgccgagcaggtcctgaggtccggggtcctgcgccggatttcggccgccctggatgcccgcgccgaactgcatgccaacggcgtcgcggccccggtgctggccggactgcgcgcccaggaccgcagcgccacccgggcgtcccagcggtcagcgtgggcagacggcctggggcacgctgtcaccacagcctcctgctgcgcggctgccttcgcagctgcctggctggccgctcccgccgtgctcggcggccggcttgccccggcgacggcggcggtggttgtgctgatgctcctcgcgctggtggagccgtacgcggccatgacgacggcggtgcgccagttccccgcgttacggacagtcatgcggcgcgtgtccgcctcgggcgccctggacgccgccaccgcgggccccgaaggtaccccagccgacggcctgcacacggtgcctgaccgccgcgacagtgctcccggcgtcgaactcgttgacctcgccgtggcgtggcctggcggtgctcccgtgttttccgggatcaacgccgccgcggagccaggcaggtggctggccgtcaccggaccgtccggttccggaaagtccaccctgctctcggtcctgctgggtttcctccctgccgcagccggagcagcccgggtgaccggccgcgccgcctggtgtccgcaggaagcccacctctttgactcgaccatccgcggcaacctgctgctgggcaggccccccgcgaacggcccggccggagacggtgagctgatggaggtgctaaagtccgtggggctggctggcctggtggagcgcctgccggccggcctggacacccggatcggtccgggcggagcattcctgagcgggggagagcgccagcgcctggccgtggcgcgcacgctgatgacaggcgcggaggtaatcctgctggatgagccaacagcgcacctggatgctgaatcggccgaggccatgctggccgacctgcgcgcgggactcggcaaccggaccgtggtgctggtgacccataacccggctgacatccatccggaggatgcgaggctggtgctggccggttccggggacacccgaggtgcaggacacaacggcgcgccggcgtatgccgcggtggcggagggtcagccgtccacgtcgtgaaggtggtggacgacgtcgtgcaggaagtactgggccagcgtcaggacggtgaactccgagccgttgctgcgcagccccttccgtccccactctgattcgcggaccccggcaaaggactccgccgcctgctttccctcagccgtcagttccgcgctgaccactgccggatccgcgttggcgtagtccttgtcgatggccgtctggtcctggtcccagttctggaaacgtgcatcatccgaatcgagcatgaggttcagccgctggtcgaaaaggctgaagacgtcccggacatggcaggcatactccagcacggaccaggtgtattcatcgggacgctccgccacgtccggcctgcgcagcacggcacgccagcggggcagtatgttggcgatgctccccggaacagtggagggcgtcaccgttgcggcgtcgaacgagcattccgggcagggacgcgtcaggacccaggtccagtccttctcatcaggaacgataggcatgcatgcagtctaggccggatcaggcagcctggccgggatcaggccacgccatggccggacccaccacatccaccggctgcgacaacgggacgccggatccgtcccgccggccgtgctcctgcggcagggacctcgcaacccccgccgttgaggcggccttggccgggccgtgccccgcccaggccagcagcagcgtatcctctcccttcaggaagcggtgtgcccgcacgccggcagttgcacgtcccttcacggggtactcggagaacgccgtgaccttggccgtgccgggggcagtcccgggaagtgcgcccgttgtcccggcgatggtcaccaccactgcggcctcgtcgttgggctggaccgcgccgaagtacagcacccggtcacctgcggccagcttgattcccgccatgccgccggccgtacgcccctggggccggacgcttgcggctccgaacttcagcagctgggcctggctggtcaggaacaccagctccgcatcatcggctcccgccggcaccacgttgaccacgaagtccttgtccttgagggctatgacgtcccagtcttcccggttcagggggtagtcaggctgcacccgcttcaccacgccctgggacgtgccgatggccaggacttcgtccagcggcacgaacgccaccagggtttcccccttgagcagggtaaggaagtccttggccggaaccccgccggcgaggttgggcaggccggacatgggcggcagcacgggcatgtccatcacctggaggcgcagcatccgccccagggaggtgaccgcagcgatctcgccgcgcgcggaggtcttgaccacggacgtgaacacatcgtgttttgcccggggtcccgcctccgccagcggctcctggttgctggtgcgggccacctgtccagaggcggtcaggatggcccagcaggggtcgtcggcaatttccagggcgagcggcgctgccttgcccttcttcccggcggccagggcaaggtcggccgccacggtgggtgccactgcttcggattccagcaggacggtccgccgcggagtgccatgctcctcggcaatctcgcccagttcgtcggacaccagggtccggagccgctcctcggagcccaggatcgcctcgagctccgcgatctcgcggcgcagctcgtcctgctccttctccagctcgatccgggagtacttggtcagctggcgcagccggagttccaggatgtagttcgcctggatttccgtgaggtcgtagatggacatcagccgggcccgggcggcggccgcctcgtccgaggagcggatgatctggatgacctcgtcaatgtccacaatggcgatgaggaggccctccaccaggtggaggcggtccttcttcttgcccagccggaacaccgtccggcgtcggacaacgtcgatccggtggttcacgtacacagtcagcagctgcaccaggcccagggtctggggctggccgtccaccagggtgacgttgttgatgccgaaggagtcctccatcggcgagtagcggtacagctgctggagcaccgcgttagggttgaagccgttcttgagttcgatgaccaggcgcagtccgtgtttgcggtcggtcaggtccacgatgtcactgatgccggtcagcttcttggcgttgacggcgtccttgatcttctcgataaccttttccgggcccaccatgtaggggagttcggtgactaccaggccggtccgccgcgcggacagctgttccacctccacctttgcccgcgtcttgaaggacccccgtcccgtggcgtaggcgtcgcggatgccgtccagccccacgatccgcccgccgctgggcaggtccgggccggggacgaaccgcatgatgtcatccagggtggcatccgggtgggcaatcaggtgccgcgcggcggagatgacttccaccaggttgtgcggggccatgttggtggccatgcccacggcaatgccggtggcaccattgaccagcaggttggggaatgcagccggaaggacatccggctgggtgagctggttgtcatagttggggacgaagtccaccacgtcttcgtcgaggtggttggtgagcgtcagggcagccgccgcgagccgcgcttccgtgtaccgcggagccgcggggccgtcgtcgagcgatccgaagttgccgtgcccgtcaatcaggggcagccgcagcgagaagtcctgggccatgcgcaccatggcgtcgtagatggcggtgtcgccgtgcgggtgcagcttgcccatgacctcgcccaccacgcgggcgctcttcacatggccgcggtccgggcgcaggcccatgtcgctcatcatgtagaggatgcgccgctgcaccggcttgagcccgtcgcgggcgtccggaagcgcccgggagtagatcaccgagtaggcgtactccaggaaggaaccttccatctcggaggtgacatcgatgtccacgatgttctccgtgtagggggtggtgtcttcgggaggggctgaactttggcggcgggccatggggttggtaaatccttctgcagagcggtgcaatgggtttgttgggcgcaagcggcggtgctgcgggagtttttggctaggctaagcctatggtggaacagcccgtggacggcgaatatccggaacattgggaagccgatgtcgtgctgcgggacggcgggacggcacatctgcggcccatccacccctcggacgcggacgctgtccagaagttccacatggggcagtcgcagaattcaatctacatgcgcttctttgccttcaaggccaagctttccagcaaggagctcaagcggttcaccgaggtggactaccaggaccgggtggcgttcgtcataaccatcggcggtgaaatcgtagggatcggccggtatgaccggctggacgaccccaccgaagccgaagtggcgttcaacatcgccgattcgcaccagggaaggggaatcggctccatcctgctcgaacacctcgccgccgccgcgcacgagaacgggatccgccgcttcagcgccgaggtgctgccggaaaaccgcaagatgctaatggtcttttccgacgccggctatgacgtcaaaaggcatttcgacgacggcgtcgtcagccttgagttcaacatcgaccccaccgaaaaatcccgggccgtgatggaatcccgcgagcaccgcgcggaggcgaggagcgtccgcgaccttctgacgccgtcgtccattgccgtcatcggggcgagccgcaagtgggggacggtgggctaccagctgctggagcacatcatcgaaggcggcttccccggacccgtgttcgccatcaatccagaggcgctggaactggccggcatgatctccttcggcaagctctcggaggtccctgaaccggtgcagctggccgtcattgctgtcccttacgaggaagtgcccgccgtcgtcgccgactgtgcggcggcaggggtgaagggtttggtgatcgcctcggcaggcttcgcggacgacggcgaacgcggcctcatgaggcagcgcgacctggtgcgccaggcacgcgccaacgggatgcgggtgattgggccggcgtccctggggatcgtcaatacccacccggccgtgtcgctgaacgcctcaatggcgcccgcgctgccgctgcgcggcggactggggttgttctcccagtcagcggccatcggcgtctcgctctacgccgcctccagcaggcggcggctgggactgtccaccttcctctccgctggaaaccgcgcggatgtctcaggcaacgacatgatgcagtactgggaggatgacgccgacacctccgccgtgggcctgtacctggaatcgatcggcaacccgcgcaagttttcccggctggcacggcgtctggcgcgcatcaagccggtcattgtggccaagtccgatgccatggggctgcggctcccgcccggccacgccgtccgcaccacgcaggcccctgcaggtgcgcttgacgcgatgctccgccagtccggtgtcatccgggtggaaaccatagagcagctggtggacgtggcgcaggtggtgtccaaccagccgctgcccgccgggcccggactggccatcttcagcaactcccaggccctggggaaagtggtggcagacagcgcctcgtcgcatggactcagcgttgcccggctggtgacaggcgtggacctcgacgccggccagtcggttgcccttcccgccctgcgttcgtccctgctcgccgccctcgagtccgacgccgtccatggggccgtcgccgctgtgctgcccgcccgcgggctcaccgtcgacagcattgccgaggtgctggccgaatgctcggtgaaggccggaaaacccgtagtggccgcgttcaccgggatcctggatccctcggtctatgtcgagggcatggtggggtccgcagagcaaaccgtgccctgcttctccaatcccggggctgcggtggccgcgctcgccgccgtggtgcggtactcggagtgggtctcgcgcgaccatgggcacttcgttgagccggaaggctgcaatccgcagcgcgcgcgggccgagctggagggcctcctccgcgacgtgaagggggagcagctcaagcagctggacccggcggccacgcgctccctgctgggccactacgggatcaccgtgctgccttccgttggcttcgacaccccggaccaggccgttgaggcagcggacatgctgggctggccggtggcgctgaaaaccaccgacccctcgctgcgccaccggctggaccttgggggagtccggctggatatccaggacgccgagtccttgcgcctgaacgtgctgcagatgcgccggaccctgtcccggtacggtgacccggcgctggaagtgcagagcatggcgcaggtggggcaggcctgcaccttccgggccatcgaggacccgctcctggggccggtcatttcgttcggcctcgccggggacgccgtcaacctgctggacgactgggcgcacagggtgccgccgctgtccgccgcagacgtgcacgatttcatccgcgggccgcgggcagcccggaagctgttcggctaccagggcctgccggccgtggatgtcgccgccctggaggacctggccggcaggctcgcctggctcaaggacagccatccggagatagcgctggtggaattcaacccggtactgtgcggcgtgtcaggggcagtgatcctggccgcggatgtccggatcggcaacgcggcccagcgcaccgacagcgcccggcgggccatgctgggctgacgcggttagcaatgtggcgggccgatctgtgaaaatgggggaatgagctcacagcctcccgcgtcggcgcccgaaacgcccggcaatgaaaaccaggcagtccgccacagctcacacagccacggcgcccagggccaaagcctggacggcgcactccagaaagccggtttctacccccggctggtggctgacgtggtggacgatgcactggacggccgcgagtgcgttgcccacctggtgcacctggaaacccacttcgaccgtgccgaggtgcgccgccacatcactgtgctggtgctgaccgcggacatgctggtgatcacccatgtggacgaccagcagcttgatgaggcgggtgagcaaatcgtggcgcagatctccaccgagtccgtgcccgtggcgcagatccgctccgttgtcctcagctacatgtacgcccagccgcaggactacaagccgtcagacccggtccgcgaggtgacgctgtccatagcatggtccggcggccagcggctggacatgggccccgccagttgcggggatccccagtgcgaggcggaccacgggtacagcggcaccattgcgcaggaggacattgtcctgcggatcagcgccgaggcggacggattgcaggccgtccaggacgccaagctttttgcccgcgccctgcgcgccgtgaacacgggctctgccgccccggcgccccacatccagtcactcccggcccggccgcgttccggcgtgttcggtaaccggctcagccgcgggcaccagcagcgctgagatgccggacgaacgacgaacaagcagcagcgtcccaccaaccggcaacgtcccacgaacccccgccagcggcgcgcctgtcccggccggcgcctccgctgcccggccggttaacgcacccgacctgccgcccgctcccgcctacggccggcgttccgtagcggacgtgctgatcagtgccgcggccagcctgggcctcgacgggttcagcaacacccttggccttcctgccgcctcccgcgtctgcgttgtggtcgccgacggccttggccggaacctcctgaagcaaaagtccgcccacacgcctttcctgcgctccgtcatccaggctggccagggcgcggtccccgtgtggctcgattcggcgttcccttccaccacggccgccgcgctggccagtttcggcaccggcctgcccccgggccagcacggcctggtgggatacgacgtgctggatcctgagcaggagaaggtggtcaaccttcttggcaactgggaccccggagtcgatccgctggcctggcagccgttccctacagtgctggaacgagctgccgcacaggccgcggtgactactgtcagccttccccagttcggggactcacccatgacccgcgccgccctccgcggcggcaacttcgtgcccgccaccacctcccacgcccggactgccgctgccgccgaggccctggccgcgcccgggcccggcctgatgtatttctacgtcaatgagctggataaggccgggcaccgctacggctgccagtcgcaggaatgggaacaccagcttgaggagctggacgccgtgatgaagcggctgaattcctccctgcccccgggcaccagcatcctgctgacggcggaccacggcatgctcgacgtgccggagcagcagcgcatcgacttctccgcggatccgcagctggtggaaggagtccgccacacggcgggcgaaccgcggatggtgcatctgtacctggacgacgcgtccgacgcccgtgcgcgggagcggctcctcgccgcctggcgtaaccgtttcggcaaccgcatatgggccttcaccagggaggacgccatcgccggagggctcttcgggccggtccggcccgccgtcgaaggcaggatcggccacgtgatgattgcggcccgcgacgagctcgccctctacgacacgaggcgggtccgccccacggcgatggaggttgtgggccagcacggatccttgaccaaggctgagcgggaggttccgctcctgtgtttcagagctgacggcaggagcgcccgccgtggctgagctcgttttcttctccggcacgatggactgcggcaagtccacgctcgcgctgcagatggaccacaaccaccgggtccgtggccggggcggcgtccgcttcagccgcaacgaccgcgccggcgagtcccgtatctccagccggcttggactggaaaccgacgccgtggaggtagtggacgggacggacttctgggaggaagtcatgcggcggcgcacccacggccagcgcgtggactacctgatctgcgatgaagcgcagttctacacgcctgagcaggtggagcagctggcgaaagtcgtggacgagatcgacgtggacgtctttgccttcggcatcaccgctgacttccgcacccggctgttccccggctcccagcgcctgatcgaactcgcggaccgggtacaggtcctgcaggttgaagccctgtgctggtgcggccgccgggcaacgcacaacgcacgcacggtcgacggcgtcatggtcaccgagggcgcgcaggttgtggtgggcgacgtggacatggccgcggacggaccggccgccacggaggcaggccacatccccgttgtgggatatgagacgctgtgccgccgccatttcatgcgccgcgtcacggcacatggcgccaacctcatggccgagcaggaccagctgctgccgttcgaggtggatgcctgcctgtggcggggcaccggcgggaccggcgcggacgcctaagggcaggttttccggcggtgccaggcgcgggcccgggagtcagtctccgcgggtaccgaagacgatttcatcccaggatggaacgctggagcgcttgggcctggcgggctggcgttcgggagttcccgcctcaggcagctggccggtggtaggggaggaatcgtcgctccggggcgccgggcgcttcggggcgccgcccagtaattcgtccagtccaccgccactggatgtcccattcccgttgccctgcgctgcgtccgctggcgcggcaccggaggcccgctgcggcgacgccacaatggtgatttcccgcgtgtcggtgctgactccgttatgcagccgcaggttctcgtcggcggggtcgtgctgcggcggcaggaggctgagccgggacagcatggagggccgggcttcccgccgccggacgaaggaatcaccctgggcagcaggagcctcggtagggtccggttcctgtccggcgtcgtgttcttccgcttcgggagtgacctctgagggccgggggtgggcggcgggaacaccgttggtcaggagcagtgccagggcgtcgtcggaattctcatccacgcccagccgctgcccgcggcgcgagcgcagcatgtccaggaggccgtcggattccttgtccttgccgggcgcctggccggcgttgccgccctggttgcccgaagcggcgtcggcatcggtctcaaaatcaaagggccggtcggagacggcggacaacctgcgggcaggcaccggtccgtccaggggctccagctcactgagctgctgggcccagcggttggcattatgcagggccttccgggccgggctgaaggtccacagcgccggcggctcctcgccgattcccggtgccccgccgttcttcgtctcgaaggtggcagacacagtccaggtcccgtcctggcggcgccatgaatcccactccacggaagcggggtcgatgccgtgcgccgaaagccggtgagccaccatgtcgcccagcgtcgccgggttgtcgccaaatgccgagcggtagatgtcgtgcccgggcgacggcgcggccacttccaccttccgggcctgctgggccacatactcccgttctgcaaggaccgggccctcgtaccgttcaaccttggccagcggcagcccggaagactcggctacgtccgccgccgtggctccggccctgatccgggcctggatgtccctcggggacatgggaatggcaggccgctcgacccgcggcttaaccgcggacctgcttgccgtcctcagcgcttcatcgatcggcagctggaacatctcgccgccggccccgctcaacaggaggtgagtcccgtcgtcgtgtacgcctacaagccgtagatcctgcatacaaatcctccaccctggcattactatcactcgaaactttgccatccgggggccgtgttttggctcaaggggcagggcgcgccgcgatattccgggacatccctctgaacggaggcgccgaaggctagggctgggagagggctgccgtcagctcatcggggcggcgggtggaggtcagccagtacggagtcgggtctgagggatcggtgatctccaccttgaccaccggatcgatccagccccggatgcagaggtaggccagcccgttcagccttgtgccgcgttccgccgtcgcttccccgccgcggaacggctggacggcgcccacgtagcggcgttcgatggtggcccgccccacggtcagcgttttgtgggtcaccacgatgctcggggtggaaaggatcaggagaacggcaatgatggaaaagagcaccactgcagccgtgtacccggcggccgcgctgatgggggcgaacaccaggattccagcgccggaaacgcctgccgcgatgatccagatccatgcgttcggccacaacttctcgcgatagatcacggcagcctctgcggagggagtactgggaacggacgcggcggagctggattcgggcatggaccaagctttccacctttccctggctatttcatcccggccggtcccttccccactgtgcagacttgagcggggcgtccccgcacggtcgggtcccgcccggcagactccctgggaggctgcacgcgttcggcagccaaccgcggcctaggtcccatccgcgggcgcgggttagagtgagtgactgtgactgatcaatccgcagcagtagacacttttcccccggccccgcctgccggagatgagccccttgcctcggcccctaccctgcaggtccagctgaagatgctggacccgggactggaagcgccgtcgtacgcgcacccgggcgacgccggcgctgaccttcgtgccagggaagacgttgtcctgcagccgggagagcgcaagctcgtgcccaccggagtggccatcgcccttcctgaaggattcgtggcccttatccacccccgctccgggctggcaacccggcacggcctgactattgttaacgccccgggaacggtggacgccgggtaccgcggtgaaatagcagtcaccctgctgaacaccgatgccacccagcccattgaactgcaccgcggcgatagaattgcccagatggtgatccagcgtgttgagtacgcgcagttcatccccgtcaacgaattgagcggatccgtgcgcggtaccggaggattcggttccaccggcgggttcaagcggcccggggcctgaggcaagcatttttccgttccggcaggcttgctgccggcaaggggcagatcacgacggcgggaccccctcagggcccggaccggcacatttcacaactaaggagacaccctcatggtctttgggctcggcaaaaaagccaagaaggaagaagcatctgaaccggatgactccctgaccgccgcggagtccccggaggacgccgccgcaggctccggcgtccgcgccaacggaccgtttgatgaatccgaaatcaccacccgcgacggctacgtggaccttggcgcgctgctgatcgcacccagcgagggcctgcagttgcgcctcgaggttgaagaagccacccagcgcgtggtggccgttaccttggatctcaacggatcgagcctgcagctccaggcattcgccgcccccaagaccgaaggcctgtgggacgaaatccgtgagcagatcggccagtccgtcggggcacagggcggccaggtcgaggaggtcgagggcggcttcggcactgaactcgtagcgaaactcccggccgggctgcctgacggcagccagggttaccgggtggcgcgttttgttggcgtggacggtccccgctggttccttcgtggcgtgctgggcggcccggcggccctggaacgggccgctgccgagccgctggaagccctcttcaggcaggttgtggtgatccggggcggcagccccatgccgccgcgcgacctgct

SEQ ID NO: 32 - DNA, 149030 bp, Arthrobacter sp. OY3WO11
gccgccgccgtctgcagccccgcagccgtctgcggccccgcagcccgcccccgcgctccaggagccggaacgtggtccggaaaccacacagattggctgatcctgcaccggacggcgtgccccggcaccacgccggcacgctccccatcagccagcttccggagaagggccgtgtcacctgccaggggcgcatcgaatcggtgactttcctcccggcagaccaggctgccgccttcagcgccatggtttcagatgccgagccgcgaaatgcttccgcccagcctggtggacggcgcgcaaggctccgtgttgtgtggctgggacgccagcgcgtgccgggcattgaagccggcgcggagatccggctggacggaatgctttccacgaacaacggactgaccaccatgttcaacccacgctacgaaattatgtcccgccaggagaacgaatgaccgcgccccagcccgacccctccgccggatcccaggggccggactctcccggccacgcaggggagcccggccctgcccaggagccatctcccatggcgggcctcgcagcggaatatgccgcgaaggcaggactgcaccggacccacgacggccgcgtggacgttttgcgaagcgccggcgggatccagggcattgccgagagcatcgcgccgggactcgtgttcctggttgccttcaccgtcacccgggaactcacgctgtcacttgtggcggcccttgctgccgcagccgtcttcacagtggtccggctggtccagcgcaagcccctgacgcaggcactcgcgggtgtggtgggcgtgggcatctcggcctggctggccaacaccaccggcaaggccgaggacttctacctgcccggtttcttcaccaatgccgggtacatcctggcgatggtcctctccatcttccttaaatggcccgtagcgggcctgctcttcggattcatcaggaacgaaggccttgactggcgcaaggacccggcgcgggtcaaggcctaccagctgggcacctggatcatcgttgcggtcctcgcgcttcggctcgcggtacaggttccgctctacctcatggggccggacggacttgctgccctggccaccacccggcttatcatgggcgcgccgctgtacatcctgggtgtctggatcgcctggctcgttacgcggcccgccccggccgggtccgggccggagtcccagccgaaggacggtccggctgcggcaaactagccgtcgaacccgtcgtcctccgggccctgctgctccaggtggcccgcctcgtcggcgggccggggctgcggcggttctgaggagtcgggggagagcagcgcgcgcagttcgtcctcggcggcgatagtcgtcacgaagaacagctcgtcgccgccgtcgatcacgtcatcccggctcggcgtgatgggggcatggtcccgcaggatggccaccagtgtggagtcctccggccactggatctggcccacggtgctgccaataacgtgcgaatcgtgcgggacagtgaactccaccagggaggacacaccggtctggagcgtcagcagccgtacaaggtcgccgatctccacggcttcctccaccagggcagtcatgagctgcggggtgttgacggcgacgtccacgccccaggaatcgttgaacatccagtcattcttggggttgttgacccgccccacggtgcgccccaccccgaactccgtcttggccagcagtgagaccaccaggttgaccttgtcgtcaccggtggccgacaccaccacgtccgcgtcctcaaccttggcgccctggagcgtgctcagctcgcaggcgtcgcccaccaaccagtgcgccccccgcaggccgctccgtccgatcacttccggcttgaggtcgatcaggaggatctcatgcttgtgcgccagcaattccctggcgatggacgatccgacgcttcccgcgccaacgatcacgactttcactgggactccttggcaggggctttggccaggatctgggcgacctgcgagctgcggtccacctggagcatggcgtggacggtgtcgccgtcctggtacgcggttcctgcagccggcaggatcccttcaccgaagcgggtcaggtacgccacccggatatcggcggctttttcgatgctgctgaccgggtgcccgatccacccggcgtcgaggtccagttcggccagcaccagccggccggagggctcccggaaatcaccggcgaggtgctgttcgggcaggatgcgccgcagcacctggtcggcgctccagcggaccgccgccaccgtgggaatgcccaggcgctggtagatctcggcgcggccgggatcgtagatccgggccacgacgtgggggacgtggaacgtttcccgcgccacgcgggtggcgaggatgttggagttgtcaccactggacaccgccgcgaatgcgtacgcttcagcgacacccgcctgcttcatggtgtcccggtcgaagccaacaccggtgaccttgcgccccgtgaacccttgccggagccggcgaaaggcacggtcgtcctggtcgatgatggccacagaatgcccggcgtcctccagcgtgtgtgccagcgtcgcccccacccggccacatcccatgatcacgaaatgcgccacggtgtttctcctctgtaatcctgtcaaggtcctgctgctagaactctaccgccagcgtccgggctgcagccgcccgccgcccgtcatgacatagtccgggaatcagactagctttgtggggtgctgacaatattgaacgccgccaagcgtgtgctggtgggccggccattccgaaatgaccggctggcccatacgctgcttcccaagcggatcgcacttcccgtcttcgcctccgacgccctttcatccgtggcgtatgcacccgacgagatcctgctcaccctggcgctggcggggatcagcgcggtggcgttctcgccctgggtgggcctggcagtcatggttgtcctgctcactgttgtggcctcctaccggcaaaacgtccacgcctacccgtccggcggcggcgactacgagatcgccggcgaaaaccttggcaagtacgccggcctcacggtggcctcggcactgctggtggactacgtcctgaccgtcgcggtgtccatctcctccgccgccacgtacctcaccaccgccgtcccgtcgctgcacggcaaccaggcggccattgccgccgtcggcgttgcggtcctcgccctggtgaacctgcgcggcgtgaaagaggcaggcaccatgtttgccgtccccacctacctctttatggcatccatcctgggcatgacggctgtgggcattttccaggcggccaccggacagctgggggaggcgccctccgccgcgttcgagatcgtcccggcccccgggttcgacgaagggctggtaggcctcgccggcgcgttcctgctgctgcgcgccttttcatcaggcgctgcggcgctgaccggcgtcgaagccatcagcaacggtgtgccgaacttccgtccaccgaaaagcaagaatgcggcctccaccctgctgctgctgggcgttatcggcgccaccatgctggcgggcatcatgtacctggccaacgccaccaaggtacacatcgtcctcgaccccgcaacggagttcctgctcaacggcaaccctctccccgagggatacatccagacgccggccatcagccagattgcccacaccatcttcgggcccggatccatacccttctatatcgtggtggccgcaaccggcgtcatcctggtcttcgcggccaacacggccttcaacggtttccccgtgctcggctcgatcctcgcccaggacggttaccttccccggcagttgcggaccaggggggaccggctggccttcagcaacggcgtccttgccctcgccgcgggtgcgctggtgctgatcctggcgttcaatgcggacgtcaccaaactcatccagctctacatcgtgggggtttttatctccttcacggccagccagctggggatgatccggcactggggccggaagctcaagctggccagggacaaagccgcccggcgccgcatggccaaatcgcgcgtcatcaacagcatcggcttcggcatgacggccacggtccttgtgatcgtgcttatcaccaaattcgagcagggcgcctggattgccctgctggccatgttcatcctgttcctgatcatgtggagcatcaaagcccactacgacaacgttgccagggaactggcagtggacgaggacgcctcaccgcgcgccctccccacccgggtccacgccgtcctgctggtgtcccacgtgcgcaagcccgtgctgcgggctttggcctacgccagggcttcccggccctcccggcttgacgccgtcaccgtggacatcgatccggaggaaaccgcgcagaccgtggccgactgggacaagctggagatcccggtgccgctgacggtactggcaagcccctaccgcgagacggtcacgcccatcatggattacgtcaagcagatgcggcttgactcgccccgggacctgatcgttgtgtacatccccgaatacgtggtgggcaagtggtgggagcagcttgtccacaaccagacagccctccgcatcaagacccggctgcactttgaaccaggcgtcatggtggcgagcgtcccctggcagctgaaatcatccgaagaagccaagaacctgcaggacgtccaatgattgcgaaggccccgttgcacacgattcaccagccacccgccggagcagccggcacggaagtagtgctcgacgtcggcccggtggcccatggcggccactgcgtcgccaggcatgaggggcgggtaattttcgtccggcacggcatacccggcgagaaggtgcgggtacggctgacggacgccgaagagaaggccaagttctggcgggcggacgtggtggaggtccttgccgcctccccggaccgcgtggaccacttctggcatgccgccgactcgctgcgggcgtggggccacggacatcccccggtggggggagcggagttcggccacatgacgctggcccggcagcgcagcctcaaggcagaggtgctggctgaacagctcacgcgccttgccggcgtcgaacagttgccggacggagccggccacagcgttgaagcagtaggcggacagcacgacggcggggaaggcctcgggtggcggacgcgcgccagtttctcggtcacccccggcgggaagctcggcatgcacgcgcaccgctccacgcacatcgttcccgtacgggagatgccgctcgcggtcgatgccatcaacgccctgcgcctttgggacctcgacctgcagggcatcgaccgggtggaagtggcggccccggccaacggctcacgtccgctggtgctgctggcaccaagcccgggaaccaagcccaagcgtcttagcgccgtcgcagcccaactgccgggcgaggtgtccgttgcaacgttcgaccccgcaaccgacgccgtgcaccagctgcggggccgcacctgggtacaggaaacagcagccggccacgactaccgggttaccggcgccgggttctggcagatccaccgcgacgcgcccggggcacttgtggggggcgtcacagaattcctccaggacggcggcttcctgcaccccggcgcggtggtggccgacctctacgcgggcgccgggctgttcaccgccgtcctggccgacgccgtgggggagacgggatccgtcctgtcggtggaggggcccccgggaccagccgggacgcgcgcaagaacctgcatgcagcgccacaggtggagatcgtccagggcagggtggagcgggtcctccgccagaaaccgcggaactttgacgccctgatccttgatccgccgcgggcgggcgcggggaaagccgtggtcaggcagctggttgaggcgcagccccgcgccattgcctacgtgtcctgcgatccggcgtcgttcgcccgggacgtgggatacttccgccaggccgggtgggacctgtccggcctccgggctttcgacctgtatccacacacccaccacctggagacggtggcactgttgacgccgcgcgcctgagaaccggtccacgatgccaccgccattttcgactacgatggccgtagtagtcccacgtcgcgcccgtaatcacggccggccgtgtgcaattttcgggcccggaactaattagggcttcctaactagcaggcggtcaaccgcgcgacaaagatgaaactgttgcgagaggagtcctgcgatgagcactgtggacagcttcggttcaaaaggcaaacttaatgtagccggaaccgaatacgaaattttccggttgaactccgttgaaggtgcagaaaaccttccgttcagcctcaaggtattgcttgaaaacctgttgaggaccgaggacggcgcgaacatcactgccgatcacgtccgcgccttggcaggctgggatcccaatgcccagcccgatacagaaatccagttcacgcctgcccgcgtgatcatgcaggacttcaccggcgttccctgcgtggttgacctggcgacgatgcgcgaagcggtcaaggaactgggcggcgaccccaagcgggtcaacccgctggcgcctgccgagatggtcattgaccactcggtccagatcgatgccttcggcaactccggcgcactggagcgcaacatggagatcgaataccagcgcaacggggagcgttaccagttcctgcgctggggccagaccgcgtttgacgacttcaaggttgtcccgccgggcaccggcatcgtgcaccaggtgaacatcgaatacctggcccgcacggttatgacccgcgaagtggacggtgcgctccgtgcgtacccggacacctgcgtgggcaccgactcccacaccaccatggttaacggcatgggtgtcctcggatggggcgtcggcggcatcgaagccgaggcagccatgctgggccagccggtttccatgctgatcccgcgtgttgtcggcttcaagctcaccggctccatcccggccggcgccaccgccaccgacgtggtgctcaccatcaccgagcagctccgaaagcacggtgttgtgggcaagttcgtggagttctacggcgaaggcgttgccgctgtgccgctggccaaccgcgccaccatcggcaacatgagcccggaattcggttccacggctgccatgttcccgatcgacgacgtcaccctggactacctgcgcctcaccggccgttcggaccagaacgtggcactcgtggaggcctacgccaaggaacagggcctctggcacgatccttcccgcgagatcaagttctccgagtacctggaactggacctgtccacggttgttccgtccatcgccggccccaagcgcccgcaggaccgcatcgaactgaccgaggccaaggacgagttccgccacgacctcaagaactacgtctcccacgacgccaacgccggcaccctggacgagtcgctcgaggaatccttcccggcatcggacgccccgtccttcaccgggggagcaacgcacatctccgacaccgaccgtgaacctccgaagtactcggcaggccacgggggagcgggacgcatctcccagccggttccggtcaagatggctgacggccgcgagttcgagctggaccacggtgcagtcaccatcgcatccatcacgtcctgcaccaacacgtccaacccctcggtcatgttggccgcggctgtcctggcacgcaacgccgtggacaagggcctgacgtccaagccgtgggtcaagacctccgttgcccccggctcgaaggttgtcaccgactactacgagaagtcgggcctgacgccctacctggagaagcttggcttctacatcgtgggctacggctgcgccacgtgcatcggcaactccggcccgctggaagccgaagtttcggaagccatccaggccaacgacctcgccgtcgcggctgtcctctcgggcaaccgcaacttcgaaggccgcatcaacccggacgtcaagatgaactacctggcctccccgccgctggtcatcgcctacgccctggctggttccatggacttcgacttcgaaaccgacgccctgggccaggaccaggccggcaacgacgtcttcctgaaggacatctggcccaacccggttgaggtccagcaggtcatcgactcctcgatcgacaaggaaatgttcgccaagggctacgaaggcgttttcgagggtgacgaccgctggaaggcgctcgacactcccgccggtgacaccttcgcctgggacccgaactccacctacgtccgtaagcccccgtacttcgagggcatgcaggccaagccggagccggtcaaggacatcacgggcgcccgcgttctcctgaagctgggcgattcggtcaccaccgaccacatctccccggccggttcgttcaagtcggacacccctgccggccagtacctcctggccaacggcgtggagcgcaaggacttcaactcctacggttcccgccgcggcaaccacgaggtgatgatccgcggaacgttcgcgaacatccgcatcaagaaccagatcctggacggcgtcgagggtggcttcacccgcgacttcacccaggacggcggcccgcaggcctacgtttacgatgccgcgcagaactaccaggcagccggcaccccgctggtggtcctggccggcaaggaatacggttcaggttcctcccgtgactgggctgccaagggtaccgccctgctgggcgtcaaggccgtcatcgccgagagctacgagcgtatccaccgctccaacctcatcggcatgggcgtcctgccgctgcagtacccggccggtgaatccgccgccaccctgggcctgtccggcacggaaacgttctcggttgagggcgtcaccgccctgaacgagggcaccacgcccaagaccctcaaggtcacggcaaccgccgaggacggcagctcgacgacgttcgacgccgtcctgcgcatcgatacccccggtgaagcggactactaccgcaacggcggaatcctgcagtacgtcctgcgccagatctccgctagctagcggtaactgccaagcagtcaccaccatcccgaagccccggccggtcaccgaccagccggggcttcggctgtgcaggttagccttgccctgcgggccaaggcgttagagttaaacggcacgtctaccacctgaaggaggggtcagtgggaatcttggagaccatccggaatccgcaggacctgaacgagttgtccgaagaccagctgaagcagctggcttcggaggtcagggacttcctgatcacgaacgtctcccagacgggcgggcacctcggacccaacctcggcgtggtggaactgacccttgccgtgcaccgcatcttcgactcgccccgtgacagcatcgtcttcgacaccggccaccagtcatacgtccacaagctgctgaccgggcgccaggacttcagcacgctgcgccaggagggcggaatctccggttacccctcaagggccgaatccgagcacgacatcgtcgagagctcgcacgcttcctcctcactgtcctgggcggacggcatctcccgcgcacgccagctcaccggtgacggcgaccggtacgtcatcgccgtcgtgggggacggtgcgttgaccggaggcatggcctgggaagccattaacaacatcgccgcggacaaaaagcgccgcgtggtgatagtggtcaatgacaacggcaggtcctacgcccccacggtgggcggcttcgcggactacctcgcgtccctgcgccccacgatcgactccttccggacggccccggcctacgaagtggcgctggactggtggaagaagaaactccaaaacgggggaccggcaggccagttcacctacaagagcctgcacgccatgaaaaagggcatcaaggactggtgggccccgcaaggcatgttcgaagacctcggcatgaagtacatcggccccgtggacggccacaacctccaggccatggagcatgccctgtccacggccaagcactacggcgggccggtcattgtgcatgcaatgaccgaaaagggccacggctacgcccccgcccgcgcccacgaggcagaccagttccatgccgtcggcatcatcgaccccgaaacgggcgaacccaccggcgccgccggcgcccagtcctggacctcggtcttcgccgacgaaatcgcggccatcgcggatgagcggaaagacgtcgtcggcatcaccggagccatgctcattcccgtcggcctgcacaaattcgcggcccggcacccggaccgtgtgatcgacgtcggaatcgccgaacagcacgccctcacctcggccgccggcatggcctttggcgggctgcacccggtggttgccgtctacgcaaccttcctgaaccgggccttcgaccagctcctgatggacgtggccctgcacaaggccggcgtcaccatcgtccttgaccgcgcaggcgtcaccgggccggacggcgccagccatcacggcatgtgggacatgtccatggtccagatcgtccccggactccacctggcagcgccccgcgatgccagcaggctgcgcgaggagctccgcgaagccgtggcaatcagcgacgcacccaccgtggtccgcttctcgaagggatctgtcggcgcggaagtggaagccctggagcgccttagcgacggcgtggacgtgcttgcccggcggcccagcggttccacagagaacgacgtcctgatcgtcagcgtgggcgccatgtccgaactcgcgctggacgtggccaaccgcctcggcgcacagggcatcagcaccaccgtggtggacccgcgctgggtcctgcccgtcccgcgttccatcatcgcgctggcatcgcaccaccgcctggtgatctgcatcgaggacggcgttcgcgccggcggggtcggttcgcggatccgccaggaaatgcggtcggcaggcgtggataccgccttgaacgaggtaggcctgccggtcgaattcctggaccacggcacccgcgcccagatcctcgaacgcgtcggcctgaccgcccagcagatcacgcacgacgtcgttgcacaggtcctcggcacgaaggtaccctttgcgcgtcccctgcccggccagcagcaccccaccaccggcagccttccgatcctgtgaggggcgaggctgagctgaaataccccggcgtcctgggggagcccgccggggacaaccacccgggagcaacgcgggcaccggagaacctgcagcccggccagctggtggtggcacggaaccgtaaatggaacggcaaagcccactgggtggttcccggacgctacctcggcgaggaccgccacggctggtggatattccaaggcaccaatgaattctgttcccgcccgggcgcggcgttttacaccagatcagacgccgtgctcctggtgccgcgcgaaggcgactgggtggccactttctacgacgacgcccatccgggcggcatgcgggtctacatagaccttgccgtggcccacgagtggagcactatccggcccgccgtcaccgaattccacgtcatcgacatggacctggacgtcgtccatacggccggcaggggcgtgttcatcgacgacgaggacgaatttgcggaacaccgcgttgccatggactaccccgcagtactggtggaatccctccaggcatcggcggaccagctttaccaggccgtgaaggcgcagcacgcaccgttcgacggcaccgacgccgaatggtttaccaagggacggtcatgagcggaattgtcagggtttacaagcacgacgacgagggcaccctccatttccgggaggcctggtacgacgaggactacggccagttcgtgatgaactacggcgctgtgggtcaccagagcaaaaccgaggagacggacgtcgccacggccgaggcggcagagagtctcctggacgccttcgcagcccagtgcgccgaggacggctacgccgaaattccggaaaaggaacagttctgggtggtggcccagttcgcgctgaagacccgtgagggcacagacagggaccgctacctggaggaaaaggccaccgatgccctcatcagccacctggcctggcgcggactggggacggtggaacgctccgaattcacggactacaagctcaacatcttctgcctgtgcccggaggtgaacaaggccgtcaacgccgtcaaggtctgcatccggggcgaggacctggacttcaccaaactgagcatcggtgccgcccccttcaccgagcccaccaacttcaagctcaagcactccgccaagcccgctgccggcttcagcctctaggagcacaatgcccacgtaccgccgcctcggaaagtcaggcctgaccgtgtccaccgtcggcctgggctgcaacaatctgggccgcgccaacaccgccaccgaatcccaggaggccacggacggcgtggtccacgcagcgatcgacgccgggatcaccctgttcgacgtcgccgatacgtacgggcgggaacccgggctcagcgagacgatgctcggcagggcgctcggcaccaggcgtggggacatcgtcctggccacgaagttcggcatggacatgaagggtgccagcggcccggacttcggtgcccgcggctcacgccgctacatcatccaggccgtggacgcatcgctgcggcggctgggcacggactggatcgacctctaccagttccacacgccggacccgttgacccccatcgatgagaccctgaccgcactggataccctcgtccgcagcggcaaagtccgctacatcggccattccaaccgttccggctggcagatcgcccaggcggagtatgttgcgcgggaactgggatgcgcccgtttcatctccacgcaaaaccactacaacctcctggaccggcgcgccgagcttgaggtgacaccggcagcagaggaattcgggctgggcgtcctgccctacttcccgctcgccaacggactgctgaccggcaagtactcgcccggccatgccccggacggatcgcgcctcagccacacccgccagcacctggtccacgacgccgactgggaccaactgggcaggttcagcgatttcgcccgggaacgcggcctgaccgaaatccaggtcgccttctcctggctggcagcccagccttcagtggccagcgtcatcgccggcgccaccggaccggaacaggtccgccagaacgctgaatcagccggctgggtgccctcggagaaagacctcgcggagctggacggcattttccctgccgctccgaaggttgccctgttctaggccctggatgaccgccttcctgctggacgtggacaccggcatcgacgacgccctggccctggcctaccttgccgccctgcccgatacggaattcgtttcggtcacggcaacccccgggaacgtggacgcgtaccaggtggcgcgcaacaccctggcattgctcgaactgtgcggcaggccgggagtggaagtggccatcggcgcacgcgaaccgctggccatcccgctgctcaccactcccgagacccacgggccccaggggattgggtacgcggtcctgccccagccggccgggtctgtgtcggagcggaacgccgtcgacctctgggttgaacatgcccgcagccggcccggggagctcaccgccctcatcactgcgccgctgaccaactttgcgctggccctgcggcgggaaccggaacttccggacctgctcgccaaagtagtgatcatgggcggcagcttctaccaccagggcaacacaacgcccactgcggagtggaacacccacgtggacccgcacgccgcgaaggaagtgtacgccgctttccggggccgggcgccggagaaacttcccattgtctgctccctggacaccactgagcggatggaaatgcacccccgccatgtgcggcaactggcggaagcggccggtgcccgcgtccccgaactggtgctgcccgaacacccggaagggctgcgcagcacctcggacaacactttggtccggcacctgtccgacgccctgcggttctacttcgagttccaccggcactacgaccagggatacctggcccatgtccacgacttcttcgccgcgggcgtggcagcgggaaccctggattttgaggcccgccccgccacagtggacgtcgagaccgggtcgccgctcctgatgggcaccacggtggcagacttccgcggactgtggggctcaccgccgaacgcacgcgtagtctccgccaaccatccggcagcggccttccgggagctggtctccgccgtgggccgcctcgccgcccggctcggctgagcggacagcttacgacggcggaactacagcggggcatcttccggcaggtcgacgtccagggccaggagggcgttttccaccacctcggtcagcgccgggtgggtccagtacgggccccgggccagctcatggacgggcaccgacccggccatggcctggaccaggggctggaggaggatggacgcttcatggcccaggatgtgggcgcccaggagcctgcccgaggcccgctcggccacaagcttcaccacgccttccccgtcctccatggcccacccgtaggcggtggtgccgtagtcctggaccgccgttaccacgtcggttcccgcggctgcccgtgagcgggcctctgcttcggtgaggccaaccgatgccatctgcgggttggagaagactgcggagggcacggcggtgtagtcgatgcggcgcatccggccggggtgttccaggttgtgcgccaccacgcgggcttcccggttggcaacgtgcttgagctggtacgggttggcgacgtcgcccaaggcgtacacgccgtccagtggcgtgccgccggaaaggatccgcaggttggcatcgacggcgagggttccgtcgtcgtttacatcgaacccggcggcttccacgcccagccggtccgtgttgggaaccctgccggtggccatgagcacaacatccgcagggacgtgcaggggccggccgtcagcatcggcaaattccaccacaacggtgccgttgccgttgtcctctatggactggagcgagaagcccagttccagcctccagcggcttgctgccgccgcggcgaaccgcccggagatttcggcgtcgtggccgcgcaagaggcggctcgtcctgttgacctgggtcacgctggagccgaatccgtggaaaatccccgcgaactcagccgcgatgtacccgccgccaaccaccaccaccctttccggcagcccgtcgatccgcatcacggtgtccgaggtgtgcacctgcggcaagtcgattcccggcacgtcgggcaggacggccctggacccggcggcaaccacaacctgctcagccgtgatgtccaccccgggtccggtccgcagggcccgcgggccggtgaagtgcacatggtcctcatagaggtcaacgtggtccagttccgttgcccggtattcccggccggctgaggagatggaatcgatccggccaaaaatccggtcgcggatatcgttccagtgcactttgtccaggctgaggtccaccccgagcctggctgcctcctggtgcgccgcggcaaggccggccggatacacgaacatcttggtgggaatgcaccccacgttgaggcaggtgccgccgaagacgccgccgtcgatgagggccacccgcttgttgtcccagtacggcgtgatcagcgaattgccggagccggatccgataatggcaaggtcatagtggggcatggcaggtctttccacgggcaacggcaggcggattttgcctgtccgggcagtctagggcagtccgggactggatgccccggcagcggtgcgccggcagtagaataatcgcggacggaacaggcgcagcagcctgccgccagctgccgaggtgacatacgcagcgttccaccggcccggactcccgggccctccacgcgcaccctgaaggaactccatgtcgccctccctgacgctgcccgccccggcaccggccgccgcccgtaaacgccgcctcctggaaatcctcggcgcagcggccatcgccgccacctacatctaccttgtgctcaaccagccggccgacatcaccggcgggcccggaagcgcgtccgccctcattgccctctccggcttcctggtgggcgccatcctgctgatcgtcgccgtcctcccggcgttgccggcctccaccgtggtgctgatccccgtggcactggtgctgaacattgtgctcggtcagttcgtgggcagcaccctggtcccgttctaccttgatgcgatcggcacagtcctcatcgccgtgctggcaggaccggcggccggtgccgcgaccggagcgctcagcagcattgtctggtccttcttcaaccccacggtgctgcctttcgccgccggcgccgcactgatcggctgcctggcgggactggccgcacgccacgggatgttccgccgcttctacctcgcccccgttgccggttttgttaccgggatcatcggcggcgtggtgtccgcgccggtggcggccttcgtcttcggcggcacgtccggcgtggccaccggcgccatcgtcagcgccttccggtccatgggggacaccctgctggccgctatcaccaagcaggcgctcatctccgatcccatggacaaggcgatcgtcttcaccgtggtggccgtcctggcctacgcgcttccccgccgcgcgcgcctgcagtacccgttcgtgcgccggcaccgcgtgctggccggaacgtcacccgaacagggctcctgaccaccacgcccatgcgcctccacccgctgacctccctggccgcggccggcagcacggcagcaatcacgacggcggcagccagcctgccgctgtccctcgccgtcatgggcgctgccgtggtcctctcggcccggggcggcacggcacgaaggctgctgcccgcggcagcggcagtgctgctcccgctgggcttgtcgctgctggtcatgcacgggctgttcttcccagaggggcggacagtcctggcccagtggggagtggcccgcgtgaccgcggaggggcttgtcttcgccctggagcggacagcgcagctgggggcggtggtccttgccctcctggcgttctccttcagcgtcagcgtgccggacctggtggcggtgctgtcctcccgcggtgtccacggacggttcgcgttcgtgctggcctccaccctgaccctcctgccggccatcacctcccgcgtggaacggatccggcaggcgcaggaatcccgcggactggtggtccgccgcggactgcaccgcgcggccgcgtttcggctgcaggcggtgccgctggtcctgtccctgatcgaggatgccggaacacgcacagcggccctagaagcgcggggcttcagcaatccagggccgcggaccagctaccgggacgttccggatccgatcctccagcgcgtgcttcgtgccgtcttgctgggggccgccgcagccgcggttgctgcgcggctgttgctgaccccagcgggaagctgagccatgtccaccacccactcgacgcagacccagccgatcctgtcagccggaatccggagcttcacctacttcggggatgatgcctccgtcctggaggggattgacctcaacctcgtccccggaacgttcacggccatcctcggagcgtccggaagcggcaagtccaccctgggccgtttgctgtccgggtggcttcccccaagaaccggtgggaccctgcgcggcttcctggaactcgcaggcacgcgcctggacttcggcggcgaccgggagccgcggatcaacccggcggaatggggccggcaggtgggcttcgttccgcaggaccctgccgccgtcctgaccacagtgcgggcaacagtagcggaagaactggcgttcgggctggaaaacgcggcgatggagcggccggccatgaaagccgctgtggaacgcactgcagcccttctgggtctcatggagctcctggaacggaacccggcctcgctgtccggaggccagctgcgccgcctcgccatcggctgcgccatcatcgccggtccgcgggtgctgatcatggatgagcccttcgcgtcgctggacagtgccggaactgccggactggcacgcctgctgcaggacctcctgaagctcggcaccgccgtcgtggtcctcagtcaggtggtcgacacaccgctcctggatgccggaacctgggtggtcctggaaaatggcggggtcacggggaacggcacgccggccgagctgcaggccggctccgggttgctgccgcccggaatccgggcctccggcggcgagcctgcaccagccggcgaccatcccggggcagtacacgcggatacactgctgccgcgcagcggggccggtgttcctgcacttgagctccgcggcgtctcctttggctacagcgccgggggcaaggaagcgcagcccaggaacatgcggcgccgggacctgggcggaaaagcggcaggcagcggtctggtgctgcagggcatcaacgtgcgcatccaaagcggtgagatcctggcggtgaccgggcccaacggagctggcaaatcgaccctgctgcgccacctcaacgggctgctgcggcctaccgaaggcagcgtcctggtccacggcagggacattgcgggggtgccgccaggcgaggcggcgcgctccgtgggcctgctgttccagcaaccccgggaccagctgttcgagcggaccgccctccgcgaagtgcgcttcggcctggaccgcctgttccaccccgacgaggcacccagccgggccatggaagcactgtccgccgtcggcctggcagaggccgcgcacacgcaccccgccgaacttcccgcatccggccagcgcctcctcgccctggccacggtccttgcccgcaaaccgtcagtcctggccctggacgaacccacggtggcactggacggcggcggcctcgccctgctggacgctgcggtgcgttccgcggcaggggagggcgccgccgtcgtgctggtgtcgcatgaccttgactatgccagggccgcggcgcaccgcgtggtgatgctcgacggcggccggctggacggctgatcaggccgggcccgatgccactcccggcggcaggaaacgccttccgttgacacgctccgaggcacccaccctgtcgaggtagggggtgatgccgcccaggaacatgggccagcccgcgcccaaaatcatgcagaggtcgatgtcctcgggagcggcaaccacgccctcggtgagcatgaggccgatttcttccgccagtgcatcctgcgtgcgccgcagcacctgctccgctgttgagggggaggtgccgaaggacatcagcgacaacgtggactccggaatttcctgcgatccgtccggtccggccgcccacaggctcttcacgccgttgtcgatgagtttctgcaggttggcggacaccgtgaagcgttcgccgaaggccgcgtgcagggactcctggacgtgctgggcaacgggaagccccaccatggcgccgagggtgaagggcgtcatcggcaggcccatggggcggagggcattgtccgccacctcagcgggggtgccctcatcaaaggcggccgtgacctcgcccatcagccgcagcaggatgcggttcaccacgaacgcggcggcgtccttgaccagcaccgccgtcttcttcagtcccttggccagttcgaacgcggtggccagcacggcgtcgtccgtcttcggagcacgcacgatttccaggagcggcatcacggccaccgggttgaagaagtggaagcccaccacgcgctccgggtgctgcaggtcctccgccatggcggtgacggacagcgaggaggtgttggtggccaggacgcagtccggggagacaattgcctccagttcggcaaagacctgcttcttgacgttcagttcctcgaacacggcttcaatcacaaagtcggcatccgcgaagacatccttggacacagaaccggtgaccagcgccttggtccggttggcggcgtcctggctgatgcgcttctttcccaggagcttgtccacctcggcgtggacgtagcccacacccttgtccacccgggcctggtcaatgtccgtcatcaccacggggaccttgagctggcgggcgaacagcagtgccagctggcttgccatgagcccggcgccaaccaccccaaccttcgtgacaggacgggccagcttgcggtccggggcgccggcggggcgcttggatcgcttctggacgaggtccaggaaggcgtagacggtggcacggaactcgtcggtctgcatgaggtcggcgagggtttcgcattccagggcagcagactgtgcctgggtcatggtgcggtttgcctcgaggatgtccaggacctttcccggggcaggcgcagcattggacgtcttcgcgtccacgaaggcccggccggccttgacggcggcatcccaccgcgcggcggttgcggcgtcggcgggatcgacggcgttggcccgttccggaaccacgtcgccggaaatgacctcggccgcccacgcgagggactgctccaggaagtccgccggctcgaacagggcgtcggcgatgccgaggccgaacgcctgggccccggtgagggtccggttgttgctgagcgggttttcaatcatcaccttgacggcgttttccgggccgatgaggcgaggcaggatgtacacgccgccccagcccgggaccaggcccaggacggcttccggcagcgcaagtgcgcctgctccggtggagactgtgcggtaggtggactgcagggcaatctccagccctccgcccagcgccgcgccgttgatgaaggcgaagcttgggacgcccaggccggccagcgtgctgtacacatcgtggcccagctgcgccatccacagcccgtgctcgcgcttgtccaggttcttgacggcggaaaggtcggcgcccgccaccaggtagtagggcttgccggttactccgacgccgacgatctcaccccgggccgcgcgttcccggagaccctccaggaccttgccgagctccaccagggtgttgggccccaaagtggttggcttggaatggtccaggccgttgtcgagggtgatgagggcgaacgtgccgggacttggcttcccgcccggtccgggcagttcgatgtcctggacgtaggaatgcgtcactgtttcgttgggaaacaggtcggcgagtcgggtgaaatctgcggcgctcatgcggctccttcggaaacggtgtgggtgacggagtttgccagccgggctccgctgtaatcggcatggtgggggttttcccagatcaccgtggcgcccatgcccaggccaacacacatggtggtgatgccgtagcggacggaagggtcctcctcgaactgcctggccagctgggtcatcagccgcacgccggaggaggccaaggggtgccccactgcgatggcgccgccgtagcggttgacccgggggtcgtcgtcggcaatgccaaagtgctcaaggaagctcagtacctggacggcgaaggcttcgttgatctcaaaaaggccgatgtcgccgatggccagccccgcgttcttcagggccttctcggtggcgggcaccgggccgatgcccatgacatccggctctacgccggcgtaggcgtagctgaccaggcgcatcctgaccggcagtccaagctccgttgcggcttcggacgatgccaggacggcggcggttgcgccgtcgttcaggcctgcggcgttacccgcagtgacccgcccatgtgcgcggaacggagtgcggaggccggcgaggtcagccagggtggtcccgggccgcggcggctcatccacgctatgcagcgtccagccctggccgggcttcatggctgctaccggcaccaggtccggctggatgcggccgttgcggcgggcggcctcatatttgtcctgggaggctacggcataagcgtccgtgcgttccttggtgatggacgggaagcggtcgtgcaggttctctgcggtgttccccatattgagggcggcagggtccaccagccgctcggacatgaagcgcggattcggatcggcgcctgaacccatggggtggttgcccatatgctcgacgccccctgccaccgccacgtcataggctccgaaactgattccgccggccacagccgtcaccgcagtcattgcccctgcgcacatccggtcgatggcgaagccgggaacagttctgggcaggccggccagcagtgcggcggtccggcccagggtgaggccctggtctccggtctgggtggtggcagcgatcgccacctcatcaatccgttccggtggcaacgaggggttgcggcgcagcagttcgcgaatgcatttcaccatcaggtcatcagcccgggtgcccgcgtagatgcccttttccccggccctgccgaacggtgtgcggaggccgtccacaaagacgacgtcccggacagtgcgcatggatgcggcgctttcctggtggctcacgtataactcctcatcgagacgtaggcgccggttgcatgccggaatgcggcagccagcctggcggcaataccttcgatgttactcgtgagtaacttagcccgcaaggccccgattgaagcgacgctctctcacttaatgcgccattttggctagcgctctctcactcgcttcaagaaagtgagcgagcgttgccactattcacgcatcaagtgagagagcgtttggggattcggtgtggagccggtggcggtgcaggcggctgcggctactggccggtcggagctgcgtccgctttgggttccttggcaggcagcggctgagggttcaggaaagcctcggagataagcggtgcagcgagttccacctgccagtcccgtgcgcccagggcgcgaagttccgcggcaatcgcgtctttgctgacatccgccggtgggcgccaggccacccggcgcaggtagtcgggggtcagcagattctccagcggcaggttcaactcatccgctttagcctgcagcagcggccgtgcggtggccagccgggcagctgccgccggatcgcggtcggcccacacgcgcggcgggggtggtgcgttggtgggcaggtgcagcggcgggagctcgtccaggtcccgggccccagcgatgcaccgcagccagcggggagcctcccgctgggcagcccggccgtggaagcccttggtccccaacagctgcggcaccgtggacggcattgccttggctgcagccaccagggcagagtccgggatcagcctgccgggggcaacatcccgcttttgcgccagggagtcccgctccagccacagctcccgcacggcagcaagctgccgtcggtcccggatctggtggagccctgaggtcttccgccaagggtcgatgcgcgccggcggcaggcctgcggccaggattgccgcgaactcctgctcggcgtaatccagcttgccgtcggcctccaggagttcgatcagctcctcccgcagttccgtcaggacctcaacgtccagtgcggcgtagcgcagccagggttcgggcagggggcgggtggaccagtcggcggcagaatgctccttggcgagcccgaagcccagcagctgttcgatgactgcggcgagtcccacgcgggggagcccggcgagccgtgccgcgagttcggtatcaaagagcctgtccggccacattcccagttcggagaggcagggcaggtcctggctggcggcgtgcaggatccactcgacgccccgcagggcatcgttgatgatgtccaggttcccgaagggttcggggtcgatcagccaggtcccggcgccttcacgccggatctggaccagaaaagcccgctgcccgtaccggaagccggaagcccgctcagcgtcaaccccagcgggccccgttcctgccgctatggcagcagcgcagcgctccaggccggactgcgtttcgatcaccaggggaacgccgtcccggggtgctgcgagttcaacgatttcggggacggggctgtcaaagccttccaccgtgatgtggggtgcggtatcagcagccgggacgccggccgtggtgttatccggaatgtttggggtcatgatgtcttcagtttaccggccggccggtccgcgcctgcgttcggtcccgcagtgccgccttccgtcccgtgcgccatctgtgcgccaccggcaagggacctcagttccgccgccggtgcgtcagcggcgtgacgccgtcgggcaggggcggcaggcccgcgaacgtgcagaccatgtccgaccatgcctcaaggtgggccctgacgtcggaggttgccggcgtccaggaggcgcggagttcaatatcgatggatcccggcctctccgagagggtgccgaagctttcggagaggacacgggtggcggtaccgcccgctgcccggtacggcgccttgtggttttccagtgcctccaccagccaggtccaggcgactgttccgagcatctcgtcgttgcccatctcgggctccagctccgcacggatataggtgacgatgcggaactccccgccccagacgtccgatccgttcgggtcatgcaggaggatgaagcggccggtggccagttccgtgccgtcgtcgtcttccgttcccgacgcggcagccagtgccatggcggccgggccgtggagtggcgttccggccgtgccggcgccgggagcgtaaacctcggcaccgagggccacggcaaagggcgccagccgggcaggcgccggaatctccgccaggcggagctcccggcggcactgggctttcctgagggttcccaaggcgtggagaaactccgggggaacctggtcaagtgcgttcaccttcgcaggttacgcaactgtgccgggcagggcgggtaggctcgccgccgcccccttgtcctggctgccggaagcgttagcccgcacgctgctggagttcccggcggatggcctcggcaaaggaatccacgtcctcttcggtggtgtcaaatgaacacatccagcggacttccctggcggcttcattccagtcgtagaagcggaaggacgtgcgcagcctgtcagccacgccttcggggaggatggcgaacacaccattggactcagtcttctgggtgggctggacgccgtcgatggtgtcgacggcggcgcggagccgcgcggccatggcgttggcgtgggcggcggagcggagccacagatcaccctccaggagcgcgatgaactgggcggacatgaagcgcatcttggacgccagctgcatgttcatcttgcgcaggtacacgagcccgtgggcggcttccgggttcagcgccaccaccacttcaccgaaaagcaggccgttcttggttccgccgaaggacaggatgtccacaccggcgtcgcgggtgaaggcacgcaacggaacctggaggtgggctgcggcgttggccagcctggcgccgtccatgtggagcttcatgcccctggtgtggacgtggtcggcgatggcgcggacttcctccggcgtgtagcaggtgccgagttccgtggtctgggtgatggagacggcgagcggctgggcacggtgttcgtctccccagccccaagcctcccggtcaatgagttcgggcgtgagcttcccgtccggcgtcggaacgtgcagcagtttgatgccgccgacgcgctcgggggcgccgttttcgtccatgttgatgtgggccgtggaggcacagaccaccgcaccccagcgggggagcagcgactgcagcgaaagaacgttcgcgccggtgccgttgaagaccggaaagcactcaatcccgggcccgaagtgctcctccatcagttcctgcagcctggcagtatagtcgtcctcgccgtaggagacctggtggccgtcgttcgcggcggccagcgccgcgaggacttccgggtgcaccccggaatagttgtccgaggcgaagccccgcacgttcggatcgtggaggcggaccccggcggcggtttcagcggttgttgtcatgggtttgctcacgctttcagtctaggtacgtcagggctccagcagcagccggctgccgttcagttcagcggccggggcctggaagaggccgacgacggcgcgcgccaggtccccgacgtccgttgccccaggaaatgaacgctccgggtggctgcggcgcagcccctcatccaccagggccttcaccaccaggacgacggcggcggccgtgccaccgtcgcctttcccggagtcccggcggaaaccatcagccacagccatggtccatgcctcggctgcggccttcgctgcggcatagctggcccccgccgccgagggcttggcgacggcggtggaggacaccatggcaaagcggccgtccggggaggctgcgacgtcgtcgtaaaatacgcgcgagacgtttcggagcgtcgtgatggctccccgctcaaggaagtcccagtcctcgtccgtctggtccgtgatgccgcgtgcgccgcgccagccgcccaccaggtggatcacggcatccatcggtccggcggcggcggagacctcggcccgcagctgccgtacctcctccatccgtgccaggtcgcacacgaagggggcaacgccgtcgcccgcttgttccgccgccgcattgatcctggcccggtccgaccccacggtgaagacgcggtggcccgcttcccggaggccgcgggccacggcgatgccggacgctccgctgccgccggtgaccagcacgttcatccgcctatgtgctgtacccggtgtttccgtcacagggcagaggctccggtgatcccggcagtcgactcaatgacggggcgcatcttcttctccagcgcttcgtagaacatggacagcggaaattcgtcgtcaagtacttggtcggtgaggccgcggggcggaccggccagcggcagggcctccgggcccttcgcccagacggacgccgggtggggagtgacggtggtggaaatcagctggtacgcggccagccagtgggcggtcttcgggcggtcaatggagcgccagtacagctcgtcgatgctcgcgccgagggcgatgacggcgttggcgacttcatcccagtcgatggtgagccgggtgtccgtccagtgcaggacccgctgctggtgcagccacgcgaacaggagctggccgcccaggccgtcatagttccgaacccggctgccggtgatcgcgaaccggaagatgcggtcaaagatgatggcgtactgcaccagtttggcgtggcggcgggcttcaggatcggcgtcctcgtcttgttctatccgtacggattcgcggaacgccgtcaggtcgcagcgcagttcttcgagcgagtacaggaagaagggcatccgctgcttgatcatgaacggatcgaacggcagatctccgcgcatatgggtccggtcgtggatcaggtcccacatgacaaacgtggcctcggtcaggtcctggtcggcgagcatctccgctgcgccttccggcagttccaggcaggtggtctcggctgcggctttgagcacgcggcggaacctggccgcttcccggtccgcgaagatggccccccaggtgaaggtgggggtcttgctgactgcgacggtctcggggaacagcacggcggaattggtgtcgtagccggcggtgaagtccacgaagcggatgggcacaaacagcttgttcgagtagtctcccgcctcgaggccggcgatgaactccggccagatcacttcgaccaggactgcctccaccaggcggctgctgctgccgttctgcgtgtacatggggaagaccaccaggtgctggaggccgttccggcgctgctcctgcggctggaaggcgaggagggaggacaggaaatcaggggtggcaaacccggcgcgggcccagccggaaaaatccgcgcacacagcatccaggtaggcggcgtcgtgcgggaaggcgggagccagggcgcggacggcaccaacgatgtcctccacccgggaagctgcctcggagtggtgggcggcgtcggggatggagccgtcctggacctggagggcctgcagggcagtggcggcgcccttgagccgcttccagtcctggttctctgcggaaatcccggtgacggcggtggtcagggtttcggtcatcgtcggctgcctttctggttgcttgctacctgatgccgagcgtagcaagcaaccagcagggctaatgcgcaaaggaccttagcctaagaaagcgttgggctcaggtgccaaatctgtcacaggaggaggcccgtagctgggggatcagttctcccgttccgctccgctgacctgcgaatcctcctgcgggaccagccggatggagatggagttgatgcagaagcgctggtccgtgggggttccgaaaccctcaccttcaaacacatggcccaaatgggaatcacatgatgcgcagcggacctccacccggtccatccccaaggtgcggtcgtggatatagcggacgttcccttcagcaagcggggcccagaaggacggccacccgcagtgggaatcgaacttctccttgctggtgaaaagctctgttccacacgcgcggcactggtagacgccggccgtgtgggtgtcccagtattcaccggtgtacggacgctcggtccccgcctggcggagcacatggtattcctccggcgtgagttcctcacgccattgggcatcggtcttttcaacgcccttgccgcccgcggcggatgacgcccccggggcgggcacagctgtgtcttgggccttatgtccgaaaatgctgtttccgaagatgctcatagccttgtcaacgctcacgagtcgccaataaatcccgagcccgcgtacaggtggagcacgggtacaccaagctggtcctgtgccttgttggcccagtccgtgtggaaagtgtccgccacggcatgcggccgggtgattaccactgcctgcgctgcaccggtctcgcgtactttggagaccagtccgctgacagctccgccgtcgacgacttcccccgtaacgcctgagcccagtccctccagggccgccaaggacacggacagggtctcggccgcctgggcacgttcctgggagggatccggcgcgtgcgaggtcaactcccggaaggccttggcgatgtccaggagcgaaaggttctcgaggaagtccaccagcaggtgccgctcggtgtttgccggcaccaggacaaccaggtgggtatccgcgccgtcgacgaggcgttcgatgttcaggcggtcgtccgcccccaggggttcttcggtcaggatgacgatgggttcactcatggccctagcctagtcctgcagcgctgccctgcgcagtggcagccacgcccgcgcgaaggtgccggcaggcaatgactgcatgcggcggaatgcgggcatcggtgccgggccggtaagaatagttgcatggcatctttccagcgaacccgccccgcccccgtccagagcagccccgattccggggggatgtcgctgcgggccaaatgggcaatcggcggagcgatcggcggtggcggcctggcagggctcctggcaacagggtcatcggcgctcgccgtgtacttcgcgcggcgggtcatcacaccggcacggcagcgggcagcagaccaggaaatgctcgcgctcatcagggacggccagcggcagcaggcgatcttcgccgccacggacgacaccacggtggacggtgtctacgggttcttcttcgacggcggcaaagggcacgcgcggatcggccgcatcgtctcttattcgcccgccgagcggaccgtcctgcgggacgttgaagcggtctacgccggggacctctccacggcccgccgcggctggtggagcggcgccgtccatccggaccccgccgccgtcggacttccgtacgaggaagtaatgatcgacgtcgaccgggggcaggccccggcctggctggtccgcgccggcggaacggcccggacctgggcggtgatggtgcacggacgcggagccacgcgccaggaggcgctgcgcgctgtgggccccgctttggagctggggcttaccagcctcctggtttcctaccgcaacgacggccttgccccctccgccgatgacggccggtacggcctgggctccacggaatggcgtgacgtcgaggcggcaattgagtacgcgctggccaacggtgcggaagagatcgtgctgttcgggtggtcgatgggcggcgccatctgcctgcaggcggccgaccagtcccgctgccgccacctgatccgggcgatggtgctcgatgcgcccgtcactgactgggtgaatgtcctggcccaccatgcgcagctgaacaggattccctccctggtgggccggtatggccagctcatgctggggcacccactggggaggcgcctcacgggattgtccgccccggttgacctgaaggcgatggactgggtgtcgcgtgcagtggaactccgcacgcccacgctggtgctgcacagcgtcgacgacgaatacgtgccgtacgggccctcaaccctgctggcggagcgaaacccggagatggtgaccttcgagcccttccaccaggcacggcacaccaaggaatggaacgtcgatccggagcggtgggaaagcctggtcaaggcgtggctgcggcagcagctggcacccaggctgaatccgggcgccctcgccccagccggtccctgaagcgggtcaggcggacagcgaactgatgggtgccgtgacggcctgggtgaggcggaccaggtcagccggtgccagttctatgtcaaggccacgctttccgccggacaccagcagcgtctccaggcccagagcacttgagtccagcaccgtgggggagggttgccgctggccgagcggggagatgcctcccagcacgtagccggtacgccgctgggctgcggccggatcagccattgccgctttcttggccccgagggcggtggcaaacgccttaaggtccagggttccgctgaccgggacgatgcccaccgccagccggccctccacctcaaccatcagcgtcttgaagacccttgagggatcgatcccgagggccgcggcggcctcggccccatagctggcggcggacggatcgtgcgtataggggtgcagcacaaagggaaccccggccgcggccagcgccgccgttgccggggttccctgtgaagcattcctgcgggccactgtgctggtccgggcagcagctaggagcgcacgccggaagcggcagcgaccttgcgcttgatccgccccagcatggccgtcatgccccgcatgcggagcggcgtgatggcccgggtaaggcccagaagttctggcatatcgtccgggacagagaggatctcttcggcggacagcccgtccaggccctcgtgcagtacaccggcgaacccgcgtgttgtcggggcctcggcgggagccttgaagaacaaccgcacggtgccggccgggccgccgtccttttccgtctcgatggtgaggaagagcggcgactggcactccaccacctgttccaggagctcggggtggtctttgagccggtccggaagttccgggaggccctcggagaattccagcagcagctgcagccgctcgggttcggacatggcctggaaatcgtccacgatggccgccagggcggtaggcaaagcttgagtagtcatcggttcaagtctacgcaatggctgcggcaccggccgcgtcaggcaccgactgcaacaggaacagaaccgcgttctgcacccttgacgattggcgcccgcacggcgttgccccattcggtccaggaaccgtcatagttgcggactgaatcgaagcccaggaggtacttgagggcaaaccaggtgtggctggaacgctcgccaatgcggcagtacgccacaacgtcgtcgcctgcggccagccctgcttcgccgaggtaaagggcctcaagctctgcacggctgcggtaggtgccgtcgtctgcggcggcgcgtgcccaagggatggaagcagcggtgggaatgtggccgccgcgcagggcgccctcttccgggtaggccggcatgtgcgtgcgctggcccgtgtattcctcgggggagcggacgtcgatgagcggcttgccaaggtgggcaaggacgtcttccttgaaggcgcggatgggagcgtcattgcgctcgacgacggggtagtcacccttggccggggccggcttttccctggtgagttcccgtccttcggcaatccacttgtcccggccgccgtccagcaggcgaatatcctggtggccgaaaagctcgaaaacccacagggcgtaggcagcccaccagttggatttgtccccgtaaatgaccactgtgctgtcacgggagatgcctttcgacgccgccagatcggcgaacgcggctccgtccacgtagtcgcgggttacgtcgtcgttcaggtccgtgtgccagtcaatcttcacggccccggggatgtgcccggtttcgtagagaaggacgtcctcatcggattccaccaccaccagctcaccgttagcgacggcgccgctttcgatagcggccgcgagccacccggtggagaccagccgctccgggtgggcgtaggctgcgaacttctcattctgttcaacggggtagggcatgatcttggcctttcattggggacacggagagcctgctgggcctggcggcgccggcattgggacctgcttccacactagccagcaccccggccggtgtccgtattccattaacaggacgaaatgttgccttcatcacgctgcgccggccgggagcttgtaacgcggcctgtggcggcaccatgggacggcagcgtgggacggcaacgtgggtccgcattgccggtatcctttctggggaccaaccaccagcagaacggacccccttggtacagatagaacagctcgccgcccgcactccggctgtttcggtggatgagctcctcaaaggtttctatccatcgccgcggttcggccaggtttccttttccagctaccgccccgatcccaagcagcccagccagtctgcggccgtcagggcactggaagggtttgccgacggcgtgggcaccgcgggcgggggaggactgttcaagaagttcttcgccaagaaggatgagtcccgcgccggcatctacctggacggcgggttcggcgtcggcaagacccacctgctcgcctcgctgtggcacgcctcgcccggccccaaagccttcggcaccttcgtggagtacaccaacctggtgggtgcgctgtccttccgcaagacggtggatgcgctcagcagctacaagcttgtgtgcatcgatgagttcgagctcgatgatccgggcgacaccgttcttatgtcccggctcatgcgtgaactggccgacgccggggtgaaactcgcagccacctccaacaccctgcccggttcgctgggcgacggcaggttcgcggccgtggacttccagcgtgaaatccaggtcctcgcggaccagttcgatgtcctccggatcgacggggaagacttccggcaccgggggctgccggcagcgccggcgcccctgaagaccagtgaactgtcctcgcacatgaaggcggaattcgacgggaagacggtggcccaggacgagttcagcacgctgatccaccacctggcgggcgtgcaccccagccgctaccgccagctgattgacggcattgacggcgtggtgtggcgcaacgtccacaccatcacggagcaggccgtggcgttgaggttcgtggtgctcgctgaccggctctatgacaaggatgtccccatcctcgccagcggtgttccgttcgaccagctgttcacggaggaaatgatgacgggcggctacatgaagaagtacttccgagccgtttccaggctcaccgcactggcccgcgaaggccagaaccacgaaccgtcctagcggcggtacagcctggtcagcttgctgctccggaacggcgcggcttcagcaccagacgaaccgccagcccggcagcgagtgcccagaacgccgacccgataccggcaaaagcaaggcccgaggccgccatgaggaaggtgacggccggggctatcctgtcctccgggtcggccagcgcggctgaaacggcgcccgccagggttcccaggagtgcaaggccggccactgcttcgagcatgccggccggtgcggccgtcaccaggctcaccagcgcagcggagaacgcagccagcacaaggtaggtaaatccggaggtgaagccggccacccaccggcggtgccggtccggccccgcctcctcaccggctgccagggcggcgctgagcgctgcgagattgacggcatgggctccgaacgttgctgctgccgcggtgcctgcaccagtcaccagcatggccggacgccatggggtgtcgtagccgaaggacctcaggacagccacgccgggaacgttctgcgacgccatcgtcaccacaaacaggggaagcgcaatacccgctatcgcctgcaggctgaagtccggcgcggtccaggccaggcccggaaggatttcgccgtcccccagggaggtgccccctgcggccagggaaatgccgatcacggccagggccaccagcagggctgccggcacggaccagcggggcgccagcttcatcatcagcagccagcacaggatgaccggcgcaatgaacagcgggactgtccccaacgccttgaacggtgccaggcagagctgcagcaggactccggcgagcattgcctgcgcaagggttgccgggatccttgtcatcagccgccccagggcggggaccataccggtcatggcaatcagtaccccggtggcaaggaaggctccgacggcggccggccactcgccgtcgaccgttccggacgttgccagcagggcagcgccgggtgtggaccacgcaagcgtcaccggcactttggaacgccaggaaagccagagcaccccaaggcccacggccagcgtcagtgccagcagtccggacgctgcctgcgcagggctggcgcccactgccctgagcccggccagcaccacggcgaaggacgacgtgaagcccaccagcgcagtgacaatgccggccacaacgggtcggtaatcgagcctggcctgcgcgggtgactgctgtgccgtggggtatgcgggggacttcgccataggggcaggttaccggccctgtttcgtaaaccccttcatcggcccggacgtgggggttaaacgcgctggttaaacgccaaaggtgcaggtgccgcctcccggcgggacctgcacccccttgacgtgctagggcatgatcctggccaaatcctgttacggagtcctgtcagccggcggaaccgggttgacgggagttaccggcggaacctgctcggcggcaggcgcctgtcccggggtaccgttcttgtcaatgagcttggaagcgccatcctggaccttgttgacgtggccggagtacttgcctccggtcttggtgtcaatcaggtcaccggccttggtgatgccgttcttgatggcctgctcgttgccacggataagaccttgagccttgccctttagatcgccaattagtcccacgagcacctcccttcaatcgcggagccaggtcgctcctccgcattcgatcctagcgccgcggggaaggcctgccaaggaaatcagggggtttggccgttcgcccgcagcggatgcacgcctgcctgcagcgggcgcggttctgatggaatccgcatgggagcggtagataagagcgcggcggtggccgggcaagaaaaaagcagctccggggagctgctgcatgtgggcgatactgggatcgaaccagtgacctcttccgtgtcagggaagcgcgctaccgctgcgccaatcgcccggaaccggaagaccggccaatgggattctaagaaacaagagagcggacgacgagattcgaactcgcgacatccaccttggcaaggtggtgctctaccagctgagctacgtccgcagatatgaagtgcgttccggccggagccggtcgaactgcatgaagcaagtttccttgcttggtgggcgatactgggatcgaaccagtgacctcttccgtgtcagggaagcgcgctaccgctgcgccaatcgcccatgtccatccggaggtgatccggaaaccatggttttcaccgaggtgggtacgggattcgaacccgtgtatacggctttgcaggccgctgcctcgcctctcggccaacccaccgtgtaagcgtcgattccgaagaacttttgctgtgacagtgtcctgcgagcggacgacgagattcgaactcgcgacatccaccttggcaaggtggtgctctaccagctgagctacgtccgcattttggaggctgattccctgccgttcccggcatttcctcgcgttccaacgagtaaaaacaatataggaggttcaaggattctccaaatcgccagcgccccgattgccctttgtgtccgcccttcccagcaatggcgcggttttggcctacttacagctgtgtaatttacgacgacgggtgcgtgccccgggtgccgcgcccggcaggttggcgggacgcgccccgcccgctgcggcggcccgggatggctgcgtggaggccgatttttgaattgggtgcggcgtcggctagcattcaagtgcatcagggcgattggcgcagtggtagcgcgcttcgttcacaccgaagaggtcactggttcgaacccagtatcgcccaccgcacaaaggtccgtttccgctcgcagcggaagcggaccttttttgtgtgcggatccgtgcctgcagattttgtcggccccctgtgaaagagttttttccatgacagctccacttctcgcccacgccaccgaatacggccggatgtacgcccgctcaacgtcggagcagttttcggttccgtccatcaccaccgttatcagccagcagccgcacggactggatggctggttcgggtacatgggcgccagcagcctggcaaaggatccgctgctggcggactgcctgggaagccctgccaaaatccgccaggctgtcagccgcgcagccaaagcagccgagacctatcgggacgacgccgccaagcgtggggaccgcgtgcacaactactgcgagcaggtggccctccgcgccctgggccgcccgcacaccatgaaggaagcccgcgaggccctggccgccaacggcgaggaagccttcgcggtgcgctttgacgagtggtgggagctgttccgggttgaacccatcgccccggaaatcaccgtgtggaacaacgcggtgggatatgcgggaaccctggacctggtggcccgcatcaacggccgcgtttgcctcatcgactacaaaaccaaaggcaccacccgggacggcctggtcaaaccgctcgatgacaaggtggtgatgcagctcgtcgccgggatgaaggcggaagagagcctggttgatccggaggccgggacctgggagccgtggaagtacggagaggaccccgtcctgctggcggtggccatcggcgaaaccgaagttcgtcccgtgcgggccaaccccgacgtccttaagcaccactggtggaagttctgtgccctgcggcgggtgtgggagctcaacgcggataccatcagcgccggtgccgcgctgctgcccatcgcaccgccgccgctggcacagatgcgcacggcctagcgctttgtctgcacttggtatgtctgcggaccagatgactgcgcctaaactggacaggttccctttaccgccaactgtaaggaattactacgcatggctatcctgaatatccgcatcattggcgatcctgtgctgcgcacagtggccgatcccgtgacggaattcgggccggagctggccaaactggtggcggacatgaccgaaaccatggaggacgtggacggcgcaggcctcgccgcgccccaggtgggcatcagccagcgggttttcacctaccggattaacggcgtggaaggccacatcatcaaccccgtcctggaaaacagcggtgactaccaggaggaccaggtggagggctgcctgtccatccccggcctcggctttcccgtgcggcgtttccgctccacccggatcaccggcgtggacatgcacggaaaccccgtcacggttgaaggggaagggatgctggcacggtgcttccagcacgagaacgaccacctggacggcatcctctacaccgaccggcttgagggggaggaccgcaaggccgccctgcggtcaatccggaacgccaactacggctccgtcaccgagcgtacggccgccaagcgcgccaagacggtcggatccagttttggcggcaccactcccggttccagttttggtcccggagcggccggttacgccgggtgagggtcctgtttgcgggaacccccgcagtcgccgtgccgtcccttgatgcgctggtggaggcaggcttcgacgtcgttgccgtgctgacccgtcccgatgcccccgtgggccgcaagcgtgtcctgacgccgtcgcccgtggctgcgcgcgcagccgagctcggcatcgacgtcatccgcgcagcccgcgttgatgccgaggcgaccgccaggatcgctgacgtaaacccggacgtggccgtcatagttgcctacggcgggctggttccgcctgcagccctatccgttccccggtacggctgggtcaacctgcacttttccctcctgccggcctggcgcggagcggcacccgtacagcgtgccgtcatggccggggacgacgtcaccggggccgtgacgttcctactggaagaggggctggataccggccccgtcttcggcaccctgaccgaatccgtgggcccggaggacaccgctggtgaactcctggaaaggctgtctcgcagcggtgcggtcctcctggcccagacgctgtccgccatcggtgcaggcaaagcggcggcgcagccgcaggcaggcgaggtttccctggcgcccaagctgacccttgaggatggccacgtcaactggaaccatcccgcacttgccattggccggcaggcgcgcggcgtcactcccgaaccgggggcctggacggtcctggacgaacagcgggtcaagctggaacctgtccggctccggcccgatgtcacccatctcgcaccgggggcactgtcgctccacgggaagagcgttctggtgggcacgggctcccacgccgtggaactgacccggatccagcctgcgggcaaaaagatgatggccgctgctgactgggcacgcggcatggcttcccttgaaagtgtggtgttcgaatgagcgggtccggcggcaacccaggcgggcgcggcagcggcggtcagggcgacaaaggcagaggcaacgccgggaaggacagcaccgggcagggacggggcaaaggcggaccccgcgacaacagccgtcgaaacgcccaggggcgtgaacgcaaccgcggaccgcagcggaacttcacggacaaccccccctcccagcgcacccgccgggccgatcccgcccggcttgtcgccttcgaagtcctgcgcgccgtggcggcggaggacgcctacgccaaccttgtcctgccggcacggatccgccaccacgggctggacaagcgcgacgccggattcgccaccgaactgacgtacggcgccctgcgcggccaaggcacctacgacgccatcctggcccgctgcgtggaccgcccgctggaccagctggatcccgccatcctggacgccctgcgcatcggggcgcaccagctgctggccatgcgcgtgccggcgcacgccgccctggaccagaccgtcggcctggcgcgcgcagtgatcggagcagggccgtctgcgctcatcaatgccgtgctgcgcaaagttgccgcgcacaccctggaggagtggctggacaagctcgtggcgggcgaaaccgacgcaacgaagatcgctgcgcttcgctacgcccaccccgaatggatcgtccgtgccatgcgccagtccctggttgcacacgggcgctccgccgatgaaatcaacaacctgctggaagcggacaacgcagctcccgtggtgaacctggtagccctcccggggctcggcaacctggacgaggccctggaacacggggcggctccgggtgagctcgtcgaaggttcggcactttccagcggtggagacctgggacggttctcctctgtccgggaaggcaccacccgcgtccaggacgttggctcgcagctggtggcccgggccatggccgccgtcgaacttggcaagcccgcaggcgggccgggagacggaaaagccgaggcgtggctggacctctgcgccggccccggcggaaaggccgccctgctcggcgcactggcgaagcaacggggcgccacgctgctggccaatgagcccgctccgcaccgtgccaagctggtgagccaggccctctccgccgtgccgcgggacacctggcaggtccggaccggcgacggccgcgagctcggcaccgaaaagcccggctcctttgaccgcgtcctggtggacgttccctgcagcgggctgggcgccttgcggcgccggcccgagtcccgctggcgccggtcgcccaaggacctggcggaccttggcccgctgcagcgcgagctcctcgcctcggccctggcagccgtgcggcccgggggagtggtggcctacgtgacgtgttccccgcatccggcggagaccaccgccgtggttgccgacgccctccgcaagcgtgacgaccttgaactcctggacgccggggcagcgctggacgccgtcagccttccggggaagctggacgcgggccacgagtccacggcccagctctggccgcacatccacggcacggacgccatgttcctggcgctcatccacaaaaaggcctaggcgaaagcaacaacagaccagtgaaaggcaatcccgtgacgcaatgctgcatcaacccgagcatcctctccgccgacttcgtcaaccttgaggccgaactgcagcgcatcagcaccgctgacgccgtgcacgtggatgtcatggacaaccacttcgtccccaacttgaccatcggactgcccgtggtgcagcgcatccaggctgtcagccccatccccctcgacgcgcacctcatgatcgccgatgccgaccggtgggcgccgggatttgccgacgccggcctggcatcggtcaccttccacgccgaggcctccctcgccccggtgaagctggcacgcgaactccgcagcaggggttctaaggcggggatggcgcttcggcccgccacccccgtggaaccgtacctggacatgctcaccgagctggacatgctgctcatcatgaccgttgagcccgggttcggtggacaggccttcctggacctcaccctgccaaagatccggcgggcaagggcagccatcgatggctccggagcgggcgtggccatccaggtggacggcggcatcacggaggaaacgatcgtcagggcagcagaagccggcgccaccgtttttgttgccggctccgctgtttacggcgctgacgatcccgccgcagccatcgaacggctccgcgggcagggcagccgtccgttacgtggggcgtctacggaatagccgggagcccgcgccggttatggcacaatagcaacacacatacgtgctccggggtcggtgtaagtccgaaccggcggtgacagtccgcgacccgcgagccggtgccttccgcaaggaaggcccggcggacggttgaaccggtgaaattccggtaccgacagttaaagtctggatgagagaagcacgtacagctgtatctgtggggccgtcccggtcccgcagccttctgctgtcgtatacccccggagccatcgcggttcgagagggaaggaacgacacaccatgaacccccagcgatggctcttaactgccggacgtcccgccgcttcagcgcaggacgcagccgcggcgatggtcgcggcatgacggcggccaaccagtttcttggaaccggcgccgccaccaccgccctccatcccggccacccgctccagcctgccgacggtgtggtgaccgccttcagcgccggcgagacccgggccatggaggctgcactgcaagcagccctgcggggcccgcgcggggcgaaccccctggtgggcgccgtcgtcgtcgatcctgccggcaaccacctgatcaccgggttccaccgcggcgccggcaccgcgcacgcggaggccgatgccatagcgcaggcggcagcagcgggcctggatctttctggctgcaccatgctggtgacgctggagccctgtgaccatctgggacgcaccggcccctgcacgcaggcgatcattgccgccggcatcacggacgtggtgtacgccgtggacgatccgcatgaccccgcagcgggtggggcggcaacgctgcgtgccgccggcgtgcgcgtccgcagcggcctgggagcggccgaatccctggacctgaaccggcagtggttcgaagccgtgacggcaaagcggcctttcgtcaccctccacatcgcccagacgctggacagccgcatcgctgcccaggacggcaccagccagtggatttccagcccggaatccctggcggacaaccacgccatccgcgggcggatcgacgccatcctggtgggtacccagaccgtcctggtggacaacccccggctcaccgcccgcgacccgcagggaaccccggcgccgaaccagccggtccgggctgtcatggggttgcgggacgtccccggcggggccgccgtgcgcggaacggacgggcgcgtcacgcacctgcgcacccgcgacccccacgaggcgttgtccctgctctatgcgtccgggacccgccacctcatggtggagggaggctcgcgcatcctgagcgccttccttgccgccgggcttgttgatgaactgattgtgtacctggcgcccaccctgctcggctccggcacccccgccctggacggccttgggatcagcaccctcgccgacgcccagcagtgggaatgggacgagtccgacggcggtgccgtgcgcaggctgggccgcgacctaagacttcacttaagaccgcagcgaaccgttgccctagacccccaaccgtcccgcgcaaccgcggagcaagccaaggaaggccactgatgtttaccggaattattgccgaacaagggcacgttctgtccgtcgagcgggacggggacgccagcgccacactccggctgcacgcgcccggcagcactgaagggctcgccttgggcggctccgtggccgtgaacggggtctgcctcacggccaccgggattagcggcacggaattcagcgtcgacgtgatgggggagaccctggtccgcagcaccatcggggagttggcgccgggcgactccgtcaaccttgagcggtgcgttcctgcgggcggccggctggacgggcatgtggtgcagggccatgttgacggcgtcggcgtgctgctggaacgggaagccctgggcaactgggaacggctccgtttcggcgtgccggccaacctggcccgctacatcgcggagaagggctcaatcgccatcgacggcgtctccctcaccgtcaccgccgtcagtgacgccgccgagcccgagccctggttcgaagttggcctgattcccaccaccctggccgaaaccgggctgggttccaagaccacgggcagccgggtcaaccttgaggtggacgtcctggccaagtacaccgaacgcctccttgcgttcagcacatcagcttctgctgtccttgatggaggtgcaccgtgaacgccgttctccggcttgagcccgaggcagtgcagccaggcgttgagcctgcccccggtgcccgcgggctaaactccatcgaggtggcggtgcaggccatggccgccggccggccagtgcttgtggtggacaacgaggaccgcgaaaacgaaggcgacatcatcttcgcggcacagcatgccacccccgcgctgatgggatggaccatccgccacagttccggcgtcatctgcgttccgctgtccggcgaccgggcggatgcccttgcgctgcctcccatggtggcggtcaacgaggacgccaagggaaccgcctacaccgtttcctgcgacgccgcactgggtgtcagcaccgggatctccgccacggaccgggccctcaccgccagggtccttgcggacccccacgcggtgccggcgtccctgacccggcccgggcatatattcccgctccgtgcagttgacggtggtgtgcgggaacgccccggccacaccgaggccgcggtggacctgtgccgcctggccggcctcgagccggtgggcgtgattgcagaagttgtttacgacgacggcgagatgatgcgcctggacgggctcctgaccttcgcggctgagcatggctgccccctgatctccattgaggatctggcggcctacctcgcagcggggggaaacgaacccacggagagcgcccgcgaggttccgggcgtcgagaaggagacacgatgacctcttcgacagcccgcggcagcggttcgccgaacggccacgggacttccgctgacggccttggggcctccccggccggccacggaccctctgccaacgggcaggagcgcagcagcaacggcgttgccccgcaccccgtgagcggcggcccggtagtgcagctgcccacggcttttggtgatttcgtggcgcaggcctggacggatctggtcaccggcgttgagcacctggccgtcagttcacccaacccgcccaaggacggtaaagcgcccctcgtccggctgcactcggaatgcctcaccggcgacatctttggctcctaccgctgcgattgcggggagcagcttgccttcgccctggaaatgatccagcaaaacggcggcaccctgctctacctgcgggggcaggaaggccggggcattggcctggccaacaagatcaaggcttacgctctgcaggaggcgggcttcgacacggtggaggccaacgagcagctggggctccccgtggacgcccgctcctacaacgccgcggcgcaggtcctggcggaaatgggcctccatgaggtgcggctcctgagcaacaacccggacaagcagaacaggctggcacgggcgggcgtgaaggttgtggagatggttcccacagaggtgccgtcccgcgatgagaacatccgctacctgcggaccaagaaggaccgcatggaacaccggctgctgctggacacccatgtggttgcggttcccgtcaccaccccggaaaccttcgagcacgaacaagactgacgcgctgcggcacacccaccagccgcagcactggcaagacacaccaccacgactgaacggaacagactgacccatgagcggacacggcgcccccgatatcgacctcagcaccctcaaccccgcagaaacgtcgcagctgcggctggcgattgtggcggcaagctggcacacccagattatggacggactcctggacggagccctccgggcagcgaaggacgccggcattgccgaacccacggtcctgcgcgttcccggcagctttgagctgccggttgctgccgtccggctggcaccgcacttcgacgccgtcgttgccctcggcgtcgtgatccgcggcggaaccccgcactttgactacgtgtgccaggcagcgacgtcggggctcaccgacgtcagcgtgcgcaccggcgtccccgtgggcttcggcgtcctgacgtgtgacaccgagcagcagggccttgaccgggccggccttcccgggtcaaaggaagacaagggccacgaggctgtcaccgcggcgctggccaccgccgtcgtgctcaagcagtacggcaaataaaggaccctgcaggacgggcgcgcgtgtgtattcgctcacatcgcgcccgtcatgcaacgggccgggaagcgccccgtgggctgcagcaagtaggctggagggcgtgaagaatttcgagacgctgttcgctgagctcagcgagaaggcagccacccgcccggaaggctcccgcaccgtcgctgaattggactccggtgtccacggcatcggcaagaaagtcgttgaggaagcagccgaagtctggatggctgccgaatatgaatccgatgaagccgcggcagaggaaatctcccagctgctgtaccacctgcaggttctgatgctcgccaaaggcctgaccctggaagacgtctacaagcatctgtagccaccggtccggcgcgctccacgccgccggtgcccgccgtggcctgcattgcctgaacacctagacctccccacaccagaaagacctccaatgctgcgagtagccgtccccaacaagggctccctgtccgaagccgcctccgccatgctgtccgaggcgggctaccgccagcggcgggatacccgcgaactggtcatggtggacccggacaacgacatcgagttctttttcctccgcccgcgggacattgcggtgtacgtcggccagggaacgctcgacgtcggcatcaccggacgcgaccttctcctggacgccgaggtggaggccgaagagctgcttccgctgggcttcgctgcctcgacgttccgttttgcaggtcccgttggagactttgccaaggttgaggagcttgagggcaagcggctggccaccagctacgacggcctgctccgcggctacctcgccggtaagggcatcaacgccaaggtggtccgcctggacggcgccgttgaatcatcagtcaggctgggcgtggcagacgccatcgccgacgtcgtggaaaccggcaacaccctcaaggccgccggcatggaaatcttcggcgaccccatcctgaagtctgaggctgtactgatccgccgcaccggcgaaggcggcgccgccaacggcacagccaaggaaatcgaggtcctgatccgccgcctgcagggcgtgctggtggcgcgccagtatgtgctgatggactacgacatccgcaaggaactggtggaaagcgccgccgcactcaccccgggcctggaatcgcccaccgtctccccgctgcgggattcggactgggtggccgtccgctccatggtcccgaagaaggaaaccaaccggatcatggacgagctgtacgacctgggcgcacgcgccatcctggtcagcagcatccacgcctgccgcatctgagccggcccccgcagtaccaacccgcgcttagcaacccagcgcagcacaagacagaatttccaggagctcccatggcagtagcagtacgcgtcattccctgcctcgacgtggacgccgggcgcgtcgtcaaaggcgttaacttcgaaggcctgcgggatgccggcgatcccgtggagctggcgcaccgttacgacaacgccggcgcggatgagctgaccttcctcgacgtcacggcgtcctcgggcaaccgggaaaccacgttcgacgtcgtccgccgcaccgcggaggaagtcttcattccgctcacggtgggcggcggcgtccgcggtgttgccgaggtggacaagctgctgcggtacggtgcggacaaggcgtccatcaacaccgccgccgttgcccggcccgacgtcattgacgaaatcacccggcacttcggttcccaggtcctcgttctgtccctcgacgcccgccgcacccgccccgggtcccagcccacgccgtcgggatttgaagtaaccacccacggcggacggaccggcaccgggatcgacgccattgagtgggccagggaagccgcggaacgcggcgtgggcgagatcctgctcaactccattgacgctgacggcaccaaggacggcttcgacctggaactcatcaggctggtccgggctgcggtcaaggtacccatcatcgcgtccggcggagcaggagagcctgcccacttcccgccggccgtggccgccggtgcagacgcggtgctggcagcctccatcttccactggggaccggacaacatgatgtcccaggtcaaggatgctatccggaacgcgggcttcgaagtccgctgaagcgagtcccaacccaactgagtagcgctaagtgtcgttttgagggctcataacgacacttagcgctactcagttggaggggttagaggcctacttcggctgactggaggagcgcgacggcgtcgggctggccttcgaaggtcaccagggcgtggcgggtgcggccgtgggcgtgcatcagcagctcgcccggctcgcccacaatggccaccgagacaggtgcgcgcttggcgacgtggcggggcccggacggccggaccaggacgattcccaggtcaacaccgcggtaaaggatcgcggcgcgcttgacgagttcgtcccagagggcctccgagtacgcctcgtcgagtgcccgcggcgcccaccggtcaacggcgcggcggatatcctccgtgtgcacgaagtattcgatgaggttggagctttcgtcgagggccttgatgttcatcggggagagcgccggcggtcctgcccggaacgtgttgaccagctttgcgtacgcttcggcagtggtcagcttcgccgcgagcctggcagtggcctggtcagaggccttggccaggcgtttgataatcaggcccagtcctacggctgctttgcgttcgcgcaggtacaggtgcgcggcaaggtccctggtgcgccagcccttgcacagcgtgggcgcatcaggaccggccgcaagcagggtctcggccaggacttctcgggacggttcgacgaaatgcatcacttgtgaaactagcatgaccggcgcggagttgggcagcgcggccgcccctgctggcgtgccgtcgttcacacacgttcgagccgccgtgcaggcactagacttgacctgatgtctgagtaccccgcccccgtcccgaaccccggttccgccgtgcctgtggctgtcccgcccggcccggccgccgcctcatcgccaagcccgcttcccgcggacctggccgccgcgctcaagcgtgacagcgccggcctggtggccgcggtggtgcagcagtacgacaccaacgaggtcctgatgctcggctggatggacgacgaagccctgcaccgcaccatgaccaccgggcgggtcaccttctactcgcgttcccgccaggagtactggcgcaagggggacacctccggccacgtgcagtgggtcaagtccgtggcgatggactgcgacggcgacgcgctgctggtacgggtggaccaggtgggcgcagcgtgccacaccggcacccgcacctgcttcgacggccgggacctcactgtcaccaccggccacgcaggctgatactcttcacgacccgcagccagctgcgggcacgcgggggagcgccggccacccccgcaagcacacccacacgcgccggcgcagacggcccaacgagaacaggcggaacagcatagccatgcaggaccttggaatcatcagcccgggcctcgaggaattccgggagctcgccgggcacagccgcgtcatccccgtccggctcaaggtgctcgccgacgccgagacacccatcggcctgtaccggaagctcgccaacggccagcccggcaccttcctgatggaatccgcggcagtaggcggggcatggtcccgctactccttcatcggtgccagctccagggccacgctgaccaccaaggacggcaacgcacactggctgggccagcctcccgccggcgtccccgtggacggcagccccgttgatgccatccgcgacaccatcgaagccctccgcaccgacaggttcgacggactgccgccctttacctcaggcctggtgggattcctgggctgggaaacggtccggcactgggaacgcctggtcagcccgcccgaggacgacctgcagctcccggagatggcgttgaacctggtgacggacatggcggtccacgacaatgtggacggcacggtgctgctcatcgcaaacgccatcaacttcgacgacagctccgagcgggtggatgaggcctggcatgacgccgtggccagggtcaaggcgctcctggccaaggtcagcacgcctgtggcgcagcccgtctcggttttggctcccgcggcactggacttcgcctccagcgtccaggaacgctgggacgaagccgagtacctggccgcgctggaccgcggcaaggaggccatcgtggacggcgaggtgttccaggtggtgatttcgcgccgcttcgagatggagtgcaaggcgtccgccctggacgtctaccgggtcctgcggaacaccaacccgagtccctacatgtacatcttcagcctcgaggacgccgaaggccgcgagtactcgatcgtcgggtcttcgcccgaggccctcgtgaccgtcaccggtgaagaggtcatcacgcaccccattgccggatcgcgcccgcgcggcaagaccgtcgaggcggacaaggcacttgccgaggagctcctggcggaccagaaggaacgtgccgaacatctgatgctggtggacctctcccgcaacgacctgtccaaggtctgcgtggcggggacggtggacgtcacccagttcatggaggtggagcgcttcagccacatcatgcacctggtgtccacagtggtgggacagctttcgccccaggccaaggcctacgacgtgctgaaggcaaccttcccggccggtaccctttcgggcgcccccaagccccgagcgctgcgactcctggatgaactcgaaccgcaccgccggggtatctacggcggagtggtgggctacctcgatttcgcgggcgacatggacatggccatcgctatccgctccgcgctgatccgcgacgggcgtgcctacgtccaggccgggggcggcatcgtggctgattcggtcaacgacaccgaggccctggaaaccgtcaacaaggccgcagcgcccctccgcgccgtacacaccgcaggcaccctccagaacatctcggcagactcgcttcccggcaggtcggactcctgatgcaccgtccggaacccgcagcaggacaggagcctgcagccgggcaagcaggcgcagggcaggcggcagcggcgggcaggcggccggcggcgccagcctgggcgcgcaggtccacactggtgctgctcattgccgtcctggcgctggcggtcttcggcaccaccacccagacctggatcactgtcaccctcgatcccaaccagcttggccagggcggcgccgcgcaggagccactcccggtgcagggcagcaaggcggccaccgccgtcacggccctggcgctggtggccctcgccggcggcctggcagccgcaattgcgggcaggattgcccggtggctcatcaccgccatcatcgtcctggccgccgccggaatcgtcgctgccgccgcaacggtcctcaccaatccgctggcagcggcccagggttccattgcggaagccaccggcgttaccggaagccaggcccaggtggctgtcactgccttcccgctccttgccgtcgtcgccggatgcctgctggccctggctgccctgctgatcgtccccgcggggcggtactggaaagcccggacgaaatatgacgcaccggcgcccggcagtccagcggcggcaggcccggtcgacgagatcgacagctgggaccggctctcccgcggcgacgatcccacctgacccggcctgtactggccgcggctccggctgcgcgccgcccgataaccggttgcgggccaaaaaatggcagaatgtaagcagtattcaccctgaggagatttccatgagcaaagcacctgcgtccgtttccaagtccggcacccgcacggtagccccgggcgtcatcgaccacagccaggaacttggccacggcaacagccccgcagcctggacctgcgtcatcgtgatgctggtcggcgccctgatcatgtcaatcgcattcgtcattgccaacacccccatcttcatcgccggcggcggcgtcatggtgctgggcctgatcctgggctacgtcatgcgcaaggcaggctacggcgttgagggcagcaagctgaagaactccggccactgatgtccactgttctcgatgacatcaacgccggtgtcagggaggatatggaggcccggaaacggcttgtttcgctggctgaactgaaggacctgtcccaggccgcggcacctgcccgcgacgcctgggcagcgctcggcggcccatcaccctcccgggcggagctcaaagtcattgcggaaatcaagcgccgcagcccctccaagggagaccttgccgaaatcggcgaccccgcgtccctcgccaggcagtatgccgacggcggtgcctctgtcatcagcgtcctcaccgaacagcgccgcttcagcgggtccctcgcggacctcgacgccgtgcgggccgccgtcgacgttccgctcctgcggaaggatttcacgcttgatgagtaccagatctgggaagcccgtgcccacggcgcggacctgatcctcctcatcgttgccgcgctctccgacgcccagctcgccgagttcagcgccctcagccgggaacttggcatgaaggtgctggtggaaacgcacaccgaagaggaaatcgagcgggccgttgccgcgcaggcacgcatcatcggcgtcaacgtacggaacctgaagacgctcgacgttgaccgttcagttttcgcctcgctggccgggcagatcccggccggggcagtggtggttgccgagtccggcgtacgggacgccgacgacgtcacgcactacgccgccagcggtgccaacgccgtacttgtaggcgaggccctggtgagccactcgacaccgcgggagcggatcgccgagttcaaggcggcaggcgccgccgccattgccgcccgcggctgacgcacacacggtgcaggagcagaaggcggggtttgccccgcccgacggtcctgcccggccagcccgcggaaccacactttgagaaacatccaactggaacaggacgggaccgatggctgaagcaccctccggcaacgccgacaacgagactgacaacaatgccgccgaagcattcctgcagggcggctccctcaagcacgccccggggccctacttcggaagctacggcggacgctggatgccggaatccctgatcgccgcacttgatgaacttgaggagaccttcaacaaggccaaggaagatcccgaattccgggcgcagatcgctgacctgaacaagaactactccggccggccgtcactgctgaccgaagccaagcgcttctcccagcatgccgggggagtccgcatcttcctcaagcgcgaggacctcaaccacaccggatcgcacaagatcaacaacgtcctcggccaggcgctgctcgccaagcggatgggcaagacccgcgtcatcgccgagaccggcgcaggtcagcacggcgtggccagtgccaccgccgctgccctcatggggctcgaatgcgtcgtctacatgggtgccgaggactgccgccgccaggcgctgaacgttgcccgcatggaactccttggcgccaccgtcatccccgtgaccagcggatcgcagaccctcaaggacgccatcaacgacgccctgcgcgactgggttgccaacgtggacaacacgcattacctcctgggcaccgcggcgggggcccaccccttcccggccatggtccggtacttccacgaagtcatcggcgaggaagcccgcgcccagatcctggagcaggaaggccggctcccggacgccgtctgcgcgtgcatcggcggcggctccaacgccatcggcatcttccacggcttccttgacgatccgtccgtgaagatctacggcttcgaagccggcggcgacggcgtggacacgggacgccacgcagccaccatcacgctgggcaagcccggcgtgctgcacggtgcccggtcctacctcatgcaggacgacgacggccagacaatcgagtcccactcgatctccgccggcctcgactaccccggcgtgggaccggaacactcctacctgtcggacatcggccgggtgagctacgagcccatcacggacagcgaggccatggaatccttccggctgctgtgccgcacggaaggcatcattcccgctatcgagtcctcccatgccctggccggagccattaaggtgggccagcgcctcgcagccgaagccgcggccagcggcgggactgcgcaggacaagatcgtgattgtgaacctttcgggccgcggggacaaggatgtggccaccgcagccgaatggttcgacctgttggacaaggattccgccgagtcggaaatcggcaaagagggggagcagctgtgaccacggcacagaccaccagcaagtcagcggccgccatcgacaaggcccgtgccgagggccgcgcagccctgatcggctaccttccagccggctaccccagcgtggaacagaccatcgccgccggcattgccctggcggagaacggtgccgacctcatcgaaatcggcattccctactccgaccccgtgatggacggccaggtcatccaggccgccaccaccgaggcgctggccaacgggttctccgtcagccaggtgttcgacgtcgtgcagggcatcaccagcagcaccgatgccgccgtcctggtcatgacctactggaaccccgtggtccgcatgggtgtggacgagttttcccgccgcctggccgaggccgggggagcagggctcatcacccctgacctcatcccggacgaggctgccgagtggatggaagcatccgacaagtacggcctggaccgggtgttccttgtggcgccgtcctccacccccgagcgcatgcagcggacggtggacgccagccgcggcttcgtctacgccgtgtccatcatgggcgtcacgggcgcccggacctccgtcagcaccgcggcgaaggacgtggtggcagcagcacacgccgccggcgccgagcgggtgtgcgtcggcctcggcgtctccaacgccggccaggtccgcgagatcgccgcctacgccgaaggcgtcatcgtgggcaccgccctggtggcagcaatccgcgacggcggtgtggacgcagtcgctgccctcaccaaggacctcagcaccggactgagccgcggcaccggactgacagaggaagaagcctaaacccatgcagaccctccttcaggcagccgccctggtgccggccagcattccgagcccggactggtccgggttcgatattcccctgccctggggaacgctgcgcatccacgcctatgccctctgtatcctggcgggcatcgtggcgggcctctggctgacctctgtccgctgggcacggcgtggcgcgcctgaaggcagcgtctgggacatcgtggtctgggccatcccgttcggcatcatcggcggccgcctctaccatgtggtgtcctcgccggacgcctacttcggacccggattcgacggcaccggcgacctgtcgctgataccgcagatccagcgcggcggactcggcatctggggcgccgttgtgctgggtgtcgtgggcgcctggatcggctgccgccgcagcggcgtcaagctcagcgccttcctggacgccgccgcacccggactgctgctggcccaggccgtggggcgctggggcaactacttcaaccaggaactcttcggcggccccaccaccctgccgtgggccctgcagatcgacgccgacaaccccaactttccggccggaactccggcggacacgctgttccaccccacgttcctgtacgaatcgctgtggaacctcgccggcgtcgtcctcctgctcgcactggaccggaagttcaacttccggcgcagcaggctcttctggctgtacgccatgtactacacgctgggcagggtctggatcgaggcgatgcgcatcgatgacgccgagcagatcgaactgtttggcatcaccacccgcctgaacgtctggaccagcatcttcgtgttcctggcagccctcctcgcctttatcctgctgggaatgaagaagcgcgccgggcgggacaccgtgtatttgccgggccgtgagccggagaaagttgacggtccgaaggctgcagttgccgccggcgacgaggtccgtgatccggacactgttgtctcagatagtgaatcgcgtgataatctccctgataaccaaaacggttcccggcgtgcttccgtgccaacggaagaggccgcggctgcacgggcgggcactacgcccggaccggacgcaacggccgccggaaagtccggcagcactgccacaggaaccgcgccggaagccggcgctaccaagtagcgcgcgggccaggcagggcagcagagccaccgctcgaagcgcccaatcaccacagcgtcgtggcagcggggccaccctggacagcatagagctgctgtccggtgttgcccggggcaggggcctgcgtaactgttagttcagcaggccatgctgacctacaatttccagtaaataacactttgttgtgcccatgagagcggcgcccgacgagtggggccaacggcgtcccttccatacgcacgatcaggaggaaggacgtctcccatgacccaaactcttcacactcccagctggtcagaaccggaccagcctgagactgccatgtcgccgttcaagcgcttcgcatccctgccggaggcggcggggctctacaacccggagcaggagaaggacgcctgcggtcttgcgatcatcgccaccctccgcggcgagcccggctacgacatcgtggacgccgccctcaccgccctgcgtaaccttgagcaccgcggtgccgtgggcgcggacgagggcaccggtgacggtgcaggcctcctcatgcagatcccggacgagttcttccgcgcggtcacggagttcgaacttcccgctcccggccagtacgtggcaggtaccgctttccttcccgccgaacagcgtgaggccgacgccgcgaaggccggtatcgagggcctggcagccgatgagggcctgacggtccttggctggcgcgaggtgcccatcgtcgcggacctggtgggcgccatggcacgcgcctgcatgccgtacttctcccagcccttcctggcatccgccaccggcgaggaactggaccgcaatgagctggactcccgcgcctggcggatccgcaagcgcgcccagaacaagttcggcgtctacttcccgtcgctgtcctcgcgcaccattgtctataagggcatgctcaccacggcccagctggagccgttctacccggacctctcggacaagcgcttcaagaccaagctggccattgtccactcgcgcttctccaccaacaccttcccgtcctggccgctcgcccagcctttccgcaccatcgcccacaacggtgagatcaacacggtcaagggcaaccggaactggatgcgcgcacgtcagtcgcagctggccaacccgttgctgggcgacaccccggaagagctgtaccccatctgcaccccgggtgcctcggactccgcgtccttcgacgaggtggcggaactcctgtggctctccggacgccccatcacgcactcgatcatgatgatgatccccgaggcctgggaaaaccacgccaccatggatccggcacggcgcgcgttctacgagtaccactccctgctgatggaaccgtgggacggccccgccgccgtctccttcaccgacggcagcctggtgggcgctaccctggaccgcaacggtttgcgtcccggacgtttctggatcaccgaggacggcctgatcgtttttgcctccgaggtgggtgtcatcgacgtcgaagcctccaaggtggtcaagaagggccgcgtgtccccgggcaagatgttcctggtggacaccgaatccggccgcgtcatcgacgatgaagaggtcaaggccgaggtcgccgccgcgaacccgtgggcggagtgggtcaaggacaacctgatcgacctcaacgacctccccgagcgtgagcacgtggtccacacggccgcgtcggtgaacatccgccagcgcaccttcggctacaccaccgaggaactgaagatcctgcttggcccgatggcccgcaccggcgccgagccgcttggcgccatgggctcggacaccccggtggccgtgctgtccaagcgcccccggctgctcttcgactacttcgtgcagtccttcgcgcaggtgacgaacccgccgcttgacgccatccgtgaggaactggtcacctccctgacctgtgccatcggccccaacggtaacctcctggacaccaagcaggtccgccagccgcaggtccagctgccgttcccggtgatcaacaacgaccagctcgccaagatcgccaacattgagaacgccgacggcgacaaggtggccatgaaggtccgcgggctttaccgccccgagggcggcgagaacgcgctccgcgcccggctcaccgagatctgcgaacaggtatccggtgccatcaaccgcggcgtccagtacgtggtgctttccgaccgtgactcgaacgcccagtgggcgcccatcccgtcgctgctgctggtcagcgccgtgcaccaccacctgctgcgcagcgccaaccgcaccaagactgccctcgtggtggaagccggcgacgtccgcgagacgcaccatgtggctgtactcatcgggtacggcgcctccgccgtcaacccgtacctggccatggagtcggtggagcagctgattgcagctggcgacgttaccggggtcaccccgcaggacggcgtgtacaacctgatcaagggcctcggcaagggcgtcctgaagatcatgtccaagatgggcatctccaccgttgcgtcctacaccggcgcacagacgttcgaggcgctcggcctgggccaggagctggtggacgaattcttcgccggcacccactcacagctcggcggtgttggcctggacgtcatcgccgcggaagtttccgcgcgccaccagatggcctaccccgagggcggcatcgagcagccccaccgccccctgctgggcggcggcgaataccagtggcgccgcgatggcgagccgcacctgttcaaccccgagaccgtcttccggctgcagcacgcaacccgtgagcgccgctacgacatcttcaaggcgtacaccaggggagtggacgaccagtccgagaacctgatgaccctccgcggcctcctcaagttcaagaacgagcgcccgcccgttccgctcgaggaagtggagcccgtctccagcatcgtcaagcggttctccacgggtgccatgagctacggctccatctcccaggaagcccacgagacgctggccatcgccatgaaccagctcggtggcaagtccaacaccggcgaaggcggcgaggacgttgaccgcctgctcgacccgaagcgccgctccgccgtcaagcagatcgcgtccggccggttcggcgtgaccagcctgtacctgaccaacgcggatgacatccagatcaagatggcccagggcgccaagcccggcgaaggcggccagctcatggcgcagaaggtctacccctgggtggcccggacgcggcactcgacgcccggcgtcggactcatttccccgcccccgcaccacgacatctactccatcgaggacctcgcgcagctgatttacgatgccaagcgcgccaatccctcggcacgggtgcacgtcaagctcgtctccgaggtgggcatcggcaccgttgccgccggtgtgaccaaggcgaaggccgacgtcgtcctggtttcaggccacgacggcggaaccggcgcctcgccgctgaactcgctcaagcacgcgggtgtgccatgggagctcggcctggccgagacccagcagaccttgatgctcaatggcctgcgcgaccgcgtggtggtgcaggtggacggccagctcaagaccggccgcgacgtggtgatcgccgcgctgctgggcggcgaggagttcggttttgctaccgctccgctggtggtggaaggctgcatcatgatgcgcgtctgccacctggacacctgcccggtgggcgtagccacgcagaacccggaactccgcgcacgcttcaccggcaagcccgaattcgtggtcaacttcttcgaattccttgccgaggaagtccgcgagatcctggccgagctcggcttccgcagcctggaggaggcaatcggccacgccgaggtcctcgacgcccgggacgccgtcaaccactggaaggccgacggcctggacctggacccgatcctgcacgggctggagttcgacgacgacgccccgctgcggaacatgaccggccagaaccacgagctggacaagcacttcgaccagcgcctgatcacaatggccaccgaggcactgacggaccgcagcccggtcaggatcgccgtggacgtcatcaacacagaccgttccgtgggcaccatgctgggccacgtcgtgaccaagacgttcggcaccgatgtcctggccacggacaccatcgacatcaccctcagcggcaccgcaggccagtcactgggcgccttcctgcccgcaggcatcaccctgaggctgttcggcgactccaatgactacgtgggcaagggcctctccggcggccgcatcatcgtccgcccggaccgcacgaacgtgttcaaggcggagaccaacgtcatcgccggcaacgtcatcggttacggtgccaccagcggcgagatgttcctgcgcggccaggtgggcgaacggttcctggtccgcaactcaggtgccacggccgtcgtcgaaggcatcggcgaccacggctgcgagtacatgaccggcggccagacgctcatcatcggccgtaccggacgcaacttcggcgccggcatgtccggcggcaccgcctacgtcctggacctggactcagcccgggtcaacaaggacgccctgcagtccggcgaactccagctccgcgagctggacgccgaggaccgcgacatcgtgcacggcctgctggtcaagcacgttgaagaaactgattcccagctggcggcgcgcctcctcgagaacttcgatgacaccgccgcccgcattaccaaggtgctgccgcgcgactacgctgccgtactgcagacccgtcttgacgccatcgaagagggcctggaccccgacggcgaagaagtgtggtcccgaatcctggaggtaaccggtggctgatccacgcggatttttgaaagtacgccagcgtgaaacccagccgcgccgccccgttcccgtccgcatcatggactggaaggaagtgtacgaggcgcaggagaagggcaccctgaaggcccaggccggccgctgcatggactgcggcgtaccgttctgccaccagggctgcccgctgggcaacctcattcccgagtggaacgacctcacgtggcgggacaagggcgaggaagccatcgagcgcctccacgccacgaacaacttcccggagttcaccggccggctttgcccggcaccgtgtgaagcctcctgcgtcctggggatcaaccagcctgccgtcaccatcaagcaggtggaagtctccatcattgacgaagcctgggacaacggctgggtggagccgctgcctcccgcacgcctgaccggcaagacggtcgccgtcgtcggctccggccccgcagggctggcagtggcgcagcagctgacccgcgtgggccataccgtggccgtgtacgaacgcgatgacaagatcggcggcctgctccgctacggcatccccgacttcaagatggaaaaggagcaggtggaccgccgcgtcgagcagatgaaggcggaaggcacccgcttccggaccggcgtcgccgtgggtaccgacgtgacctgggagcagctgcggcggcgttacgacgccgtcgtggtctgcaccggcgccaccgttccccgtgacctgcccatcccgggccgcgacctggacggcgtgcacttcgccatggactacctggttccggcaaaccgcgtcgtggcgggggagaccatcgagaaccagatccacgcccagggcaagcacgtggtgatcctcggcggcggcgacaccggcgcggactgcctcggcaccgcacaccggcatggtgccgcctcggtgaccaccctggcgattggcaagcagccgccgtcggagcgtgccggccaccagccgtggccgacgttccccacgctgttcgaggttgccagtgcccacgaggaaggcggtgagcgcacgtaccttgcctccaccgtggagttcgtgggcgaggacggcaagctgacgggcgtcaaggttgccgagacggaattcgttgacggcaagcgcctgcccaaggcaggaacggagcggatcattcccgcggacctggtgttcctgtccctgggcttcaccggagccgaacccgcgggcatcaccgaccaggtgaaggcggagttcgacggccgcggcaacgtgtcccgcgacggctactacatgaccaacaccgagggcgtcttcgtggccggtgacgccggccgcggccagtccctgatcgtgtgggccattgccgaagggcgcgccgcagcggcagcagtggacaagtacctgatgggcagcaccattttgcccgctcccgtggccccgacggaccgcgccatcgccgtcctctagcgatgcaacggagggttcacctccgcgacaacttaaccaatgcaagagaccaatagggtaggtatatgagacgcgcaaaaattgtggctacgttcggcccggccatcgccagctacgaaaacactctcgcggtgctggaagccggtgttgacgttgcccgcatgaacatgagccacggcgactactccgtgcatgacaacacctacgagaacgtccgcaaggccgccgcggacctgggcaaggccgtggccatcatggccgacctccagggtcccaagatccgcctgggccgctttgttgacggcccgcacgccctcgccgttggtgacaccttcaccatcaccaccgaagacgttccgggcaccaaggacatctgctccaccacgctgaagagcctcaccgatgacgtcaacgtgggcgacgccctcctgatcgacgacggcaaggtggccctgcgtgccacggctgttgacgacgtcaaggtggtcgccgaggtgaccgtgggcggcatggtgtccaacaacaagggcatcaaccttcccggcgtggccgtcaacgtgccggcgctgagcgaaaaggatgaggacgacctccgctgggccatgcgccgcggcgttgacctggttgccctgtccttcgtccgcgatgcctccgacattgtccgcgtgcacgagatcatggacgaggaaggccgccgcgtgccggtcatcgccaagatcgagaagccgcaggccgtggagcagttgccagagatcatcgacgcgttcgatgccatcatggtggcccgtggcgacctcggcgttgaacttcccctggaggaagtgccgatcgtccagaagcgcgccatcgaactggcccgccgctgggccaagccggtcatcgtggcaacccaggtcctggaatccatgatcgacaacccgcgccccacccgtgcagaggcttccgactgcgccaatgccgtcctcgacggtgccgacgccgtgatgctctccggcgagaccagcgtgggcaagtaccccatcgagaccgtcaaggtcatggcccggatcatcgagtccaccgaggtccacggactcgagcgcgtccccccgctgggtaccaagcccaagacccgtggcggcgccatcacgcgtgccgccgtcgaaattgccgaccagctggacgcaaagtacatttgtgcgttcacccagtccggtgactcggcacgccgcctgtcccgcctgcgccccatcaagcccgtcttcgcgttcaccccggtggagcaggtctggaaccagctggcgctgacctggggcatccagccggtcctggtccagatggttgaccacaccgacgagatgaccgcgcaggttgaccgcagcctcatggagatgaacctggtgaacgacggcgacctggtggttatcgctgccggttcgcctcccggaaaggccggctccaccaactcgctgaaggtgcacaaggtgggcgacctcgccgactccacccgcgttggcgaagcaaccagcaacaaggaaaagctcggcccctggccggaaaagaagaagaaggcctaggctttcggattacgcgaaaggacccctgccagccggcaggggtccttttcgttgtggtctggtggttgggcctgccgtttgtgcggcaggcccaaccggacggagctagttgacctggttgatgatggtttcggcgacttcgcgcatgctcaggcggcggtccatggaggtcttctggatccagcggaaagcttccggctccgtgaggcccatcttggtggtgagcaggctcttggcgcgctcaacgagcttgcgggtggcgaactgctcctgcaggtcggagacttcgctttccagtgctttgatttcctcgtggcgggagagtgcgatctccagggccgggatgaggtctgcgggggtgaacggcttcaccacgtacgccatggcaccggcgtcgcgggcgcgctccacaagttccttctggctgaatgcggtcagcagcaccacgggggcgatgcgggccttgacgatcttctcggctgcggaaatgccgtccataacgggcatcttgacgtccatcaggacgaggtccggcttcagttcctcggcgagctggacggccttctcgccgttgtccgcctcgcccacaacgtcatagccttcgccgcgcaggatttcgatgatgtcgaggcggatgagagtttcatcctcggccacaatgacgcggcgcgccggctgggacgtgggctttgactccgtctgttcagtcacgggatctccttggaaaggtacggcggggacatcactatcttaggtgcgcccggtcctgtacatgatctgcatggtcggttgcggcgtcggcggcgcgattctggaattcagcctatctggctgtagagtaattccgcgtacgtgaagcgatcgcgttgctcacaatccgctgtgggcgtaccggtttgctttgtgtattccgcgcccgagtggcggaattggcagacgcgccgcactcaaaatgcggtatcgaaaggtgtgtgggttcgagtcccacctcgggcacagtgtttccacaggtcagacggctgttaagcggtcaggtgtgtacaaaaccaccaaaagtgtgtacacgagcgtaccgttttttgtatggcaagcatcgctactcgcaccaaaaaggacggttccaagtcctacatggtgcgctggcgggatccaaagacccgcgcttcacagggcctcacagtagccagcctcactgaagcagagacgctcaagcgcctgctggacgccaacggccagtcgttcgagatcgcgcagcatgccatcctctccaacgaaaagcgcacaccgactgttgctgaggtcatccaggagcacatcgacctgctgatccgtccgtcgagcggaaccacaaagacctaccaaaccatgctggacctccatgtccggagcgtcatcggccacgtgcccgtggacaaactcgattaccggctgatcgcgcactgggtgaagtcgatgatggcgaagggcaaggcgccgaagactatccacaacgtgcatggcctgatctcggcagccatgaatacggcggagatgctcggctacatcacgcggaacccctgacgtggggtgcagggagccggacctccttggtcttggacttgtcgttgtggctgacctcggtgatggcaacctggcgtgtggcgaccgacgccgtcctcaatggagtccacctcgaagccttcaccgtggttgtcggtgatcttcttcatcagctggctcatgtgccgagccgtgtcgaagttcggggggagcttcacccggatgcgttcggtgcttgaggccacgcgtgttcagtccttcggtctgcagaatgatctgccaccgaacatgcgtagatagggggctgacaacccttgtaagccgagaagccgggtgccacactgccttaatacgaggggtctggggttccggcacgaagaagggacccccatgcgcagccgactaggaatcaaactcaccctgctggcatcactggcagtcattcccgtttccctgacggcctgccacggagaactgaagctggcgcaaagcgctgcctccaaggcgtaccagtcggtgggtaagaacaccggggacatcacggtgtccgagtccgaggtgtcacgtattgccagcaagtacctcgtgcccacagaggaggtcgcggccgtggccgggcaagcggacaactatagggggtggtcagttccccagtcacgagtcgacaagatggcgcagatagcaaaggccgcgaagaacaacgaagccgtatctgccggcgtcgatgtcgcctgtgactggatgaagggggagatcacgacacaggatcagttcctggcctccgtggtcgaggcggcaaaagggatgacggacagcgagctgcaggcgtactggaaggcagtcggtgagctcgccgatcaacttacggagatgatggaggagggcacagccaaagacaaggcagctgccgcgctgttctgctacacctactctgttctctagatggaccgaagatacgtcggttcccctgccgtctaccttgcctggtccgggtcccattcgtccggcggatcacgcttctccagtgtctcgatcagcgggttgaacccgtcgtcgcccgttgcgtctgcgatggcgcgcagttggccggcgacttcccgccacatgccggcgtaccaggcgacagggtcggtgccgttctcccgcaggaaggcgtccagggtggacttgcggtagaccagccgggaaccccgtttctccaccaccgggcctctgctgacgtaccggaggttgcggaggaacttcgcgctgaccgtgtagccaaccgggccgctgaggtaggccgctgcctcgttggtggtcatctccatgtcgtcagcggtgaattcggattccatcaagctggccttcgctgaagtcggtagggggtggctactcggatgtcctgttgagggcctctttggccgcgcggatagcctccttggcctcccggagcccggtagcctgtccggcggccggcccgatcctgggcgccagtcggagtgcagccagtcctcggcgtcgcagagcatcttgtaggcctcgcgccgcccgtcctcgaaggccggcagttcagccacgagagctctctggcctatgcggttcggacccctcgtcagaagcccccgacgcccttggggacggctgcgggggcgcggctggcgtggccggcttagcgaagtgctcgcgcgtcttccggtatgccaccgacaagcccatgccgagggtgacgtaggcaatgccttgcagctgtcccgtaaccctgtagtgagttctcaatccctcgggcccacggcgtttcgccgcctcctgcaacagcctggtccagtcattcgccattgcggtctcctcatcgttcaaagctgcttcggtcaactgtagcgacgcgtcgcgcttgccgggggcgaaccaggggtctccgtacacattcgggccatgagcaccctgatgcaggcccccgccatcgaacccgacatccttgaccttttcgccggacccggcggctgggaccgcggcgccgagcttgccggcatcgacccgcggcggatcaaggggatcgagctggacgcagcaaccgtgcagacggcccgcgccgccgggtacaaccgggtccacggcaacgtgctggacctgaaccccgccgactacccgcacgtgaagggcctgatcgccagcgcaccgtgcccgacgttctccgcctccggcaagcgcaccgggctctccgacgactaccagcacgtcctggatgtcatcacccatctgggggccgagcctggctgcaactgcacctgggaggagatgttcggcgacgccgccggcatcgttcaggaccagcgcaccccgctggtgctgcaggccgtccggctcgccttcgcgctgcccagcctcgagtggttcatcctcgaacaggtcccggccctggagtacatgtgggaggacattgccgccgagctgtactcggcagggtgggaattcgtcgacgtcgggatgctggacgccatggacttcggggtcccgtcacgccgccgccgcgccttcctgatcgcccacaaaacaagccggtccacatcccgcagccggcacccggcaccgcccgtaccagcgccgcagcggctctcggctggggagcgggggagcaggtcaggacccgggccaacggcaagcccggcggcggcaacctgttcagcaccgacaacccggcgtggtgtctgaccgagaaggcgaggacctggacacgcgagtccgacggcgcccggctgaccagctccgaggccggggtgctcaacggtttcccggcagggtttccgtggtccggcagccggtcccgccagttcctgcaggcagccaatgtcgtggccccgcaggtcgccgcggcgctgctggcagaggtcgcggtctgaccccttgtggacgaactcagtgccaaacggggatgcctgactctgccggtcaggggatcaggcacaaaggcgccccgcgccgaagagggacggggcgccgctttcgctaagttcagctgcggaatttgaagacggctgtgtgcttggagccgtccgtcagggccagctcgaacatcctgcaggagtcggcccacgccttatcggttttccagacgtagctgtacgtcccgctggccgcatcgtaggagaggctgctcgaaccggcggttgtcgttgtctcaacctccgcaacgggtgcgcccgtctcgcaggtgaccgggacggaggtgggggagcctgcctgaaggatgttcagtccgaaatctccgcccaggctgaacttcatcggcaccgaccggcccgccgtcatgacgttcacggccggtgctggatcgaccggcgcgtggaagccgctgaaggcaaagccgctcctggccggaagaaccacccttgccggcaatcccatcccgccaccctcggtgaatccgacaaccccgatttcgacgtccttgcctcggtgtacgtccgtgatggttgccgtgcggctgcctgcgtccacgagtccggccgggatgccatcgactgtaagaccccagcggtagaccagcgggtcggaggactgccaggtcacctggacgctgctgacatctcccgcgttggagactggtgtggcggtgacgtccaggggagcggtggggtagccgtcaaggggagacttgccgatgtgaagaagtgccgaggcgttggcgaccaggcccctggcgtcggtgagcctgacctgcatgatgccttccatcactgaggcgtaagtgcgccggccaacgggtgtcgtcgtggtttcttcgaatgtcccgtcaccgttgtagtcccagtcgtatttcacgatgctggaggacacggagtacgacgacgaggcgtcgaaggtgacttgctggccgggcatggcgtagtactcgggatgggccagcagtggcaccggccggtcctggatcctggttagcgccgtggtgagcgcggctttggtgtccccgccgtcgacgatgacctgtccgctggtccgccccgccagtgatgagtagaagttgctgaagtaggacggaactacggggtaaacgttgacggggtcaatttccagtgaccgcttgaccacggcatcgagggtggtgccgtcgacgaggtcggggtcgtgatagtcggcgtcggtcaggacgatggcagccttggtcgcaccgttcctccactccagtccgttgaaggcggtcatcagggcgtggagtgcagcttccggacggtcgcctccgccggacgcgtagatggtggagagctgagtggagaattcctgggtgtcttcctggaagccgctgaggatccgggccgagaactggtctcctgcgtccttgtattcgaccagggcaacgcggccccggtttgccttgatcgtgtcggccatttcggcggcgaaggccttggtggcgtcaatccgtccccacatcgatccggtcgagtcaatcaggaaaaccacgtccaggccggtggctcctgaaggcggcagggtgactgtgtcgttgacctgctctgcgggcagaagcggcgtgagccgctttgcgatctcggctgcggccttatcgatgctctgattgtcgccccagtagttcatgtggcccgcgttctcccagaacacacggctggaaccgcagacgaagtcgactcgagcgcaggacaggccggtggtagaggtgaatcctgccggaaggtacggaatccgggaaccgagtgagccctgggtgacggagcagtccggaacgtcaaatctccattcagacgcttcggctgcgccgcggcagtagggcggggtagagagcagcccctccccttccgggagataggtccggggatcaccgaaaagcgcctggtagacgatccggccgcgcaggctgtcgctgagcttctcgttgtacgcttcgcccacgacctgggcgccctgggagtatcccccgagcacgaagtgggcgtcagggcaggcggcggcgcgcttggtcagataagcattcagctcgtcaacgccttcgttgacgctggcaccatagtcaaacccaccgccaccgctaacccccgccccgagagtgttccagatcgactcccagccccgatccgttccgaccggcacggcaggataggagaacccgtcgacgcccccgttgccgagttcgtaatggtgaagggttgccgggctggacagtcgagcacggatctgggatacgaagcgatcttcttcactgttgttcaggccttgtcctgaacccctggcgaagacgctttccacgggagcgcatgcctcggtcacagggtcagcagcggccgccggcggaagcgttagggtcaaggcagccagggcagcggccaggcccagggcggttgattggaaaggagtttttgagcgcacagaattacccccacggtttctgaacggaatcgccgccttgttctgcggctcaaagctgcggatgcggcttgaatggtctcaggctaccgggctgtttatccaatcgccagagaaattaccctcaagatcttccaaggtttagtccactgggcggacgatcatggtgacgatctggggttcgttcagtccagggctggccacgttgagcatgtaggtgtagttgtcatccgtgccggagaatctgcaaatggtgatggagccgcttacgttcgcaggccgctggcaaggagtgtcggtcttcatctcgaagccgactcccgaaacgacagctgcgacatcgtctgtggccaactctttccctgcatcccattgccgggaaaggctggggcacgggttcgtgctcatgcagaggaaccgctcggagcgcacgatttcgtcggtcagcttccattccgaagggatcgcgaagcgtccggcgcgggcaagcatatccgccgttaccttttcctccgcagattggacgaggaagaacgcgaccgcaccgaggacaaagaccgatgccaggacaattccgacaatacgtttcaccggttcccccaaacccatcagtgcaggcactgatccaggtcaacaaccgccagtgctgaacgcatcgtacctgcattcatgggccgtgtcagcgcctgcccccgaacgtcaggggtggggtggcttcttgttcctcgcgagtccgacggcgcccggctgaccagctccgatgccggggtgctcaacggtttcccggcagggtttccgtggtccggcagccggtcccgccagttcctgcaggcagccaacgtcgtagccccgcaggtcgccgcggcgctgctggcagaggtcgccggctgatccgccactccaacggtgcctatagaattatcgggcaaactactgccgaccacgggggaaccatggctatcgactggacagggctgctgaagcaagggctcaaggccgtcgctgcacgccagcgcccagacaccaatgccagtggtccgatggtggaacaggtcaaggccgatatgaggaccatcgttgacatccaccaccgcaaacatcacaacgactggcttaccgttgtcgacgactccggcccaatgatctcctgtgtctgccgaggtgggtacggggtcaacgttcaacccgagaacgtgatgaaacgccggcaggtggcgaagcccatccccatgtccaggccccgagcaggcggcgcgacgtgcggcgacgagaacctgttcggactcaagtagcgcctaataagggtgcgcttgatgcatcagatgcaaaatcaacctcttttcgctgacgtaggcatagttaccggaacggccacgggtcatgcttacatacagcaactcgcgcgtgagccggccctgagtgatcacggtgtggcccgtgtccacggtaaggccctgggaacggtgtgccgttgttgcatagcctagctcgacggatgtctccagatacgcccgggggagcaggacgctcgcgcccgtgtcccgccgccgcgcgagcagggagccgtcgcgacgattgacctgttcgacgtcgaagagtgtgccattcctcacgaaattaccgtcgctgtcgactagctttcggttatttccgcgggcgatggccgtgtcaccggaacccacccgtaggccgtcgctgagcagcaccgtctgatcgggatccacctctccctgggccactcgatccgcctgcgcccgttcattgagcatgccgaccgtttcattgtcggcggcaatgaggatggacgacttgcctgcccgagtatctgagtgccaggcgaggtacgccttgtcagccatatccagatagctaccgtgccggatccgcccatgttgggcatagtccgcgatggctgaatagtcaccgttccgcagcttcagcgacgacgtacgctcccactcctcatgaaacctccagatcagtcgcctgaggctgtagacgaggcacgggcttgggtcgcgagcagtttcggacgaggcagtggcagccttagcgatcggtatgtttatcgggatggagtagttgatgaggccctaaacgccgaatacgaaaccctccttcaaaagcttactgacttcgcgaatggtgcttaggcggaccggcggagctcgcagtcctgaaacgggttgactccccgtcgcggtcgagcagttgcaccgggcggtagctcttacgagacatctcatgaacgaccgttggcgagacagcgacgcttatcgctccctgtgactttcagcgataaatggcggctttttcggagcgctatttgtcgtgtgcagtccgcaaggggatccctcaccgaacgcccgtacgccgaaccccaaacgggacggttctgtcacgaatccttcatcggggtttagccaggactcaggacctacgatgtggcgatgctggatctggacctggccctggatccagccgactttgtggtcttgtgttgagcactgggtgacgtttcgcgggttaccctctagcctcgtttttatggggaagattgtccggctttggtttgtagggtggcggcggcagaaatgcagggccatcattaccatcaacgatcggcgatacgtgcgtcacgtgaggccggagggaggacagcatggtcggcagaatcctcaggatcgactttggcgtgaactgctatctcatcgatgttgagggcggctacgtcctcatcgacacgagcttcccgaacaaacaggaccagctcgacgccgaacttgctgcggcaggttgcggacccgatgacctgcgcctcatcgtcctgacccacggcgatgtcgatcatgcgggcaactgtgcacatcttcgcagcactcaccacgcgcccatcgccatccatcgccaagatgccgcgatagtacggagcggagacatggatatcggccggaaggacaagcccgacagacacactctcgcgttccggttcctgacttgggcttttgggttgctatacaagatcaccggaacgggcgcggacttcgaaaccttcgaaccggacgtactcctggaggacgggcaggacctgtcggcctatgggctcgacgcgcgggtcatacgtcttccgggtcactcgagcggatcaatcggtatccttgcgggcgatggggccctgttctgtggggacctgctcgtgaacgtgatgagaccctcactccactactacatagacgacttggcccaagcgcacgagagcatccgcaaactgagcggcctcggcgtcgggaccgtctacccggggcacggcaaaccgttcccgttgagccggctgccgataccgggccggtgattcggctgattccagcggtcgccaggtgggaataagcgcttcaacctgacgcataggcctgtcgcattttggaagcgcaccgccttggccaacatcccgcgcaggtcgttcaaagcctcggacgtggtcgcggtgatggagaacatcatcgccgagaccggcaccgccccgacctacgtccgctgcgacaacgggcctgaattcaccgccgccgcgctggtcgattggtgcaacaacgccggcgtggacaccgcgttcatcgacccgggctcactctggcaaaacggtttcatcgaatccttcaatgcccagttcagaagggaacaactcgccggagaaatcatggacaccatggccgaagcgaagtatttggccgaggaatggaaagctatctacaatcatgaacgaccttacggatccctgaacggcatgacgctgaaacgctactgggaaaactggacgcaagaaaaccaattagctatcgcatagacgctggactgctaacgggggcccaaccaatatccgttgtgttaaccggatgctcgggtgggaccggttcgattgccgaatctgaacgccagggtgggctgcccgcggaagcaattactgcaaagccaagcacttctgctcaggatactatttatcccttcccacgagcaggctggctcgatgccgggaccaaattcgctgtcgtattgaacggcagttcaagctgcccagcctttccctcgcgtattaagtaggtcattcggccctgacatgtctccggactgagtgggagcgttgcagcatggatgagcgaaaaccttccctaaggacacaggggaagcctgcgcccggggatgctggccggtcctggcgtggactttatctgtcggccggcattgccgcggttcttttcgttgtgctgttgatctcggctctggtcattgacttcatggcaccaccgccggtccacgggggcgttgaaacgctcaaattcattgccgcaaacaagaccctctatattgccgaacagatcctatggatactgcccagcgtcctaccggtggttgtgttcgtcgcgctctacgttgcgttggccccgctcagcaggagttgggctcttcttgccgcggttgttggagggctgccgtgggccctgttactggccgtccccgtttcaaggccggggttcgctcagccttgtctacctcagcgaccgatactcggctgcaggctcggaggctgacaggggcgtcttcgccacggccgcggaagcgattattgccgaaaacaacacaccggcgattgcgggtctcctgtcacccgtgggtatttttcttatttcgttggtcatgcttaagggcgtactgccccgcgcggtcgcatggctgggcctcctgaccggatcccttggcctgctcagtgaggcgctgcgcttcgtggcgcctgcgttttactggggatacggagttcttctctgggcatggttcatcgctgtcggtgtcagcctgatacgtctgcatcccgaggccccggacccgacagggggcggcgcggtccgtgaggacagtaactaggagaagcaatggaacagctcgttccgtggttgatattctgcatcgccatctcgatctttgcctgatacgacccaacgctgcccggatctttgtcggcgttttctttatcatcatggccctggccgtaaacgcgctgctgagcattgtcgccccggaccagttcgtgcgtctcggcacggatgctcccttgattccgttctatgcctggttcttcgaacaggttgttgcactgtccccggcactggttgggatcttggctgcgataggagagatcgcggtcgggctgctgattctcagcagcggaaaccgggtgaagctgggtctgaccggcgctatcctcttcctgattgtgattacgccgttgggcgtatggaccctacccaatccggtcatggctgggggtttggcctggctgctgaccaaggactatcccaagagcatgccgcagctgcttcgccgttcaccgaggcgcccgacggttgctggaaaagaactctaagaccatcacggcaagccctggccacacgtcatggccttctgaattagcaggcgttttggccttaaagcagggccacgaagatgatggccgcgttgatgaggatgttgaaggccagccatcggtgaaagtatacgagggtgagaagcagggagactgtggcaccggtaatagcggctgcctgcgcccaggccgcgcccatgatgacacccgtccctgccacgaggaacaccgctgcggccgctactgccaggaccacggcaagggcccgggctccgccctcccatccacctcggacagcaagccaggaacggcgggggtcgaagggggctttgtcggggtcaaacggggcgcaccagataccaacgtgcaccaatccatgggccagcaaaaacaatccagccagccaagtcatgatggcggcctggtgagctcaacccccggcgacaccgccccgctcctgttcccgtgggcctcgacatagatggaaagtcgggtactcacgcatgagctccgtgtagatgatggtccggtaatccagcagtggagaccccaaacaaggtcaaacatgctcgttctcctgaggttacacatgcctgtcccctcatgtggagggctgctgttcatcgctcaaggtcatggcgagcatctcgccccagcgccgcgcacgctcctgctcaccgggcaggaggccgctgtccccagtgacgaggaaactctccggatcgaccactaactcaaaaccgtgctttttcagtttctttccaatgcccttggccgcatgtcccgtcaatagttccggcatatctacccgagtatcgaaagcggctgcccggccagagctgggcccaagcgcgtcgagccaatcacgcaggcccaagcctccggccgagggatcgatggtcagacctttgtcccggctcatggcgtcctgcaccgctgcatgacgggtttgcgtccgcgtcatgccgtgcgcgtgcgtaggcccgccgacgaccagcagatcgatgccgctaagatccattcgagctgcttcttccacggagaccacgtgcgcggctcctgccgaccccagtccctcggctatggcctgggcgatgctgtgggtattgccgtaaatcgattcgtaaacaactgcggctttcaatgtcccgcctccaagctggaatcttttccgggcatccacctatgcaatgcgtacatgtattcgcctgctggtgcaagggcctccacgctcttgctactgctgacggtttcactgatgctcagagggctggcaaaccatcagtcctaaaggtctgaagggaacttcagcacctctccttctggcgaaaggtcaccatgctcactcacatgaacatccaccggatcctttgggctgttatcggagtcctaacgctggttgccgccgctatagggctagggaacccgcgcatctacgaccgcatcgtcaatgaaaacctcattcccggggcatattcgcaggacctgctctcggcactctcagcattcggcctcatgtatctggccctcacagcacgtatcgaccgacagaagcaccagataattgcactggggcttatgggctatctgttctacgcatatgggatctacgtgatcgagcgagcctacaacggcctgtacctcgtctacatggcgatcttcacgctggccttttggagcttggtttatgcaggtgccgaccttcgccttggcctacccaaaccagctctctccaagacgcttcgcctggtatcggcctccggcgccatcctccagcccctcatcttttacccgctctggatcgggatgctcctgcccctgatgcgaaccggtgagcagatcgactccatctactcgatcttcgtcctggacctgtgcttcatcatgcctgccttcctgatcctctccgtcctgacctacagaaaccacggaatcggactgttgttgctaccggccatctacgtcctcggcttcaccctcatcttctccctggccgtgggcgaactggtcaaacccatgttcaacgccgcgttgagcccagccgcgttctggccggcccttgcgttgtccctgctgttccttgtcctcggtatcctgcacctgagcaaactgcaggtcgtgagccccaaagcgctgataacggggtcacttctgccccattgaccgcggaagcgcaggcgtatcctcgggaatatggccacccccgaaccatccccaaagaggaggaagaccgtgggcgaggctatcttcaacgtcaccatatttttcgtcgcggccatcctttgggcagccttcggagcgctcctgatttggcgtcaaggtgatctgagcgacctctggaacagtttttgaggacaaaactggctgctgcaggtagtcgagttcgttctcctcttgccctgggccatcgcactttggattttgaacacaggttggtggctgtgggtccgcatcgtgcttgtgctcgctcttgcctgggtcaacctcgtaatgttctggccctgggctagcagtgacaagcaagtcccgactccataaacccttaccgctaccggaccagatactgtctcccttattaacagatttccacgacagcgcagccctgctcggatgaccgctcgagctgacggaaaaatccggccttcccatgtctcggaagcgcgtctcaacaaaaaacgtctcgccgggggcgcatcctggactttgcgactcagaatggctgcaggagcacctgagttacacccgtacccgaaattccggcctaggctgcagaggagcagatggacggaatggccgtccgacgcgtacagaaccgcggcgccgtatctgagtgacgagtaccggactggtgacccggaacgctgccgacatgggccaatttcaaggtgtggacattgtccacactgttggcttcagactcggcggtactggggttggtccgggacggattccgcatgtttccgcggattcccagtgatcacaaggtttggaatgcagttcgagtctcacctcgggcacagcatatccctcgtcagagggggtttgctttaacgtgtgtacaaagcttgtggtggcgtccctctgtcgggtggttcgccgactgtggcctggccgccgggatggcctcttcagtgtgtgaggtgagggtttgagggtcctggctggtgcgctctccgcctgctgtggtgggttccgtggtttcttggtcaacacctgttcatgggcgaaggtacgtgggactacatgacttcgccgacttaggtgtggatgccttcttgcgggacttccctcagacgtcacgggagccatcgactcgctgtgggcgccccgcgccccgcccagtcaacaaagcgtgggctggtgatgcgctgcctgcttgccgggggactgccttcggtggaggccgaccccgccgacgtttcggccggtgattctcgcgcagcctaagggaaagacacgtgaattgcttgattagctacataggactggtgcttcagctgtcgcgcatccacgacctggcgttgcgggcggcggagctgagtatccctcagtgacgctgaggtcctccgcttgggtgggggctggtccgaggacgacgttgtgggttgaccctctcgagatcgagatggtccggacgctccagcagccgtgaggcggcgtatccgatgaccaggccccagaaggctgcgtggatgttgaacagatcgaggccggagatggtcaccacgaaggtcaccagcgctcccagagtgaaggtggtggagaaggcggtcacgaacgcctgctggagtgcccgcagcatcgcgattccgccaagaactaggacgaattccttgggcgtggcgagcatcagccaggtcagggtgggagccagcgccgcgcaggccagtgcgaggccaccataggtcaccgctgctgtgtactggcgttctttatcccccgacgacgtcaacagggcgttggtgggtccggtcacgcaagcagatacggcgccgcagccggcgttcagcagggagaatgcgccggacacgatggcgaagacgttcaccggtggccggtggccggcggcccggagaacggcgatgccctggccgttttggacgaagaggaccgtcagcgccagggggaccaccagttccagctgcgactcccacgtgaacaccggaggggtgaaggccggggctgccaggagaaagccgggttcaccggcgacaaactgcccgctgacggccaccgccaggccgccggccagcaacgtcccgaggaccggcgggaggaattttcccagggccggcaccgcagtcaggagcaggaaggcgcccaccatcggggcggcaatgaccggattggcttgggtcgaggacacgatatccgtgccgaagcggaggaagacagcggcgaccatggccatgacgatcggcatgggaatcatcgccatgatccgccggaccacccctgtggcgcccagcgccaggatgagcaggccggcagtgaagaacgtacccaccacttccgcgaaggaaaggtgctgcagcgacggcccgagcagtaccgtgcctggaatcgaccaggcgaatcccagcggctgccggtacatcagagacatgaggagtgtcgcggcgccgccggagaacagtatgccgaaaacccacgaggcgagctggtcctggctcagcccgcccgctgccccgacggcgagggtgacggcgatgggcccggaggcggtgaagaccaggccaatggcgccgttggacaggtaggcgggtgccacgtcccgaaggaaacgccgtggtccggccggacggcgtccgggccgttccaggagcggttgctgcgaaggcggcagctccgcggccggcagcccgggcgccggctctgcatggacgggcgctgctgcggtttcgggctgggtggatgggtcctggcgggaagtgggcatcctggctcctggctgcgtggtcagaaaaggcaggcgccccggagatgcagctccggggcgcctgggttgccgggccttggcgcccggcctcaaacaagcaggggcaaagacctacttggtctcgccttccttggcgaggacgtagttgtacacaacatcctcgccggctccgccgtccgtgcggggtttggggtccagcatcagttccggcttgacggccgaggcgatgtcgtcggcgttgtgcgggtcgcccgggaagtagagctgctgggtgacgggctggtagccgggtgccgagaccttgatgtggatgtgggccgggcgccaggcgtgccagccggccgcctcgatgagctggccgcaagcgccgtccgtggggatctggtacggcgccggacgcatggtgttgatttcgaagcggccctggtcgtcggccttgaccgtggcgcggaagagccattcgggcaggcccggggcgtactgcgagtagaaaccggcggcgtccgcgtgccagatttccacctgggcgttctggagggcattgccgttggtgtccgtgaactggccggtgaagcgcagcggggtgccctcttcgccgtcgcgcatgaggacagtggccggcgtcgcaagctccggcgaccctggcacgtagtaggggccctcgatggtgcccttggtgccggggcgctcctgggagttgacgtcctccaccgtatgctccagccacacgtcaaggaacagcggccactcgccgtcggtacccaccttgatgagccacgccttcagggcgttgtactcctcataggtgacctcgtgctcaatgacgatgtcattcgcggccttgatgagcgcgccggccagcaggctcacgcgttccttgggcacgctcagttccgaaagcttgccggaagcggtgaagcgttcggtagccttcgagccggcttcaacggccgtgccctcgttctcgttccggatatccacttgggtctcagtcatggcggtctccaccttcgtctttgaaattggggcccaggaaggtctcctgtacccgccgcgggacgccggcgcaggagaacctgcgggccgtggcgtcgcgtgatgtctgtctcatcgtaggtccgaagataatgacgaaacaaatattgataaggccgaattttagtcattatcggaacataaacacacccttggtcgaccctaggtgtttgcctgatgtgagacgagtcacggcagggaagaattgcctctaacgtccaccgccggcgccgccgccagcccggacctcccgcccatccgtccagcaatctccaatgagggagcacgccatgaccgagaacctgatccatacccgcgaggtccttgccgacgccgtggtcgacgaccgtgagaacggcatcatccgggccaagcgcgaaatcttcactgaccaggacatcttcgagctcgagatgaagcacatcttcgaaggcaactgggtatacctggcccacgagtcccagatccccaacgtgggtgactacttcaccacgtatatcggccgcaccccggtgatgatcacccgggacaaggacgagaaactcaactgcctggtcaatgcctgttcgcaccgcggcgccatgctgtgccgccgcaagacggacaaccgcaccaccttcacctgcccgttccacggctggacgttcaagaactccggcgaactgctgaaggtcaaggactccaggaacgccggctaccccgagaccttcaacaaggaaggctcgcacgacctcaccaaggtggcccgcttcgagtcctaccgcggcttcctgttcgggtcgctgaaggctgacgtgcttccgctcgaggagcacctgggcgatgccaccaaggtgatcgactccatcgtggaccagtcgcccgaaggcctggaggtgctgcgcggttcctccacctacacctatgacggcaactggaaggtccaggctgagaacggggcggacgggtaccacgttacggccgtgcactggaactacgccgccaccacagcccgccgcagcgccggtgactccgccaacaagaccaaggccatggacgccggcaagtggggcaaggtcaaaggcggcttctactcctacgaccacggccacctgctcctgtggcaggaatggaccaatcccgaggaccgtccgctctgggaccggcgcgaggaactggtgcagaagtacggcgaggaaatggcgaacttcatgatcaacatctcacgcaacctttgcctgtacccgaacgtttacatcatggaccagttctcctcgcagatccgccacttccggccgatttccgcggaccagaccgaggtgacgatctactgcatcgcacccaagggcgagtcccaggagaaccgctccaagcgcatccgccagtacgaggacttcttcaacgccaccggcatggccacgcctgacgacctcgaggaattccgctcctgcaacaagacctactgggccaccagcgccccgtggaacgacatgacccgtggctccacccacgagatctccggcccggacgagcaggcccaggccctggggatgaccagggtcatcgcctccggcgtgcgcaccgaagacgaagggctctaccccatccagcacgggtactggaaggaagtcatggaccgtgccctggcggaggaagaggagcgttccgcgctggactcattccccgcctccgcctgacagagcccaccggaaccacagagagcgcagaccccatgaccaacctgacccaaaccgccccggtcctgaagaccgcggaggagatcgcaaccctggaaacggtccgggcgttcctttaccgggaagcccgcctgctggacgaccgccagttcgacgaatggctcgcgtgctaccacccggattccgaattctggatgccggcctgggacgtggacgaccaaatgacgcaggacccccagaacgagatctccctgatctactacgacaaccgcggcggcatcgaggaccgggtgttccggatcaagaccgaccggtcttcggcgacctccctccccgagccgcgcacgggccacaacatcacggacgttgaggttctggcgaacgacggcggccgggtggaggtgcgcttcaactggttcaccctctacttccgctacaacacgacggacacgtacttcggcaccagctactacacgatcgacctttccggcccgcagccggtgatcctgaagaagaaggtcgtcctgaagaacgactacatccaccacgtggtggacgtctacatgatctgacctgcccgtgcggcgcccggagttccccggcgccgcactgcaggtcacattccgtgcccgccgggcacacgagaacttttcccgggacgcgacgacgcgcccgcccagccaggaggaccccatgggccataaagtagccctcagcttcgaagacggcgttaccaaagtcatcaaggtcggcgactatgaaaccgtcatggacgcggcctacaaggcgcgcatcaacatcccgtcggactgccgcgacggcgcctgcggcacctgcaaggcgttctgcgattccgggtccttcgacccgggcgactacatcgacgacgccatgaccgaagaggagctggaaaagggctatctgctgacctgccaggcagtcccggaatccgacctggccatccagatcccggccacgtcggagtcagcgaagacggcggcggccaccttcacctccaccatcaaggagctcaaccggcacacggacaccacggtgtctttcaccctcgaggtggacaaccgggatgcgctggccttccttcccggccagtacgtcaacctcaaggttcccggcaccgacgccgagcggtcctactctttcagcagtggccccgaggttgaggacgcgtccttcatggtccgcgtcaccccgcagggcgccatgtccgaatacctgcgcgaccgcgcggcagtaggcgactccgttgaattcaccggcccctacggctcgttcttcctgcgcgaacccaagcggcccctgctgcttctggccggcggcaccggcctggccccgctcctgtccatccttgaaaaactctccgaaaacccgccgtccagcccggtccacctcatctacgggctcacccgggaggcggacatcgtgggcctggactggctgcgtgcctacgaagcgaagctgcccggcttcacctgggactacatcgcctccgagcccggcacctcggccccgcacaccggctacgtcacacagatcatcgaaccgaaacacctcaacgaaggcgacgtggacgtctacctctgcggcccgccccccatggtcaacgccgtctccaagtggctggacactgaaggcatccagcctgccaacttctacttcgagcggttcgctccgaaggagaccaccggaggcgacgccgaaacgggtgccccggcgccggccgggaagatccaggccgaaggcgacacgatgagccgcggcgaggcagtgtcctcgctggagaccggccggctggatttcggcaaggaggacagcttcgcccacctcgacgcccgcatgggcctggagctggcggtcagcgaactgctgctgggcaggctcagcgaagcgcagctgcgccagttccgccggctcgccgaagccaccacggcgtcagtggacggcgggaacatcacggaccccgaggagttcgcgcgcaccaacgaggaattccacgagtacctcttcatgatctgcgacaaccccatgctgctggagtcctaccggcgcctggatgtgcacgcccagatggccgcggccctcgacgccggaacgccgatcttcgagcgggtcacccaggaccacctggacatcgtggacgcctttgaacgtggtgacaaggaccgtctccgcgccgtcatcaccgcacacgcccacgacgctaaggacaccatggccggcgccatcgacgccaaggctgccctctgatggctgcgccgtacgccgggcagttcgtgacccccggccgcttcggcggcaaggtcgccgtcgtcaccggggccgcccaggggatcggccggaaagtggccgaacgcatcggcgccgaaggcggggcagtggtcctggtggaccgcgcggaactggtccacgacgtggcccgcggcatcgaagaggccgccaaggcctccggctccgggggttcggccacgtccgtcacagcggacctggagaccttcgccggcgccacccaggccgtcaaggctgcgcttgccgcccacggccgcgtggatgtcctggtcaacaacgtgggcggcaccatctgggcccgcccctacgaggaatacgacgaggacaagatcgaaaaggagatccgccgctcgctctttccgaccctctggagctgccgggcggtactgccggcaatgctggaacaggagtcgggcaccatcgtcaacgtgtcctcggtggccacccgcggcatgcaccgcgttccgtacgcagcggcgaagggcggtgtcaacgccctgacccaggccctcgccatggaggttgccggccgcggcatccgcgtggttgccactgcgccgggcggcacaaaagctcctccgcggaaggtcaaacgtggcccggaagccgaatccgccacggagaaggcctggtaccaggtgatcgtggaccagaccgtggaatcgtccttcatgaagcgctacggcaccctggacgagcaggccgcgcccatcgtgttcctcgcctccgacgaagcgtcctacctcaccggcagcatccttccggtggccggcggggacctgggctagcgcttggaccccctccgcagggagcgggccggccgctccggtagactggcggccatgactgcggggtccgtccagggcgacatcggtgcggattcgccgctggtggggcgggacgcggtgttcggggaactcctggacatcctccgcgccgtgcgtaaaggcaaggtggccacagtggtcctcaccggagcggccggttcgggaaagaccgcggtgctggagtccttcctggagcactgccgaaccggcgcgcgcggagtccgcgtgttgtccgccatgggggatgagtgggaggcgcagtttgccctcgccggatactcccagctcatgctcacctcgccgttgcgttcggcaaaggcgtacgacggcggtccgcagcttccggcgacgcccgtcgccgccctgagcgcggaccagatggtcaactacgcgtcaacgctgagcacccacctcgaagggctgcagtctcacggaaccgtggtggtcgccgtcgacgacgtccacaaactggacgtggaaagcctgcgcatcctcacgttcgtcatgcgccggctccacggcaagcggatccttttcctgctcacgctgaacccggcggacgcgccgcgcatccccgccggtgtcctggatttcctgacggggcaccaggtggcccggatccccatggagccgctgaccccgcagcaggtccaggaagtggcccggcgcctgcacggcatcgacctcagcgtcaccgcggcccacggcctggtccggcacacgggcggcctgccgcagcccgttgcggagctgctgcgcgagctgcccccggaaacctggctggcctggttcccctcgctgccgcccacctcccggctgcgtgccagggtgcacagcgtcctggatgccgcgtcgcccggactcgttgccgtcgccgaagccgcgtccgtgctgggccgcagtgcgggcctgccggaagtggccgccgtcagcggagtggagtcagtcctcgaagccttggacgaagggcaccgcgccggactcctgcggctctccgtggaccaggcgcgctctgccgtcgtgttcgtcgaacccggcactgccgaggcgatctacgagcagatcgttcccagccgccgcatcgcgctgcaccgcctggccgccgaggccgtggagccggagggtgaaaaactggggcaccgggtttcggcaacgcccgccgcggaccaggcgcttgccgaggagctcgaggactttgccggccgccaggcggccgtgggcgcatggcaggacgtcgcgacggccttgttttccgcgtcccgcctgtcgttggacctccggacccgcaacgaccggctgctgcgcgcggtggacgccctggtgggggccggcaatgttgccgaggcgcagacctggtccgccgccgtggacgccctgccgccctcaccgctgcgttcctcggtgctgggctacctgtccacggtgtccggccagaacgacagcgcccagagccagctggaaatggcgtggcgcaccagcaacccggagcgcgatcccaaggcagcagcccaggtggcccaacgctttgtcctccacggggtggcgtcctgggacgggccgatgatcaccggctgggcggaacgggccatgtccctgaccgcgcccgggacgccggcgcacgtcgaatctgaagccatctacggcctgggcctgtacgcccgcggccggctgggggaggcggaggcctcgtaccagcgcgcgttcggccacgccgccgagaatgcgcagaagcagcgggtgcagatgggagccggctggctggcgctgcggatggacaatgtcgaatcggccctggtgaacttcgagtcggcggcccccaccgagtaccgcggcgggtccctgcggatttccctgtgggccgaggcgtggctggcccgcacccacctggtgctggggaactgggatgccgcggcggccactatcgcacggtccagcgtccgcctggaaacctcccggatgcccctgatccggcccctcctgtactggaccgccgcggagctgtggtcgatgcgtggggactgggaccgggcccgctattacgtctcccaggccgcggtccagccggggacgtaccgggccatgcaggttccggcaagcctggcgcgggcacgcttccatgaggcaagggcggactacgagagcgccctggccgtgctgcagcccctgaccgagctggacccgtggaccgaggaccgggtgtctttctggccgtggcaggacacctacgtcaacgcacttgtcatgaccgatcagctggataccgccgacgcgttcctgacgtccttcgagggactgcggcgcgagcgcgaaatcccttccgatatggcccggatggcgtgggcgcggggccggcttctggcggcgcagggggatcccgacacggcccgggagtatttcgaggcggccctgggccacctccgcgggctaaaccggccctacctgcgggcccggataagctttgccttcggtcagagcatgcgccgcgccggcaagcggcggctggcatcgtcggtgctgcgtgcggcccgggacctctatgactccctcggggcggctacctatgtggagcgttgcgacagggagctcaaagcgaccggtctcgacgtcggaaacctccccgatcctgccgacgcagtgctcaccgccgcgcgggaccaccacatccagctcaccgcgcaggaacaggcggtggccgagcttgtggccgggggcgccaccaacaaggaggcggcccgtgccctgttcctcgcggagaagaccgtgcaataccacctcacgcggctgtaccggaagatgggcatccgctcgcgcagcgagctcgccgccgcgttccgggtcaaggactgacccggaacgggcgttctgggtcagtccttgacgtcggagggatgcttggccagcggaaccaccgagatctccatgtaggggaacaggggcaggttctgcaggatgtcgtggagttcgtcgttggagtcaacgtcaaagatcgaatagttggcgtactcaccgaccacgcgccagatttccggccacttccccgagcgttgcagctcctgcgagtaggccttctccttcgctttgatcccggccgcctcggaggcgggcaggtctgcgggcaatttcacgtccatgtggaccaggtacttcactgggtttcctttcgtggaaggggtggcgttagcggtcgctgcggtagcgttcgagtttttcctcgttcaccccggtgcctacgccggggccctcggggacgcggatgcgcccgtcaatgatctgcagcgggtcggccagcaggtcgtccgtcatgtccaggtagttggacagttccgcggcgcgcttggcggtgtgggcgaaggcggcgccaaacaccacggacgccacggtgcccacctgggtgtcgatctggttgccgatgtagacgtcgatgcccatgccctcggccattcccacgattttggcggcctcggtgaatccggagcgggccgtcttgaccgccagcaggttggccccgccgttgaggatttccttggcggcctcgccgaggttgggggcggattcgtccgctgcgatggggatgggggagttggcgacaagccggcggcggcccaggacttcgcgggcgtcgtccggctcctcgaggaactgcaggccgaggtccgcggtgcggcggagcacttcggcggcctcattcgcggaccagccccggttggcatccatgtagagttcggcgtcctcgcccaggccctcgcgcagcacgcgggccgcttcgatgtccaggtggagggggcggcggccggtcttcagtttgaatgtgttgatgccgtacgtttcgcggaactccagcgccagggcgagcagttcccgggcgggcttgaacccaagcatgtgggagacccgcagcgaatcggagtagccgcccagcagtttggtcaccggttggccgaggaccttcccgatgacgtcccacagggcgatatccacggcacccttggcggtctggttgtggacggtgcggtagaggatctcctggaccttctcccggtcaaagatgtcgacgccgatcagctgcggcgcgaagacgtcctgcaccaccgcgacgatggacttttgcgtctcgccgtaggtgtacgggcgcggcggggtgtccgcgaggcccaccacgccgtcgtccgtgcggaggcggaccagcacgtggtcggcctcgtggaccgacccggaggcgaagtgcagcgggtggcggtaggggatcgagtagggaatcgcctcaagggctgcgattttcatgaaggggaaaacctttcatcggtgggaagcgggtcatgccctggcgcgatggccgccacgacgacgtccaggaagttgtgcagcagggcggagcggtggccgcggagccaggcgacggcgagttccacggaaggtgcgttgtcgatctcccggtaggcgacgccgtcgagctggaaagcccggacccgggacggcatgaccgccaccccgcccccggcggcgacgaaggcgagcatggtggaggtttcacctaccacctgggtgatgcgcggctggaagcccgcgtggcggcagaggtccgaggtgatgcggtacaggacggactcgggcgcgtagctgatgaagtcctggtcctgcagttcgtgcatcgccaccggcttgtcctcggccagggcgctgaaggacggaacagcgaggacgagcggctcctggtcgacaacgcggtagtcgatgtcctgggaggagacgggagggcggaggagtgctgcatccagcgtgccgtcccggagtccggcttccatggacggagtaagcatctcgccatgcaacgccagcgacaggcccggcagcatctgcttggccagccgcgcgatctgcggcatgacgccgtaggtggccgaccccgagaatcccacccgaaggacgcccgtggctcccttgcccacttggtacacgtccgccttcaaggtctccatgtcattgacgatctgccgcccgcggtccaacaggagttcgccggctgtggtgaggtccacgcggcgtgtggtgcggttaagcagccggacccccagctgttcttcgagctggcggatttgctgggagagaggcggctgggccatgtggaggcgtttcgcggccctgccgaagtgccgttcttccgccaccgcgatgaagtagttcagctgccggatgtccaccgtgatgccttcccatgcgccctgccaaggctctgccctggacgactattgattcaaagaataactctaaaaagacttactagtgcattctttcgactcaatgacgtccagggcaggccgctgcgcgcgctactggggctgctttgccgcgacgtccgtttcggcgcggtgctcagcgatttcttcgacctggtgctcggcctcttccaacttgcgctggtgcgggaccaggacggtgacgagggcgcccaggagtgcaacgccgccgtagatgtagaaggccgtggagccgccgatgcccgctgccgcgagccaaccgccgatgatcgggccgagtacgccgcccagccggcctacgctggcgcaccatgcaacgccggccgcgcgggcgttggtggtgaagtagttggactggaatccgtagatcagcacctgcgtgcccagggttcccactccggctacggcgatgaaggtgaagagcatgggcaacgggaagttgaaggtcatcaggaccagcgacacggtggccagcccgaacgtggaggcgatgacccgctgcgggccgctcttatccgcgagtcgggaggcgatcaggccgcccgccactgcaccgaggttcagggccagggggaagaacagggaatacgtgcggccgtagccgtaaccttccataatcttgggcagccatgtgttgaggccgtacgtgagcaggaggccacagaaggacatgaggcccagcaggaccgaggccagtgcgaactgcctggagaagaccgcggcgaacccggacttctgcggtgctgcgcccgtgtccaaaatgacgcgctcctcgagcagcggaacaccggtgcgctcggctgcggctgcggcttcctcttcccggccgcgggagagcagccagcgtggagattcggggagcttgcgccaggcaaggggcagcagtatgaccagcggcagtgcgccaatgatgaacagtccgcgccagccgaggctgtcgtggaacaggatgcccatgatggaggcaaccacgccgccggcggggacacccgagtagacgatggcgttgtagaactggcggcggccagccggggcgaactcggccatggtggcgcccgcgctggcgatgaccacgcccaggcccaggccagtgatgaagcgcatggcgccgaaggccggcaccgtagtggtgagggcggtgacgaacatgcccactgagaaccaggcgatgccaaggagcatcagccgccggcggccgaagaagtcgcctacggcaccgcagatcagcgatcccaccagcacgccgatgagtgcccaggagccaagtaggccggcggtggccatgtcgaactttccgatctcgccagggtccgccaggaggcccggcaggacggttccgtagatgaccaggtcgtaaccgtcaaagagcagggccgtgcagatgatgaaggccacccagttggcggtgcgggcctccctttgtgggttttcagcgataaccgcgtgcggttgtgtcatgtccgggtcctctcaggggtgattgcatgcgctggcacgactgtgggccagcggtcgtttccgggttcccttcagcctgacaggtgtgtgacccacggcatatgaggcaaatacccggggtttcgcccgggggtttctatgtacttatttcgactgaataagacccttatattgaagagtaggtatagatgacagctcacccgcctgccgctaggctggcgcaatgacgactcctgcacgccttcattccgacctgtcccgcctcggccgggaaaccgacatgttcctcgctaccgtcgcgtccctgtcggacgacgaaatggccggcccgtcgctgtgcgacggatggtccagggcgcacgtgattgcccacgtcgccgccaatggccgtgcgctggtccagttcatcgactgggctgccacgggtgaagagcgccggttgcacgcctcgcccgaagcccgcgccgaggccatcgccaccctggcggccctgccccgggaggaacttctggcggaactgcgggcatccgccggacacttcgctgagcaggcgcagcggctgtccggcacgctcgttgcccaggagatcagcttgaaccgcagcccgctgccttcggcgtccattgtggcgctccggatcgcggaggtggtggtacaccaccaggacctcgacacggcctggaccatcgaggaagccgacccggactcgctgctggatgcgctcgaagccgcagtgcgctccttgggtgccaaggatgcgccgggcatgaccctggtaaccgaggaacgcgacaaatggattatcggcgacggcacacttcgcgttgagtccgaccgtgagggcctgctccagtggctggcgcgcggtgatgccacgcatatcgaagcggagggccaggtgccggcgctgccgcgctggtgagtcggcaggaacggctccagcggcatcccattgcgggtcccgcacagtccggcgggatcattttctttgcgccagcgcttctgcctcgtggtacctggcggaggatacgagcggagttttgtggcattgccggcccctgaatttgaaccgggctgcgattcgttgaggcggcgcgcctgaccatccgcatatgctcttcaagtaccacgaacgattggacgcacatgagccgcagttatgtcatcgatgcgattcccggcgacggcattggcgtggatgtcaccgacgttgcgatgcagtgcgtcgacgccgtcgccggcatctacggcttcgacgtccagtggcgggtccgcgattggaacagcgacctgtaccgcaaggcgggccgcatgatgcccgtcgacggcatcgagcagctgagcagcggtgacggcatctacctgggagccgtcgggacaccggacgtgcccgacgacgtcaccctctggggtctcctcatccccatccgcagggagttcgaccagtacatcaacctccggcccatgcggttgctgcccggcgtcgtcggtgccatgcccggcatcgaggacctggacatcgtggtggtacgggagaacgttgaaggcgagtactcccagatcggaggaaggttcggcaccggaaccgacggcgagttcgcggtccaggaaagcgtcttcaccaggcgcggtatcgcccgggcggcgcggtatgccgccaacctcgccaccgaacgcggcggacggctggtctccgcaacaaagtccaacggcatcatccacaccatgccgttctgggatgaggtggtggcggagacggtaaaggcgttccccggcgtcgtcgtcgaaaaggtgctcattgatgcgctggcggcccggttggtgatgaagccgacgagtatcaggaccatcgtcgcgtcgaacctgttcggggacattctctcggacctggtagctggtattgccgggtccatcggcattgcccccagcgccaacctcaacccggagcggcggcacccgtcgatgttcgaacccgtgcacggctctgctccggacattgcgggcaagggcatcgccaacccggtcggcgctttgtgggctgcggcaatgatgctcgaccatctcggcgaggcggaggccgcccggtccctgaccctggcctttgagggcacgctcgcggacggcactgcgacgccggaccttaagggcactgccaccaccgctgagttcgccgctgcagtgctgtcacgcctgtcctaaacgaccagccctccgcgcaaacgcttctccaaacggaacgcgaccagcgaggccgccgccccggctgccgcaaccaccgctgcgagcgtccatccaacggccgggctgaactgggagaaaacgatcccgaagagcaatggccccagcgttccgccgatgtaggttccgctctgggtgatcccggtggcctggatggtgaacggatgcgccgtgcgtgaaaccacgtaatgggccaggccgttccagccccagcccaaaccgaacgcgacgacggccccggctgcgtaggcggccggtaaaccggtcgccatgcccagcagccccagactcccggcccccatcatcagggccactgtagccatcgagccgccgaccccccggtccgcggcaataccaaccagtgggcgcgccagaatcccggccacgctggcggcgcccagcaacatgcccgcaccggcggcggagaaccccgcctgcacagccatggtgaccgtaaaagcacccacgacattggcctgaccggcgcccagggcgctggccacggcggtagcaaaaaggaatggtttaagcctccgggggagcggctccctggcagttttgccggagccgcgattgggaggggcagtgcgtgggagggtacggaggagcaccgggaccagggcggccgccagcagtgctgccagcgcaaaggtccagttccatcccacggtaagtgcgaataccgggaccgacaggccggcggtgagcgtcgccgtcggaatggcggcctgcttgagcccaaacgagaaggcgcggttgcggaccgccacctggtccacgatcaggccgttggacagcgggtggatcagggcgttcgcggcaccggcgaaactgagccagacgatcagccacgcccagtgcggagtgacaaaagcgatgccggccagtgcaacaaagcccagcccgacggcgagcgggactccgcggcggagccccagttcgcccgccacatacccggccggggcagacagcagcgctgacacagcccagaaggcggccacagccactccgagtgctgacgccgtcatacccaggtcctgctcgagctggacagccagcccgccgaccagaaagaccggcagcaccgccaccaccgttgtcaacgccgcgatggccgtggcccgctgtcccggtcgacgcgccggtgttcgaacgggtccgacggcggccggcctcaccgtggggttcggctctgcgaaacggcgcccgcgccgtcctgtacgacggcgtcaccggccagcagggagcgcccgccggtccgcacctgggccagcaggccgccggcagtgaggacggcgcgttcggccggagagaagtcgagcccgagcgtcagctcagtgtccccgtccacgcgggcggtgacggagcggcggccctcggccagggcgtcggcaagcccctcgatgacccaacgctgcccggttgagctttgcgcgtcgggcgaaaggatcagcggcacgattccggcggcgatgaggttgcggcggtggatccgggcgtagctgcgggcagcgaccacccggacccccaggtacagcgggatcagggcggcatgctcccgtgacgaaccctgcccgtagttttccccgcccacaatgatcccaccgccccagtcgagggcccggtcgtggaattccgggtccaggcggcggaacatgaagcgcgcgcagacggcgatgttggaccatacggacatggcgatggcgccgtcgggagccatgtcaccggtggagatgtcatcaccgacggcgatcagcacccgggcgtccaggtcagccggcagcggggttggctgtggcggcgggacgaggttgctgccccgctcgatctcgatggtgcgacgggtctcaacgggcaggacaccggcgatgtgcaggtcgtggacttccggatgcgggggagtggcagggcggagctcaccccggctgacggtggcagcgtcgacgatggcgccttccagtgcgctggcagcagcggttgacggcgagcacaggtatacggagtcctcggctgtaccgcttcggcccgggaagttgcggttgaacgtccgcaacgacggcgcaccttccgtgggtgcctgcccgatgcccacgcaggggccgcagactggctcgagcatccgcgccccggcctccatgaggtcctcgtagactccggaggcgatgattgtctggaggatctgccgcgatcccggggtcacggtgagctggacggacggatggacggtgtgtcccttgaggatggccgccacagtggcgagatcctcgtaggagctgttgaccgaggatccgacgcagacctggaccacctcggtgcgcggcagttcggagacgggacggacgttgcctggggagtgcggcagcgccacgagcggaacgagacccgagagatcaagccgctcatcgtcgtcgtactttgcgccggcgtccgctgacagggggacaaactgctcctcgcggcgctgtgcgcgcaaccacgcgcgggtctggtcatcggaggggaagacggcggtggcagcccctgtctcgatgatcatgttgcagatggtcgcgcgcgccgagacggacagggaggccaccccttcaccgtagaactcgaagaccttcccgcggccgccgcgcacgccgtggcggcgcagcagctccagcaccacgtccttagcttcggcatcgggtccgagcgtgcccgtcagttccacgcccacgacggcggggcacacaaagtcgaacccgtagcccgccatggccacggccacctccagcccgccggctccgacggcgaacatgcccagggcgcccgccgtggaggtgtgggagtccgcgcccaccaggacgccaccgggcctggagaagtgttccaggtggatgtagtgggagatgccgtgcccggcgggggaatagcgcagcccatagcgggcggagaaggtgcggaggtagtggtggtcctgcatgttcttgtcgtcgatctgcaggacgttgtggtcgacatacatgaccgccagcggcaccgcgatggaatccacgccgagcatttcgaactgcatggcggccatggttccggtggcgtcctcgatgaggatctggtcaacggcgatggtgatgtcgctgccgggagtcagctcgccggaggcgaggtggctggcgaggagcttctgggtcaggttctgggccactgggattccttagcgctgtgcgtacagacaactgcggcccgccgggggatcggcgggccgcagggaagcgggattacttgacgaactcgttggtgtaggtttcctcgagcttgatctcggtttcgccgacctccgggttggccacccgctgcgtctcaaggacggcttgtacgccctcctcggtgaaggcgccgtccttgctcagggccaccttcatctcttcgatgaccttggcgtactgttcgggatcgccgccggcgaaggcctcgggcatctcggccgcgatttcctcaccggagtggtcggcgatgaactgcagggttttcttgatagctgaggcgagcttcttggccgactccggattcttttccagccagccggaggttgcgtacaggctcgacgacggccacgcgtcggtgccgaatacctctttaaggccctccggcgtgcggacgtcctggatgatggtcggctcggttccgagccgcttggccaggacggtgacgtccggctcgagcatgacggcggcgtccacctggccctgctcgacggcggcaacggcggaggacccggcaccgatcgccgataccgcagcgtcgtccagcttcatgccgttcttggagagcaagtacttcacgaacatgtcggtggaggacccgggcgaggtgacgcccacgttcttgcccttcaggtcggcgacggatttgatggagtccttgttcttctccgcgaccaccagcgcaagtcccgaggacaggttcatgttcacgaacgccttgacggcctgcttcttggcctgcatctggattgtgtgctcgtagtagccgctggtgacgtcggtgctgccgccgatcatcgccgtcagcgccttcgagccgccctgcaggtcctgcagatcgaccttgacgccctcttcctcgtagtagccgagttcctgggcaagggtggtgggcaagtacgtcagcagcgtctggccgccaatcccgatggtgacggtctcaccgctggcgcccccgcccccgccgccggcggtcccttcctgtccgggaggtgctgactgcggggcgccgcaggcggacagggcaagggcgaggccggcgacgacggcgaggggcttggcgaggaaaacgcggcgtccttgccggtttgcggagctgaacatggggtccctttcggacggaggggctgggattggttaggaagactgctgcggcgggcgccagcgcaggagatggcgttccacgcggttgaccccgaggtcgatgatgaggaccacgaccatcaggatgaacatgccggcgaacacgccctcggtgtcgaacacaccctgggcctgggcgatggcgtaaccgacacctgccgaggcgcccaggtattcaccgaccaccgcaccggtaatggcgaagccgacgctgatgtggaggctggagaagatccatgtcagggcgcttggaatgaacacgtggcggaggagctgcttttcgctggctccgagcatcttggcgttgtccaccaggacgcggtccacgctcttgacgccttcgagggtgttgaagaaaacgatgaagaacaccagggtgaagccgaaagcaaccttggaccagattcccagtccgaaccagagcaggaagattggggcgaggacaacgcgggggagtgcgttgaacatctgcaggaatgggtcgaagagccgctccaggaggcgcacccgggccaggaggaagccgaggaccaggccggccgtcgcacccgtgataaaggcgaggaccgcttcctgcagggtgatccacaggtgcgggaagacgaagcccgtggagatccaggcccacaccgtcaccaggatgtcggaggggaggggaaagaagaacgggtcgatgacgccgatgcgtcccagtaattcccacgcgccgaggacagcgacggcgaggcccagttgccccatccggatggagaagttcgacgcgtcgggccgcttgcgcttgggacgctggaccgccgccgggttctgctccttccggaggggaaagcgttgtgagttcttggaagctggtgccacggtcatgctgcgtcgctctcttcttcccgtgctgattcgtaggtcctggatacctcaaccttgaggcggccccagatttccctgtggaggtctacgaacttgggatcgtcgcggatttcgaggaggtcccgggggcgggggatgtcgatctcgtagctgccgacgacggtgctgcccggtccggccccgaggatgatcacctcgtcggacagggcaatggcctcgtccaggtcgtgggtgatgaacacgacggctttgtccgattcctgccagagctggaggagttcgttctccatgatctggcgggtctgcacgtcgagcgcggagaagggttcgtccatcagcaggatgtccgggttgacgatccaggcctgggcaactgcggtgcgcttgcgcatgccgccggaaagctggtgggggtaccggtcggcgaagtttttcaaccccaccttctccagccagcggcgtgattcgtcgtaggcgtcagatttcgagacgccggccatcgtgagcccgaggctgacgttgtcgatgaccgacttccacggcagcagggcgtcctgctggaacatgtaggaggcgcggcggttcaccccatggacgggctcaccgaagctatggacagtgcccgacgacggattcaacagtcccgctgccatgttgaggatcgtggacttccccgaccccgttgggccaacgatagagacgaaccgtccgggctcaaccttgaggtcgatgtcccggacagcgaagtacgatccaccgccgggagtggcaaactccttggtgcatccgttcagttccaccgcatacttcgaagattcaggctgtgagggctgcgtcattgctatttctcccgctaaccacattgtgagttgatggccatatagtgggcactaggctaacagtaacgtctgtcacactacaaggggggcttttagaggcgccttcctgcctgaccgagaagaagaaggaacccggagtcgagccatgagcgcaaccgaaaacgccgccgccccgttgctggtgctgaagaagatcacggccatcctggatgccttctcgctggtgcggcctgaactgagcctcgccgaaatacgcgcggagaccggactgccgcactctacggtgcagcgcctggttgcgaatatggtgcatgaaggaatgctggaccggcgtgatgaccagttccgggtcgggttgcgtatgacccattgggcggcgcccgcccggcatggcctcgacttcctggaattgctgacaccggtgatacggcggttgcgggacgaactgggcgaaacggtgtgcatcttcagggaatcgcagggaagcagggtttgcgtcgcgttggccgaaacccggcgggtgctccgaagggcagtcgacgtcggcgatatcatgccgctccacgccggttcggcaggccgtgtattgctcgcctggaaccccgacctggcaggcagggtctacgggtcagggctccggtccatcaccgaccagaccatcacggacgcagcaagccttgatgccgccgtcgcgaagacccgtgcggacggttttgccatcaccaccggggagcgggtttccggggccagcggcttgtctgttccaatcttcggcccgcaggctgagctttacggtgctctgaccgtcatggggcccaccatgaggatgccttacgacgtgtgcgcttcctggatagagccggtcatcgctgcggctgctgaagggacccggctgatcggcggaagtctcccctcggaggtggagcccatattgtgatttcatgttcacaatatggggaagtgagtgcatactggtttcttggacggcggggtacccacgggcctccgtccgtgtgtacggcgcccgctgggtccgcatcaggaatcaggagttgagatttgatgaaggttttcgaaaccggcacagcgaagcgcggcaaggacgccgcggacggggccggccacgggatcgctgaagaaacgcaatcagccaccgcaagcaggaaaaaagccacgggtgatggtgccggtccgctgtccggagtgcgcgtcctcgaactgggatcccttatcgccggccctttcgcagggcggcagatgtcagacttcggtgccgaagtcataaaggtcgaatccccagacaggccggatcccatgcgcgaatggggccgcgcgcgggttaatgaccacaccctgtggtggtcggtgcagtcccgcggtaagaagtgcgtcaccatggacctgaaagtcccccgcggccgggagctttttctcgagctctgcaaggaagccgacgtcatcctcgagaacttccgcccgggcaccatggaaaagcttggcctcggccctgaagagctgtggaagatcaatcccggcctcattattgcgcgggtgtccggctacggccagaccggtccggaagcgtcaaaaccggggtatgcctccgtcgctgaggctcgcagcggactgcggcacctgaacggctacccggatcagccgccccctcgcacgggtatctccctgggggacagccttggctcgctgtatgccctgcaggggatcctcttggcattgtattggcgggatgcccgcggagggaccggccaggtggtcgatgtctcgctcgtggaggcgtgcttctcactgctggagagtgccgtgccggactacgccgcgacgggtattgtccctggacccagcggttcaggactcaaggggatagcgccgtcgaacatcttccgctccagcgacggcaagtgggtggtcatagcggccaaccaggactcggtcttcgtgcgcctggccagagcgatgggcatgcccggactcgcgcaggatccgaaatatcgcgaccacgcgcagcggggtcgtaaccaggaggagcttgaaagcgtcatcgccgattgggcggtgcagtactccaccggcgagctggtccgcgtgctcgatgaacacggtgtaccaaacagcacggtgagcagcgttgaagatatcttcaacgacccgcagctgaaagcccgggacatgctggtcaacgtgcccgatgaggagctgggcaccgtggtccagccgggaatcgtccccaagctcacgcgctctgcgggccggatcggctggaacgggccgctgacgcatggatcccataacgtcgatgtgtaccagggcctcctgaatctcaccgaagaagagttgcagagcgcccgcagcgaaggagcaatctgatggcttttggcaacggaaccaggccggtctcgatcgtggacgtcagcccccgcgacggcttgcagaacgagaagacccctgtgagtaccgaggataaggtccggctgatcgaagagttgatccggatgggtgcccggcggatcgaagcagtcagctttgtgaatcccaaagcggttccccagatggccgatgccgatgccgtgatggcggcggtgccgcgcaccgacgcggtcagctatatcggtctggtactgaacaccaggggcgccgtccgtgctgtcgacgccggggtggacgagatgaactatgtgctcccggtgactgacgcgttcgccacagcgaaccagaacaccaccgttgcagcggcgctcgcggcgctggaagaagtttcggatatcgcagccgcggcatccattccgctcagcgtcacagcagctgtcgcttttggctgcccctaccagggtgacgttcgcatcgaacagaccctcgacgtcgtccgcagtgcgatgggccgcgcgaacctggcggaggtggcgttggcggatacgatcggttgcgccgtgccgtggcaggtgggcgaggctttcaccaggctgcgcgaggaaaccgacctgccgttgagggcgcacctccacgagacccgccacactgcgctggccaacacctatgcggcgatggcatcgggcgtagatgttttcgatagcagcgtcggtggtctggggggatgccctttcgcccctggagcagcggggaacatctccacggaggaccttgcgtggatgctagggcgagccgggttccatacagggatcgacgtgcagaaggcaacggaactgggccgctggatttgcggcctcgtcggtacgaatccgcgttccggactggcgggggcgggagtgttccccgcggcagcgtaaggcgcagtactttgactgcgccgattgacgtgggatggagagagcaggagggactgtggtgcggaaggattttgatccggcgcagatgtcgtcgggggagttttaccagttgttgacggcggtggttgttccgagacctatcgcttgggtgtccacgacatcggtggagggtgtggacaatcttgcgcctcattccttttacactgtagcgtccgtggatccgccgattgttcagttcacttcagtgggtgaaaaggattcgttgcgcaacatccaggcgctgggagagttcgtcgtgaatctcaccccggcttcgctgtttgaagaggtcaatgccactgggacggactttccagcggaggttagcgagttcgatgcagcggggctatcccgggaatcgagcaccgtggtgggtcctccacgggtaaaggattctcctgtggcactggagtgccaattgcacagcaccttggagctgggtaactgcacgctggtgtttggccgggtggtccacgcggtcgtgtctacaagcgtgctcgacggcgaccatccgcagatcgaccttttggaacccctgtcccggttggggcgcaatgagtgggggacgctcggttcgattcaggagctcagccgcatccgggcaaaggactggcccgggcacttcggcgacgccgttggacaaggatgaaacacacaacgaggggtgcatggttggctcttgatggtttcggtgtggagcgcggcggcggcctgccgcggtaggtgacttcggcgctgaacgcgttggtctggatggaatgcgcgggcaggtcaaggctcatgcagggtccgactctatgaaacaggtggtggatcgtcctgcggtgtcatggcttggcaatcaggacgttgtcatggacgggctgcattccatctttgatgaagtcggacgtgtctacgttgtcccccaccagcatcacggtgacgactccgttgagacccgtcgtaacgatctcgcgaagagaattcggggccccgccgcacccggtaatccaattcagtggggtttggtcgactactgcacttatgcacgtggtgttgccgtcaccgcttcgcccggcgaagtagcggatgccttcgatctcgggccctttccgagggcccatgaccacgccctcgggaaggacgtcctcggcggtggcttcacggtccagtgcggtaaagcctgcaggcgcggtagccggtgcgcacccggtgatcaggagtactcccagtgcggcaatcacgccggtccgtcggtggctgtgattcattcctctgccccctcagactttgaggttgagcctacaggagggttgcagacgcaggtcggggtgcacccctccttgaccgataggctagccccatgacgttgggggacgcagcgggaataggtgtcggacgcctcccggatctggtgccgtacggtgccgtacacatagaatccaaacccatcaccgatagaaagacccccgtgaagcagagcattttcgcccgcgtagcccagctcgctaaggccaatatcaacgccctcctggactccgcggaagacccgcagaagatgctggaccagatggtccgggactactcggccaacatccgggaagccgaggccgccgtcgcgcagacgatcggcaacgtccgcatggccgaagaggactatcgccgggcggtgaacgatgccaactcctggggcaacaaggccatcgccgcgtcacgcagagcggacgagttccgggccgccggtaacagtgtggacgccgacaaattcgatgccctcgccaagctcgctcttcagcggcagatggccgctgagaccaccgccaaggcccaggagccaaacctggccgcgcaaaaccaggtggtcgaccagctcaagcacggcctggaccagatgaagggcaagctgcgcgagctgacggccaagcgcaaccagctggtcaaccgtgcccgcgtcgcagccgcccagtcccaggtcaatgacgcggtaaagtctctggacgccggggacccgacctcggcgatcggccggtacgaggagcgcatccgccgccaggaagccacggtccgcggccagcaggaacttgccgcctcgtccctggacgcacagttcgcgtccctggaagacctcggggagcagaccgaggtggaggcgcggctggccgcgctcaaatccattgaccggaaggccatcgactactaaaccggcggcctgcatttccgtgggcttgtcctgttcttagggctccctgtcgatcctcgcattccgagcggtgatgaaggcgtttttcttccccaagtacagaaggtactccttacttgtcctggggacggcagaatgcgtgctgaagtcgtcagtggacgggtgaaagaagcggatagtgccgttctttctcacgaggtcctgcagcaggaagaactcgacatacccgttgaagtcttggaagagggcgaagaatcgcgaatggcgcgcgatgcctttcccaggagcctagtcgtgacggcgtcgctggcgaggaaaacgtcgcccttcgctgatctgtgcaccagatactcgccggattcgggtgccagatcgaagcggccgcccgtgggtaaatccttgctccacaggatccggtggtgctctttcaggtctcgctgagtttgtccggatcctttccggggggcgtgtcatcgtggtatttaagggtcgtgttgacgccggcggtcaggctgttctcccgtggcgagcggctgcgagttcggcaaggtcgcggatgagccgctgcacctcgtgttcccggcccctgcaattggacgcctgctgcactgcacgcggtgcgaccaagagcttggtcagcgggactggcaaaggcgtcttcgtggctcgtggttcctccgcagacgggatactgctcttgctcatacgtcccccagacgtcgtcgttgctgccttgggaacactctaggaagccaggaggaaacgggggaagggattcggtcaatcctcgggatctcttgtgtcgatcttgagcgggacggttccacgtcctgtgaaccgtcaaccggaggcttggtcctccttcctcatgaagtagtcgacgccggtgtagccgccatccaccacgaccgatgtcccggtgatgaaggcagcctctgcgctcagaaggaaggcgacgactttggcgatgtcttcggggctcccgttgcggcccaggggagtgagggtcgccgcctcgtacgaatccgtcagtatgcccgaatcgacccaccctggcgtgaccgcattgacccggattccgcggggccccagcacgttagctaggctcctggtgactgagaggagtgcggccttgctggccgagtaggcgatgccccggaaggagcccacgtacgcgtccgtgctggcaatattgacgatgctcccgccactggagaggcggggacctattgcttgagccaggatcagcggggcggtgacgttgaccgccatggtcctgtcccaggcatccaatgtcatcgcatcgaagggctccttctcgagaaccccggcgttgttgaccagcgcggtcagtggaaattcatcgcagatatgctgtgcgaaatggactgtccctatcctgtccgccaggtcaatctggcgaatatcgacgttatgggtgcgtgccagctcctccgcttcgtccaggccagtgaggtaggtggcgatgacatgccaaccgttctcagccagacgctcggctgtggcccggccgatgccgcatgcacctccggtgaccaaaacggtctgttcgccggccatcgaggcctcctgctagttcgagaggaacaggtagacatactgtgggcctggccgcccccgaacaccagacccaattcctgagcagaaggtgaaacccacgcaccaagcccactcatgggatggtcccgtgaccgaccaagaggctgcgcttcctgacgatcgcccaagcggccgaagagcggaacgtgaaccagctccgggccctgctcatggcaggggagcttcgcggaattcaggtcggtggcccgggggcatgtggcgcatcggggccaccgacatcgaggactacttcgccgaggcgtaccggcgcacggccgtatcaggcgggtcatcagctaggcctgattgggccgcaaaaaacagggggatgccagacgcagctccgactggtaggacctttagtctcgacggcccggtgactgggtatagtcggtgatgccggcgatctcctgcaaagcacgcaggtgcgcgccgaaggcgtttcgcccggccggggtgagggaaatccaggtcagacggcgggcatcgctgcgagaaaccgatgcggctttgctcaggctgacgtatccggcctcagccagggtcttaaggtgctttgagagggtcgcgtctgagacgtcgagggtgtcgcgcagtacagcgaagtccatctgctccacctgccgcaacaacccgcagatccggagccgtaccggggcgtggatgaggtcatcgaactgtgccttggtcatcgtcgcagctggtccagtgccgagcggaaggcgatgccggcgagccaggtgaccaagccgaaggcggacaagctggtcagcaggaccgcccagcgcgcgccgaaggaaccgaggccgagcgagattgagaacaggatgaggcagagcaccggaatggccgccataaccagggccgcgcggggccccatcttgcggaagcggattccggtttcgcggcggatcaagtgagctatcaccaaagctgcgaccagccccagccatccggacgttggcggctcgtagttctcacccgggttagcccctgcggccccagccacccaccaggcagccacgcctccgagcgcggccagcagcatcttcgggacttgcaccccatcggccagggcctgcctgtcagcacccaggtcccggaggctggcagcggcctcctcggacgatgggcgcccttcaaagtcgttttccatattggaaagcctatagaaagactttccgatcaggcaagttatccgttttgccgtaacggaagtgtgattagttcaaccacatttgatgaagctacgaagatgcgcgccctacgtcagtccgcaattcttactaagccctgagttgttgcacctaggctaagcgggccggcaaggggctcgagggcggtgccggtagtacccagcctcgactaggccgctctttcatcggagctttggatctccgcactctggactgctcgtctgacgtgggctggcggctggcgccgggctttgaccagaacaatcagcatggtcaggattgtgaccgtccaggcaatcgcggcgaggaacaccaggccaattcccactaaggggtgcataccgaaagtctaggaccgtgccgctttcattttcggacgcaactccgcagcatcagagccggaatttgcccacgtagggaccagaagtcagcggacaagcctcagggcacgaaaaaggtgcgccccgttcgctgagcgcaccctcctcgattcccctcacagtcgcatccccatccgactgcagccatcataagcatgcttaggattaagtttgcaagcccaaggcccacaccgcggcaccgaggcagatggctccgaacaggacggggactgctcgagggctcacgcttgctgctgggcgcgatcggcctcacggtctgtaggcatggtcgccgacggtgcggtgcggtgccagatccaggcggagcgcaggataaaggcgaggagcagcacctcgattgcgatgaggaagccgtagtgaagtgcccagtcccaggacgcccctgccgcgttgaacaccgtgacggggacgtagagcgttgccacgacgaggttcgtggggcggttcacccgggcgggcagcgtcatggagagcatcaccatcagggccgggattcctatgactacgacgaaaatggtcatcaacgacggggtgatgccgaactcaaagatgccgccaccccggatttggtcgatggcgccgggctggcagaggtggaagtagccgatgtagatgtagaagaacatcaagctggtccaggcggcggcgagctcggcttgcaccgggatccgccggtcttccagtgcggtgggggtttgacgtgctctcatcctgggctccgttgttgtcgtgaggatcggtagttccacgatcgctaagcccggcggtgggcacatcggcccggagtcgatcaccagctcagcagcagcccccaagccggcagcccgagcagccagccaccggccaaaaaaccgaggtcgtcttgcagtcgagcatgtctgcccagcgtttccggccttgctggagcgcggtgccggttggctgggaagcgatggcgtccaggtaggaagcaggcagcatgacttctgcgatggatgagttatcaggccacgagcagtccgtgccgcgagtcccggcgtagaggtgatcgaagtgccggcggctgagcccgttgtcaatggtgggggactttggatggtttgattagtcggtgcttcgtctcagacgcctcgttgtccttgtcctgttcgcggtttgcgccaccaccgcgtccttgttctgggcacttgggcaatctgccgcggacgctcgtgctgccttttctcctccgccgcaggcggaagttgagctcgaaatgctgtcctccggtatgaccaccgctgtgaacgtgaccagaaacccggatgctgattgggtgatccgggctgcagggcataccggaatccctgagcgcgcgctgcgggcgtatgttgccgcggctgtgaccgtgaatgctactgtcccgacgtgcgggatcggttggaacacggtggcggcagtgggtttcgttgaaacagcccacgggacgtacggcggcggtagcctcaccgcttcggggctagggagccgcccggttataggcccggttctcaacggtgccgggttcgccgccatcgcggacacggacgcaggtgtcctggatggggatgcccgctgggaccgtgctgtgggaccgatgcagttcattccttccacgtggaagctcgtagggcgggacgggaacggggacggaacggcggatcccttcaacatcgacgatgccgcccttagtgcggcgatttatctgtgttccggcggccgggacctcacaaccgcggacgggtggaccggcgcgatctacgcctacaaccagtccgatgcttatatccggcaagtgcgtgatgaggccagggcgtacgccgcgaaggcaggcgccgcgggatgagccccacttttaggtagccatgctcccttgcgtaacgcggaacgttggatctcttcgcaggcggcagcaggaggcccagagagtgcgtgacgcgccgacgtgcagccgcccattaaagacccgtgccggccatcctgtggatgaccggcaccgggcagcctcgatgctgctgtaagagctggtggtggtgttctgccccggttcagggaaagaggctccgggtacagtcaaaaatgtcggccatggtccaggcgtcgagggagagcacctctgccgttcctttggcagcgaggctcacgtggcccctgcccagggtggggtagacgcgggcagtgagcgctatcccgttggcaaaaatttcgacggcggaccggtccaggatgacgcgcaggtgcacccgcccgtcgggcatggggacgggtccggacttgtcttccgcatcaacggctggatcaaggctgctttgggtgcggtccaggcggagtgtgccatcgccggcgccgtcagccgccctgcgcagctcgatgaccgtttcctcggcggggctgccggaggtgccccggccagtggagcccagtacaccgagccgcagcagtgcgcccggtgccagttggagctccagttcgaggtcgagttgggtgccggacaggccggtttccaagggttccaacaaaccgctcagcacctgtccgggcaggcgggtgtggtcacggcgcagtttcttgatttccggtacgggtgcgaagcggagggtcccgtcctccgccgcagtgacggttcgcggcaggctcatcacccctgaccagccggcctccaccattgcggcatcgcttcggccttcctgcatccagccgaacatgacacgccggccggactcatcctggaacgattgcggtgcgtagaagaagcggccgccgtagtcgagccggtgcaaggccgccggctcgaagctgtccccggcgtaccggccggtccagtacagcgggtggcgggtgtcgccgtcgttccatgcggagaagaccagcacatccggtgagccgtcagaaggtgtggaccccagcgaaccctgtcccgcccggaaaaggtccacgcattcccacatggtccccgtccagtcagtgtccgcaggatcaccctgcgaggcatcgccgatgaacaaaggcccgatgtagtcccaggaccgcaggtccgctgactcgtacaggaacgccgtaccgccgcgctggcggatgcccgaacccaccagctgccgccacttggttccttcacgccagacgcagtgatcgcggtacgccgtgatgtctactccagccggcggcgctgcgatcacgggatttgccgggtccttggtccagttcagaaggtcaggggatcctacggcgacgcagggcagctccttgccttcgagacgccccgaatacaccagggtgggcgtgccgccgtcgttcaccagcacccctgaccagcagccctcggcgtccggtcctgcggacggttccaaggcaacgggctggtccgtccaggtgaccatgtccgtgctggtggcgtggccccactggatgcggtggtggaacgcgccctccgggttgtactggtagaagaggtggtaagtgccgttccattggcagacgccgttgggatcattgagccaaccggccggtgacacgaaatggaaacgtggccggagcgggtcggcttcggcccgggcaaccaactcatcccttggaacggttgcgagcgggtgggtcagtccagtcatgcggaagcctcttcttgaacgttcgacgccgggcggctgggttggcttggttcgcccgccagggcatggccggcggcgccggcccacggccggtagaggtggcagcgcacccagtgccggttttcggggtccccaacctggtggcgcacgggttcatcggctgaacaggcctggttcgggtcgccgtcgaaagcgcacgtggtcgaagccattaccgcctgccgcagttcggcccggcggacgggatcgtacgagcctgcccgtgcggggtccgggacagccgagaccaggagtcgcgtgtaggggtgtgcgggattggacagcaggtccagggactcgccttcctcaacgagttcaccggcgaacatgactgccgtccggtcggccaggtagcgggcggacgcgaggtcgtgggtgatgtagagcatggagatgccctgctcgtcacggagcttgcgcatcaggttcagcacaccgatccggaccgaaacatcaagcatggaggtgggctcgtccgccaggatgacttgaggttccacagcgagggcccgcgcaatcgcaacgcgttggcgctgaccgccggaaagctcgtgcggatacgagttcagcatgtcagcctgcaggccaacggtggtcatgagctcttcgagccgccgcacggtctcctccgcggaaccgccgcccttgccgtggatcgccagcgaacgccgcaggaaatgctcgatcctgtgggccgggttcagcgaaccgaaggggtcctggaagaccatctgcagctgggaccggaacgcacgcgacgcctggaaccgatcgcgcttgaggatgtcgacgccgtcgatcaggatcgcgccgctgcttggcttctcaagccgggcaacgcagcgggccaaggtgctcttgccggaaccggactctcccacaagcgcgacgatttcgccgcggttgatggtcaggtccacgccgtgcagggcgcggactgagtcgcgggagaacagccctccaatggggaacgatttgccgaggccacggatttcaagggcgggggtgcgtgtggtggacgcagccaccggggatgtcagggagtggctcatcgtgcggctcctgccaggtctgcggaatcaatcactggagcgtcggcaccaagcggagccacgaagtggccgggtgccgcctcggtgaggtccgggatgttacggaacttcacgccgtcgggcagtcccgtcagcggtacccgcgggccggtgagcggcgggaatgcgcccatcagcgcctgggtgtaggggtggcgggggttggtgtagacgtcctgcgcttttgcagtctccacgatcctgccgccgtacatcacggccatccggtgcgagagttccaccatgagtgacatgtcgtgcgtgatgaacaggacagagaagccgagctcgcgctggaggtccttgatctgggccatgatctcctgctgtaccaccacgtccagcgcggtggtgggttcgtccaggatcaggagtgacggcttgagcgccacggccatagcaatcactgcacgctgacgcatgccgcccgagagctggtgcgggtaggacttgaggcgtgcggggtctatcctcaccagttccagcagttcaccggcgcgccggagggactccttgcgggagtagccggcgtgggtggtgaagatgtccacgatctgttcgccgatggtcagcacggggttaagcgagttcatggctgactggaagaccatggccacgtcctgccagcggaagcgccgcagctcctccgggctcatggccaggacgtccttgccgccaaaggaaatgctgccgcctgcgatcttcgcgggatccttgagcagccgcatgatcgagttggcaatggtcgattttccgcagcctgattcccctgcgagcccgaacacctcaccggtgccgatgctgaaggaaacgcggtccacggcggtggtggagcgggtgtcgccgatgtacttgacggtgaggtccttgacgtccaggacgggttcgtgggagccgaaggacacttgggagatggtcattttgaggcgctcctttcggtatctttgggggttttgatcttccgcaggcgcgggttggtgacctcgtccacggcgtagttgatgagggccagggcgaaggcgaccagtgcgatgcagacgcccgagggaacgaacacccaccagctgccggtcagcagggcgccttcgttgcctgcccagaagaggttgttgccccacgagaccgtgctggcgtcgcccaggcccaggaactccaggccggcttgggcgccgatgccgtaaatgacacaggccagcagggtgcccatgacgatcgaggccatgttgggcaggatttcgcggaacatgatccggccggcccgttcgccggacactacggccgcggccacaaagtccttggagcggatggacagggcctgtgagcgcaggacgcgtgctgagcctgcccagccggtgaccacgaggacaagaatcacagtgcccagccccggagggaggaacgcggccaggatgaccagcagcggcaggccgggaaggagcaggaagacgttggttaccagggacagtgcttcgtcgatgaacttgccgaagtacgccgaggcaagtcccaccaggatgccgacgaaggtggacgcgaagcccacggtgagccccacgaagagggaactccgggagccgtggacggtcagggcgagcacgtcctgacccttggctgtagttcccagccagtgctcggctgatggttccagggaggccatggcggtgatccgcgtcgggtcgccggggaaaagcaccggtgccagcagggcaagtgcgatgaagaccagcatcacggccatgcccgtcagggcttttttgttggtgaggaggccgtggacgaagctgcggttgggcttgcggacagctggggttttgtcggccgttttaccgggttgctgcaggattgcggttgtcatgatccctccctctagttgctgcgcacgcgcgggtcaaggcggacgtagaggatgtccaccaggaagttggccagcagcacggcggcggtgatggtcaggaacaggccctgcatgagcgggtagtcgaggccctggacggcgttgaggagttggtagccgacaccggggtaggcgaacaccacctcggtgagcagcgcaccgcccaccacgaaccccagtcccatgccgaagcttgtaaccgaggggagcatggcgttgcgtgctgcgtagcggagcatgatgcggcccgggcggagccccttggcttcggccatggtgatgtagtcctcggagttggtggcgatcatggtgttccgcatgcccagcatccagccgccgatggagaccagcacgatggtcagggccggaagcaccaggtgggcgccgacgtcgccgatgaactcccacgtgaacccgggctccaggccggcggtgaaggcgtggcggatggggaaccagttcagtactacgccgaaaaggtacagggcgcccatggcgagccagaagtaggggaacgagccgatgaatacgagcagcggcggaagcgcggagtcgatcgcgccgccgcgccgccaggcggcaaggacgcccagcaggttacccacgacggcggcaatcaccagtgcggttccgccgagcaggagggtccagccgatctgggacgagatgacctcggtgaccggggtggggaaccgggaaatggagacgcccatctgtccggtgaagatgtttgtcatgtagccgatgtactgctcccagaggggccggtcatcaacacccagcagcttgcgcagggcctcgatctgttcgggctgcattctgtcctgggagcgggcaaacatgcgggagacggggtccccgggcatgaagcgcgggagcaggaaattcagggtgatggatgcccagaaggcgatcaggtagaaacccaggcggcgcaggatgaagcgcacggtttccctccattcgggaattacggaaaagtttgggggctggccgccggatgatccggcggccagcagtggtgcgtgatgggcccacgccgccgcgggttccctggccgaagcggagcgaggctagggaggcggtggggagttacttgcgcggttccagcgtggtcagcacaagcaccgtagaaggtgagcggaccgaaagggttgcgtaagggttgtcctcggtgggccagccggtgaagcgggtgtcgttgaaggcgccccactccggaccggagaacagcggcaccagcggtgcggcgtcgtcgtattcttcctgcagcttgttggcgatgtccttctgcttggactcgtcggactctgcagcgaactctgccagcagggcgtcagcctcggcgtcgccgaagcggtggtagttgtcgaacgtcttggtgcccacaggcttgacggtcgccgtgcccattgcggcgttgaaatacttgtacgggctggggtcgttggcgctccagacgatgccggagtcgaaatcgcccgtttcgtagccggcaaccacggcagcccagtccggggactccacctttgccgtgacgccgacttctgccaggttctgcgcgatcacgttggccacggacagccagtcggaagaggatgcgcccacggagatcttgaattcgaacggcttgccgtccttgagcgtgcgcttgccgtcggcacccttcgggtagcccgccttgtccagcagctcattggccttctggacgtccagcttggtccaggtgcaattctccttgacctctttgttcttccaggtctcgtagttgccggaaagcccggtgcagtccgcaggctcggcgtagccgctcatgccgatcgtggtgacctgctcccggtcaacggccatgctcagggccttgcggacgtcgacatcgttgaagggggccttggtggtgttgagctgccagttgatcatggcgcccgtggccgggaaccagtactggcggtgttccttgtccttggaaacgaacgtcttttcgatgttcgggatgtactgcggggcccagtccacatcgccgttcgcggcggcgaggttggcgccgtcgtttcctgcaaaagcgagcatcttgataccggcgatcttctgcttgtccggctgccagtagttggggttcttcttcagcacaaacgactgggcctggaaactgtcaacctcggtgtaagggcctgtgccgacgggttttgcgttggcgtccttctccggatcggcgatggcggaccagatgtgcttgggcaggatggtgaggtgcccgacgtcgtacagggccggcgaccagggcttgttgaatgtgaaggtcactttgttggtgccttcggcgctcacggtgtccaggtactcgaagccacccttgatcttcttctggagctcgaaggtgtaggccacgtcctcggccacgaagggctggccgtcggaccacttaacgccgtcgcgcagggtgaaggtgatggacttgccgtcgtcggcggccttccattcagtggccagccacggcacggtgtcacccttggccgggttgaagatcagcagcgactcgtagatggactgctggaccatcgggttgacggtgggggcgaacgggttgaagttctgcacgaacgtgcccatgtcctcacgcggaatggtgaggaaggcgctggcgttggctgcggcgtcggtgccggcagccttgttgccgttggccgcacagccggtcagcagcagtgcgcctaccgccagcccggccgccgtggtgcgggcagccctcaggaatcggggttgtgtcatgatggttatctctttcctatcttcatcagcaaggtgaaggggtgggggaggggttgctcttcgaaagtgatttcgcggtcagaccgaagagcgttctagcagcggacagccgaccaattgctggtcggcaataatcggctgtcctgctgtcagagctgcgagcgtctggactcccagggcgcccattttttcaaacggcaacgcaaccgtggtcagtttgggcctgaggtaggccgcaatcagttcctggttgtcgaagccaatcacggcgatgtctccggggatggtcaggccccgttccttgatggcgtcgtaagcgcccatcgccatgcggtcgttgaggcagaacagcgcggttggcctgtcctcctgcgggtagcggtccaggatgcggcacgcggcctcatacccgccgtctgccgttgcatatccgggcaccacgagctccgggtccagctcgagtccggcgtcggcgagtgcttcgcgtgcaccctccaagcgcccgattgctgccggaatgaccgggtccaggttgatgactccgatcctgcggtggccggcccggagtaaacgttcgacggcggtgcggccgccggcgcgttcgtccgggacgatcgagggcagcttcccgtcggcgtcgaagcagttgatcagtacggtgggtacttccttggcggtttcgggcacgtgcacgccacggtggaatgtggctgcgtatagaagtccttccacgcgctgctccagcagcttttcggttgctgcgtcctccaggccctggttgggtcctacggcatcggcctggtcggagggtgcgatgagcaggaacttgcggtcgagccaggcctggtcttgtgcacctttgatgatgtcgacggcgaacggtgccgtgacgatctcggtgacaatcccgtaccagtcactgcgctgggatgccagcgcacgtgctccggcattcgggcggtagcccaaggcctggacagcttcgttgatccgcgtgcgggtttcctctgaaatgctggcattttcgcggttgctcagcacgaacgagaccgcggtccgggaaacgcccgcgcgcttggcaacatcattcatggtgacaccccgctgccgcgcggccccggcatggttcggggtggtggttttcgccattgaatgctccggtgatagtcggtggtgctgccagtaggtaacgcgcgttacttgcgcatagttagaggttacgcgcgttactagatctgtgtcaagggttacatttctgggtgtgaagtcggcgcaaaaccgacgttcgatgcagccgcacagagggctcgtgctacgcgtgcgaattcaactggggctgatgctggagctgtgtgcggagttcgtcttcggttgggggccgggcgccggcccgggatacggtgacggcggccgcggcggccgccgtgcatcccagctgatcgaggacggaaggtgccaggccgccggttccgcgcgtgaggagtcccaggatcagggccgacatgtaggagtcgccggcgccgatggtgtcaaccacggaggtcttcactgcaggaatgctgagggcggtggtggatgtggcaagcaatgagcccgatgagccctgggtgatgactgccagctccgctccgagacccaggatgtgtgtggcggtttcctcgaggctcttcttcgggtagagccatgcggcgtcctcgtcgctgaatttgacgacgctggtgagctgcaccagttcctcgaaagtgtgccgtgcttcggcttgggttccgagcagggctggcctgatgttgggatcgtaggtgatgatgcactcgccgcggagttcctggagcatggctttgacgcagttggcgcccggtgagaggaagcttgcgatcgaaccggtgtggacgatcctcggcggagtaagggcaggatccagcggtgccacatcccaggcgatgtcgaaggtgtagctcgccgagccatcgcgggcgatggtggcggtcgccgtcgacgttctctccagtgaccgggagcctggcaggagcgtcaccccggcgcccgtgaggtgctcctcgagtgcgtcaccacggtagtcagtgcccatggacgtgagcagtccggtgctcactcccaggcgggcaaggccgtaggcgacattggccggtgacccgccgggatgttcattggtcccctcaggcgtggtgacgacatcgatcagggcttccccgataacgacgacgtccaacccctgcccgggagggttcggtttcccgttgttgtgcatgtctggtgttccttgctgtggtgccgccctacccgagctgcgtgacctggaggctgttcatggtcgccgtgccgcctacggcgtagacggcgacgtcggtgctggtctccgccgggaagatcagttcggtcatggtgacctggccgtcctgggcaaagacttcaacggaacagcggtccacgtagatggtgagctcgtaggacccgtgcctggccaggatgggagcggtgtcaagggagctgaaggatgcgtggaagtctgccctgccggattcgcgccggtccacgaggagtgtggcttgcccgggccggatgcccacccgggttcccttcgtgccgtccccacgcaggatgaggccgaattcctctgcgcttccgggggtgaagctgacgtcaatgcgctggacggtgccggccgcgcccgccaggatctgcacgccgtcgtcaatggtggttccggaaaggtggcacgactccgtgccagccagggcagtccagtcgcccgcgggctgctggaccaggcacagttctccgtcgcgggcctggagtgtgatttcccgggcgaggctcatggggctgcgccagggcgtggtggggatctggttggcgtattcccagttgttcatccaggcgatcatcaggcggcggttctccggcgcgtcgctgaaggagacggcggcgtagtagtcgcggccccagtccagccattggtagtctcccagccgggccgggtcctgcgggccttcggtgacggtgctggcggaggtgaatgtggttccgtcgaagtcaccgatgaagtattggccggcggagccgttgttgggaccgccgggattgaggttgacggtgaggacccatttgacgttgtccgggtcgccgtccacgggcaggggaaacaggtccgggcattcccagaccccgccggtggcattagccggcccgaagctgctcagcagttcccaggtcttcaggtcgcgggacttgtaaagcaccacctggaagtccgtggcttctacggcgaccattacccagtaactgtccgcgccgccgtcgtaccagatgaccttggggtcccggaactcggcggacccgcggttaaggacggggttgccgccgtgttttgtccagctgtagcccccgtccaggctgtaggccagggactgggcctggacgccctcgtgcagggagcccggtttgaaagcgctggtatagatcgccaccaggggcgcagtggagccggtgccgaagccgctggtgttgtgacggtcatggacgatgctgccggaaaagatgtcttcgttttcgtcgcaggcgatggcgacggggtgctcggtccaggtcagcaggtcggtggaagtggcgtggccccaggacatgtttccccagacgtttcccagcgggttgttctggtagtagaggtggtagacgccgtcgtgaaagatcaggccgttggggtcattgagccaggtgtccttggccgtgaagtgcagggccgggcggtagctgtctgttgtggctgccgtgctggtcggggtgagtgtatccatggggttccttttgaaaagtacgtgttatttgctcgcgccggccgtgaggccctcgcgcagggtgcgttggccgaagataaacacgaccagtgcgggcagcatggacaggatcacgccggcgaggaccaccgatatgctcccggtgccgaggttgccttggagcgtgaccaggcccaggggaagagtgaagttctgttcgctgatagtgaggatcagcggccggaagaactcgttccagtggaagttgaaagcaaggatccctacgatggccatgcccgggaccgccaagggtgcgtagacggaactgaagatccgccacggtccggcaccgtccagggcggccgcttccgcaaaatcattgggcaggcccaggaagtattggcgcatcaggaaggtgccgaaggcggtgggaatggccggcaggatcagggccagcagggtatcggacaggcccatccctcggatgagcatgaacaccgggacgatggtgacctgcaccggaaccatcatggtggccagcaccaaggagaagatggctttcctgccgcggaagtccaggcgggcgaaggcgtagccggcaagcgtggcggaagccatctggccaagcgcgatcagcccggtcaccagggcgctgttcaggacgaggaggctgacgttgatctgcttgaacacctcctggtaggcggtgaagtcagggttgatgggcaggaaggacggtggcaggttgaaggattccgacggcgtccgcagcgaagtggacagggtccacaggacagggccgagggtcagtgcagccgccaccgctaacgcggcatacctgccgacggttcctgccgcgggcaggcggcggttgcggtaggtcttgcgcgtcggcgtgccggtgctggaacccgaatgctcgttggtcccggtgtgcagggtctggctggacataagggacctcactggtagaagacgaagcggcggctgaggcggaattgcagggcggtgacggcaaggatcagcacggtcaggaccagtccgatggccgaggcttcgccgaattccagttgctggaaggcggattcaaagatcaccatgacggcggtgcgggtggagtcccctggacctccgttggtcagcacgtacggctggtcgaagacctgcagggcactgatgatcgccatgacggaagcgaccagcacggcggggctgatcagtggaagggtgacgttgctgaactgtttccagcctgtggcgccgtccaggttcgctgcctcgtgcagttcttttggaatgttgctcagggcgccgaggaagaggaggaaggagaacccgaagttctgccagacgtacaccaggacaacgacggcggcggaagccaggggactggtcagccacgggactgcgggaatgccgatgagcgacaggagccagttcaccacgccgaactgttcgttgaacatgtaccgcatgaagatggacaccgacgcggcggagagcaccaggggaaagaagaaggtggaacggaggaacaccctgagccaggacggcatcctggcctggagcatggacgccaggctcagtgcgatgccgagttgaagggttactgcgacgaccacgaacacgatggtgttcaggaaggacacgcggacggtggggtcctgtgccagggaggcgaagttggcgaaaccgacgaactggggtgctgagatgatgtcccagcggaagaaagccaggaccagcgagccgatgatcggcaggaaagtgaacagggccatcccgagcagtgtgggggccaggaagatcattgccagccatcgctcgacgaacgagcggcgcgctgccggtggttttacggtgtggcgcggggcggcggaagtggtggtcatgcgttcctcctgagggccagttcgagatcacgctgcagggttcccattgctgtccgtacgccggcggagctgccgctgacggcggcggaaacgtttttcatcagggcagtttccacggcggcttgctgcggcggcgcggggataggacctgaggtggggaacctgtccagggtgtcgtagaagactttccagtgccggggcccggtggcggcataaaaggactcgttcaccatcgaacggcgggtgggagtggtgttcggcttgggaatggccaactgcatcgcttcgcggctggagcagaacttcacccattcccaggctgcgtccttatccttcgccgtgcgcatgatcgcgtagccggcagcgccgaactggtgccgctgcgtccgccagcgggggaagaactgcacatcgaactgatcggccgtcatgccggcttcatgcaggccctgcgcccagtagccacccgccggcgtggtgccgatgcggttgttcgcgaacaagcccaccagggcgttgccgcccccggattcaggccgcacgcccagtccttcggcaacaagttcgcggaggtagtcaaaggtctcgacaacccgcgcgtcctcggcgttgggggccagccactgatacccgccgccgcgggtggcccgggcagggtccttgggataaaagcggtcccacagccagtccccgccggaagccttgctctcagtgaggaagctggtgtcgttggcgtacagccacggcactactccgccaaagagacggttggtccagtagtacggggtgaagtccgccggccgggctttccgcagggcgcggagggtggcgctgaagtcgtcctgcgtccagtcgtccttcggccggtcaaggccggcctgggcgaaggtggtggtattcaaatacatgttcgccgcgttccagtccagcggaagctggtaaaggcttccctggtacatgaaggcttccagcaggctcggatgaacgtcatcgaagtagtcgctcatatcggcagcatcccggcggacataatcatccagcggctcggcgagcttgtcggcgaacagctgggcgccctcggtggccacgtagacgacgtccggcggcgttccggccgccaccatggtcaggattttggaaaagaaatccttccagtccgcgccctggatggcctgcacctgcaccgggatatccggatgggcggcggtaaaggcctggaccaggccctggcgggccgcggcgtccgctgcagttccaaggatggcgatgttcagggccttgctgccacggcccggaatgtcggctccggtaagtcgcggccaggctcccagggtggctcccgccacagcgagtcccgtaaggcccagcatggaacgccgcgtgaagtgcgagatcctgctgccggaccgcggcgtaaacgaggggttgggctgccccggtgtcttttcagacgtcattgtcggctcctcctaacacgtgttaagtagagtagatacccgacctaacacgtgtcaagtgattttggtgccgtatgtgcggcgtcatctggaacgcgcagaaaggactggctgtgtggggaaaggggtatataggcaggggctggcgctggccgttcctgcattgaggcatcagcagcgcagcggctgtgggagcgtccgcggcttagccggccgggatggcagcggtggaagcccgtgggatgatccggcagggcacgtggagcgttccctctccagtatcctccgtggccgtagtttttccttccaccgcatccagcagcatggacatggccgccgctccaatttcggcgtgcggaagcgccaccgtggtcagcgcgggaacaaggttcgcggcaaggttctgctgatcgtcgtagcccaccacggacagatcctgcggtacacgcagtcctgcggcggccgcgtacagcagtacgccggtggccaccctgtcgttcgagcagacgatcgccgtcggccggtctctgccgcccagcacggaggaagcggcacggtagccctcatcgatgtcccatccggtcgcgtggacgtgctgttgttcacgccccagccccgctgcttccatcgcctcgcggtaaccctgttcgcgctgtggggcggcaggggagctgagggttccggtcaacagcgtgatgcggcggtggcccaggtcaatcagaagctgtgccgcggcgcgcccgccttcgacctctgccggtatgaccgactggagcccggcggccgcatccgtgcaattggccagaatggccggcaaggtaagcatcgccggcggggcggtaatttcgcgcaagctgccggtggcatacatgattccgtctacctggcggtggacgagctgctgggccgcggcgctctcgcggaccttgtcatgttccgtgtcgaccaccaggaccatgtacccgcgagccagggccgtacgggacgcgccgctgatcagccggcccgcgaaggggctggtgacaatgtcatccgtaatgatgccgatcgttgacgtttgctggttgcgcaggctgaccgcaatcgaattgggcgtgtagtcaagctctgccgcggcgcgaagcacgcgctcctggcgttctgcggtgacgttgccggttgccctgccgttaagcaccagtgataccgcactgcgggacactcccgcccgccgtgccacgtccagtgccgtggctttacgtttgaccataccgggcccccttgctttcggcctagcatacctaactcgtgtgaggtgaggggtgccttgcttgggtgctgcggctaccagcaggctgattcgtcaagcggcaattgaaaccgccgtggtgatgacttggattcatcacacggcgcggccgctgattcgagaaacgagacgtgtggctggcaccacggacacgcctcccggcggcaggccgtggtcgaagctagcgtggaacagcccgctgcaacagaaggaccgttcacatcatccgctccgccgcacagaccctaaccctcttagcctccctactgctggccggctccctcgtcagttgtgacgccgcagccaacgcccttgaggtacttgagtctgctcaagacagtgcagccgaggcgccagcccaggcagacccgtcccttgccgttgatgttgccaacgccctgggccagctgcagggcatcccggtgaagggccgcgcccctaagaccggctatagccggaacgagttcggaccggcctgggctgacgtcgaccgcaacggctgcgacacccgcaatgacattctcgcccgggatctggctaacgaaacgttcaagcccggcaacaacaactgcgtggtcaccgccggcaccctggccgataagtacaccggcgcgaccatcaaattcacccgcggccaggacaccagctccgacgtgcagatcgatcacatcgtcccgctcagcgacgcctggcagaagggcgcgcagcagctcagcgccgaccagcgcaaggaactcgccaacgacccgctgaacctcatggctgccgacgggccaactaacagcgccaagggagacaaggacgccgccacgtggctgcctccgaacaaggccttccgatgcgaatacgtggcacgccaaactgccgtcaaggccacgtacaaactctgggtcacacaagccgaacacgacgcgatcgtcagcattcttgacggctgccgctagatccactggtgttggctgccttccaatgggacgagctcactgcgggctgaccctcggcgggtcagcggctgccaacgattcttcgtgccagggcccggtcgattcccggcacgcgggaggcccgtatgacccaccgacgcagcaggcgctgggctttgttccggggcaggaatgacgaggcagcgcgccgcccggctgcctgcgcatcttcaacaacaggtttccatcgctcctcgaacccggcgagcgcaggactgatgccttcagcggaagccactggtccgaggaagtcacccaacagcgctgcccctgcggtcgccaacgaagcgccctgacccgccaggagcgatacggctcctgaggcgtcccccaggaggatggtgcgctccttctgccagcccggcaagatgatttgggcaacgacatcgtcgtacacgtgctcggggcaggcctccagcaccctgtcgacggcggcgctgagtccggcgaactccccgcgcagccgctcccgtatactcccggccccccggcctcccgccgcggccgtagagtcccgataggccaacaaggccgccacttcgcctgtgcggaggttgtagagcccggccatcctgtcgatgctgtccgtgaggacgaaccggttcctgaaccgttcgtccaggagcggccccatcacggtgaacgcggccgcacgcatgcccaaggggcgcaggtacccgtcttcggggccgaagagctgcgcccgcaccgttgagtggatgccatcggcgcccaccaggacgtccgcggcgaggggggcctccggcaggcctcgacggtgacccgcacgccgtcgtgatcactccaaacccgggaaacctgcgcaccgtaactgatccgcacccggcccggggcgacgtcgtcgagagcggcgagcgcggcgcgctccatgtcagggcgcagcaggctcaggattttcccgcctgcaagccgtgcaaactggttgtaatcgaggctgcacgtgcggcgtccctttccatccacatagtcgactgcctcgacctggtacgttaccgctgcgaggcgcgggtaaaggccgatccgttcggccgcctggagtcccggcccaaagaagtccatcatgtagccgtcgggccttggacccggtgatttctcgacaagctccacgtcccagcccgccgaacccagctggcgggccgcgaccaggcccgcaatgcccgcgcccacaacaattgccttcatatccctcccctccgtcagaggaaccgctatcagagcagccgcgccgctagagctgcagctcctcgaaagtacggagctcacgcgcgggagttgctgtggccagcgcttcctgagcccgggggagcggttcatattcgttgttcatgggatcccagccgacgaggtggccgaagtccagtccggtgagttcgttgatcctgcggaccgggacctggaaggtgaccggtgtgaaggcctccctgagaatgtccccaaccagctcatgctggctgatcatgtaagcgctggcggaatggctgccgtccggacgctggaagacgaggatcttccagaacgacagcgggatgcgcgtgcctcggaactccggatcgctgccggtgaagaccgggcctgtgaacaccgtgagccgcagcttttcagccttcgcggtgtccagcaggtagtcctcaaggccggcccatagggatgcaccctggttgaacttcttgtgatggggggagcagttggcaaaatggaaggtgtcgtcgttcgcagcctttgcaacgctgtccggaccccagaccggatccaggcggcggacgaggtgcccgcggtcaaagtcgttgcccgcgtagagatctccgccaatttgttcggaccggtccagccgggggtcgaagtaccacttgtcccgttcccgcttcggggattggctgaggctgccatcgacgttcacggcagtgtagagggccagcctcctcctgcggttcatgacgaggctgaagtggtggtaatccagcaccgttggatcccgcccaggggccgcgcggcggttctgtgctgcgtcggtgcgctgttcggctgtgagggccggcaacggaacgtgcacacccaggaaatcggggtcgtatcctttccttcccgaatagtcggggtctatcgccacggcttcatcggccaccgcagtccccgtgccaaccgcgtccccgccgcccggaacggcgttggcggtccggtctacagcggaaggatccggttcttgtgccgcctgcaccgcaccgagccggatggtgatgtgcagggggatggtgagggacacggcaccgtccgcagtgacgactggctgctccaagtccggctggacctgcgccggggcctgcccttcctccaccgggtgcagaagttccaccgggtgtggcgggtcagctggcagcggaggcgggttcagtgcttcctccagcagggcccgttcttcgttggtcatgccgtcggcgttcgctcccagccaggccaggatactgctgatccggataccttcatttgccacccactggatccgcagctcatcctgcgtcctgtcccacacggtgccgtccacggtcaggatgtctcctgccgcattgcgggcagggacgccggaatggtgcaggcccaggacttcccactggttgttgaagagcggtgacccggacgagcctggagaggtgtccgtgtggtagtgcaggaactggtcgaagcggtcgatgagttcgttctgttgcagcgcgagctgtttctcctggccttccgggtgctggatgatgttgatggactctcccagcaggatcttgccctgttccttggacgtacggttgaagccgaagccggccagcggaaccgaggcacccgccccgtccggacgtgatgtcgctgccaccgctaccacggtgacatccagtccggcatccgtccggaagaaggtgtccggctccaggtcgaactgcgatgcagccaggggaaggccgctgacgccgttctggaagttgaattccagccgggagaagcgggcggactgtgcgtctgccagcacgtggttgttcgtcagggccaggcgcggcgagaccataaaccccgtgccgaaggagcggatctggaaccggtcacggacaataaccctgcccacactgcgtgccaccgccgtgcccaactccaggaaagcgatgccgagcaggttgtttccgccgataatccgctccagcaccagctcatcccgcacctggccacgctctgccggtgaggtgtcagccgtcgccctgagcgcgtccatgaccatcggctggcgcatgacccgccggctgcgcagttccacccgttccggagcgtccacgttgaggatgctgccctgcggggtatgggcttccgcgatcttctcctccgttccccggcgtggacccttgcgggcctggaaccgcgcctgggtggcggtgagtacgtcgtccgggatgaccatgtgtccgttccttcggggtacttcaagccggtcaatgaccgcttcggactgagcgccgggctgacctagttggcattcgtgggtgcctggaccaggcccgcccctacgtccacggggtcagtgccggccttgagcggcttgaacgttccggatgcgatcagttttgcctggaggagcacagggctgaggggcccttgcgccagaagccgctccgcccacagcgccgccacgccggccacgtgcggagtggccatgctggtgccgctgatcgttttggttccgccgttgagccaggcgctgaagaccccgacgcccgggccggccactgtcgccatcgtgtttgagaagggtgccacggtgagtccgccgccgccgtcggccagggcagccacggatgtgatcccgaaggccgcggccggcggggcaacgttgatctcgtacgcggggttgccgttgcgttcactttcattgccggcagctgcgaccacaatcgtggtctgggcgacggaagcccgcgcgttgaggaggttggcgagctgttcgaaaagccggacgttggcgcggtagccttcgagcgctaaggatgtggcggcggggatggacaggccgtgcaccttcaccagttcgtccacccagcccgggaagtcaatgcccagcgacatggaaatgacgtgggcgccgttgtcggtggcccacagcattgcggaggcaagaatatcgctgctgccgccgttggggcctccgaggactttgccgatgaccgctttctggacgccgggtgcgacgccgatgcgctgaccagagatgtcgcggccaaagatcgtgccggcgcagtgagtgccatggccgttgtcgtcttcggcgctgcccgcgccggtgaagtccttggtgaccaggttgacgccggcgaacgccgggtgggtggccgcgatgccggtgtccagcaccgaaacggtcaccccggccccggagaagggggaggtgtccgcgcccacagccttgacgccccacgttgccgcagctgacggcgcagcctcggcgtcgaggggttcgatgagtttcatgggcatggcgggagcgaagcccaggaccgtggggtcgttccgcagggcgttgagggctgcagcggaggggttctcgtcccgctcaacagtcatgcccacagcccgttccgcgatgttctgggcggcgctttcgagccccggtgaagctcccggtccatcgaacgggtcacgggtggcgccgagggacggcgcccgcagaatcatgattttctgattgaacagcttggtcatcctgggctcctcggcctctacgcggaacggtctgcgccggatggcgcagcggcggcagtggacgtatcagccggcacggtgaacgtctggtcccacccgtcgccagttctacgccgcgaggcgttacatcagcgttactgcccgggagggccggacaacggccccgttaagcgcaatgccgtcccgctttacctcttcgcgctatcgtttcccctattgcgtgccactcagtacaacggattgcgaggggacctgaatgggcgacggtttaatggaaggccggctggagtgcctgtccacgggctcggtgtgggcggaggggcccgtgtgggttccttcctcgcagaccgtgcggtggagcgatattcccaacaaccgcattcttgagttcacggcggccacaggtaccaccagggaatacgccaccgacgccgggtacaccaacggccggaccctggacgccgacggcagcgttgtgcagtgcagccacgggcaccgccgcgtcgagcgggacgtcgaggggaccgtgacaggactggttgactccttccagggccggcggctgaactcacccaacgacgtcgtggttgcccgcgattccagcatctggttcaccgacccgccctacgggatcctgccgggaacacgggaagggcacgagggggagcaggagtacggcggctgctacgtgttccggttcgagcctgcctccggggacctcactgctgtggtgacggacctcgagtatccgaacgggctggcgttttcgccggatgagtcggtcctttatgtaacggacacggccggttcggagcatggcgtgccgttgcggatcgcctcctacgatgtgctggacggcgcgtgcaaacgccgggcacccgccgtcgagcttggagacgaccatgccgccgacggcttgcgcgtggacgtccacggccggatctggacctcggccggatcggaagtgcgtgtctattcaccgtcgttcgaactcctggacaccattgaagtgcctgaaaaagtatcaaacgtatgcttcggaggcccgggcggccaggacctctacatcacggccactaccagcctctaccggatccgcaccacaacgcgggatgcggccgcccgtctcaccactcccgccgacaaccgataacgaggccaacaaatgaactacagaaccctgggaaccagcggcaccgttgtttccacctttgcgctgggaaccatgacgttcggggcggaggccaccgaggagtcatcacacgccatcctggacagctatttcgacgccggcggcaacttcatcgacaccgctgatgtctacagcacgggagcttcggaagagatcatcggacgctggctgggcaagcgcccggacgtcagggatacagcggtgatcgccaccaagggccgctttccgatggggacgggaccgaacgacgtcggcacctcccgccgaaggttgacccgcgccctggacgattcgctccggcgcctgggcgtggaacagatcgacctttaccagctgcacgcctgggacccgatcaccccgctcgaggagacgctgcgcttccttgacgactcggtcagccgcggaaagatcgcctactacggcttctccaacttcctcggatggcagctgaccaaggccgtccaccttgcccgcgcccacggctggactccggccgtgacactgcagccccagtacagcctgctggtgcgggacatcgaatccgaaattgtccccgccgcgctcgacgccggaatcgggttgctgccatggtcccctttggggggtggctggttgtccggcaagtacaagcgggaccaggcccccaagggtgccactcggctcggcgagaaccccgaacgcggcatggaggcctggaaagcacgcaacaacaatcccggcacctgggatgtcatcaatgccgtggaagacattgcggccgcccgcggagtgagtccttcccaagtggcgctggcgtggctggtggacaggccggccgtgacgtcggtgatcctgggtgcccggaccacggagcagctcgccgacaaccttgccgcagccagcctgcagctcagccccgacgaagccggccacttaacccaggtcagccagccccggacaggggtttatccgtacggcccgatggcgcaggagcagcgcagccgcaggatcgagggtggacggtaacgcggcaccttatagcgcacgtgtgtcaccagccgcgtgccgcctacctccgttggtccgagcctaagatttccgacgccgtgttgccggcaggccaatccggccttgaaggtcctgctggcacagggctacgattgccgccacctgccaccaaaggagacggcaatgggcgcggcatctgaacgggagccatcctcggttgagctgacggttgacctcatcatttccctcgacggctacgcctcagccgaaggctggcccggctggtggggcctggaaggaccggagtaccttgcctggctggagcaggagggcaaaaaggacttcacgtaccttcttggcgcgaacacctaccggctgatgtccggcatgtcggaggaagccgctgcaggaggcccggggttttccgaggaagaaggagcaagccttaccggccttgcagcggtgaccaagatcgtcttttcctccacgctccaggggccgctgagctggccgaacacgacgctggtcggcggggacgccgtggaggccgtgaaggaactgaaacggaaaggcacccatcccctgagcaccctcggcagcctgagcctgtgccggtcgctgctgaacgccggcctggtggacaggttccgcctggtggtcttccctgtcatcacaggccgcaccggcagggaacggatctacgacggctatccggacgtcgcgctcgagatggtggacagccggacctttgacgggaggttgcagctgctcacctacatccccactgtcctggacggtccggcgggggcagcacctgaaccggcgaagtgcgccggagccgatgccccgccaaatgaaccacgatgacgggccggcaccgggcacacttgatggcatgactgatatcgatcccgtgaccacccagcgctcaacggttgaggagtggacgcgtgcccttgcggaatcgaaaggttcaccgggcggaggggccgggacgggcgtgatgcttgccattgccgcgtcactggcttcaatggttgctggttacaccgaaccgaaggagggccagcgggcggagctcgcctcccttcacgagcgcgcacaggcgcttcgggaggccgcccttaaattggccgacgacgacgctgccgcctccgaagccttcggcgctgcctttcggctcgaacggggcccggaacgggatgaggcgatccaccgcgcctccgtcaatgccgccagggcatcggccgtcctgggggagcgcgctgccgctgccattgacgaccttggctggctcgccaccaacggcaaccccgcgctcatagccgatgtcgtcgtcggattcggcgccctgagggcggcggtggcgggagcgcgcacgaacgtcagcttcgaccttgccaccctcaggtctgccggggccacgctggagcagatcagggaacagcacccgggcctgtgggcagcggttgagcagttgaccgcagccctcgaacgcatagaccgcctcaccgcagccgtggatgaccgggctgcgcccaccgacctggaatgacctcccgcaccacaggcaggccgcttgtgaagtgtcccgcccggtaccattaagggatgaccagggcggtccggaatccacgcaacaccttttcgctggcacggaaagcgcggggcctgttgcgccgggtaccggtgtggagctggcgcctcctgatggcgggcgtgagctcccgcgaacgggtcaggttcaacacggatcccctcaccgacgtcgattacgtccatgacatcacctacgcagacgacgcggctgccgggcagcagcttgacgtgctcacgccccggaacatcgtgcgtgatgcggacgaggcccttcccgtctacgtgtatttccacggcggagggtggacatccggggataaatcggccgtcaccaagtactgcgccaaccaggcttcgggcggaatggtagtggtcaacgtcaactaccggaggccgccccggttccatatgggccatgtgctccatgacgccaacgccgcagtggcgtgggtacgcggcaatatcgggcgttacggcggtgatcccgaatgcgtggtcctgggtggagattccgccggcggacagatcgccgctttgctcacggctgccacgttgcggcccgagctcgccgcgcactactccctccgccctgctgtggccgggcatcacctgaaggggcttgtgcagcattgcagcgtggttgatttttccgtgttcttccagagcggcttcatcatgagcctgaacttcgtccgcatgctgctgcccccggcaggccgcgcaccgagccggatccgaagccctttcaccacaccggaagccattggacggctgaaggccgaggccggcttcatgtctccgatcgagtggctcgacggccggtttccgcctgtattcgtcacgacctcggaacgcgacttcctgtatgaggccaacgtcaacttcatcagcaggctcaaagaccatgacgttccggtggacacgctgatctaccaatggtcgaacgccaacaccgagcacacgtggcagcaggactaccgctatccggaatcccaggaggtgtacctccggctgcacgccttcgtccggaaggtcacccagcgccccacagcgcacgcctctcacgaaacacgggtaacggggctatcttgggacgatgggagcccaggaccagccgccggtgggggtcagtcctgacgagttcggctcggcccgcgtggacggggccgccctgctcgatggcgggctgggcgacgtcgactgggccagcccgcctccgggatcgcgggccatgcggatcccggcgcccagcgggcagctcgcggcacggaccatgggtgacccccatgacccttggataatcctggttccgggcgccaccggatccaaagaggactttgcgctaatgatgccaggcctggccgctgcaggttactttgtgctgagctacgatatggccggccagtacgaatcggcggcagccggcccggaaaacctggttccgccacggctgcactacgattacggacttttcgttgacgacttcctggcggtcctcgaaacggccggcaaaccggttcacgtggtcggctattcgtttgccgcgctcgttgtccagattgcctactcgaagcgcccggacctgttccagacgctcacgctcctgagctgtccgccggagcccgggcagagtttccgcggcgtgagccggattggcaggttcagcagctgggtcaatggccggatcggggccgccctgctcatttgggggatccgccggagctttgtccgtgtgtccaggagccggcggaagttcgtcaactaccgtttgcgctttacccgccgcgcgtcggtccgtgacatctacgtgctgatgaagaacgtcccggacctccgcagcctcctggccgacgcagcccttccgaaattcgtggcggtgggcgaacacgatctatggccactgcagctgcaccgggtgttcgcccaggccattggtgccaggatcgccgtttaccgcggcgggcacagtccgtgcgagacgtcgccgcaccagttcaaccgcgatcttcttgccctgtacgcgaaggacagcgggcctgcgtgagcgcggtccgccgtcgtctgttcctgcctgcgccgtgcctactccaggctgcgccgtgcccgaacccgctcccggcggcgccggagcggcggttcctccctgaactccacccggaaagtggccagcgacatgcgtatatggcggcggaaggacggccagttggtgagcggccgcgaggagacgcccatcgccagggtggggtcatagatgaccgtcatttccgggcggaggtggtacgagatgtcaaggtcgtcgtggacatcggcgttgttcctcaccacgctgccgccgatcgcctgccacacagcccgtcgcagcgcgaagttcgatccgtaaacgggcggatggcccaggaggaatccgagcaccctaaagtaaccgcccaggaagacatgccttccggcccatcggacccagcggcccccaccatagaactcgccgggtccggtcacaagggacagcgggcccgcaggccccaagacggcttccacccgttccagccagtccgccgggggcctggagtccgtatccagccgggcaatgatgtctccggacgccgcatcgaagccggcaccggtggtggccggaatgcctggcacatcgacgggaatccgccgtacgccggctgcgctgcaaacggcggcagtatcgtcgctgctggcattgtccaccacgatgatctcgtccgcgggccgggtttgccgggacagcaggtgcaggcacgccgtgagcattacggcgtcattgcgggtggggatcaccaccgagaccgttgacgcgccacctgctggttcctcagccacgccattacctccacgctcgcaatgcacctccacgctaaccacctacggctaatgctggcggatggaaccgcgcaccggcaggggcttttgtcaccctgccctgatccgcgcctgaagcgccgtcccgtcgtgagctgcaccaggggcgcgaaggccgccaagcgcgcccactatgcgtgcctgcatctgcgtgaagctttccccgcccggaaaacggaacgacgacggcgtgcgctggactgtgcgccattgcggcagtacctccaggtcggcgagcgcagctccggtccactcgtcaacgtcgcattcgagcagcccggtgtcctccgtcacgggaagccctttccgggctgcggttggtgcggccgcccggggaacggcgtttgggaaagtcctcgatccgcggctggtgcggggctacggtgtaggggtgactgatcgtcccgaaatcttcaccatgggtgaattgcgtgcctccggccacgtcctcaaggacctgcgccaggaaatccgcggaaacctgctcgccgcgctcgccgccggcgagaatccgtggccggggatgtacggcttcggccggacggtgcttccccagcttgagcgtgccctgatcgccgggcatgacgtggtcctgctcggcgagcgggggcagggtaagacgcgcctcctccgcaccctggccggtctgctggatgaatggtcgcccgtcatcgagggctctgaactgaacgagcacccgttcgagccgattaccgagcattcccgcgcccttgccctgacggagggggaccggctgcgggtggcgtggcgccaccgctcggagcggtacgtggagaagctcgcgacgccggacacctccgttgcggacctgattggcgacgtcgatcccatgcgggtggccgaaggacggcgcctcggggacccggagaccatccactacggccttgtcccgcgttccaaccgcggcatcatcgccatcaacgaactgccggaccttgccgaacggatccaggtgtccatgctcaacgtgatggaggagcgcgacatccagatccggggctacgtgctccggcttccgctggacgtactcgtggtggcgtccgccaacccggaggactacaccaaccgcggcaggatcatcacgccgctgaaggaccgcttcggcgcggagatcaggacccattaccccatagagctcgacgacgaggtgtccgtgatccggcaggaggggcagctggtggccgacgtcccgccggtgatcctcgaaatcctggcccgttacacccgtgcgctgcggcagtccccggcgatcaaccagacctccggggtgtcggcacggttcgccattgcgggcgccgaaacagtggccgccgcggcgctccgccgtgccagcatccgcggcgaaaccgaggccgtcgcgcggatcgtggacctggacaccgccgttgaagtcctcagcggcaagatcgaattcgaatccggtgaggaagggcgtgaacaggccgtcctggaccacctcctgcgcacggccacggccgaagccgtgcgggcgcatttccagggccttgacctgggtccgctggtggcagcgctggacgggcacaccaccgtgaccaccggggagcacgtgacagcacgtgagttccttgaaaacctgccgtccttgaacgggtcggggctctacgacgagatcggcaaccgcctgggagccgggaatgagggccagcaggccgccgccatcgaactggcactggaaggcctctaccttgcccggcggatctccaaggagtccgacgacgaagaaacggtctacggctagggcaccacggtgcgtggctgggcagatggcggaagcgagggacgggcggcaccatgaacatccataaccattccgccaggtacggccggtacacgggcggtccggatccgcttgcaccgccggttgacctggccgaggcgctggacgccgtcgccgaggatgtcatggccgggtactcgccccgccatgccctgcaggagttcctccggcgcggcgggcggaaccgggaggggctggacgacctcgccaggcgcgtccagcagcaccgcaatgacctgctgggccgccacaacctggacggcaccctcaacgaggtgaagaagctcctggacactgcggtgctggaggagcgcaagcagctggcccgcgatgccatgatggacaacacggaccgcgccttccgggagctgcagctgcagaacctgccccaatccactgccgcagcggtcaatgaccttgcctcctacgactggcagtccggcgccgcccgggaagcttacgagcggatcaaggacctgctgggtcgcgaggccctggaccagcggttcgcgggcatgaagcaggcgctggagggtgccacggaggaggaccgcgaagccgtcagcgccatgctgcgcgacctgaacacgctgctggacaaacaccgccgcggcgaggatacaactgccgacttccaggagttcatggcccggcacggcgacttctttcctgaagacccgcagtcagttgaggaactgattgacgcccttgccaagcgggccgcagctgcccagcggctcctgcagtccatgtcccccgagcagcgggaagaactgatgcggctgtccgcccaggccttcggatcgccggaactcatggcccagcttgaccagctcgacgacagcctgcgcgccctgcgccccggtgaggactggaccggctcggaacgcttcgagggccaggaaggcctgggcctcggcgacggcaccggcgtgctccaggacatcgccgaactggatgagctggccgaacagctctcccagtcctataacggctccaccctcggcgacctggacctggatgccctggcccgccagctggggcaggacgcagccgtcgccgcccgcacactggccgacatcgaacgggccatgcaggacggcgggtatctgaggcggggcgcggacggggacctgcggctctcaccacaggccatgcggcggcttggcaggtccctgctgcgggatacggccaagcagctgtcaggccggcaggggcgccgggatacccgggtagccggcgcggccggggagcagaccggatccagccgccagtgggagttcggggacgccgagccctgggacgtcacgcgcacgctgaccaacgcgatcagccgcaccgcagccggcggcggaaccccgggcagcagcctgcgcctcaccccggcggacatcgaagtgagcgaaacggaagcgcgcacgcaggccgccgtcgtccttcttgttgacgtctcgttttcaatggctgccgaggggaggtgggtgccgatgaaacgcactgccctggcgctgcaccacctggtttccacccgtttccgcggcgacaggctggaactgatcacattcggccgccatgcccaggccatggacattggtgaactcaccgcactgccgccgctgcgggagcagggaacaaacctccatcacggattgctgctggctggccgtttcttccgcaggcacccgtccatgcagcctgtcctcctggtggtgaccgacggcgaacccacggcccatctgctgccggaaggcgagccgtggttctgctggcctcctgacttggaaaccatccgtgtgacggtggcggagctcgaccggctggggcgcgccggcacacaggcgacattcttccggctggggaccgacccaagcctggaacggttcgtccagcgcatggtgcgcagggtgggcggccgggttgtcgctcccgaggcaggggatcttggcgccgcggtggtgggggagtacctgagggcacatttccgggggcaggccttcggcgactccgactgggcttcctagccgagggcagccggtgaaagggccggagacgttgccccatttccgggctgattcatgtgaggatcgaagcatgcctgaccgcctcatgctgctggacaccgcatcgctgtacttccgcgccttctatggactgccggacaccattcgccgcggggacggcactccggtcaacgccgtccgcggcctgctggacatgatcgcacggctcaccacggactaccgggccacgcacctcattgcctgttgggacgatgactggcggccgcaatggcgggtggatctcctgcccacctacaaggcccaccgggtggcggaggccgtcacgggttccccggacgtcgaggttgtcccggacgcgctggaggcgcagctgcccatgatccgccgggtgcttgagctcgccggcatcgccattgtgggcgcccccgaccatgaggccgacgacgtcgtgggcacctacgcgagccatgcggaccttcccgtcgatgtggtcaccggcgaccgcgaccttttccaggtctgcgacgacgaacggcaggtccgcgtgatctacaccgcccgcggcatgaagaacctcgaggtcattacggaagaagtggtggtggccaagtaccgtgtgctgccccagcagtacgccgactacgcaacattgcggggtgacgcctccgatggcctgcccggggttgcaggaatcggcgaaaaaaccgcggcttcgctgctgcttaaatacgggaccctggagggcctgctggaggcggccgggcatcccggcagcggcatggctgccccagtgaaggcaaagcttgccgccgccgcggactacctcactgtggcgcccgccgtggtgaggctggtgcgggacctggacctgcccagtcccgaacaggcgggtgcggaactgaatcccgtgccggatgaaccgcgggccgaactcgaacggctcgctaccgagtggaacctgggcggctcggtaaggcggctcctggcggcccttgacctgcggcaataggcccggcgggtcacggcggatgtagccgcctagcacctggtttcggttcgcgtcgccccgtatcagcgtgcttaaagactgcgggtttggcgatgttttcccgccgcgccacgcttgcatcatccaattcaggtagtaagcttgctgaccattagtactaagcttgctgattaattggagtggcgggagcgggtcgaatgagtgcagttgttgttgccatctggtccctggtgggcgcctccggagcagccctggccgccagcgccccgtacggcgccgtgggccacggccagtacctcgccggccatgtacttctgggcgtcggcctcggccagttgctggcggctgtggtccggtatgccgtccggcggatggttgccggagcggcggcccggacgacacccgcgcccctcgccgcggtccaggcagtgcagacagcagccgcggccgcgcctgctgtggacaggcctgctggggacattgcagccgtgaccgtcctttatccccggcctgccgccgtcgtacccttgcggggcaggcatgccgcctgaccatctccagccgggtgggccgcagggctcctcgccaaagcgcccacaccggaggtcctgggccggactggccgccgcagtggcggcggccgccctcgttgcaggcgccgtcagcgtttccccgggtttaggcgcttccggttcggatgaggccaccctccgcggcttccagatccgcgttctcaacgtgacccaggccgccgcggagaacaggctggacggggtcctcgatgcgcttgaggcgcttgaacgggacctcgacctggccgccggccagggttccatctcagcggcccggtaccgcggcatcgatgctgccctggaagcggtccgggcagatgtcacccgcaccatcacggcccaggcagcctctgccgccgacccaaaaccagctgtcactgcggcggaggcgccaacggtcaacgtcaccgtccctgaggcggctccggaaccccagcaagcccagtcccagcccgtccagctccagccggaagcacccgccgccgctccggtgccggcacctgaacccgccccgcaggaacagaaccttccagacgccgccaaggaagccagggaaaagggcaagggcgccggaaagccctgagcccacagctttataagcccggaacctgtgcctggcggggctcgtggtccgcagcggactggctggccgggcaaaatggagggatgactttccccagcggcaggcaggtgccccaacctggccgggccttcgaccttcgggccatcggtgccggcctgccctttgccggctcgctcccggctttggccgacgcgctgggagacggcgtgacgggaggaacggcagtagtccaggcgccgccgggaacgggcaagaccaccctggttccgccacttctcgccaacctcgtgacacgccccccggccggcgccgccgcggggccccgcaggattgtcgtcacccagccgcgccgggtagctgcccgcgccgcagcccgccggcttgctgccctggacggcagcccgttaggcagccgtgtgggttatacagtccgcggagagcggcaggccggatccgacacgctcatagaattcgtcacgccaggcatcctgctgcgccgcctgctggccgatccggacctgacggcggcaggcgcggtggttctggatgaggtgcacgaacgcggcctggaaacggatctcctgtttggcatgctcaccgaagtccgccagctgcgcggtgacctcaccgtcgtcgccatgtccgccaccctggacgctccccggttcgctgccctgctgggagacaccgacggcggcgggccggctcccgtcgttggctgcccctccgcgctccatccgctggagacggagtggcgcccggcgcccggcccgcggctggacggcaggggagtgacgcggcctttcctggatttcatcgcagacaccgccgccggggcccaccggcaggcactggcagcagacggcggcgccgacgcactcgtcttcgtcccgggggcatgggaagtttcgcaggttgcggcagggcttcgaagccgggtgggcccggggactgacgtactggaactccacggcagggtgggcccggcggagcaggaccgggcagtatccgggcggcggccgggggagaacgcgaggatcatcgtctccacggacctggccgagtcgtcactgaccgtgccgggggtccggctggtcatcgactcggggttggcccgtgagccgcggcgcgacgccgcccggggaatgaacgggctggtgacggtttcctgctcccgcgcttctgccgaccagcgtgcgggacgcgcggcccgccagggccccgggacggtggtccgctgctacagccaacaggcgttcggtgccgccccggcccacgtgaccccggaaatcaccgtggcggaccttgccggcgccgccctggtgatggcgtgctgggggtcgccgcgcgggaagggactcgccctgccgaacgccccgccggagcaggccatggaagatgccatggaaatcctgcacgaacttggtgccgtgtccgggatggccacgcgaccgccgccggcaggaccctggcgggcctcccggttgatccgcggctgggacgtgc

SEQ ID NO: 33 - DNA, 329537 bp, Arthrobacter sp. OY3WO11
ctcgacggcgccgctgccgctggcccccgggaggcagccgaggtggtggccgccgtggccagtgatgcgcgggctcccggtctcctgtccgagctccgaagcgataaacggaccggccggccggcgctgggcagaccgaaagccgcgcctccaggtcctggcgcagcaagcaccactgcctgacgctcccgcgctcccgcatcatgccggcgggagcgcactggtgggcgccgtcgtcgcccttgccttccccgaccgtgtggcacgcagggttcccggcgacggtccggagcgttacctgctgtcctccggaacccgggcagggctcccctcaggaagcagccttgccgggcacgaatggctggcagtggctgaggtgtcccgcggcgagggcagggactcggccggtaccggcgccgtgatccgcgccgcagccccgctctcggccggcctcgccgaatcagccgcgtcccacctcctggtcgagaccgtagaggcggccttgacgcagggccgggtcaccgcacgccgtgtccggcggctgggcgcgatcgtactcgcctccacccccgtgcgtccttcgcctgccgagggccgggccgcggtggcagcagcgctgcggaaggagggactcgccgccctcagctggtcgacggcggcagacgccctgcgcaggcggctcgccttcctgcaccgcgagctgggggagccatggccggacgtgtcggaggccggcctcctccgccggctgcaggactggctcggacccgagcttgagtcgcttgccgccggcgcggacgtcaacactgttgaccttgccgagcccctgcggcggctgcttccctggccggaggcagccaggatggacgagctcgcgcccgaatcgctggaagttcccagcggctcgagggtacggattgagtaccccgagtggtctgatgtgacggcgccgccggtggtggccgtgaaactccaggagtgctttggtctggccgcgacgccccgcctggtcaacggccgggtgccggtgctgttccatctgctctcaccggcccggcgcccgctggctgtcaccggcgacctgacgtcattctggtccgggccctacgcgcaggtccgcgccgaaatgcggggccgctaccccaagcatccctggcccgaagatccctggtccgcgcccgccactgcacggaccaaacagcggaaatagcgtcccgccgggacggcctccccggcccgtgttccgtgcgtgagatgtccgatacacgcttgttacttcgcgtcgacgcgctgaaacatgcgccgcataggctcgtttccacctggacagagtggtccacacgcagacatggaaggacctacagatgtttcttttcaacaacttcaatctcctgctcgacggccgccggagcgatgacagccggttccacgcaggtggcaccggaagcacggaattccccgaagggcagctcacctccgcagcctgggaaggctggtggcacgaagaagcggcctgacggacggtcttccgcagggccggccccgggacctttccgggcgtcagccggcggcgcggataaagcgggccaccggctccgccagggaggcacccacctctgctgcggaacgcttgaggcccgccaccgcaaaggaatggtcgccgccctccacccactgcaggacggctgacggcccgatcctgcccacgacatcctcaaggagtttgggggtagcgaaggtgtcccggctgccctgcaggaaaagcatcggcgcggtgatgccgtacaggtgcccgtcccggagtttgtcgggtttccccggagcatgcagggggtatcccaggtacaccaggccggcggcttccatcccctctgccacggccatggatgccatccgtccgccgaacgatttgccggccgcccacagtggaccggtatcaccgtgttccgccgcccgctccgccgcggcggccactgcggcccgccaggcggcaatggcggcgggcgggcggtccggaaatttccgccccgcctcccggtaggggaagttgaagcgaagggtggcaacgcccagggagttcagcccatcggtaaacccgcgcaggaaggggtgctccatgcctgccccggcaccatgggccaccaccacggtggcggacgggctgccggggcgggcaaagacggcagacaccgtgccctcgcccacagcgatatggaagtctgattctgaaacggacatgcctccatcttgccggaccggctgcgcaaatctgccgggcctccgatgcgggggtgtacgttgtccccatggcgagtgaacagagcaccctcacagtcccgggcccccacggcgagcgcgagatgcgcatctccagccccagcagggtgatctggcccgaacccggaatcaccaaactcgacctggcgaggtacatcaccgacgtcggggaggcgttcatcgctgccaacggcggcaggccggtggcgctgcagaggttctccggcaccatcgaaggggagatgttcttctccaagaacccgcccaagggcgccccggagttcatccggtccacccccgtggtcttcccgagcgcccggtcgcaccccatgctgatacttgacgaacccgccgctgcggtgtgggccgtgcagatgaacaccatcgtgttccacccctggccttcacgcgcagacaacacggacaaccccgaccagctccgcatcgatcttgacccccagcctggaacggacttcgacgacgccgtcccggccgccctggcgctgaaggaggtgctggcagaggcaggcctggaatgcttcatcaagacttccggcaaccgtggactccacgtctatgcgcccatcgaacccgcccgggagttccttgacgtccggcatgccgtgatcgccgcggcccgggaactggaacgccgcatgccggaccaggtcaccacggcctggtggaaggaagagcgcggccagcgtgtgttcgtggacttcaaccaggccaaccgggaccggaccatcgccggcgcctacagcccgcggccgctggcccatgctccggtgtcctgccccatcacctgggacgagctggaacgcgtggacccgaaagacttcaccatcctgactgtgccggaccggcttaagacggtcggtgatccttgggctgacatgcacagcaagcccgggaccattgacaccctgctcgggtggtgggaccgcgacctcaagtccgggctcggagagctccccttcccgccggactaccccaaaatgccgggcgagccgccccgggtgcagcccagcagggcgcggaaacaggactagcccaccccggaaggggcgggcagccgtggataaacctgcgtccggaccggttggtgggacgggctatttagtgggaccggctattcgaagcgggacgggtcccctgttccgcgacggaccacctccgccacgccgctggaaaaatcaataacggtagtgggttcggaaccacagtcaccggcatcgatcacggcgtccacctggtggtccaggcgctccttgatttcccacccctcggtcagcgggtcttcctcgtcgggcagcagcaaggtgcttgagagcagcggctcgcccagttctgccagcagtgcctggaccacgcggttgtccgggatcctcacacccacggtcttcttcttgggatgcagcaggcgcttgggaacttccttcgttgccggaagaatgaaggtgtagccgcccggggtgactcccttgatgctgcggaacacatcgttcccgatgttcacgaactgtcccagctgggcaaagtcccggcagaccagcgtgaagtggtgtttgtcgtccaggcggcggatgctcctgatccggtccagggcgtcccggtttcccacctgggcacccagcgcatagcaggaatccgtggggtaggcgatcaggccgccgtcgagcactatcttgaccgcctgggtgatggcgcgcggctgggggtcctgggggtgaacgtcaaagtatctggccatgacccagagcctacggcccagtggcacacttgtgcaccacccgtcccgtttcccctaccaccggcccctgctttggggcaggatggtgactggttccaccatgttccgtccccacgccaaggagatccatcatgccgaccaccctgaatccctacctcagcttccgcgacaacgcccgcgaggcgatgaccttctacgagtccgtttttggcggcgagctgaccttgagcactttcggcgagttccaggccagtgacgatcctgcggagtcggagaagatcatgcatggcatgctcaccaccagcaaggggatggtgctgatgggcgccgacactccgaacagcatggggtacacgccgggggcgtccatatccatctccctcagcggcgacgatgaagcggaacttcgcggctactacgagaagctcagcggcgacggcggcacggtgaccgtgcccatggagcagtcgccgtggggtgacattttcggcatgtgcacggaccgctttggcgtggcctggctggtcaacgtcaacagcgcccagggcgccgcgggaaccccccaggggtgatcccccttctggcgtgggccgcttcctgaggaggatgcgggttcttgaggagggtgccgggcggtgcaaggattaacgcgtggaatcgctctttgagttccttgacgacaaatggtggctggtcttccctgcgatcgccttcgccgggcattggacaaactcgctgcggacagccggtgaggggcggcaccagcgaagagtggagctgtacaagctcaagaaccagtcccgcgaactcgaaaaggcttccgcagcggacgtcgaagcgcttgttgccacccacgacgccatcaacaagcgctggctggactacgagctggacgttggcaagcctatcgattttccgctcatgaccgatgtccgggagccactcaccgtgaccttcctccgggcgaaaagggaggcggacggtcagcgcccggtttcccctgcggacatggcctcgccgtcgcggctggaggcttaccggaaggccgtcaacagcttcgcggtggcgctggacgtggccgaacgtgaagcccgccggatcagggacagcaaattcacaggcccggaacgtgaacgccttgccaccgcccggcagttgctcaggatcgccggggaccatgccgccacgccagccgagcggcaggcggcctacaagcgcgcccgccgcgaactggatggtctgatcgtcctgccggatgccaccgttgctgccctggaagggcaggtagcgccagggcttgacgccggccgggaaccgtccgactccccccgccgctaggttttctggactcccgccgtgacccgcacgctctatatcgacgtcgacggcgttatctgtcctttcggaccggaaggcgccagcggctggggaaacggctggaaacatgccaccgcggggctcctgcccgtggcctacgcgccggaacttgtggccgccctgaacggagttgccgcgatggcaggggtgcggtgcgtctggcttacgagctgggaagaactcgccccgcagtatctgtgcccggctatcggcctggacggggcacggtggccatacctgacggcggatggggcaggaacgggcgccggctggtggaagcttcgggccattcaggacgatgtggaagagaccggtccggaagccgcggcctggatcgatgaccagctcgcgttcgaggcggaggcgcaatcctgggccaggctccttggccgccggatcctggccttgtccccggacccgaggcgcggaatctcgcctgccgaactgcagcgggtgcagtcatttctggcgcggccgctgttttgacctgatgccggggacgcgtacgatcgataaggtttcacgccggttgtattaacgccacaggtcattccaagcgaacagctggtgaattatgctgtgcaaggcagccgggggagatgaaactgctgaacgtcgactctgcagattgggcaacaggtggatatcaccttcatggtggcgctggtcatcgcactggcactatttttcgacttcacgaacggcttccatgacaccgcgaatgccatggccacgcccattgcaaccggcgccatcaagccgaagaccgcggtgaccctggcggccatccttaacctcgtgggggcattcctgtccaccgaggtggccaagacggtctccggcggaatcatccgggaaggatcggacggcatccagatcaccccggacatcatttttgccggcctcatgggcgccatcctctggaacatgatcacgtggctcaagggcctgccgtcgagttcctcgcacgctttgttcggcggtctgatcggcgccgcgatcgccggcatcggcttcaactcgatcaacctcgagggcctgatgcaaaaggtcatcctccccgccatcttcgccccgctgatcgccggcattgtcgcctacatctgcacgcgcctggcatacgcgctgacgtcccggcatgacccggagaccggcagcaagctcacccagaagcgcggcggtttccggaccggacagatcttcacctcaagcctggtggccctggcgcacggcaccaacgacgcccagaagaccatgggtatcatcacgctggtcctgatcgccgcaggcacccaggagaccggatcaggcccccagctctgggtcattgccgcttgtgccttcgccatcgccatcggcacgtacgccggcggatggcgcatcatccgcaccatgggtgccggtctcaccgaggtgaagcccgcccagggtttcgcggccgagaccagcacagcgtctgcgatccttgcgtcctcgcaccttggctttgccctctccaccacccaggtggcgtccggatccgttatcggatccggcatgggccggaaggggaccagcgtccgctggagcatggtgggcaagatcgctcttggctggctgttcactcttccggccgcaggcattgtgggggccctgaccgccctgctggtgaagaccggcgtcatcggcgtcctgatcgccgccgtcgccggcacggcggccgtcctctttatgttcttctactcacggaagtccgccgtcggccaccacaacgccatcgaggtggaggaagccggccaggccgtgcgcttcgccaagaagaaggccatggcgcgtgcccgcgcccatgccaaagccaagtcgcaggcaaaggctgacgctgacgccgacaaccagaaggagactcagcgatgaagtggttggaactcctgaccgttgccggcgccaccctggcggccgcggtaacagttgtggtcctgtactcgctcggcgtgcggctcaccgccatcgcagcggatgtccagcagacgtccccgggcatcaagcggtccctcgcctacatctgcttcggcctgtgcagcctggcagtcctcttcgggctgtacctgatcatcccgtacttctccggctgagcaggcctcctggtgccgctgcgccaggttgacgacggcattgcccaacatggtctttgcttgaccagtttctgctcacccgtctttggtccaaccagtctctggcaggcgctggtgcggttggctaggcttggcccatgcctcacatccagtacttcgtcgccgcttccctggacggcttcattgccacccccactgatgacctgggctggctcctgcagttcgacgggttcgaaggcggcaaggaaagctacgagtcgttcatggcggatgtgggctgcatcgtcatgggtggagaaacctattcctggcttctggagcacgaaccggacaactggccttaccccggtacgccgtcctacgtcttcacccaccatgagtatcaggccccggcaggggcggacatcacgttcgtccgcggggacgtcaccgagtttgcagcggatttcgaacgggacgccggcggcaagaacatctgggtggtgggcggcggcaacctggcggcgcaattcgctgctgctggcctgctcgacgaaatcatcttgtccgtgattcccgtggtgttgggaagcggcaagcggcttctccccctggaaaggccgacgccgccccttgagctggttgcctcccgcaccatgggcaggggcatcattgagctgcggtacctcctggacggcagcgcggccagcggcagttaggtcaacggcgcgcaacctgcggcatgcaggttcggccgcagagcacccggcacgtgtgtccggccgcgcagcaagcaggtgttctttccacggaccttggcggctggccccctgcccgcaacgggagttcccttactccagctgctgttctacgacgccgcgatcagacgctgtaaaccgtggacggaggccggtcagccgctgccgtagaagaacctttccagttcgacttccgcctgtgatagcccgccacgaagtagatccgcgtggccaccgcgggcacgggcgggtagggctgctggcggtgcgcttgcctattgtgacactccgccagtttcaggcgcgccgccaaggacgacaggacagactggggccagtggggtggttcccagtcctggtgttcgcttttgtagtggcggccggtgggtgaggtccagccgggtggttcatttttggtggccggcgttggtgtccagccggtggtgtgccggagtttgtggtgtttggggcatggttgtccgaggttgctgattccggtggtgccgccgtagtgccaggctaggaggtggtctgcttcgttgtccaacgacgggttgctgcagccggggaaggggcatgtgccgtcccgcattctgagccagttccgcatggctttggtgacgcggtagctggtccggccgatttccagcggtgctccgtcccccgggtcgacgaggacccggtggaaggagtcggcgccgtcggcgacaagtttccgggccatggacggcgggatggggccgaagccgtcgagcatggcgggctcgtcggtcaggcccatgagggcgaataccggcacggtgacgagcacctgggcccggatcggcgatgaaggggtgggatccgttcctgcgcccgccccagcgctgttggctgcattgaagtttggattggtgccgctggtgaggatggctgaggcgaatgtgtcggcgcggatttgggtgagggtgtggggttcgtggggtccttgtgcggcccgggcgagggcgttgaggcggttccagcctgccatggcctggtcggcggggaggtaggccgaaagccaggccatgccgtcctggtccggcctgtactcgacgcgccggtccgccacgcccttggcatggcgcttctctatcgattctgtgtggtggcgttcccgccaggttcgggccttgtgcttgaaccggtgcgcgggcatctccccgatcgtggccgctccggcaggcctgggggtggcggggtcgaggaagtgggtttccagagcggcggcgccggcggggtcgagggtggatgtctcgtccgccagggccagggcgtgctgccaggagattgttccggcctgcagggcggaaagtgtcagcggcaaggtggtggtcagggcgtgggaagcggcgaggaacgcgcttgcggcccgcggcccgatggccagcacgcacccgatttccgtggcgacggccatctcctgcgcctgcaccggcatgtccggggccagggcttgggcggtgtcggcgtatttcatggcagcacgggccttcaaccccgccacgccggcctcgacagccgccgcgccggcaagaatgtccaggctcccgtccgccagaccggccaacggatcggcagccgaaaacggcgctgaaccacacccgtccacctcagcattgagcacagcaagggcggccttgatatccgcaaacgccttcaccaccgcttcgctgcccatatacccatcatcgggggagggtctgacaatcacgcggacagcaaacccgcggaagatgtcctaagaggctttacagcggaaatcgccaatcctgccccgcctgctggcgcccaggtgaccttgaacagtccccgatcgggccgggcagccggtcggctacagcggcggcagcgccacggtggtttcgcccaacaggagttttgccggacgcgaactgtctataccggatggagtcctgatgatgtaagtgcggggcaccatgtcggctgtgcagttgggtccgccgcgggtgttgaggcccagtttgacggtgtcaggatcggcaacttcgatggaggacggaaacgcagggcagctcgaactgccggccagcacgacggcgaacctggcgccgccatccagccagcctgccgtcggaaaagcgtatgcacggtctccgccggaggagcctggcttcgcagtgattgcttcagcaggaagcccgcccacgtgttcagattcagcaattgacgccggtgcagaggaacacgcggtcagcagcgctgagataccgacaatccaggttccgctgatcctgcccataggttgaggttacgtggccgccgtttgcataggcgctgtcagccgtcgtcagccgttccctgcgacggactgatcgacccctttcaggtggcggtcgggacgttatcccggatcatgttggtgatgcgtgccgtggacagccgcctgccctgctcatctgtcatcacgatctcatgggtggccagggttcggcccaaatggatggcggtgcacgttccagtcacggttccggtggcgatggagcggtgatgggtggcgttgacctcgatgcccaccgcatggcggccttgcccggcgtgcatcccggcggcgaaggaccccagcgtctcggccagcaccacgtgcgccccgccatgcaggattcccgcgacctgcgtgttgccctccaccggcatggtggcaacgctgcgctcggggctcatctcctggaaccggatccccattttcaccaccagggcgccgatcccgaaccgtccaagccaggcgtgcaggtgctcagggatgccggcggcggaaagctcgtcggcgaaggggccgggcgtgaaattgtccatcatggcaactaggctggcacctgtgagtgaaacaaccaaaccggcccctttcccgtcccaaaccctgcaggaggacaacgccccgcagggcccaaccgccctcgaggacgctgcagtcggggaaggtgcaggtcaggacaacgttggggtcccggccggcggatccgtttcagcgaccgccgcccccgtagtccccatgaccggccagcctcggctgctcgtattggacggccactccatggcattccgcgcttttttcgcgctccccgcggacaagttctcaaccaccaacgggcagcacaccaacgccatccacggatttacctccatgctgatcaacctcatcaaggagcagcagccaacccacatcgccgtggccttcgacgtctctgacgagtccacccaccgcaagaccgaatacagcgaatacaagggtggccggaacgaaaccccccgggagatgaacaaccagatcgacctcatcggggaggtcatggaggcctggggcatcaagaccatcaaaatgcccgggtatgaggctgacgacatcctggccaccctcgcggccatgggtgaaaaggccgggtacgaggtcctgctggtgtcgggggaccgggacgcgttccagctcatcacggacaatgtctttgtgctgtaccccaagaagggcgtcagtgatattccgcggatggatgccgccgccatcgaggcgaagtacttcgtcagccccggcaggtactccgacctcgccgcactggtgggtgaaaccgcggacaacctcccgggtgtgcccggcgtcgggccgaagaccgcagccaagtggatcaacctctacggggggcttgagggcgtcctggaacacctggattccattggcggaaaggtgggcgacgcgctgcgcgagaatgtcgacgccgtgaagcggaaccgccggctgaaccagctccacacagacctggaactccccgtcacactcgatgacctgtaccagccgcgcccggaccaggcagcacttgaggacctcttcgacaaactagaattcaagaccatccgcaacaggctcttcgcgctgtacggcgatgacgacaagcctgccgccgagcgggaaagtatcgacactcccgagtacgtcaccccggcggacgccgaggaactgtccacgttcctggccgccggcgccggacaacgctccgccgttgctgtggacctcatccccggccgcatcggcgaggacgccgcagcgctggccatcgtccgggacggcgccgcggcgtacatcgatctgtcgggccaggacgccgaggcagagaacgtccttgcgggctggttgcgcgaccccgaatcgcccaaggtcctgcacgggttcaaagccgccctcaaagccctgacctcccgtggactggagctggaaggagtagtggatgatacctccatctccggctacctcatccagcccgaccggcgcacctatgaactcgctgaactggcccagcaccacctgaacgtgggcatcccgggcgcaacagcaaaggcagggcagctggagctctccttcgacggtgaagacgacgctgctgccgacgcactcgtccaggccgccgccgtcgtccttgccctcagcagctacttcgaatcggaactgaaggagcgccgggccgaggaacttctgtccaccctggagctgcccgtcagccgggtcctggcggacatggaactcgccggcatcggcatagacatggcgcgcatggacgatcagctcgccgacctggccagggtcatcgaccaggcgcaggagcaggctttcgcggcgatcggccacgaggtcaacctgggctcgcccaagcagctccagacggtcctgttcgaggaactccagctgcccaagacgaagaagatcaaatcgggctacaccacggatgccgcctcgctgaagagcctgctggaaaagacgaggcacgagttcctggtgcagttgatggcgcaccgggaggccgccaagctgcgccagatgcttgaatccctaaaaaagtcggttgccgaggacggccgcatccacaccacgtacgcgcagaacgtggcagcaacaggccggatctcctccaacaaccccaacctgcagaacatccccatccgcagcgaggaaggccggcgcgtccgcggcatcttcgtggtgggggagggctacgaatgcctgctgtccgcagactactcgcagatcgagatgcgcatcatggcgcacctttccggcgaccagggccttatccaggcctacaaggacggcgaggacctgcaccggttcgtgggctcgaacatcttccacgtgccaaccgaagaggtcaccagcgccatgcgctccaaggtgaaggcgatgtcttatggcctggcctacggactgacgtccttcgggctgtccaagcagctggagatctccgtggacgaggcacgcaccctcatgaaggactacttcgaccggttcggcgccgtccgcgactacctccgcggcgtggttgaccaggcccgcgtggacggctacacggccaccatcgagggacgccggcggtacctgccggacctgaccagcactgacaggcagctgcgcgaaaacgccgagcgcatcgcactgaacagccccatccagggctcggcggcggacatcatcaagcgcgccatgctgggggtccacgctgagctgaaggcccaaggactgaaatcccggatgctgctccaggtccatgacgaactcgtcctggaagtcgccaccggcgaacgcgcagccgtggagaatctggtcaccgaacagatggccgccgcggcggacctcagcgttccgctggaggtccagatcggcgtcggacccagctggtacgacgccggacactaagcgacgcacaacgcagaagaggtgggacggaaaccgtcccacctcttctgcgttgccagcaggtccccgcccgccggggcagggcatactgtcagctgttccttgccgactcccgccgctgcctcaggcgctccagcagctcgtgctcagcgtccgcaccgggagtgacgccggacggaatgcggaacaacaggacagctccgagcacccaccagaggccgaacaggatccacggcggcggggtgagggctgcgggcatgccgggcaggtaaaggctgagcagtccaaggcagaggaccaccgcggcaacgccgatcatgatgcccccgttgccctgtccgcccacgcggagcggacggtccatcccgggctcgcgccggcgcaggatcacaaacaccagggcgaccaggatgtaggcaatgacaatgctgggtgcccccgaatccacaagccagccgagcatcgatacgccgaagaacggcgcaacgaaggacagcacgccgatgaacacgagcgcgttgaccggagtgcggtactttggatgcagcttggcgaaccaagccggcagcatgccggaacgtgccatcgagaacatcaggcgcgaggcgcccagaagcagcgagttccatgaggtcaggattcccgcgattccacccgcaatcaggatcttcgccattacgtcactgccgaacagcgcgcccatggcatcggcagttgcaatatccgcctgtgctatctcgcccgcgggcatcgccgaggccgtggtcaaaacggtcatgacataccagatggttgcgaggatgacggcgacgacgacgagcctgccgatctgccgtgccgggatgttcacttcttcagccgactgggggatgacgtcgaagcccacgaacaggaacggaaccaccacgaggacggcgaagtagccgttcaggcctcccgtgaagaagggttccatgttcgtcgccgaacctccaacgaaggaaccgaacaccagcatcaggccaatgaccagcaggaagaccaccacgaacgtctgggcaacaccggcaagcttcaccccgaggatgttaattccagtgatcactaccgctgcgatagcccccaccagcgcccaggtcaggtgcacctggtagcccgccacttcccacagggggatctggctgaggttcgggaagaggtattgcgcagtccgcggcagggccacggcctcaaaggcaacgatggtgatttacccgccggtgatggcccaggagccgatgaaggaccaccgggggcccatcccgcggagcaggaagttgtgttcaccgcccgccttcggcatggccgcagtcagctcggcgtaggtcagacccaccacgcccatgatggcgccaccggtgatcattgccaggacggcccccatggtgccggccgacgcgatccagccgccggtgagaaccacccagccgaagccgatcatggctccgaatccgagcgccagggcgtcccagttgcccaggactctcagcagggatgcgtccggtgtttgttccgcttgagaaacttgcatgtgtcctcgcttgggtcaggtgctgcgggcagaaatttcgtgtggcccagaatgcctgtcccacacgtgtgaagcgcgtcacgtcctgctccaacatagacccccggggctgccggcgcactgtgcattggcccaggatgcggcaaacgtatttgaacaggatgccgatggcgggtgcctgcggcggagctgcgggcgtggcgtgtgggtgactggtgaaggctgccggccatgactaggctcagtgacgtggctgaactgagtggcaactatgaaatccggcgctttggcgctgtctccgagggcaaggatggttatgcggaggcggaagcctggtcgcgtgcggtgtccttcgggttccacgaatccaccaggactcccgagcacgtggcgaaatcgctcgccacgtacgaagctgacggccgggtgctcacaggcgtctaccagacaggggcggtggcgccgtcctccatgccggcaacggtgccggtggccaccttcgcgaccttccgcaagaccctcaatatcggatttggccggatgttggaatcacagatggtcacgtcggtgaccgtccgcacgtcgcaccggcggcggggcctcctgcgggcgatgatgagtgaggacctgcgcctcgccaaggatgacggcatcgccatggccgcccttaccgcctcggaaggtaccatctacggccgcttcggttacggcgtggccagctttgaacgcaccgtcaaggtggacaccaccgcgcgcttcaacgtccgccacctgcctgccggaagcgtggaggttgccgatcccaaagccctgctgcatctggcgccggaggtcttcgaacgggtgcaccggcttacccccggatccatgggcaggcagaactggtaccggcagctggcgtccggctccttgggccgtgacggcaaggaggacccggccatcaaggttgcgctccactatggtccgggcggcggcattgacggttacgtctcctacaagttcctgggctgggacacggagccctacaccgtggaggtcgtggacctggtggcagcgggcaatgacgcctacctggaactgtggcagttccttggtgccatcgacctggtggaacgcgtctcgtgggacgaagcgccggttgacgaccccctggcgtgggcgctcgacgacccgcgctgcattgattcgtcggacagccgggacatgctgtggctccgcatcctcgatgccggcaaggcactggaggcccggcactacccgttggacggccggcttgttttcggcattgcggacccgctggacctgacggcaggaaagtacgccctgttcgtcgacggcggccaggccgccgtcgagcgcctgccggacaccgccaaggcggacttggcgctggatgtctccgccttgtcctcgatctacctgggcggggcgtgtccggtcacgctggccgcggcggggcggatcaccgaaaacacccccggcgccgccctgaaagcgcggcagatgttctcggtggagcgggcaacgcactgcctcacccacttctaggacctccgctggttcctggccccgaataacactgtcattccgcggcattacggcggagagtatggtgggcactgcaggcacctccggtccgggaccggcggggcgctctgccggcagttggccagccgatcgggacctatgcgggacgggcgccatggcggtgggattcgggaaatggtcgtcgtggcgccgggaatggtcccaatccctgggcgtgggcctagccatggttatccttgcatcctccctgattgccgtgccgctgtctgctgccgggcaattgaacctcgcggacggccaggtgaccgcctgggtgatgaccatctacacggttccctgtgtgctgggcatcgtcctgacgctccacttccgccagcccctgctcctgacgggcaacatcttcgtgctgatttttatcgtgtccctccagggaagggtgccgtttgccgaacttgcgggcgcctccctggtggcagggggcgcagtggtggccatttccgcactcgggctggcggatcacctggcgcggctgatccccgaacctgttgtggttggccttctggcaggatccacgctgccattcgtcgccggcgtcttcaccggtatggggtcggagccggcagtggtgggcgccgccttcctggcatatgtcctcggccggaagtacctggagagccgtgtgccgccgatcttccttgcactcgcggtggggattggggctgctgccgtcctgggcaagtttggcggggcggccgctggtgttagaccgtcgcttccgctgcttattgtccccgtctttacgtggagtgcgatcctgacggcaacccccgtgatggtggtgctcattgtcctccagtccaacgtcccttcattgatcttcctgcggggtgagcagtaccggccgcctgcccggctgttggactacgtgagcggtgcgggcaccatggctgcgtcgttcctgggcccggcaggcgtgtcgctgtccctgcccgcgacagccatggtggcaggcgccgacgccggtccgcaccagtaccggcacagggccgtggtcctcgcctatgccgtcttcctcgcccttactcctttggcagtattcgcggcaggcgctgccgatgtcctgccgcttgagctgctggtggccattgcggggcttgccgtgatcggtgttttggccatggccctgcggaggatcaccagcggcccgctcacccacgggccgctggtggcttttgccgtcgccgtctcggatgtgtcaatgctcgggctgggcccttacttctggtccctcgtgtttggtgtgtctgtgtcctggatccttgaacgggacggcatccgtgaacaacggatgcggatcaaggactgaaccccctccagggcgtgcctcgctttgacccctgttacgggcaccgagtagaatgaacgggcgtgtattacgtgtgcccactttggtttgcatgtgatcaccgcgcaatcaggatgacccggcaaatccgccgcgctccgcctccaggtcagtacccggaagtggtggtcgcctgatcaactaactatccacaacggagcccctactacatgaccatcacctccaccgagaagcccggtacccccgtagtcgccattaacgacatcggtaccgctgaggacttcctcgcagctgtcgacgccaccatcaagtacttcaacgacggagacctcgtcgagggtaccgtcgtcaaggtcgaccgcgacgaagttctgctcgacatcggttacaagaccgaaggtgtcatcccctcccgcgagctgtccatcaagcacgacgttgatcccggagacgtcgtctccgttggcgatcaggtcgaagccctggtgctcaccaaggaagacaaagaaggccgcctgatcctctccaagaagcgcgctcagtacgagcgtgcctggggcgacattgagaaggtcaaggaagaagacggtgtcgtcaccggtaccgtcatcgaggtcgtcaagggtggtcttatcctcgacatcggcctgcgcggcttcctgcccgcatccctcgtcgagatgcgccgtgtgcgcgaccttgctccgtacatcggccagcagatcgaagccaagatcatcgagctggacaagaaccgcaacaacgttgttctgtcccgccgtgcatggctcgagcagacccagtccgaggtccgctccacgttcctcaacaagctggaaaagggccaggtccgtcccggcgtcgtttcctccatcgtcaacttcggtgcattcgtggacctgggcggcgtagacggcctggttcacgtttccgagctctcctggaagcacatcgaccacccgtccgaggttgtcgaagttggccaggaagtcaccgtcgaggttctcgaggtcgacctggaccgcgagcgtgtttccctgtcgctcaaggctacgcaggaagatccgtggcagaccttcgcccgcacccacgccctcggccaggttgttccgggtaaggtcaccaagctggttccgttcggtgcgttcgtccgcgtcgaagacggcatcgaaggcctggtccacatctccgagctggcagtccgccacgtggagctggccgagcaggttgtctccgttggcgacgaactgttcgtcaaggtcatcgacatcgacctggaacgccgccgcatctcgctgtccctcaagcaggccaacgagggcgtcgacgccgacagcaccgaattcgatcccgctctgtacggcatggccgcagagtacgacgaagagggcaactacaagtaccccgagggcttcgatcccgagtccaacgagtggcttgaaggctacgagaaccagcgcgccgcctgggagcagcagtacgctgacgcccagacccgctgggaagcccacaagaagcaggttgcccagcacgctgccgacgacgctgctgctgcaacgtccggtgacagcgattccggcaccaccagctactcctcggagccggctgcagagtccaacgccggtgcaggcacgcttgcatccgacgaggctctcgccgccctgcgcgagaagctgaccggcaactaattgccaccggcccggtttcccgggccaacgcaacagaccccctgcccacaaggcagggggtctgttgctttaacgcagctgttggccaccgtccgtcaggcgtcaccgcgccttaaagttcgacgacggcgcggaccgtcccgtcgtcgtcgtgcgtcaggacggccccggctgaggccagaatgcgctgggcgccgacgtttcccgcaagggtgcgggcggttatccgggaaagtcccgcccttcgggcctcctccagcaccaggcgcaacgcggcggcgccaacgccccgggaccgaaagctccggccaagccagattcccgtatcggccaccgctccggcgggtccgggttccgcggtgcaggatgtggtgcggcgcaggcggatggatccggcgaggctgccatcggcgaggattccccacgtcttttccccggcgaggccgtccaggccgtaggcggcggcgcggtggtaaccgaagaaccaggcggtccgctcagggttccagcccggcccgcccagcgggggagccacctcatcgggggaggcgtcgcgctttgcgagagcaaggagcctgtccagcaccgcctcatccacgtccaccagggacacctcaggggacggggacatccacccactccgttcccttcgccgccagcgaggcactgccggccgtcagcaactgcacccgctccgcagcgtccgctattgcgccggcgtcgtccggcaccgccacccgcaggacagtgtgccgggctccgtagctggttccggccattaccaggtttgcggcccgcaggtcgttttcgagcttcccggccgcagcgtgggaaacttccaccgagcagatccgcaggcggctgcgccgcaccagcggcacgagggtcagcgctgcggacacggactcggagtacgcacgcaccagtccgcccgccccgagcaggacaccgccgaagtaacggacgacgacggcacttacgtcgctgaggtcggccgccccgggcaccgtctcccgtttggccaaggcttccagcatgggaacgcctgctgttccggacggttcgccgtcgtcgttggagcgctggatgtcccggtcgggtccgatgatgaacgccgagcagtggtgccgggcgtcgtggaactcgcggcggaggccggccaccaggtcgcgtgccgcgtcctcgctgtctgcccggcgcagcaccgtgatgaaccgggaacgcttgatctccaactcgtggcggaagtcggagcccgccgccagcgtggtgtaactggtggccctgctctcttccccttgcacccgcccaagtctaggcccaagctcccatgacccggcaagacgccggttgccggcccgaactcttcgcggcaaggggattaaggatcgattaaggcgtcagcagaattcttagaaaaccaggaaatgggaccagcagagaattccagctcggaagcagccttaaagacctggtagcacccgacgctggtttatctcattgtattcttcgccgcatttggcggaagcctgaacagaaaacggtcaggaaaaccttgtcattcaccatgggtggcaccgcaagaaaggggcaatacattgttcaccttcaagattagccacttggccggacctgtgtccgggcaataccaggcgttctggtggagccaaaaagaggaagatgttcctttccatcgcaactgttgccgcagctggtttttcgggagcagtgtttgccgcgcccgcacatgcctctccaccgacggcgaacggcggcaccggcctgcagatgggctcgatagccgcgccttacagcgaagaggaaatccgccgtctgcaggagtttggcgattttcttggcgccagctcccggatcacggccaaccaatatgccctcggccacatgtatcagaacaattaggttgcagctccctggcgcggtcgcgtatgtctaaggagcaggaggatcatgcgattgggtgttgatgcgccgggccggtgacaaaactccgcgccctgttccagggataccgcaattagcgtgccggccgccccgggcagggcgttggtgccgatctgcaccgaggatccaaaaaccaaccataatgcagccatcatgcgcctggcagcttcaggagacgcacctggacctgggccgggggattagggtggggagatgctcaagattggcctgacgggcggtattgcctccggaaaatctgttgtctctttcaggctgcgcgaacgcggagcggtgctggtggacgcggacgcgctggcccgcgacgtggtggaaccgggcaccgacggtctggaccgcatcgtcgcggagttcggcacgaatgtcctggacgctgccgggcggctggaccgccccaaactcggcgccctggtgttcgggagcccggagcggctcgcagcgctcaacggcatcgtccaccccctggtccgggctcacgccgcggccatcgtggcggcggcggccgaggacgccgtggtggtgcaggacatcccgctgctggtggaaaccggccaaggcagcgacttccatctggtggtggtggtggacgccccggacgggatgaggctgcagcggatgctggagcaccgcagcatgacggaggagtcggcacgctcccgcatggccgcgcaggccacgcgcgaggatcggctggctgccgcggacgtcgtgctggacaactcgggcagcctcacggacctggcgggacaggtggaccggctctgggacgaacggctggaacccttcgcccggaacctggccgcgcatacccgcgccgacagggccggggggccggtcctggtgcccgcgcgctccggctgggttgccgaggcccggcggctgatggaccggattgccaggtcccttcccgccgagtggcagggggccgtccggattgaacacatcggctccacgtccgttccggggctggacgccaaggacgtcatcgatctccaggtggccgtcccggacctggcggttgccgacgccttggcccctgccctggccgctgcaggtttcccggcggtcccgggcaacacggccgatactccgaagcccgcccatccgcggcctgaggactggcaaaagcggttccacgccaatgcggaccctggacgggccgtgaacctgcacgtcagggccgccggctcggcggggtggcggttcgccctgtgcttccgggactggctcaaggctgatccggaggcggccgcggagtacctggccctcaagcggaggcttgccgcggaccatgcgggcgacgactccacggaaggctacgccgcggccaaggaggactggttcatggcagcggaagaacccctggaacggtgggttgaacgctcgggctggcagccgccgtcgtacgcttcctgatcaccgtccggctggtgttcgcccgtaacggattggccccttccctgtcagtgcccggttgtagattagatccatgagccttgcgcaggatatcaaccgtgttgtagcacccttcgaggtcatcagcgagttcaagccggcgggcgaccagccggcggcgatcgccgaactgacagagcgcatcaagaacggcgaaaaggacgtggtgctccttggcgccaccggaaccggtaagagcgccaccactgcctggctgatcgaacaggtccagcgccccaccctggtgatggtccagaacaagaccctcgccgcgcagctggccaacgaattccgcgaactgctgcccaacaatgcggtggaatacttcgtctcctactacgactactaccagcccgaagcgtatgtggcgcagactgacaccttcatcgagaaggactcctccatcaacgaggaagttgaaaggctccgccactccgccaccaacgccctgctgacccggcgggacgtgatcgtcgtggctacggtgtcctgcatctacggcctgggtacgccggaggaatacatcgccggcatggtcacgctccgcaagggcgcggagatgaaccgggacgacctcctccggaagttcgtgtccatgcagtacgcgcgcaatgacatggacttccaccggggcactttccgggtccgcggggacaccgtggagatcatcccgatgtacgaggaactggccatccggatcgagttcttcggtgacgagatcgagaacatccacacgctccacccgctcaccggtgaggtgatccgggacgaagaggaaatgtacgtcttccccgcctcccactacgtggccggacccgagcgcatgtccagggccatcaagcggatcgaggacgaacttgctgacaggctcaaggtgctcgaaggacagaacaaattggtggaagcgcagcgcctccgcatgcggaccaactacgacctcgaaatgatgcagcagatgggcttctgcaacggcatcgagaactattcctcgcacatcgacggccgcggccccggaacagctccgcactgcctcctcgactacttcccggacgacttcctcctggtggtggacgaatcccacgtgaccatcccgcagatcggcgcgatgtacgagggcgacatgtcccgcaagcggaacctggtggactttggcttccggctgccctcggccatggacaacaggccgctgaagtgggacgaattccttcagcgcgtcggccagacggtctacctgtccgccacccccggcaagtacgaactcggcaaggctgacgggttcgtccagcagatcatccggcccacggggcttatcgatcctgaggtggtggtcaagcccaccaagggccagatcgatgacctgctgggggagatcaagacccgtactgccaaggacgagcgcatcctggtcaccaccctgaccaaacggatggcggaggacctcaccgactacctcctgggccacggcatcaaagtggagtacctccactccgacgtggacaccctgcggcgcgtagagctgctgcgcgaactccggatgggcaagttcgacgttctggtgggcatcaacctgctccgtgaaggcctggacctcccggaagtgtccctggtcagcatcctggatgcggacaaggaaggcttcctgcgctcctcaacctcactgatccagaccatcggccgcgctgcccgtaacgtctcgggccaagtgcacatgtacgccgaccgcattacggactccatggcgcacgccatcgatgagaccaaccggcgccgcgccatccaggtggcctacaacaccgagcacggggtggacccgcagccgctgcggaagaagatcgcggacatcaccgatcaactggccaaggaagacgccgacacccaggagctgctcaacaacagccggctggcgaagggcggcaagcggaagtccgcggcgaagggtgccgcgcaggtgcgctccgacggcctcgcagcggcaccggcggaggacctggtggggctgatcgaacagctgacggaacagatgcacggtgctgccgccgaactgcagttcgaggtggcagccaggatcagggacgaagtgagcgagctgaagaaggaactgcggcagatgcaggcggccgggcacgcctgacacagaggtaacggggacgggcggcctgggggattacggtacagttaacgtcacgtaggggagtatcccgagcgctacgatcgtcaacacgcagggcatagttgcccggccgggcgtagcgggccgccattcagcaccaagtgcacaggcaggccggagagacttacaccgcatctctgtaccctgcgaaaggctaccctgtgctcgaattgcccgtgtggttcgaagtcggctcacttgtcgtcctcggcctgatcctcctgatcgaccttctcctggtggtccggcgcccccatgaaccctccatgaaggaagccggactgtgggtagcgttttacgtcagcctcgccctggtgttcgccggggccatgttcgccttcaccggccccgaatacggtggccagttcgtcgccggctgggtaacggaatacagcctcagcatcgacaacctgtttgtcttcatcatcatcatggcccgcttctcggtgccccggaagtaccagcaggaagtgctgatggtgggcatcatcatcgccctgatcctgcgcggcatcttcatcctgctcggcgccattgtgattgaacagttcagctgggtgttctacatcttcggcgcgttcctgctctggactgcctggaagcaggcccaggacgagggcgaagacgaagaagaccgggaaaacccgctcatcgccaagatccgcaaggtcatccccatgtcggagaagttcgacggcggcaagctgcgcaccaccgtggacggcaagaaggtcttcaccccgatgctgatcgtgttcatcaccatcggcctcacggacctgctcttcgccgttgactccatcccggcaatcttcggcctcacccagagcccgttcatcgtgttcacggccaacctgtttgccctgatgggcctgcgccagctgtacttcctgctcggcggcctgatgaaccgcctgatctacctgaagcacgcgctgtccttcatcctggccttcattggcgtcaagctggtcctccacgccatgcacgtgaatgaactgccgttcatcaacagcgggcagcacattgaatgggctcccgaaatccccacgttcgtgtccctggcggtgatcgttggcaccatcgtcatcgccgtaatcgccagcctgctcagctccaaggccaaggaatctcaccttgacccccgcctcgaagaggacatccggaagagccacagcgacgccgagtagccctttcctctccattaccagcaagcaatcccggccgccgagcggccgggattgcctgctttaaaccatccctgctgcgcgcccgcggcggggactatgctcggtgcatgggtccaatcctgacgacggagcaaggggtgcgccaggtgcagcggcgcactgtggcgcttctgggcatggcccaggtttttgccggcattggtaccggcgccacggtgtccatcgggtcgatcctcgcagtcgagctgtcagggtccagcgcctgggcgggtgccgtggccacggtgatgacgctgggagcggcgctggcagcactgcctcttgccgccctggcagaccgccggggacgccggatcggccaggtagccgggctgtccgcagccctggcgggtgctgtgctgatggtgctcgcggtggtgtccggcctcttcgtcctgctggtattgggggccgccggcatcggagtggggagcgctgccagcctgcaggcgcggttcgccgcggtggaccttgccgaccccgagcaccgtggcctggccctgtcaacggtggtctgggcggtcaccatcggtgcagtcaccggacccaacctgatccagcccggcactgtggtgggccaggcgctgggtcttccgccggttgccggtcccttcgtgatttccggtgccggcctgctcctggcagccgtgctgctctttgttgggcttcggccggatcccttgttgctcgcgagggaactcgccgcgcagggcgcacaggccggggagcatccggcggcgccgcgggtggacggccgtgcaggcattggccctgccggacaggcagcgcacgacggcgggacactggttcggggcctgcgcgccatccgcggctcccggaccgcgctcctggccgtggccgccgtcgtcggagcccacgccgttatggtgggcgtgatgtccatgacgcccctgcacctgcaggaactggtggaagggccgggcgccagccatgcgggccacacggcgtccggcgacgtactggtgatcatcgggttcaccatctcgttgcacatcgccgggatgttcgccctgtcgccggtgatgggctggctgacggacaaagcgggcagggcccagaccatcatgatcggtttcaccctgctgatgacggccgtggctgtcgccgggttcggccaggcatccactgcggccgtggcggtgggcctggtgctgctgggcctgggctggtccgctgccaccgtgtccggctccacactgctggccgaaagcgtggcgcaggagtcgcgggttgcggtccagggcgtttccgacatgctgatgggtgctgccggcgccgtgggcggggccgtgtccggcctggtcctcagctgggttggctacctggggctcaacctcctgggaggtgcagtgggcgcagttgtcctggccgcggcgttcctggccgtcatggccgggcggcggcagtcagcggccgcctgagcgtgccatgcccaggagccgggcgaagatcccttccccgtcgtcggcgataccgtcgtggtggaagtccgcggactcccacacctgcaggccgcggacggccgacaccgtttccagggacagcttccggtccacatagatatcttccgagtagacggcggcggccaccggaaccgtattggctgccagttgcccgcggtcgtagagcggtttccagtcctctttggcggccagcaggtccgccacctcccggaggggccgaagtgcagggtcctgctcgaaataccagggatagaccatttcgccggtgagcagcagcggctccgcgtccggcctgaactcgggatactcgtcaaggacgcgccaggccgcccagcttgtcgcctgcccctggccgtagatggactcgtgcatcagcgcgtagaggggattggagcggcgggacacgatgccctgcacctgctccaggaaggcgtcggaaagccgtgggccgccggcggtctccgtgaaggcatcctccagcaggtggtgcaggctgtctaccctggtgttgccgcccaggaatgcacccaccatctggaagcgctccacggtgagcggaccgccgtcgggcaggatttcctgggtgtgccgcaggtggcgggcaatccgctcaaccgcggcacggtcctccggataccaggaaaagtactcggcgttccgggcggctacgcgctggaaggtggcgcggtagacgtcgtcgggcgggccggccaggggcgcaaggccgccggtgaccagtacttcccgaaggccctccggggcaaaggacaggtaggtcagggcacagaagccgccgtagctctgcccgtaaaccgtccacgggtctgcccccagggcttcccggatcagctcggcgtcggccacgatggaatcggcgcggaagtgctccaggtacgcggcctggtccgcggccggcccgcgcagcggaagcgtgttccggtcaatgggcgaggagagaccggtgccccgttggtccagcatcaggatccggaagtccctggcggccgccttgccccagccgcccagggatccgaacctgttgccccgcccgcccgggccgccctggaggaacagcagccacggaagctccgcggcctgttcttccgagtgcgcggccgagacgtactcgcgggcaaaaacgatgatggcttcgccgttgggggagttgccgaaatggtccagcggcaccctgaagaagtgttcaacggtgcgcatgccacggaactcgtgccgtgccctgacctcgtgctgtaccttgacggccgagcgcgccggggcctgcatccctgcgtcagccattggcgcgggccgggttggcactgccgaactgttcgagtgcctggccggtgagccggaacgtggaccagccgtccatgggcccggctccaaggctgcggtagaagttgatggacggctcgttccagtcaaggacgctccattccaccctggcgtatccgttgtccacggcggtggcggcaaggtgctggagcagcgcctttccgtgcccctcgccgcgggcctccgggctgacgtagaggtcctccaggtagatcccgtgcacaccttcccaggtggaatagttcaggaaccacagggcgaaaccctggacttcccctgcctcgttttccgccatggctgcgaacacgcgcgggttttcgccgaacagcacttcctggagcatttccggtgtgttccggacggcgtccggctccctctcgtagtgcgccagttcgtggatcatccgaaggatagcgggtacgtcttgccgggttgcggggcggattacactcattgttcgagcttaccgtccggtacccacgccggcatgtgaccgctcagagccggttgacgtccgtcaccttgatcacggcggtgcccgtctcgtcggaggcggccaggtcaacctcggcggaaattccccagtcgtggttgccggccggatcgtcgaagatctgccgtaccttccaccggtcccgttcctcggtgatgatgagcagtgccgggccgcgggcatccggcccggttccgatgtcatcgtgttcgtcgaagtagtcgtccagggcgtcttcccagcgctcgacgttccagcctgcggcgccgtcgagttcgcccagcgctgccgcgttctcgtcggcaaagagttccacgcggcggaacatctcgttgcggaccatcacccggaaggcccggatgttggacgtgagcgacggcgggggaggcgggggagcgtcgtgcggtgtgggtgccaggccggacgcaagttcctcccattcgtccaggaggctggagtccacctgccggacgagttcgccgagccacgcgatgaggtcctccaggtcgtcacggagcatgtcctgcggcacagtctggcggagggccttgaaggcgtcagcgaggtagcgcaggacgatgccttcggaacgggccagtccgtagaactggacgaactcgccgaagttcatggcgcgctcgtacatgtcccggaccaccgacttgggcgccagctcgaagtcgcccacccagggcgcggccttccggtacacctcgaaggcttcgccaaggatttccgccaggggctgggggtaggtgacgctgtccagcatggccatgcgctggtcgtagtcgatgccgtccgccttcatggccgccaccgcttcgccgcgggccttcttctgctgggcggagaggatctggcgcggtttctccagggtcgcctcgatcacggacaccacgtccagggcatacgacggcgactccgggtccagcagttccagtgcggcgagtgcaaagggggacagcggctggttcagtgcgaagttcggctggaggtgcacagtcagccggaccgtgcggccatcgcgtccctgctcgtcggcggggatccgctccacgacttccgccgcgagcaactcccggtaaatgcccagcgccttcttcatgagctgcagctgggaggaccgggtttcgtggttttcggtcaggaggcggcgggcagcggcaaacgggtcgccgggccgttccatcaggttcatcagcattgcgtgggtcacggagaaactcgacgtcaacgggtccggcgccgattcgacgagccgcttgaacgttggttcgccccagctcacaaagccctccggcggcttctttttgaccacctggcgcagcttcttctggtcgtcaccgaacttggcgacggccttggccatggccttcacattctcggtcacgtgctcgggggcctggaccaccacggtccctgcagtgtcgtacccggccctgccggccctgcccgcgatctggtggaactcacgggagttgagcaggcgggtccggacgccgtcgtatttgctgagagcggtcagcaggacggtgcggatgggcacgttgatgcccactcccagggtgtcagtgccgcaaataaccttcagcagccccgcctgggcgagctgttccaccagccggcggtacttcggcagcattcccgcgtgatgcacgccgatgccgtggcggaccagccggttcagtgtcttgccgaagcccgcagcgaaccgaaagttcgcgatcagctccgcgatcctgtctttttcctcgcgggtgcagacgttgatgctcatgagggtctgggcgcggtcgatcgcttcgatctggctgaagtgcaccacgtacaccggtacttgcttggtggagagcagttcctccagggtctcgtggaccggtgtctcgtggtagtagtaatgcagcggaatgggccgctccgccgagctcacagtagtggtgggccgtccggtcagatgcgtcaggccttcctcgaaccggctgacgtcgcccagtgtggcggacatcaggaggaactgtgcctgcgggagctccagcaggggcacctgccaggcccagccgcgctgcgggtcggagtagaaatggaactcgtccatgatgacggtccccagttccgcggccgccccttcgcggagtgcggtgttggccaggatctccgccgtgcagcagatgatgggcgcatcctggttcacgccggaatcgcccgtgatcatccccacgttctccgcaccaaagatgtcgcacagggcaaaaaacttctcagagaccagggccttgatgggcgcagtgtagtaactgcgccggccctgggccatggcctggaagtgggctgcgatggccaccagggacttcccggaccctgtgggcgtcgccaaaatgacgttggcccctgttgcgagctccatgatcgcctcgtcctgcgccgggtacagggccagtccgcggctttctgtccactccacaaaccgggtgtagaggtcatcgggatcgacgccggcaggcaggctgggggcggaaagttcggtcagctgatcaacgagtttcattgatttccagcttagtgcccggccgggcccgggattccgccgtgcccgggttaggcttcgcccgtagacgtgacggcatcaagacgtggagatggacatggaatgggatccggcgaaatacgtccagttcggcgattaccgggatcggccctttttcgaccttacggggagggtccacgcggaccgtccggtacaggtggtggaccttggctgcggaccgggaaacctcacagcgacgctggcggagcgctggccggccgcggacgtggtgggcgttgactcctctgccgagatgctggccaaagcggcggcgctgaccggggcgggcgggggcctgcgtttcgaagtggcggacatcgcggactggaagccctccgcggagactgatgtggtggtgagcaatgccgcccttcagtgggtgccgggccaccaggagatgatgcgtgcgtggttgaatgccctccggcccggcgcctggttcgccctgcaggtgcccgggaacttcagcgccccgtcccacgcactgatgcgcgggctcgcggcctctgggaagtgggcgccacagctgggcggggtcctgcgcggcggggaatcggtgggcgagcctgcggactacctgcacatcctgctcgacgccgggtatgcagccgatgcctgggagacaacgtaccagcaggtcctgacaggcagggacgctgtcctggagtgggtccgcggtacggcgctgcgcccagtcctggctgccctctccgagccggctgctgccgagttcgaggcggagtacgcagcagcgctccgggaggcctacccgcagaccgggcacggcacggtgtatcccttccgcaggatctttgcggtgggccgcaagagcccgtgaccaggatcagccccgcagtgcctcgacaatgcagtcacgtgatgtgacaacaatggaaagtgatctggcttacaataacggggtggctgatgggggagaggctaccgccggctgccccctcggctgactgacgtgagtggaggtacgttgctgatcggactaatgaggcggctgctcggggcccacaaagcccatgtggttgccatcgttgttctccagttggtccaggcggccgccaccctgatgctgcctacggtgaatgccgcgatcatcgacgacgggatcgtggccgggaacactgcggtcatcacccgcctgggattcgtcatggcggccgtagccgtcgtccaggcagcggctgccatagcggcaggctacttggcggccgtcgtggcaatgaggatcggacaccagctccgggccgaaatcttcaccaaaatccagtcactgtcctcgcaggaagtggcagccttcggcacccagagcctcaccacccgggccaccaacgacacccagcagatccaggccttctccgtactggtattcaccatgctggtggcgggaccggcaatgggcctgggaggcatcgtccttgccctccagcaggacgtggcgctgtcctcggtggtaatcgtcatcgtgccactgcttttgctgatcatgtacctcatcgtgcggcgcctcattcccctctaccgtgagggccaggacctcctggaccgcgcagggggcatcctccgcgaacagatcatgggcgccaacgtcatccgtgccttcgtccgccaggaccacgaggtacggcgtttcgcccggaccaacagcagcctgacggcaaacaatctccagtcagccctcctggtggcaggaatgctgccgctgatcatgctcgtggtgaacatctcttccgtggccgttgtgtggttcggcggccaccggatccaggccggcctgatgaacatcggagcgctggccgcattcatcgcctatatcctgcaaatcctgctcgccatcatgatggcgatgtacgtcctgatgacggcgccgcgggcggcagtctgcgctgagcgtatcggcgcagtcctcaccactgaaccgtcggtgcgcgatccgcaggaaatgaaggccgggccgcgtacggcgggcggcggtttcccgttgcaggacccgcagggggttgtgcagttcaaccgggtggggttttcctatcctggcgcggaagagcctgtcctggcggagatcagcttcacggccgggccgggaaccaccacggccgtcgtgggctctacagggagtgggaagtccacgctgctcaacctgattccccgtttcctcgattccacagcagggaccatcagcctggatggtgtggacatcaaggacctgccgttggacaccctgcgcgcagccatgtcgatagttccccagcactcccacctgttttcgggcaccattgctgacaacctccggatggccgcgccggacgccacggatgaagagttatgggacgcccttgagacagcgcagaccatgcggttcatgcgtgagctgccgctggggcttgccacgcccgtgggccagggcggaacgaatctttccggcggccagcgccagcggctgtgcatcacgcgggccctgctgcgcaagagtccgctctacctgttcgacgacagcttttcagcccttgactacgacaccgacaccaggctgcggcaggcgctggcagccaggctcgccgccgccacggtcatcgtagtggcggaacggatctccgcggttgaaaacgcggatcttattttggtcctcgacgacgggcagctggtggcgcagggtacgcacctggagctactggaaagttcctcaacctaccgggagatcgcagactcacagctggcactggacggacctgtatgacgacgccggctgcagttcccggagcggctgaaaagttctggcccacggccggacggctcctgggccggctgcggccgttcaggcgtttcatgctcggcgccgtcgccgcaacgtgcgccttcgcggggctcaacgtggcggcgccgaaataccttggcgatgccacggacgtggtggtggaaggcgtgctccgggggtctttggaccaggggcggctgggcctcctcctggccggtgttgccctgatgtatgtccttgcctcactgttcaactggatccagggtgcgctcaccgcccggtcggtccaggggctcatgtacggcctgcgggctgcgctggaggacaaactgcaccggctgccgtccgcctatttccgggaacggtcccggggcgacgtcctgagccgtgcgacgaacgacatcgacaatattgcccaggccatgaaccagcttttgacgcagctgatcatgtccgtcctgatgctgtgcgggtccctggccatgatgctttggatctcgcccctgctcgctgtgatcgccattgccaccgtcccgctgtccaccctgatcaccgttctcgtggcccgccgttcccaggcgcacttcgcagggcagtggacggagaccggcgagctgaatgcgcatgttgaggagtttgtctcaggacacgaggtcatcaaggcgttcgggcatcaggcccaggccgcagagacctttggacggagcaatgacaggctcgcacgcgcagccacgaaagcccagtactcggcaggcatggtgcagcccctgatggtgctgatctccaacctcaactacatcgcggtggccgtggtgggtgccctgcaggtcatcgcgggcgccatgaccatcggcgggatccaggcatttatccagttcagcaggctcttcacccagcccgtgggacagatcggcggcatgctgaacctcatccagtcctgcgtggcctccgctgcgcgcgttttcgccctccttgatacggaggaggatcccccagagccggcggcggacaaagcggttccgccgggtggacacatcgttttcgacgacgtcaccttcggctatccggaatcggccccggcggtacacaacctctccttctctgtggagcccggccagacggtggccatcgtggggcacacgggagcagggaagactaccgtggtgaacctcctgatgcggttctacgagccaggctccggccggataaccatcggcgggacggacattgcggcaatgtcccgggaccggctccgggagcagttcggggtagtgctgcaggatgcgtggctcttcgcgggcactatccgggaaaacattgcctatggccggccgggagccacggagggctgcattatcgcggcgtccgaggccagttacgtggacaggttcgtcagggcgctgccctgcggttacgacacagtcctggaaaacggtggtgaacccctgagccagggccagcggcaactgctcaccatagcccgcgcgcaactggcgggcagggcggtcctaatcctggacgaagccaccagttctgttgactccaggaccgagctcctgatccgccaggccatgcagcgcctgcggcagggcaggaccagcttcgtcatagcccaccgtttgtccaccatccgcaacgctgatctaattctggtcatggaccatggacgcatcgttgaacagggcacgcaccacagcctccttgctgccaacagctactacgcccggctgcacaacgcccagttctcggcgggcccgggccgggctgacgcactcgaggcgggcatttgacgccggcagccggctttcccggaacgtggaggcccaacaccgccagcactgtggcgttgtttgagcagctccggctgcacgtcatccacctggcggacaacggatccctgccgcccggaaccaggctgcccgcggtcagggcgctggccgagatcctcgacgttgctccgcacacggtggcccgggcctataaagagcttgaagcggccggaatcgtcgccacccgcggcaggaacggcacggtggtgtgcgcacgtgatgaacgtctcggcgggctctccgccgcggccgcagcctacgctgctgcggccaaagcgcagggtgccacgttcgccgaggccgtgaagctgctggctgctgcctacgatgttccctgagggcggaaccgtgcaagttcgaagaagttttcgattagcattattgggtgcctaaagccgtagctgaagaaacctccgccccctccactgccctgacggtcccccctgcggccgccccgcagcgcccggacctctcccgccttgtggtgaagggtgcccgcgagcacaacctccgcaacgtggacctcgatctgccccgggacgcgatgatcgtcttcaccgggctctccgggtcagggaagtcctcgcttgccttcgacaccatcttcgcggagggccagcggcgctacgttgaatcgctgtccgcctacgcccgccagttcctaggccaggtggacaagcccgacgtcgacttcatcgaaggtttgtcgccggcagtatccatcgaccagaagtccaccagcaagaacccgcgctccacggtgggcaccatcaccgaaatctacgactacatgcgcctgctctgggcccgtgttggccgtccgcactgtcctgtgtgcggcgaacccgtggccaagcagactccccagcagatcgtggaccagctgctggagcttgacgagggcacccgcttccaggtgcttgctcccgtggtgcgcggacgcaagggcgagtttgtcgatcttttcaaggaactgaccgccaagggctactcacgcgcacgggtggacggaaacctggtgcagctgagcgatccgcccaagctcggcaagcagttcaagcacaccatcgaggttgtggtggaccgcctggtggtcaaggaaggcatcagccagcggctcacggactccgtcgagacggctctgggcctggctgagggccgcgtcctggcagagttcgtggaccttgaggcggacgatcccggccggcttcgggctttctcggaaaacctggcatgccccaacgaacacccccttgccattgacgagatcgagccccgctctttctcgttcaacaacccgttcggtgcgtgcgcggcctgcagcggcattggcaccaagctggaagtggacgaggaactgatagttcccaacccggaactctccctgggcgagggcgccatcgctccgtggtccctgggcacggccaccacggagtactggaacaggctgctcgagggcctggccaaggagctcggcttctccatggacaccccttgggagaagctgggcaaggacgtgcgccagaccgtcctgcacggcaaggaccacaaagtggtggtgcagtaccggaaccgctttggccgggaacgcaaatacagcaccgggttcgaaggcgccatccagtacgtccaccgcaagcacggcgagacggactcggactgggcccgcgaccgctacgaagagtacatgcggcagattccctgccccgcctgcaacggtgcccggctgaaccctgcgtcgttgtccgtgctgatcaacggcaagtcgattgccgacgtcgccgcccttcccatgcgcgactgcgccgacttcctgaacaacctggtgctgtccggccgtgaagcgcagatcgcccaccaggtactcaaggagatccaggcgcgcctgacgttcctcctggatgtcggccttgaatacctgaacctggaacgcccgtccgccacgctttccggcggcgaggcgcagcgcatccgcctggccacccagatcggctccggcctggtgggagttctctatgttctggatgagccgtccatcggcctgcaccagcgcgacaaccggcgcctgattgacaccctcacccggctgcgggacatggggaacacgctcatcgtcgttgaacacgacgaggacaccatccatgttgccgactggattgtggacatcggacccggtgcgggagagcacggcggccaggtggtccactccggctcctacaaggaactgctggacaacactgcgtccctgaccggagattacctgtccgggcgcaagaagatcgaaatccccaagaagcgccgcaagtacgacaagaagcgtgagctgaaggttgtgggggcgcgggagaacaacctcgtgaacgtggacgccgccttcccgctgggcctcttcactgctgttaccggggtgagcggctcgggcaagtccaccctggtgaacgagatcctgtacaaggtcctggccaacaagctcaacggcgccaagcaggtggccgggcggcacaagactgtccagggcctggagcacctggacaaggttgtccacgtggaccagagccccatcggccgcaccccgcgttccaaccccgccacgtacacgggcgtcttcgacaacatccggaagctctttgccgaaaccactgaagccaaggtgcgcggctaccttccgggcaggttctcgttcaacgtcaagggtggccgctgcgaggcctgctccggtgacggcaccctgaagatcgagatgaacttcctgccggacgtctacgtcccctgcgaggtatgccacggcgcacgctacaaccgggaaacccttgaggtgcattacaagggcaagaccatcgcggacgtcctgaacatgcccatcgaggagggggcggagttcttcgctgccttctcgcccatcgcccggcacctcaacacgctggtggacgtgggattgggctatgtccgtctcggccagcccgcaaccacgctgtccggcggtgaggcccagcgtgtcaagctggccgccgagctgcagaaacgttccaacggacgcagtgtgtatgtcctggacgagccgaccaccgggctccacttcgaggacatccgcaagctgctgatggtcctgcagggcctcgtcgacaagggcaacaccgtgatcaccatcgaacacaacctggacgtcatcaagagcgcggactggatcgtggacctcggacctgacggcggctccggcggcggccaagtggttgcctcgggaacaccggagcagcttgccaagtccaccgccagccacactgctgcattcctggcggaaatcctggagtaggaccgcacaagtattccgctccgcgtatgcgagtttcaggcatgagtgctgtcatgagaaactaacccggtgactcaaacaacagtgcccgtgatctttgacctggacggcactcttgtcgatccggccggtgggataacagacggaatcgcctcggcactgcgtgccgtgggcctgccggttcccggccaggacctgctcaactcgatgatcgggccgaagctcagtgatgccctgctgaacgtggcacaggtgccggcggacctgctggatgaagtcatccgcctctaccgcgagtactacgttgccactgggatcgcgcagagccggatctacccgggcctccgcgaagtcctggaatccttcgcctcggccgggctgccggtggctgttgccacccagaaaccgcagcgcctggcccgcacggtactggagcatcatggcgtggacgggcttttccacggcatccacggttccgcggatgacgagagcgccgtgcaggggattccgctgggcaagacccaaatcatcgccgccgcactcaaggacctggacacgcagcatgcagtgatggtgggggaccgggcgcaggacgtttccggtgccatcgccaacggcctggactgcatcggggtggcgtggggattcgccccggacggcgaactggaagaggcaggtgccgtagccatcgtggaaaccgcggaaggcctcacggaactgatcggacggatgcaggctgtccacgtggctgccatgagcggggtgaccaacgatggcaatgtttgatgccgtacgctggaccacccgcagcctgatctcaggcacctgccgccccagcgtcgtcggacttgaaaacgtcccaaccgacgggccgttcatcgtggcccccaaccacctctcattcttcgacagcgtcattgtccaggcactgatgcctcggcccgtcgccttcttcgcgaaagccgaatacttcaccaccggcggcgtcaagggcaaggtcatgaaggccttcttcgagtccgtcggctccatccccgtggaacggggcgagcaggcagccagcgtgcaggcgctcaagacgctgctggacatcctggagtccggcaaaggcatcggcatctacccggaaggcacacgctcccgggacggcatcctctatcgcggacgcaccggcgtgggctggcttgccctgaccaccggggccccggtcatacctgttggcctgatcggtaccgagaacctccagcgcgcgggcgaaagcggcgtgcggccccagcacttcaccatgaaggtgggggagccgctgtacttcgacaagacgggccccgaccactcgttgccagcccgccgggaagtgactgaccgcatcatggacgcaatcgccgaactcagcggccaggagcggtccagcagctacaaccagagcaaaaccgtggaataagtcctgcccgccgccgggccgttgtccacggccgggcatccgccggtcgtcggcagggcaggccgcggcaggggccccgccgcctgcgcaggcggcggggtggaacgagcacccggcgcgcctcagtagactgtataggtggcaaatccagcaagttacaggccgaagacgggtgaaattcccaccaaccccggggtgtaccggttccgcgaccagcacggccgggtgatctacgtggggaaggcgaaaagcctgcgctcccgcctgaactcctacttcgccaaccccgccggactgctgcccaagacctacgccatggtccacgcggccagcagcgtcgagtggaccgtggtgggcagcgagcttgagtcgctgcagctggagtacacctggatcaaggaattcaagccgcgcttcaacgtggtcttccgggacgacaaaacctacccctacctggccgtgaccctgaacgagaagtatccgcgcgtccaggtgatgcgcggcgacaaacggaagggcacccgctacttcggtccctacacggccggtgccatccgcgagaccatggacaccctgctccgcgtctttccggtgcggagctgcagcgccggtgtattcaagcgtgcggaagccagcggccggccgtgcctcctgggctacatcgacaagtgttcagccccctgcgtaggccggatttccccgccggaccaccgtgccctggccgaggacttctgcgcctttatgggcggggaagccaagcgcttcatcgtcaaactggaaaagcagatggccgaagccgtggccgagcttgactacgagcgcgccgcccgggtccgtgatgacatcaccgccctgcgcaaggtctttgagcgcaatgccgtggtcctcgcagacgagacggacgccgatatcttcgccctgcacgaggacgaactcgaagccgccgtccaggtgttccacgtccgcggcggccggatccgcggccagcgcggctgggtggtggaaaaggtggaggattccaccaccccggaccttgtggagcatctgctgcaacaggtttacggtgaagacggcgacagccacgggaggctgccccgggaggtcctggtgcctgtcacgccaagcaacgccgacgagctggcgcagtggctcagcggactccggggcgcaaaggtggacgtccgcgtgccccagcggggggacaaggccacacttctttccaccgtgagggagaacgccgaacacgccctgaaactgcacaagacacggcgcgccggggacctcaccgtcaggtcccaggcgctccaggaactccaggaggcgctggaccttccggtcccgctcctgcggatcgagtgcttcgacgtctcacacgtccagggcaccaacgtggtggcctccatggtggtcgttgaggacggactgcccaagaaatccgactaccggaagttctcggtcaccggagcggccgcggcggacgataccgcggccatgcacgacgtgctgacgcgccggttccgccactacctccaggacaagtcggcacaggtggatgaggccgtcctggccggttccgctgacaggccggaccaggggcaggacccggcacagggacaggacagctccctggacaccaccacgccggcgccgcgggcaaagttcgcctatccgcccaacctggtggtggtggacggcggcaagccccaggtcaacgctgcagcccgcgccctcgcggacctgggcatcgaggacgtctacgtggtggggcttgccaagcgcctggaggaagtatggctgccggacagtgacttcccggtgatcctgcccaggacatcgcaggggctgtacctgctgcagcggatccgggacgaggcgcaccggttcgccatctccttccaccggcaaaagcgcgggaaggctatgacggtctccgccctggacggggtgccggggctcggcgcgtccaagcgcaaggcactgctggcgcacttcggctcggtcaagggcgtcaaggcggcctcggccgcggagctgtcgcaggcgaaaggcatcgggccggccctcgccagcgcgatcgtcagccacttcgcgccggacggtccgggcgctgctccggtgccggccatcaatatgaccaccggcgaagtgatcgaaacttagcggagttccctgaaacttggctagggtaaagaacggggtttccgccgacgcggcagcctgcgggacaacaacagaaacggggcggacttaatggcagacacgacggcggaatccggagccggggaggacgggctgcaacccgtcaagcccctcgaagcggagctgctggtggtcaccggaatgtccggagccgggcggagcacagccgctgacgcgctcgaggaccacggctggtacgtcgtggaaaacctgccgccgcagatgctcgggaccctggcggagctggtgtcccacgccccgcagtccattccgcggctcgcggtggtcatcgatgtccgcagcaagggccttttcgcggatatccgcgccgcgctgggagccctggccgccagcggtgtcgccttccgcgtgctcttcctcgatgccagtgacaatgtcctggtccgaaggttcgaacagggccgccggccgcaccccctccaggccggaggccggatcctggacggcatcgctgcagaacgtgagctgctccaggaactccgcgacagctccgacgtcgtgctggatacctccggctacaacgtgcacggcctggccaccgccatcaccgaactgttcagcgaaaccggcccggtggccctgcgcctgaacgtcatgagcttcggcttcaagtacggcctgcccgtggacgccaactatgtggccgacgtcaggttcatccccaacccccactgggtgccccagctgcgcccccataccggcctggacaaggacgtcagcgattacgtgctggaggccgagggcgtcaagaacttcgtggaccgctacgtcatggccctggagcctgtcctggacgggtaccgccgcgagaacaagcactatgccaccattgccgtgggctgcacgggcggcaagcaccgctcagtcgcggtcgccgtcgagctttccaagaaactggcgcagtacccacgagtcacggtgaccaccacccaccgggatctgggccgggagtaatgtcgctgttcaccggcgccctgccgctggtcccgcccgcggggtccgcagcgggccagcatgacaaggggccaaacgttgttgccctcggcggcggccacggcctttctgcatcgctctctgccctgcgcctgctcacctccgacctgacggccgtggtgacagtagcggacgacggcggatcctccgggcgcctgcgccaagagtacggcgtccttccgcccggcgacctgcggatggcgctgtccgccctgtgcgacgacacagactggggacgcacctggcgggacgttatgcagcaccgcttccgtcccggcaggggcccgggcggatctttggacgaacacgccatgggaaacctcctcattgtgaccctctgggaactgctgggcgacgccgtcgccgggctcaggtgggcaggcgcactgctgggggcacgcggccaggtactgcccatgtccaccgtgccgctcaccatcgaaggggatgtgcgcgtcgacgccccggacggcggcaccgcgctccagaccatacgggggcaggcccgctgcgccgtggcagggtccctggagcaggtgaggctcctgcccgaggcagccccggcctgcgtcgaagccctcaccgccatcgagctcgctgactgggtgatcctgggccccggctcctggtacacctccgttctgccgcacctcctcctgcccgagatgcgccaggcactgtgccagactccggccaagcgctgcctgaccatgaacctggccacggacacgaaggaaacaacgggcatgtccgccgccgaccacctggacgtgctgcggcgctacgctccggagttcagcgttgacgtggtccttgccgatcccgcctctgtcccggaccggcaggagttcgagaaagccgccgcgatgatcggcgccgaggtggtcttgggtaaagtaggggcgtcgggacgccgtcccgtccatgaccccttgcgtctggcgacggcgtaccaggacatttttgggaacagttaggaaggtgccatggcactgacagcatcggtcaaagaagaactgtcccgtctggacatcaagaagtcatcagtgcgcaaggccgaggtttccgccatgctccgttttgccggcgggctgcacatcatttccggccgcatcgtcatcgaggcggaagtggacctcgcctccacggcgcggcgcctgcgggcagccatcgctgaagtctatggacaccagagcgaaatcatcgtggtctccgccgggggactgcgccgggccagccgctacgtggtccgggtggtccgcgacggcgaggcgctggcacgccagaccggcctcctcgacggccgcggccgtcccgtgcgcgggctgccgtccgccgtcgtcaacgggtccgccgctgacgccgaagccgtctggcgcggcgctttcctggcgcacggttcgctgacggaacccggacgttcctcctcccttgaggtcacctgcccggggccggagtccgcactggcgctcgttggggcggcacgccggctggacatccaggcgaaggcccgcgaagtccgcggcgtggaccgggtggtcatccgcgacggggacaccatcgcggccctcctcacccggatgggtgcccatgatgcgctaatggtgtgggaggaacggcggatgcgcaaggaagtgcgtgccaccgccaaccgcctggccaactttgacgacgccaacctgcgccgctccgcccaggcggccgtggctgccggcgcacgcgtggaccgggccctcgagatccttggcgacgacgttccggaccacctcaagtacgccggcgaacttcgggtggcgcacaagcaggccagcctggatgagctgggacgcctcgcggacccggtcatgaccaaggacgccattgccggcaggatccgccggctgctggccatggcggacaagcgcgccctcgatctcggcatcccggggaccgacgccaatgtgacgcctgaaatgctggacgagtgacagccccatagaatcaaaaagattccgggcgccagccgcccggatgcataatccgagagttaccaaccggaccgaatgtccacgatattggaggattttgtgaccgagtacgtattgcccgaactcagctacgattacgccgccctggagccgcacatttccgcgcgcatcatggagctgcaccacagcaagcaccacgcagcctacgtggccggcgccaacaacgccctggcccagctggctgaagcccgggagaagggcgacttcgccaacatcaaccggctctccaaggacctcgcattccacaccggcgggcacgtcaaccactcggtgttctggaacaacctctccccggacggtggcgacaagcccgagggtgagctcgcagcggccatcgatgacgcatttggctccttcgacgcgttccgtgcccagttctcagcggcagcacttggcctgcagggttccggctggggcttcctcgcctacgaacccatcggcggcaacctggtcatcgagcagctgtacgaccagcagggcaacgtggcgctcggcaccacccctctcctgatgctggacatgtgggagcacgccttctacctggactacgtcaacgtgaaggccgactacgtcaaggcgttctggaacatcgtcaactgggccgacgtcgcaaagcgattcgaagctgcccgcaccagcgccacggggctcatcaccctcccgtagtgaggtgcgccgcactgcggtgtaacaaacttcacaatccggacatataaaggccgggatgtggacgggccgcccccgcacttgcgggggcggacccagttaaacgtaagataggtcacggaaggcggttagccttcagcaatgaggctggtcgccctccgtatgtaaatcatctctgcccaatggcgtgcgggatctgttagttggcttgatagcccgctcaactagttgtgcttctgaaagcaccaaggagactgaaaaagtgacgacccgtattggtatcaacggctttggccgtattggccgcaactacttccgcgcagcactcgcacagggcgcggacctggagatcgttgcagtcaacgacctcaccagccccgaagcactcgcacacctcttcaagtacgactccgtcggcggccgcctgaaggaaaccatcgaggtcaaggacggcaacatcgtcgtcaacggcaccgtcgtcaaggtcctggccgagcgcgatcccgccaaccttccgtggggcgagctgggcgtggacatcgtgatcgaatccaccggtttcttcaccaaggccgccgacgcccagaagcacatcgacgccggcgccaagaaggtcctgatctccgcacctgcctccgacgaggacatcaccatcgtgatgggcgtgaaccacaacctgtacgacaacgccacgcaccacatcatctccaacgcatcctgcaccaccaactgcctcggcccgctggccaaggtggtcaacgacgagttcggcatcgagcgcggcctcatgaccacggtccacgcctacacagctgaccagaacctgcaggacggcccgcacaaggatttgcgccgcgcccgcgccgccgcgatcaacatggtgcccacgtccaccggtgccgccaaggccatcggcctggtcctgcccgagctcaagggcaagctggacggctacgcaatccgcgttcccgtgcccaccggctccgccaccgacctgacggtcaccgtctcccgcgagaccaccgtggaggaggtcaacgccgcccttaagcgcgcttccgagtccgaggagctgcagggcttcctgacttacaccgacgagcccatcgtttccagcgacatcgtcggcgacccggcatcatccatcttcgactccggcctgaccaaggtcatcggcaaccaggtcaaggttgtttcctggtatgacaacgaatggggctactccaaccgcctcgtcgacctcacggagcttgtcgcagccaagctgggctagggttagacacatgacatcaaacaccctcaacgaactcatcgctgaaggtgtccgcgggcggtacattctggttcgaagcgacctgaatgtgccgctcgacggctctacagtcactgacgacggccgcatcagggcctcactgccagtgctgtcaaagctcacggacgccggtgcccgcgtgctggtaacagcccacctcggacgccccaagggcgctcccgaggagaaatactcccttcggcccgcagcaagccgcctggctgaactggccggcttcagggttaccctcgctcccgacactgtcggcagcgccgccaaagaaggagcagcgtccctgcaggacggcgaagtcctcgtcctcgagaacgtccgcttcgatccccgcgaaaccagcaaggacgacgccgagcgtggcgccttcgctgacgagctggtggccctgaccggtgacaacggcgcctacgtggacgacgccttcggagccgtgcaccgcaagcacgccagcgtgtacgacgtcgccacccggcttccgtcctacctcggcgaccttgtgcacaccgaggtggaggtcctgcggaagctcaccacggacacccagcgcccctacgtggtggtgctgggaggctccaaggtctcggacaagctggccgtcatcgacaacctcctgggcaaggctgacaccatcctggtgggcggcggaatgctcttcacgttcctcgccgcagccgggcacaaggtggcctccagcctgctcgaggaggaccagattcccgtggtccaggactacctcaggcgcgcagcggatgccggcacggagttcgtggtgcccacggacgtcgtggtggcggagaagttcgcggcagacgccgcccacgagactgtccctgcggacaacatcgagggcagcagcttcggcgcccagggcatcggactggacattggaccggactcggcggccgtattcgccgagcggatcaagggagccaaaacggtgttctggaacggtccgatgggggtcttcgagttcgaagccttctccgccggcacccgcgccatcgcccaggccctcaccgaaaccgaagcgttcaccgtggtgggcggcggcgactcagccgctgccgtccgtacgctcgggttcgccgacgaccagttcggccatatttccaccggcggcggtgccagcctggaatacctcgaaggcaaggaactgccggggctcagcgtcctggaccggtaatttcctccggcagcagtacctgacccttcagcccctccggccggcaggttgcccacggcagcctgccggccgaacacttatcaagaacttttggagaatacgtgacaacgtcaacgaacggcgctttcgaccgcaagccattcatcgcgggcaactggaagatgaacatggaccacgtgcagggcatcaccctgctgcagaaacttgcctggaccctttccgacgcgaagcacgactacagccgggttgaggttgccgtcttcccgccgttcacggacctccgcggcgtccagacccttgtccagggcgatgacctggatgtcgcctacggcgggcaggacctctcacagttcgactccggcgcctacactggcgatatctccggccagttcctgaacaagctcggctgcaagtacgtcctggtgggccacagcgaacgccgcaccatccacaacgaatccgacgacgtcctcaacgccaaggtcaaggctgccttcaagcacggcgtcacgcccgtgctctgcgtcggggaaggcctggagatccgccaggcgggcacccacgtcaaccacacgcttgagcagctgcgtgccggtgtgtccgggctgaccgccgaccaggccgctgagctcgtcgtcgcctacgaacccgtctgggccatcggtaccggtgaagtagccggaccggacgacgcgcaggagatgtgcgcggcaatccgtgccgagcttgagcagctgttcggagcggacacagcagcgaagacgcgcttgctgtacggcggttcggtcaaggccaacaacgcggccgcaatcctcaaggaacgcgacgttgatggcctgctggtgggtggcgcgagcctcgatccggccgagtttgctaatattgtcaggttcgagagtcacctggtgacggactagtccgtcccgccgcgcacactcccgcaattccaacttcctgaaaggccgtcgtggacgttcttcatgtcattctgcagatccttctgggcatcaccagcctcctgctgacgctgctcatcctcctccacaagggacggggcggcgggatgtcggacatgttcggcggcggcatgagctccggactcagctcctcgggtgttgccgaacgcaacctgaacaggttcaccgtcgtcctcggcgtcacctggggaatggtcatcatcgcactgggcctgatcatgcgcttcagcggaggcggagactcctgatcccgtagcccgggaaaaggcaccgcgcggacactgccgctgcgcggatcagagaactaaactgtggctgtcggttcccgacagccacagtctttgtttaaccagtcaggagtcccgatgattcatccggcatcaggcttccgcggcacgcgggcgggcgtcacggtagggacgggttccagcttcgagtcagaggatcacggcaaggcgctaccccgtatccaggtttcctattggtgcgccaaggggcacgagacgaggccggttttcgtcaagcttcccgaggaccagattccgctggtgtgggactgccggcgctgcggggcccccgcgtcacgggacgggcaggcagcggcggccgcggacgccatggacgacggctacaagacacacctcgaatacgttaaagagcggcgctccggccaggacgccgaagacgtcctggccggagcgctcgaaaaactacgcgcccgcggcgtccttgcggacgagctgctgcgggacacgtgacgcggcgttctcgtcaataagccacagggtccgggacgtaccccgcggccctgctgccgggacctgcaccgggttggcgcccgccagggccagccctaccgcgccggccttgtcctgtcctgccaccaccatccacacctcagaagcggtgttgatggccggcagcgtcagggagacccgcagcggcggcggcttgggtgaattccggacgcctaccaccgtgctttccttttcacggacaccgccctgctcaggaaacagcgaggcgatatgcgcgtccgggcccacacccagcaggacaacgtccaggcgggggagggcagcgggttcttcgggccggtcatcggacatgtccgcggcgtgctcggccgccgcggcttcccgaagcctccgcgcgtagtctgcggccgcctcttccgggccgccgaaatcatccgaagacccgggctcatggatccgctcagggtccacgggtatgtgcgagagcagcgccccgaacgcctgggtggtattccggtccgggtccccggcgggaaggaagcgttcgtcgccccaccagaaattcaccttggaccagtcgacggccggagccgccggagagtccgcaaccgctttgagcgtgccgatgcccacggttccgccggtcagcaccacggtggcctcgccaaacttatcctgcacatcaacaagctttgtgatcaggcgggcggcgatggcggccatcaggacggacgagtcaggatgaatgcttactcttgggtcaacgctcactgggtcggacgctccttagattggtacgtggcagtccaatagtaatcacttccccaaacacctcgtcggggtccaggcgtcggagctcctcggcgaggcagtcccgcaggctgcggcgcggaagcgaaatccgctgtgccggctggccgggctgggtcagctcggccactgacaaaccgggccggaagagctggatgtccccgccgggccgcgtcagccggacccggcggatacccgtccctgcagggtcggcgacaatggtcaccggcgcgtccagggtgagcgtcagccaggccgcgaggaggatagtgctcggcgaatccgaggcaccctcgacggccacggacgtgacgggggaggaatccacctggtccaggacagcggcaagctggatgcgccagttggtcaggcgcgtccaggcaaggtccgtgtccccggctttgtaggtggaccggatgttctccagggcacgctgcgggtcaggctcgttggcggagtcggtgatgcggcggtgggctatccgaccgatggacgtttcgcaggcgttctccggggcaccatgcggccaccaggccacgatcggtgcgtccgggagcagcagcgcggctaccagggactcgctctcgtgcgagagctgtccgtagccgcgcagcacgatcacctcggaggcgccggcgtcaccgcccacgcggatctgggcgtccagccggtccggggccgtagctccggcgtcggccaggacgatgatccggcaggggtgttcacggctggcctcgttggcggcctcgatggcctcctcctccagcccggacttggtgaccaccacgagggtgagcacccggcccagcgcaatcacgccgccctgctcgcgcagggacatgatcttcttggaaaccgttgaagttgtggtgtccggcaggtctacaatcatggccttctccaggttcgtccgtcgcgggccagcagctcgtcagccgaggcggggccccagctgcccggggcatagggctcgggctgctcgttcagctgcgcccagtattcctcgaacgggtccaggatcttccaggacagctccacttcctcgtgccgggggaacagcggcggctcgcccaggagcacgtccagaatcagccgctcgtacgcctcggggctggactcggtgaacgagtgcccgtagccgaagtccatagtcacgtcccggacttccatctgcgtgcccgggaccttggaaccgaaccggatggtgacgccctcgtccggctggacgcggatcaccacggcattctggccgaagtcgtcctcggcatggtcgcggaacaacaggttgggtgcccgcttgaacacgacggcgatttccgtcacccgccgtcccaggcgcttgccggcgcgcaggtagaacggcaccccggaccagcggcgggtgtggatgtccacccggatggcggcaaaggtttctgtggtggaatcggccgggatgccatcctcctccaggtagccctggacctgttcgccgccctgccaccctccggtgaactgcccgcgcgccgagtgcgtggaaaggtcctcggggagcttgacggcagcgagcaccttttccttctctgcgcgcaggtcgtcggcgttgaaggagatgggctcctccatcgccgtcagggccaggagctggagcaggtggttctggatcacgtcgcgggccgcgcccacgccgtcgtagtacccggcacggccgcccgtgccgatgtcctcggccatggtgatctggacgtggtccacgtagttggcgttccacaacggctcgaacagctggttcgcaaaacgcagggccaggatgttctggaccgtttccttgcccaggtagtggtcgatccggaacaccgcgtccggcgggaatacggattcgacgatgtcattgagctgccgggcggactccaggtcatgcccgaacggcttctcgatcaccacgcggcgccacttgtcgccctcggcctgtgccaggccgtgcttggacagctgccggcagacctgctcaaacgccttgggcggaatggagaggtagaacgcatggttcccgcgggtgccgcgcaactcatcaagctcgtcgatgacttcacccaaccgctcaaaggcgtcgtcgtcgtcgaactccccctgcacgaaccggatgccctcggagagctggttccacactgcctcatcaaaaggggtgcgggcgtaggcctgcacggaagccttcacctcggcggcgaagtcctccttgtcccactgccgccgggcaaaacccaccagggcaaagcttgggggcagcaggccacggttggcgaggtcgtacacggccggcatgagcttcttgcgggcaaggtcgccggtcactccgaagaggaccagggatgacggaccggcgatccggttcaggcggcggtcacgcgggtcgcggagcggattccgcccacggccagcagacttcctgccgtattcagtttctggcatggtgcttttcgtgccttagctttcagtaacggaggctgacctggcggacagcgcagcaatgatgtcctgcaactgtgccacaccggcggcccggtcagtgaggtgcaggcgaagcacgggacgtccgtggtcggagaggacctgggcgtcgccggcagcctgcgcggcaatcagttcaccgaacgtgaagggacggtccgggatggcgagatcctccgcggatgcagccgtgacctggaggaacactccgatggccgggccgcccttgtggaactggcccgttgagtggaggaaccgcgggccccagccgaacgtcacgggacggcccgagacggcggccagttcatcccggatgccttcgagctgagtgaacgccagccggtcgaagtaggcctggacgctgaggtagctgtcgctgtcgagcgtgtccagcagggccttcacggcgtcctccgcggtgcgggcctctcccagccattcaccgccgcggacctcgatggctccgtcaacaaacgctgccggagtgggctccggctgggcgtccagcaggccgcgcgcggccaccttggcggcctccacgtcgggctggtcgaacgggtcgatgcccagcaggcgaccggccacggcggtggcgaactcccagaccatcatctgggtgggcagtccgccggcgatggctacctcgttttcaccgagttcgacgtcggcatcggctgctaccagccgcaccaccaggacgtccggcgcgccgccggtgacctcgggcgagttggggccggcaaccaccggaagcacaccggtgcccagcttgccggtggactcggcgatcagctgctcggcccagtcggcgaagcctgcaatgccggagccgtcctcggcgatgacgatcttgttccgcagggggctggttccgccaagggcggttccgagtgccagtccgatgttttccggcgcatcatcgttgaggatctccgctgcttcctcagcctcatccaggaaggcctggatgtccaccccggccaggccggaggggacaagaccgaaagcggtcagcgcggagaagcgtccgccaacgttggggtcggcattgaagacggcacggtagccggcttcacgggaggccttgtccagcggggaaccgggatcggtgacgatgatgatccggctcctggcatcgatgccggcgtcattgaacgccttctcgaagacccgccgctgggaatccgtttcaacggttgaaccggacttggacgagaccacgatcgcggtctcgtccagccggtcggcgagggctgcacggacctggtccgggtccgtgctgtccagcactgtcagctcgacgccggcggtgccggcaataacctccggagccagcgaggagccgcccatgccgcacagcacgatgcgggtcacaccttcggccttcagggcgtcgcggagttccaggatgtccttgaccagcggctgggagacggtggccgcctccacccacccgagacggattgccgactcggcctccgcatcgggaccccacagggtgtggtccttggcgaagatgcgggtggcaatgcgttcctccacgaggacggggaggtgcagttccaatgcttgctgtgcggcaccggtggcgtcgtagctgagagtggtcatagtgggttaggaagccttccgtgcagaggcgagggcgccctcaacgtcggccagcagttccttccagctggccacgaacttgtccaggccttcggattcgaggagtgccacgacctcgttgtaggagatgccgagcttctcgagcgcgtcgagggtggcgttggcttcggcgtaggtgccgctgacggtgtcgccggggaccacgccgtggtcgaaggtggcgtccagggtcttctcgggcatggtgttcacgacacccggggcaacaagttcggtgacgtagagggtgtccgggtaggccgggtccttcacaccggtggaagcccacaggggacgctgggggagtgcgccggattcggccagcagggcccagcgttcggtggcgaagagttcctcgtagacctggtacgcaaggcgggcgttggccaggccggccttgcccttgagtgccttggcttcctcggtgccgatggcgtcgaggcgcttgtcgatctcggagtccacgcgggagacgaagaacgacgccacagagtggatcctggagagatcgtggccgttttccttcgcctgctccaggccggactggaaggcgttaatgacggcgcggtagcgctccagggagaagatcagggttacgttgacgctgatgccctcggccagggtggcggtgatggcttcgaggccctcgagggtcgccgggatcttaatgaggacgttgtccttgttgacccgcttgtacaggtgcttggcttcggcaatggtgcctgccgtgtcccaggccaggcgggggtccacctcgatggagacgcgtccgtcaacgcccttggtggctgcggccaccggtgcgaagaggtcgcaggcgtccgcgacgtcggtggtggtgatctcgaagatggtgtcctcgacgctggcgccggctgctgcctgcttggcgatggtgccgtcgtagtcggtgcctgccgtgatcgcggcgtggaagatggacgggttggtggttacgccaaccacgttcttctctccgatgagcttcgccagggtgccggtgtccaggcgtccgcgggaaaggtcatcaagccagatggaaactccggcgtctgagagctgctgggtgggagtagtcattgttttgtatctcctggaaatcgttggttaggcctggaggcctgcgagggagtccttggcggcagcggcgacggcctctgcggtgatgccgaactcctggaagaggcgcttgtagtccgcggaagcgccgtagtgctccaggctgacggaacggccggcgtcgccgacgaattccctccagccgagggcaagtcctgcttcgacggatacgcgggccttgacggcggtggggagcacggactcgcggtaggcggcgtcctgcttgttgaaccattcaacgcagggcatggagacaacgcgggcggcgatgccttcagcctgcagggcctcgcgggcctggacggccagctggacttcggaaccggtgccgatgaggatgacgtctgccgggacggtggcgccgtccttggatgcttcggcaaggacgtagccgcccttggcgacgccggcaacggaaccgaaggtgtcgccgtcggcctcgctgtcaccgcgctcccaggtggggatgttctggcgggtcagcacgatgccggcggggttgctgtggttctccagcatggtcttccaggcgacagctacctcgttggcgtcgccggggcggacaacgtccaggcccacgatggcgcgcagggaagcgagctgttccaccggctggtgggtggggccgtcttcgccgaggccaatggagtcgtgcgtccagacgtacagcgacggaacacccatcagggcgccgaggcggatggcggggcgctggtagtcgctgaagatcaggaacgtaccggagaatgcgcgggtccgtccatgcaggctgatgccgttcacgatggaggctgcggcgtgctcacggatgccgaagtgcagcacgcggccgtacgggttgccggaccaggcgtcggtctgcttggaagcaggaacgaatgacggcgaaccctcgatggtggtgttgttcgactccgcaaggtcagcggaaccgccccagagttcggggagcacggggcccagcgcgttcaggaccttgccggaggccgcgcgggtggagacgtccttgccggccgggaagaccggaagggctgcgtcgacgccgtcgggaagttccttggactcgatgcgctgcagcagctcggcgcctgtgggattggcagcctgccaggcgttgaaggactcctcccattccttgcgggcagcagcaccccggtccaccacggcacgggcgtgggcaagaacgtcctggtcaacatcgaaggacttggccgggtcgaagccgaggacttccttgagggctgccacttcttctgcgccgagggcagaaccgtggatcttgccggtgttctgcttcttgggcgccgggtagccgatgatggtgcgcagcgagacgatggagggcttggacgtctcagccttggctgcgaggagcgccgagtagagctcctggacgtcttccttgtattcgccggtcttggtccagtcgacgcgctggacgtgccagccgtaggcctcgtagcgcttcaggacatcctcggtgaaggcgatgtcggtgtcgtcctcgatggagatgtggttctcgtcgtaaatcaccacgaggttgccgagctcctggtggccggcgagcgaggaagcctctgccgtgacgccttcctgaaggtcgccgtcggacgcgatgacccagatggtgtggtcgaacgggctggtgccggcggcagcatcggcgtcgaacatgccgcgcatacggcgctgggagtaagcgaaccctacagacgacgcaaggccttggcccaggggcccggtggtgatctcgacgccggcggtgtgcttgtactcagggtggccgggggtcagtgaatcccaggtgcgcagtgcttcgaggtccttcagttccaggccatagccggaaaggaacagctggatgtacagcgtgagggaagtgtggcccggggacaggacgaagcggtcacggcccagccagtcgggattccgcgggtcatggcgcatcagcttctggaaaagaaggtacgcggccggcgccaggctcatggccgttccggggtggccgttgccaactttctccaccgcgtccgcggccagcacgcggacagtgtccaccgcacgctggtccaggctggtccaggacagttcttgctcttccaaatgtggcacgaaaaccgggcccctctctgtgctgatggcaggtggcacaccggatccgcatgaaggcacgctgtgtggcgcccgctgcggtgtgtaccagccgttcaccatcgaaacgttgatctttcactcagccactggcagccgggaatgcgttttccaccgcgttcctgctgcgtgctgatctggtgacagcttagctctattccattctgcgggcggcccaaatctcacgttttggacgcaatttcgggttatgtgaatgcgtctgaagtgaggttgagttaatctgctcgaattggcgcgcgagcgatcatcagcaccaacgtacggcttggcggggcaggtggacggcgtcggcggaccggccgtggcggggaggccggcgcggtatgatattcggaggccagcgccgggctgggggacacttgccaaccgcccggactcccgctgttgcgtggatcactgttccgcgggcgcccggttttggggcggggccggatgacacagctggaaagccagacagaactgccaacagaacgggtgactgccaccgtgagcacaacagatacgacgctgaacgcatcacgggcttcgcggcccgggatcgcccgtaaggcaaaggcgtatctcgccctcaccaagccccgggtcattgaactcctcctggtcagcacgctgcccaccatgatttacgcagagcgcggctttccgtccatcgggctcatcctcgccaccctggttggcggcgccttcgcggccggcagtgccggagccttcaactgctacatcgaccgcgacatcgacaaactgatgcaccgcaccgagaaccgcccgctggtcaccggtgaggtcacgccgcgtgaggcactgatcttctcctggctactgggtgccgccgccatcgcaatcctgtggttcggcgcgaaccccctgtccgcctggctcgggttgggcgccatcttcttctacgtggtgatctacacgatcatcctcaagcgccggactgcgcaaaacatcgtgtggggcggggcagcgggctgcttccccgtgctgattgcctgggcggcagtcaccaactcggtggaatggccggccgtcatcctcttcatggtgattttcctctggacgcccccgcactactggccgctgtccatgcgctacggcgaggactaccgcaacgccaaggtccccatgctcggcgccatcgccggcgccaaggtggtctcggtccaggtggtcctctacgcctgggccatggtggcctgctccctgttgatggttccggccggcggggccggatgggtctacaccgtcactgccgtccttgcgggcgcctggttcctctacgagtcacacgggctctacaacagggcacagcgtgaggacatctcggacaagcgggccatgaaggtcttccacggatccatcagctacctcaccctcctgtttatcgccctggctgtcgacccgttcatcgggcccgccgtcatggcaggctgaccagctgcgcatccagttgggataggatccctccgcaaggcagggcaagacgacggcggagcaggccggaatgatatgggcggtcaccagttaatgtcggcttcgcccagcgaacagaagcgcagtggccgcggatcgccgctctccacgagttccaatagctgtgccgctgcgctggcaggaagcttggacgcctctggagcgcccatctccgtgagcagtttgccaggatgaaccgcccagcacctgatggtctggccaagctcgtttgccaaggcaatggtgagcatgttctgtgcacccttggacacccggtaggcgtagctggtgcccattgccgcatagttcccggcagcctggcgtgacagggagtccagccgtgaagacacgttgatgacaagtggcgccgatgcctgctccaaggcgggaagcacttcctgaaccattcggagcgtaccggcgacgttgacgtccaagctgaccatcagcatgccggcgtctgcatcgcggacgccgccccggggcgcgcctcgggcagcattgttgaccaggacatccaccgcccgcccacgcagggcggcgcgaaagattccagctgggtccgaccggacatcgtgctctatcacttcgacaccgttatcaaaggccactaggtcctcgagggatcgaacggccgcgacaacgtcccagccgttgcctgcaaacgcgtctgccacggcccggccgaagccgcgccccgctcctgttacaagcaccagcttccccattggcaaaaccctacactcaggttccatccgctcggtgtgtgcaagcattaccgcatgtatagagaatgtgcagaggggccgcagacgtgctgtgaagggctcgatgaacgggaacccgcaatggactccctcagttgctgcccgccggagcaccagtggatttaggcggtggccgccatgggtgaagctgtccgcgtggcgtatgaggccaaggcggacgagtatgcggaacgcttcggcaccatggcagcagtacaccaatcggaccgcgatctggtcgccggttgggcgcagggcatcagcggccacatcatcgatgctggctgcggcccgggccattggacggggtttctgaaggacctgggatgcgatattgagggcgttgacctggtggcacggttcatcgatgctgcccgtaccagttttccgcaagcgatgttcaggacggcctccctggacaacctgggctcgcgtgatggacagctcgccggcatcttggcctggtactcggttattcatcttccgccgggggagctgcacgttgccctggcagagttcgcccgatgtcttcgtccgggcggcaccgtggtgctcgggttcttcgacggacccgcaggtgaagccttcccccacgccgtcgcgccggctcacacgtggagtgtcgccgcaatgcggagtgatcttgccgccgagggattggaagtcacggaagcccacgtccgcagcgagcccggctgccgtccccacgcagccgtggttgcccgcaaattgggcgtccgggaaggggctgaaaccttctgatctcggcatgacactcgacgtgacaacaactgtcacgttcgtcactttaaactgtcatatcccgtgacggtgtggttatggtggaactggtcccgctcccaagcaaaggaagttccatggcacaaccgccgcacccacccacagctgtcgccccaagccacagcccgcctccggctggcacaggcaaccggtacgggttccgccggccgggcttcgtggcccatcttgcggccgacgtacctgcttcactggtggtgttcctcgtcgccctgccactgtcattgggaattgccgcggcgtccggcgcccccgttatggccggccttatcgctgccgcagtcggtggcattgtggcggggagcctgggcgggtcaccgctgcaagtgagtggcccggccgccggccttaccgtcgtcgtcgccggccttgttcaggagttcggctggcaggtgacctgcgcgatcaccgcggcagccggcgtcgtccagctgctgctgggcgtcagccgcgtggggcgtgccgcgcttgccgtctcgccggtagtggtcaaagccatgttggccggcatcggggtcaccatcatcctgcagcaggtccacgtcctgctcgggtcgcagccagccggctcggccctcgagaacctcggggccctgcccgcagccatcaccggcgtcgaactgcacgccgccctgctgggccttaccgtcgtcgctatcctcctgggctggaagtacctgcccgccgcggcgcgccgtgtcccggggccgctggccgccgtcgctgccggcacggcactgtcggttgcgttcgcccctgctgttgaacgtatctctttcaccggttcaatctttgacgccgtcgcgttgccgcagttgcccgacggcagctggcgggcagcagcgtttgccgtcctgacgatggcgctgatcgccagcatcgagtccctgctgtccgccgtcgccgtggacaagatgcagcatgggccccggaccaacctgaaccgcgagctggtgggacagggtgctgccaatatcgtttccggatcgctgggcggcctgcctgtcaccggggtgatcgtccgcagcgccaccaatgtggaagccggcgctgcgacccgggcctccgccgtcctgcacggtgtttgggtcctggccttctccgcactcttcgcagggctgatccagctgatcccgctgtccgtcctcgccggactcctggtggtcatcggcgcccgcctgatcaaggtggcggacatccgcaccagcctccggacgggtgacctgctgatctatgccgtgaccctgctgtgcgtggtcttcctgaacctgctggaaggcgtcatgatcggcctggcactcgccgcggccagtgtgctgtggcgcgttctgcgggcaacactccacgcccaggagcctgtgccgccgtccaggtcctggcgggtatccatcggcggttcgtgcagcttcttcgcccttccccggcttaaccgcgtgctgcactcggtcccgccaggcgagcgcgtgcttgtggagctcaacgctgactacgtggaccatgcgttccgggaggccctgcttgcctggcagcagcagtaccaggccgccggcggtgctgtcctccttgagcatcacgggaacaccctgttccaggacgcggcggaccaggcgccgaagcgccaggaagcgcaggagctaccgctcccacccaggacgtcgtggcagcccgctccagatgggctggcagtgggaattgaagggcgaagcacgccgccgccatcaccggtcctgctgggcatcaacaagtaccaccgccgcttcgctgacaaggtccggccgctggtccaggacctggcggacgggcagaacccggacaccctgttcgtggcctgcgtggactcgcgcgtgaaccccaacctgatcaccagcagtggcccaggcgacctcctgacgttgcggaacatcgggaacgttgtgtgccatgacggccaggacgcctcgatcgactcagccctctcctttgccctgaagggcctggaggtggactcagtcgtgatctgcgggcactcgaactgtggagccatgaaggccgtcatcgccgatgccgaaggtgcgggcaaccccggacttggtaccggttttgacgcctggctggagcatgcccgccccagctacctcgaattgctggcggaccatccggtggccgccagcgccgctgccgccgggtattgccgggtggaccagttgggcatggtgaacgtcgcggtccagctggccaagctggaaagccatccggtagcaggtcccgcactggccgacggcagggtgcaggcaacggggctcttttacgacatcgccacggcccgtgtggtgcttgtgcgccagacgggcatcgagttcctggacccggaacaggctgcggagatgtccacggcccacgcaccggcgggctgagcgcggcatcagcagataggcaaaagggcgccccggttcacgaaccggggcgcccttccagtgtcagtcgagcgggtttacgccacggggcttgacttggcgatgtcccaggcgttcgttgcagcgcccatgagcattgcggcaccgagcatgtgggctgccaccagcagggccgggatgccgttgtagtactgggtgaatccaatgacggcctggagcatggtgacgccaaggaggccgaggaccgctgtccggatggggcccgtgatccgacgcagcagcaccagcgccagcgcaaccagggttccggcagtcaccaggtaggccgggacggcgtggatgtgcgagaacaggtcccagtccagcccgttgcgcggtgcatcggcgtcccctgcgtgcggaccggctccggtgaccaccacgcccagcatgacggcgagggcagagaaaagcgcgacggcggccgtcaccggacgcatgacccccggcagggcggcgaggggagcggtccggaaccgaccggtccggccgaacgcccggttgaccagcagcgtggcaagcaccaccagcgccatggagaccaggaagtggaggcccaccacccaggggttgaggttggtgaggacggtgatgccgccgatcacggcctgggcggggatactggccagcaggcccagcgccagcagaaagaggtcgcggcgctccttgcggaggttccacagatacaccagcatcagagcggcgacggcggccagtgcgaaggtgagaaggcggttgccgaactcgatgaacccgtggactcccatttcgggcgtgttcaccagggacgtgtccgtgcagcggggccaggtggggcagcccagcccggaggaggtcaggcggacggctccaccggtcagcaccagcagggtctgcccgatcagggaggccacggcgagccggcgaacacttgcgtccacggtgcggggcagccttgacgcgaggcggccggcgaactggggaaggcggaaggcggtgctcacgagtatctcaattccacttgaaccaacggattgctgcggccccggcagtaactgtccagagcaccagtatgagggaggcggcgccattcagcgcaccgtgcaggaaggcgtcgcgcagggcttcgccgagtgcgcccgagggcaggagcccgacgatctgctgggccgcggcgggcagccgttccgccgggatcacgatcccgccgagggcgccgaggaggatccagagcaggttggtgatggccagggttgcttccggacggacggttccggccaccagtagccccagggcggtaaaggccgccgcgcccagcgcgaggaggagcagcccgggaacccagccggccgccgtcggctgccatccgaggccaaacccgaccgccgccaccaccgcaatctgcaggcacagcaccaccagtacggaaagcaccttgccggcgatcagcccgccccggcccaggggagtcgtggacaggaatcggagcacaccgtaccggcggtcgaatcccgtggcgatgccctgcccggtaaacgccgtggacatggcgcagagtgcaaggattcccgggactgccacatcaatgcggctcggccccaggccgtccaggaaaggcgtaacagtcaggccaacaagcgccagcagcggcaggaccaccgcgaggatcagctgctcgccgttccgcagcatcgccagcgcctcgtatttgccctgcagcaggatgcgccggagcaggggtgcgggctgctgcctggcgggtgctccggccccggcagcgggagcggtgcccgcgggggtcgggttcatcggatgtcctttccagagatgtccagaaagacgtcttcaaggctacgcgcctgcaacgtcatggcggcgggcataacgtcatgcgctgcccaccactcagccagtgtggcaaggtgccggggagtcagggcgccggtggcggtgtagcttccggctcgctcctccaggaccaggacgtcgtcgggcagcacgccggacaggtccagtcccggcttcgcatcgaaggtgagggtgcgcacgtggtctgcgccggcgtccacggcgggtccgcgctgcagcagttcctggaccgttccctcggcgacgttgcggccgccgtcaatgatgtagacgtagtcagccaggcgctgggcatcatccatcaggtgcgtggtgaggatgattcccattcccgaatcacgcagctcgccgatcagctcgaacaccagttggcgggactgcggatccaggccagcgctcggctcatcgaggaacaggacctcgggcctgcccaccagggctgcggcgagggccaggcgctgcttctgcccgcccgaaagccggcggacggtggtccggctgaaggtgtcgatgccgagcctttggatgaggttgtccacgggccacgggtgtgcgtaaaggccggcaatgtgccgcagcagggggacgggcctggccgacggcgggaggccgccgtcctgaagcatcacgcctacgcgggagcgcagctcggccccggccgttgccgggtcctggccgagcagcgagatgctcccgccgctgcgcttctggaggccctgggcgcattccagggtggtggtttttccggcgccgttggcgcccagcagcgccgtgacctgcccgcgttcggctgagagtgagacgccgctcaccacccggagcattcttccgtccatgctggaaagcgggcctacatctttaactagcccgttgatggacagaacgggggacaggggcgatcgcaccccagtattctacgggaagtagtattaccgggagtcctcttggcccgctgcccgcatccgggagtttctgtccagatacgcagggttcatcgcgggtgaagtctgcacatctggacgaagactccaaaggtgggtttcagcacaggtcagcctcgccttactggaatgcgggactaaattacgacactattgtgttgtgtattccatgaccaacgctactgctgtgcctgtcgcccggcacggggcctccgctgttacagcggaacgcggagccatgcccgccgggccggtggctgacgccgacgagcgcacgcgcgaccgcgtcctggcggctgtcctggagcacggacctgtcagcgccgccgaactgggtgacctgctgggattcacgccggccgccgtccgcaggcacctggaccacctgtcccgtgccggcgtcatcgaagtcaagcgggtggcaaagtccggcggcggcgcaggccgcccggcacgccgctacgtgctcagttcacagggccagtcgagcctcggcaacgattacctcgacattgccgccctcgccctccagcagctccagaaggttgccggcccggatgccgtgcgagccttcgccgtcgagcgtttcgccgacatggaacgccggtacgctccggaaatcgaccaggccggcccggacatcactgaccgtgccaaggctctggcggatgccctgagccgtgacaacttcgtggcatcggcagcctccattgaggccaaggctccgctgcccgccgccctttccagcgtccagctctgccagggccactgcccgatccagcagctcgccgcgcgcttccccgtgttctgcgacgtggaaacggaggtcttctccaggctggtgggcgttgacgtgcgccggctttccaccctggcccggggcggccacgtgtgcaccacccacatacccacaggccggctgtctgccggagggcccacaacgcctccggcagcccccgccagcctgactgaagtaaacaaccatcagcaagaaaggccgtgatgacggaccaactatcagagaaagcagtagccgaaaacactgtgatctcggagattctcgagaagaatcccgagcttcacggcatcggcaactacgagtacggctgggccgacaagaacgacgccggtgccaacgcacgccgtgggctcaacgaagaagtggtccgggacatctcggccaagaagagcgagccggagtggatgcttgacctccgcctcaaaggcctgaagtacttcgaccgcaagcccatgcccacctggggtgcggacctttccggcatcgacttcgacaacatcaagtacttcgtccgctccacggagaagcaggctgccacgtgggacgacctgcccgaggacatcaagaacacgtacgacaagctgggcatccccgaggctgaaaagcagcgcctggtgtccggtgtcgccgcccagtacgagtccgaggttgtgtaccaccagctgcgtgaggacctcgagcggcagggtgtcattttcctggacaccgacaccgcgctcaaggaacaccctgagatcttccaggagtacttcggcacggtcatccccgtgggcgacaacaagttcgcctcgctgaacacctccgtatggtccggcggctccttcgtctacgttcccaagggcgtccacgtggacatcccgctgcaggcatacttccgcatcaacacggaaaacatgggccagttcgagcggaccctgatcattgcggacgaggactcctacgtccactacatcgaaggctgcaccgcgccgatctacacctcggactccctgcactccgccgtggtggagatcatcgtgaagaagggcgcccgcgtccgctacaccaccatccagaactggtccaacaacgtgtacaacctggtgaccaagcgtgccatctgcgaagagggcgccaccatggaatgggttgacggcaacatcggctccaaggtcaccatgaagtacccggccgtctacctcgtgggcgagcacgccaagggcgagacgctgtccattgcgttcgcaggcgaaggccagcaccaggacaccggctcgaagatggtgcacatcgcgcccaacaccaagagctccatcatttccaagtccgtggcccgtggcggcggacgtgcagcctaccgcggcctggtccaggtccgcgaaggcgccaagcactcggccaacaccgtccgctgcgacgcgctgctcgttgacacgatcagccgctcggacacctacccgtacatcgacatccgcgaggatgacgttgtgatgggccacgaggcaactgtttcccgggtcagcgaagagcagctcttctacctgatgtcccgcggcatgcgcgaagacgaggccatggcgatgatcgtccgcggcttcatcgagccgattgcccgcgagctccccatggagtacgcacttgagctgaaccgcctgattgaactgcagatggaagggtccgtcggataacgatgactgaaatcactactgaaaaggcacgcattggcgcgccttcagcccagccgttcatcgacggcttcaccgaagagggcgaaagcctctcgcccatcaacgcggcaggctccaaggccccgctggccggcgaagcggtcaagagccactcccacggtggcggtgtcggcgttccggacagctcacgcgccggccgcctgacgtcctataagcttgccgacttcaagccgctcaccggcatggaggaagactggcgcttcaccccgctcaagcgactccgcgggctgcactccgagatcctgtccggcgcggcgcccaccgtcgtcgtgaccggcccggaggaagtcaccgtggagagcgtcggacgcgacgaccggcgcatcggcaccgcgggtattcccgaagaccgcgtctccgccaacgcctgggagaactttgccggcgccaccgtggtgaccatcccttccgagttcgaagcactgaccgaagtcagcgtggacattgaaggtacctcactggacccggctgcccagcacctggtgattgttgcggagaagttctccaaggcagttgttgtcctgaaccaccggggatccgccatcgtctccgaaaacgtggagatcatcgtggaagacggcgccagcctgaccgtcatcacgctccaggaatggaacgacgacgccgtccacgcctcctcccagcaggcgaagatcggccgcgacgccaagctcaagcacgtcatggtgagcctcggcggcgaccttgtccgcgtcacgccgtcggcccgtttcaccgcccccggcggcgaggctgaaatgtttggcctgtacttcgccgacgccggccagcacctggagcagcggctcttcgttgaccacgccgtggccaactgcaagtccaacgtgctctacaagggtgcactgcagggccgcaacgcccacgcagtgtgggttggcgacgtcctcatccgcaaggaagccgagggcaccgacacctacgaggccaaccgcaacctgttgctgacggacggtgcccgtgccgactccgtgcccaacctcgaaatcgagaccgggctgatcgagggtgcaggccacgccagcgccaccggccggatggatgacgagcacctcttctacctcatggcacgcggcatccccgaggatgttgcccgccgcctggtggtccgcggcttcctgaacgagatcatccagcagatcaaggtcccctccatcgaggagcggctgaccgaggctgttgagcacgaactcgctctgacggacaactagaaggcacggagcacggttacagatgactgaccagccaaagggcgagcttgtctgcaaggtggatgaaatccagctgaagcaggcgctgcggatcctgattgatgactacccggtggcgatcgtcaaggactccatgggggagatccacgcgatcggcgacacttgctcgcacgcggacatttccctgtccgagggcgaagtggagggatgcgccatcgagtgctggggccacggctcccagttcgacctgcgcagcggcgaacccttgcagctcccggcctacgatcccgttccggtgttcgccgtcgagatcgtcggggacgaggtctatgtggacgtcacgaatgtcctcaacggcgccgaggctcccaacttcagctagcaccacagaattacgaaccaacttccagacagagaccgcaccgccgccgcccaggcccggtgcagaggagaacaagacacatgtctactcttgagatcaaggacctgcacgtcagcattgagacggagcagggcaccaaggaaatcctgaagggcgtcagcctgaccatccggaccggcgaaacccatgccatcatgggccccaacggctccggcaagtccaccctggcttccaccatcgcaggccacccgcgctacaacgtcaccagcggctccatcaccctcgacggcgaagacgtcctggaaatgagcgttgacgagcgtgcccgcgccggcgtcttcctggccatgcagtacccggtggaggtccccggcgtgagcatgaccaacttcctgcgcaccgccaagaccgccatcgacggcgaagcccccaagctccgcacctggaccaaggacgtcaaggctgccatggaacagctgcgcatcgacgccgacttcgcccagcgcaacgtcaacgaaggcttctccggcggtgagaagaagcgggtggaaatcctccagctggaactcttcaagcccaagttcgccatcctggacgagaccgactccggcctggacgtcgacgcgctcaaggttgtttccgagggcgtcaaccgtgcgcacgccgagggcaagatgggcacgctgctcatcacgcactacacccgtatcctgcgatacatcaagcctgacttcgtgcacgtgttcgtggacggccaggttgttgaggaaggcggcccggagcttgccgaccgcctagaagaagaaggctacgaccgctacgccaagggtgccggcgcagccgctgcacccgccgtggcgcaggcctagtaaggacactcgccatgaccgaaatcaacgcggcacgcaccagccttgaggacgtcgaggaggcgctgaaggatgtcatcgaccccgaactcggcgtcaacatcgttgacctgggcctgctgtacggcctgaagtactcggacgacgacggcgcactgctgatcgacatgacgctgaccaccgctgcctgcccgcttaccgacgttctcgaggagcaggtgggcaaggccctggacggcgttgttgacgactggcgcctgaactgggtctggatgccgccatggggtccggaacggatcaccgacgacggcaaggaccagatgcgggccctcggcttcaacatctaaattaagtacgacgacggcgggtcaccttttccagggaaaaggtgacccgccgtcgtcgtttaatgcgggaggctttggcgggttacaacgtcggtgccgagaacgtgtcgcactggttgatgtcgccggtctcgtagcccttatagaaccagcgctggcgctgttcgctggagccgtgggtccacgcctcgggggagacccgcccggtggccgcttcctggatccggtcgtcaccaacagcggaggcagcggacagggcgtcgttcaggtcctgctgggtgaggggttccaggaatggctggccgtcgggcccggcctgggttgatgcatgcttggcccagaggcccgcgtagcagtcggcctgcagttccacccgcacggcgccggattcaggtccctgcggatcctgctgggcctggtcgaggtttcccagcacgttctgaatgtggtgcccgaactcgtgggccaccacatactcctgcgccaggggcccacccgaggagccgaacctgtccaccaactcctggaagaacccggggtcgaagtaggccgtggtgtcggtggggcagtagaaggggccaacagcgctggaggccgtgccgcagccggtgctgacaccctgctcaaagatgaccgtctccggctgcgggtactggacgttgtactgctgcaggtaggcaggccagaaggcgttcaggctgttcacggtaccggtgatacggcagtccacccgggcatccgcgtcagctcctgtatggcaggcgggcgccgttccctggctctgcggctcctgcccggccccggccaagccttccagcagctgtggattgacacccaggagtgccgcgatgagcaggatgagcccaccaccgatgccgccgcccacttttactccccggcccatgccgcgccggtcctggacctgggagggatccagctgcacgttgtcattgaaactcataaagtcacaatacccgcggacccgaagctcaaccggtgccggccggtaaagttgatccgatgcctttcctgaacagaatccagcgctgggccggggaacggccccacgacaccgccgtcgtgattgccgggcgccgcctctcctgggcggagctccgtgactccgctgccgcgctggtaccccacaccaagtccgtgacctccctgtgcgaagccaactcggtcaactttgcggcaaaatttgcagcgggagtggccgcgggacgccaatgcgccgtccttgatcctgcctggccgggcccgctgcaggaagacatgaagcggcgcgtggacgcgtgcgcccaacccgcggcggtatccccggatgacgagctcgcggacggcgatcccgggtccaccttcctgatcgggctcacatccggcaccacgtccattccgaaagccttcacacggtcccggcggtcctggcaggaatcctttgaggcctccatcgaattcttcgggctccgtgcggacgatgtgaccctggcgccgggcccccttgccgccagcctcaatctgtacgcgctggccgaatgcctctacgcaggttcggaattccagacccttgcgagtttcgatgtgggcgacgtccatgccgccatcacccacgaccgtgtcacccggctggtgctggtgcccaccatgctgaggatgctcagcgagcgcggcctgaccggatgcgtggacgcctccggcgtgcggaccatcatttgtgccggctcgaagctggacgcgcggacccttgaggctgcacgccgctgggccccgaatgccaccatcttcgagtactacggtgcttccgagctgagtttcgtctcgggggcggggctggccgccagccagctggcagtactgggtggaacggggatcggccgggcgtttccgggtgtggacgtgcggatcctcgatgattcggggcggcagctgcccgacggggaggccggaaacatctgcgtccgcagcgccatggtcagcaacggctacctctggggtgacgacggggaggccctgaagtcctttgacggctggttcacggtgggcgaccagggatacctggccggaggggaactgcacatcctgggccgccgcgcggacatgatcctcacctcaggcaagaacgtctacccgcatgaggtggagctggcactgtcagcggtgccgggtgtgtccgccgccgtcgccgccggaatgcccgacgacctgcgcggtgagcgggtggtggccggtgttgttccctcccatggcggcatcacggccacacagctccgtgccggacttgaggacatccttgcccgggacaagcgcccgctccagtactacctgctgagcgaattgcccaccacggaccgtggcaaggtcagccgcagcctgctgctggactggatcaagtcccgggaccgcagggtgcgcagccttgacagctgaaatgctcccaccggaccggcagccggtcatcattgccgcgcgccgcacccccgtgtgccgcaccaacggtgccctccggagcctgcgtgcccacgaactgctcgcgcccgtgctccgggagctcctggcggcaacaggggcggcgcccggtagcgtggccgatgttgtgatcggcaacgccgtgggcggcgggggaaacgtggcacgccttgccctgctcgaggcggggctgcccgtcagcgttccggggattaccgtggaccgccagtgcggctccgggctcgacgcggtggtcctggcatcgagtgtggtggctgcgggaggaaacccgctgtacctcgccgggggagtggagagcaccagtacagcgccactgcgcgcatacaggaacgacgacggcgggcccgagttctacgcgcgggcacagtttgtgccggccggcttcggcgatccggacatgggcgttgccgcagaaaacgtggcgcgggagtttggcgtcagccgggaacgccaggacgcgttcgccctgcggagccaccgcctggcgcttgccgccagggacgccggggtgttcgacgccgaactggttccgttggatacaggcgcggggactgcctgtgcggacgatggccccaggcgcgggctcaacgccgccgttctggcgcggttccccgccgcctttgtcgacggcggaactgtcaccgcgggcaactcctgcttcgacgccgacgccgcatccgccgtcgtcatcacgtccctgcagcgggcacggaacctgggcgccggtgacgggttgctggtgctggggagcgggacggctggagtggatcctcaactgctgggcgtcggcgccgccgccgcagcacgggacgtcctgtctgccgcgggggtctccgggggccaggtggacctggtggagttcaacgaggccttcgcgtcgcagacgcttgcctgccttgaccaggtgggaattgatgctgagcgggccaacctcgacggcggcgcgctggccctgggccatgcctacggcgcgtccggtgccgtcctggtgacccgcctgctggcccaggcacgccgggccggaacaccggcaagcctggcgctggccatgatcagcagcgccggcggcatgggcaccgccgcgctgctggaatatcagcggctttaaaacgcgggtgccctggggcgtcagtcttccgcttcaccgaggccgcgggcggcgagcgcctcgcccgtctggcgcgcaaacgccaccgaggtgatgaagacaggaaggatcagggcacgcggattgcgctccagcccccgtgcccgggcggagtcccggacgtcggcgaaggtgccggcgatgtaggggatgctccgcagcatgatggcgatggtcagggcaaaccgctcggggtcggcgccgaagcgcttgaaaggaccggctgccctgaccactccgtcaaggagccgctgcacgggagtggtggcagtgagcagggatgcagccaccacgcagaccaggatgttcaggacaatccgcgccgccgtgggtgctcccagcatccaccactggaacaccccgatgaccagcagcacggcggcgagcggccggatggctgcccacagcttcttcaggcctgctccggtcaggaggaacaggccgcagagcccggccaggactgccagtgacacccgccagtccaccacaatgaacgaggccaggccgcagccgaagaccaggaggaacttcagcgccaggggtgcccggtggatgaaggactgacccggcacgtagttggccaggaggaagccgtggcccctcatcgcggttttcccgccggcaggccgtcccggcacaacatccggtagtggtcgacggcggccgccgcaccgccgtcgaacactacctctccctcttcgatgaccagcaccctgtccatctccaatgccagctcaaggtcgtgggtagacatgatgatctgttggtccagtcctgccagggtcctgcggaggagttcgcggttgcggaggtccaggagcgtggacggctcatcgaggaccagcaccgacgggttcaccgcgagcactgcggccagggccatgagctgccgttccccgccggacagctcgtagatgctctggtctgccaattccagcaggcccagccggtccagtgccgcttcggctgcttgtcgccgttccgtaccgttgcggacggagcggcgcagggacagctccacgtcctcccggcccgtgggcatcaccagctgggacagcggatcggtgaagacaaaacccacgttccggcgcactgtccggacgttgcggaccgtatccgcgccgtccactgtgaccttgcccgccgtcggctggaccaggccgttgaccaggcggagcaccgtggatttaccggagccgttggccccaatgacgccgatccgctgttcggtgagctccaggcttacggcgtcgatcaggactttcggttccggtgtgttgtccgtttcgacggcgaccgttacgcggtcaaaggtcacagcgggcatggcggattccttatgccttggcgggctgggcagcactgcgccggacgcggcgcaccaggatgtccgggaaggcgcggtggagagccacggcgatgacggctgccaggatgttcttcaccatgtcacccgggtagaacaccaggtcgctcaggaaggcctgcccgagcgtggccttggtgttgagcgcgatccccacgatgccgagggagtgcaccacgacggcgctggtgacggcggcagagaggaagaaccacagcgccctggccttggtggtccgccggatcacgatggtggccagccagcccacaacgcaggcggcgatcgggaaggcgatgatgtagccggctgaggggccggcgaggatgcccagaccgctgcggccctggctgaagatgggcaggccggcgagtcccaggagggtgtagagtccaactgcggcgaagccccgtcccgggccaagaaccaggccggtcagcatcacggccagcgtctggaaagttatggggacgccgaagccgttcacggccaggccggggaccagggctgcggcggcaaccagggcggcgaagacggcgatcaggccaaggtcagtggcgttccagcggcggcgcccggtgctaatgggattcttaacggcggtgtcggtgttgctcatggcagtcctgtcggggttgtacaagcggaatctaatgtactgccgacgttactggtgcggaactgcggacattttgtagggggtctactaagcgggttgcctgcagctacatgctgggcacaaagctggtgcgttttcccttccccggtgtgtttgaaggtggtcctttttgatggacaaccgtcattcgatgacgtagcgctgcatcatgtcgttgtcttcgtgttcgaggatgtggcagtgccagacgtattcccccttgaacgatgagccgatggccaatggtgctccaccggctgcgcctgctccgaacggaacacggatccgtgtcacttcaccgggcatcgacactacggtatctttccagccccgctcgttggcgggtgctcccgtggggcggcccctcaggaacggcgtgacgggcacgctgctgccctggcccggcgtcaccagcccggttccaggatcaacgtaaccggtggcggcaaggtatttgccgacgtcgaagcgctggcggttgaggacctggaactgggtgaaatgcaggtggatgggatgcgcatccactgttgtgttgatcagctcccactcctcaagggtgtcgccttccacctcggtgatatcagcggtgtggaaggggcggttgttcagcagggccatgatggggatgcccgccgtattcagcacctccaccagggccatctggcgggatgcagcggtggaaaagcctgccagcctcgtcatgggctcgtctcgcaactgcgccggcaacggcgccgtatagcccgcccggctttgtaccgtgaactgcatgatttcgcggagggggaccccgccctgcttcgccgacacaggaccgtcgggatacggggtgggcgcattgttgcccaaaaccaccttggatccggcaggcaggcgggcaaagtccaccacaaggtctgcccgttcacccgggcccaggaccagcttgttgagcttggccggggtgtccaggaggcccccgtcagtgccgatctgggcaaacgtaagcgcgtttccgcccgtcacgaacttgaggttgtagaacctggcgttggagccgttgaagacacggaaccggtactttccccggtccacgtccaggttcggccagcatttcccgttgaccgttgccacgtccccgaaaaactccggcgcccagggccgtggggtgccgtcgctggtcgtcagctccggattgggcgggtaagcgaaggatccatcgggattgaacatccggtcctggataaccagcggcacttcgtaagggggcggcgggaggtgggttccgtctccggtgtcgattccggtcccggacggccccggggtgtcccggataaggtagccgccggccagcccggcgtagacgttaaggcgggtgatgcccagcgcatggtcgtggtaccagagtccggcggcatcctggttgttgtcgtagtggtaggtgtaggaactgccgggggaaaagacctgttcagggccaccgtcggacccgggcctggtgttgccgccatgcaggtgggtcgaggtccgcggggcgttggcgtcgtcgctgccgggcggcaccagttcattgtcgatggcgaatgccagcgggtgcttccgctctcccagctggttgtgcacggtgagggcgaacggggtgccgcgctgggtgacgatgacgggcccgaggtacgtctgggatgcgccgtcggcccggtaggtgaacgtgtccgtggggtcaagctggctgtggaagttgtgcttggcgttgagcatagacagttcggcctggccgcccgcccgcatatccaggacccccagttcggccagcgtgggcaactgctcggagaactttgtcaggggaccggcctgccgggcaagtgtgcgggcagcgagggcggcatccgggtggaccaggatgccggtgccggctactgcaccggcctgcaacagctggcgtcgggttagatacatcgcggactcttttcgctcgaaagatgagtccccccttgattgacggtacgagtccggtgcgggtctggaacagggccgttagacccgcggtttcaacgtcggtggttcaggagcgcaagataaccgtgccaaacagatgtggccgtgagaactacgtcgtgaaggggagtacggtgggttcggttccgtatccactcgcgagccgtgcacatttgatgagcgtcgtcggtgtcatcgatgctgaagcggaactcccgtcccagctcatgaaccaagtcatcaataagaatggaaattgacccgaacgccaacatattctcgtggaaatgtccgcgccttcggctggcatccaggagcgtacgctcctcaaacactctactgggagcgttcaggcggaggactcctgaaaagctgatgccccctgatttgcaggccgcggccgattcctcaaaaagatcagccagccccggatcgccgccaaatttttagatgcgagaacgcaggcaggtagatcactcccgaatcggtgacggtccagtccccggcctgcactgattgatcgagcacatggtcaatgacggccttctgtcgccttagtccgggttcagccgaaagacgcccagcagcggtcaattcgtgtaggggctcgtgtatgggcaccattgcgggaggcagggttttaggaaggtcgtttttcccgctgccgggggacccatcacctctattgccattgcaccaatctactcatcacgctcatccgcggcccgcggttcacggcgcctcaagattggctgaagaaatccgcaggatggaaacgttcccttccttccgccgtcagtgcttcctatggtgttcttacaagttcgtctaggggggactctttgataaccgccggtgcgcctgctggaagaagaaacggtagagccatccaccagcagtttcgtcccgcatacggtttatgtatccctgccccggaacgaacacaccctccctcaccgcaggccatgccgatttcgactcccgcccccgactgggaaaggacccgctgatgagatatcttccgcccgcactcatgtccgatggccctccaagcaagatacgcgggatcgtgtggatcgttcttggcgcggtcgtggcgatctcgctggtcgcgtttgcggtatttactgccaccaggccggcgccggcagcccttcaatcgccagcgaaaaatgtcatttacctgctgggtgacggtatgggccgcacgcatgtcacggcggccagggaacgcttctacggtgccgagggcaggctcgtgatggaaaccctcccgtcccatggttcggtcagtacgtattcggtagagaagaattccggccagccgggtcaggccggtttcaggccgcagccggtcaccgcgtccccggctgccgccacggccttcgcctccggggtgaaaacctacaacagtgccatcggggtggacgccaagggcactgtggtgccaaccatcatggagttggccaagcaggccggctaccgtacaggcaatgtctccaccgccgaagttaccgacgcaacgccggccgggcagatgagccacgtccttgcgcgtggctgccagggacccgattattccgccgacgcgtgccaggacaccgatatcaccggcgaaaagttgcccaccagcgatgtccgggtcactccgatcgcagaccagatctcccgcaacggcaccgctgacgttatcttcggcggtggcatggcccgcttcgacgccaaggatgaaaccgcgctgaaggagcagggctactccatcctgggatcggtctcgagccagattgccgccacacgcgccgacctgaacggggcctccggtgaaaaggtctttggcctgttcaatacgggaaacctcacccttgaaaaggccaagaaggacaacccggacgcaccccaggcggatgagccgtccctgcaggagatgacaaagaaggccatcgaactgctgaaccgggatcaggcaagcggcaaaggtttctacctgcaggttgaaggcgccctcatcgacaagcgttcccacgacaatgacgcggcccagacactggatgaagtcaaagccttcgacgacgccgtggccgcggccgttgacttcgcaaaaaaggacgggaataccctggttattgccaccgcagaccacgaaacggggggtttcaacatcatcgaaaagagctccttcactaacgcggaagcagccgggccccccgtgaacgtcgattccgggaacagcgccaacagttccaccccgacccggaacggcggaaacttcaaagacgaggagcgctccacaggcatcatcaacggcgaaggctcaacggatccgaagaacttcggcccggccaccttccggacccccaatgatcccgccgatgtcgaggacggttccaaggaagcgagtctctggctgtcctacgcctccggaaaccacaccggcgcagacgtgcccatatacgcctacgggccaagtgcggaacaactgcagggcagcgttgacaacaccgacctgttcgacctcgtgggccaggccttgcgcgtcctgcgctgaggttagcgtcaactaccaccggagactggccgctccgggtattggacaccccgcggccgcccgcacacccagaggggactcgatgaaccgcaagccccggattctcctgatggcagcactcggtgccgcgtcgttggccgtgattgcctccgccctgctgggtggtggggcttcgacccctacacccagcaccgacagcgtcccgccggctgccgcggccgccaaaacaacgttccctggcctggtcagtgccgcaggggaaccggacttggcaggactccggacaacccggccagccccgggccaaatccttaaaatccaaggcccattcgatgacaggatcgtgttcgaaggcctggcttttgagggacaggctgccaccgggacagtcagagtcaccagcgatgtcagcgacctgctcgaactccaggtgctcgccggcttctacgatgaccgcggcaaccttcttggcactgcccggttcgtgcaccatctcggcactgaaggccatgaacacgcgggaccgtctgaagaaggtgaagcgttcaccattccggtaccggccgggcttggaccccaagctgtctcagcagcagtaggcgtacccgtcctcgtcaacgagtagcccggaaactcgcaccggctcgccagcacgtgcacggaccaggcaaacatggttccggtttccgctgaccgtatccctcccggttcccgccggataagatcgctcgtgagatatccgtgaggaccatcccggcaatgaaactacctctgagaccattcagccgccgcgcgctcctgcaaggcgccgctgccggcgtcgcaagttccgctttgttcacggacaaacccaccgcgtcccgcgtgggcaggaacacccggtatgtgagcgtctttggttccgactcggacccgggcacggaggcagctccgtggtgcagcctcgcccgcgtccaggatgccctcagcaacggggacctgcgcctcggagacaccgtcctgctcaagcgcggcgacacattcttcggcaccctccatgagccgtccatccggggcacggggggcgtcttcacggtgggcgcctacggcaccggcccccgcccgaagattgccggctacaaggtcagcaaaccggcctgggtccagcacaccactggggtatggaagctggacatcactgcccggtccggccagtacagcggcaacatcgccgcgccgtccaccaatgtcggcttcctgaaggtagcgggcctcatccgtggatggaagcggaccagcctggatgcactggcgaaccagtgggacttctatagcgacgagacttttgtgtacgtcaggtcgaactttgacccgggttacggcgtcgctatcgccgtcaagcaagacggcatccggcccgcatccaacagcgtcctggatggcatccatgtcgagggccatggcgcccacggtattgcgacgggcggctcggaaaacatccgcatcaggaactgccgcctggaggaccttggcggatcccaattgagctccgacgccacccggtacggcaacggcatcgaggtctggatcggcgcatccaacatcatcattgaggacaacaccatccgggaatgctacgacgtcgctttcaccatgcaggggacggcaaccaaggaagcaaagtcgtggaccaacatccacttccggaacaaccgggtcgagaactgcaaccagaccttcgagatgtggtctgccggcgacgcgactccagggtccgggcacatccgctgcacgttcgaagacaatgtctgcatcaacgcgggttactcgtgggccgccaccatccggccggacacggcaggcaagggcacccacatcctgacgtatgacaccgaactgcccatggatgtagaggtcacccggaaccagttcatcggcgcacgggacagctatatcaacatcagtggagacaggacggcccccgatgggctgaacctgcatcacaacatcatcaagctcggcccaggtaagaagaccgcctaccagaacgcggagaccatcgagcaggccgcacactggcaggcccgcaccggtaaggagcgcggctcaacgttcggtgtgctcaccaccgatcgttgcgaagcgcagccatgaacacgcagtgaaacatccgggtcggatgctcaggatttgatcaagagcattgcttggatggctggcgaggcctacggtcaggtgcatgactccaagatcgagcagggaagacgcctgcgcggcgggacccgaagggtgaacggactgatgcggcagcggaacttccctaacgcaggcgggctctgtgtcggcgccctgatcctggccatatcgctcatcgcccagcctggtgacccaaattcggtgatagtcagggacctcctgatcaccttcagcgctgtcttcaccggagccaatgcggtggggctcctggaacttcgacggcggcaggaagttccggacgtactgaacaagaaacccacctagggttccataacacccacgtccttcctgagggggctggcggagtgttctccgtccagtgctcgcgccgtcatggaacgagcctgacgtcctcgccggagagccttgcgcggaagccgtcgccttggaccgcgatgtcctgaaggacgaggccttcgggcaggccctcgatgctgtgctcaatggtcacgagccttctcactgcagcaccgacagagtcggagaggaatcccggcccgccaaagtcgatcgagcgcggctcaacaaccagcctgccggcgtcgaccctgactgtgcccgtggcgttgacgcgcagctcgcggcccaaagcctcgacggtgcggaccaccagaacctggccgtcatcggcggcgcggaccacggtcccaccaccgagttccccggcgacgacgtcgaacggaacggtcgcgtccaccgcgaggcgttcagcaaccatcccgcccggccccgtgaccacgccctgccctacagcactgacgtggtgaagcaacgagccggcgattgccactgtcccggcgtccagcgcaagatcggcgagccacacctcgtccccgcgcaggtcggcgggaggcccagcgcccgccgtgggttcagcgcccgccgtgggggtgggagctggcgctgcctcatccccgctggctggactgctcaccacccaccacgcaattgcaactgctaccaccaggacaatgaccatcccaccagcaccgatcagccagtccttcgcacgcatccactccatgaggacagtctggtggctcacccactgggctgcgaaaccccaaaaccacccacgctgctatctgccctgcctcggacccccatgaactgccggagagcctccacccaggattcgaacgcatccagatggctgtcgtgggaagccccggccaaatccacgcgctggaccttgcggccgcgctcgcagaactcggatttatcctccgcggtgaacatcccgtgttctccgtaaacaacgagtgtcggcgcagcaatgctttcccactcgtcccagcggggctcggccactggcttgatcgcggccaccaggacgtcagccttaaaccgcggccacaacccgtcggccttttcctccaggtcagccacccacgcccgcgccaaaggtccgtccccaaggaaatcctgtgctgctgagcggcttgcgaagggcaggggaaaggaccggaagtattcacccaaaagttcgtgctcgtccccgttgccgccggcggctccggactcgagaaggaccagccgggacaccaggtcagggcgcgcggccgccaccagcatcgccgtgtgcccgcccaaggactgccctatgagcgtcacgggagcaccgacctttgattcgataacacgtacgacgtcggcaacgaaggcttcgcgggaaaggtcacccggccgggtagtacttctgccgtggccgcggagatcgatcagaagggtccggaattccggcagcgcgagggccgtctcgacgaactcaagcgcactgccggccaatccatgcaggatgaccacgggcgctgcgtcggcgggacccatctcgatgccgtggatgtgaaccccgggtccggtctggactccgaaagtccgtgcagggaagtccatcgctgtcatgccccccaacgctagctgtactgtcccggcaggttggtgacacggctggccggtggctgacccctgagtgaggtgtggcctcgatgatgattgtagtgatggagccagtcggggaaagcgttaacacgctcggcctctgatttgtaggggcgggcgtaggcccattcgtcgagcatggtgcggttgtagcgctctactttgccgttggtctggggacggtacgggcgggtgcgtttgtgcttgatgtccgggcccagcgcgtctgtgaaggcgtgggagcggtagcaggagccgttgtctgttagcacccgcttgacggtgatgccgtgggattcgaagtaggcgttggcgcgtgcccagaaaccggctgccgtttctttcttttcatcggccaggagctcggtgtatgcgagtctggagcggtcatcgacggcgttgtggaggtagtggtatccgggtctgcggttggccgcggtaccggttctgttacgccagccggcggccctgccgaacgcgcggtggccgccgccgtcggggatccggccgagtttcttgatgtcgacatggatcaggtcccccgggcctgtcgtgttcgtagcggcggatcactcgtccggtgccacggtccagccaggtcagtttcgccagccggtagcgggacaggacccggtgcacggtggaggggtggatgcccagcagataaccgattcttgccggtccccagcggcggttcacacgcacggcgatgatccgccgctccgtacgtgttgccgtgcgccggggcgaacaatgcgggcggctggagcggtcctccatcccagccgggccgtgctcgcggtagcgctgtgcccagcgagcagcagttggcacggagacctgaaaccgctctgcagcccggcgcaggttccagcactgatcaacgacacattgcgcgagctgcagccgcccccggggcgtcagaagagcgttagggtgggacatgaagacctccgtgcgtggaattggactctagacaagccccactccacccggaggtcttcttcatgtcaccaaaccacgccgaacatcactaacgtccgtggtcaatacagctagctgacagggggctgcagacggagcgttctgcgtggagggcgccggacggtagacttggatgggccgttctccggccactctgccccggctccctcccaacatcgtgcgagggctgcggcgttccctgttgtgaaaggccttacctgctgtgattactgtccaggatcttgaactgcgtgccggcgcccggctcctgatggaccaggtgagcttccgcatcgacaagggagacaagatcggcctggtgggccgcaacggcgccgggaagaccaccctcaccagggtcctcgccggcgaagggctccctgccgcagggaaagtgacccgtaccggcgagatcggctacctgccgcaggatccccggacaccggacatggagcagctcgcgcgggaccggatcctgtccgtccgcggcctggacatcgccgtcggaaaactccgcgtggcgcacgaagaaatggccagcgaggacgccgcggtccagcgcaaggcgatgaaccgttacgaccgccttgagtccgagttcctggcagccggcggctacgctgccgaggccgaggcggcggcaatctgctccaacctcgcgctgccggaccgcctgctgaaccagccgctcaagaccctgtccggtggccagcggcgccgcgtggagctggcacgcatcctctactcggacgccgagaccatgctcctcgatgagcccaccaaccacctcgacgccgattccatcgcctggctgcgtgacttcctgaaaaaccaccagggcggcctgatcgtgatcagccacgacaccgaactgctcgaggccaccgtgaacaaggtgttcctgctggacgccaaccgcgcgcagatcgacttctacaacatggactggaagcgctacctcacccagcgcgaaacggatgagcgcgcccgtaagcgggaacgcgccaacgccgagaagaaggcccaggttcttttcgaccaggccaacaagatgcgcgccaaagccaccaaggcggttgccgcccagaacatggccaagcgcgccgagcggctgctcagcggactcgaggccgtgcgcgagaacgaccgcgtggcagcactgcggttcccggacccctcgccgtgcggcaggaccccgctcaccgccgagggcctcagcaagtcctacggttcgctggagatcttcacggacgtggacctggccatcgaccgcggctccaaggtggtcatcctgggcctcaacggtgccggcaaaaccaccctcctgcggatgctcgcgggcgtggaccagccagacaccggtgacgtcatcgccggccacggcctcaaggtgggctactacgcccaggagcacgaaaccctcgacgtcgaccggaccgtcctggaaaacatgcgctccgccgcccccgacatgaaggacgccgaagtccgcggcatcctgggttcgttcctgttctcaggcgacgacgtcgacaagcccgccggcgtcctctccggcggcgagaagacgcgcctggcccttgccaccatcgtggcctccagcgccaacgtcctcctcctcgacgagcccaccaacaacctggaccctgccagccgcgcagaaatccttggcgccctcagaaactacagcggcgccgtcgtcctggtcagccacgatgagggggcagtggaggccctcaacccagagcgcgtagtgctgctgcccgacggcgtcgaggaccactggaacgaagactacctggacctgattacgctcgcttaagcgttccacgcccgctggctccgctgcgcggcgcaggcgatttcccgcgtgctggctcgttcctcgcctttgacgcacgctacataaatcacccgcgccgcttcgctcgttcctctggagccttacgcttcaacgcacctttagttccagggcttcggttatttcttgaagctgccggtaggtgatgctgaacatggagtggtggtcgcctgcgcctgcccagaggcgctggtgctcctggaggctcgtgtcgaggagcgtccggactttttccgggtgacccaccggggccactccgcctaccgcctggccggtatgctgtaggacgaattcgggggaggcgcggcgtatcctgcccgcccccaactcttcagcaaccagtctggtatcaacgcgggcagcaccgctggccaggatcagcaggggctcgccgttgaggtcgaagatcaagctgttggtgattgccgctaggtcgcattccagcgcctcagctgccgcggacgctgtcggaacgcccgagggaaaagtccgcacggtgtccccaactccggcagccaccaaggcggcgcgcaccacagcaaccgggccgccgtcgtgctccgtcatccgtcagtacccctgcgcatccaggagtgcgtcttcctcttcttcggaggtcgccttcttccgcttcctgggaggtgacggacgacggcggtgctcgccgcgtgcggggcgggccgcgccctctggtgccccgtcgtcgtcctcggcgtcaatggcggcgttgcgtgcctgctggcgggcagcgtagccaaaaccgacgaacatcagcacgccgaacgcgaaccactgcagcgagtacgaaaggtgtgtgccttcctcggtggagggtttggggaacgggaacggcatgtccgccgctggcggtgtctccgacgcgagctggccgtacgccccggtcaacagcggatacccgagctgtccggcataagctgcaaggtcgatggaagccagctggccttcgggggcgccgcgctggagttcgggctcgggatgcttcaaacgcacgacggcggtcacgtcacccgcagggggttccggcaccgagtccggggcgcccggattatcgttgccgatgggcagccaccccctgtcgatgacgactgtctcaccggaggcaaggcggaacgggaccaccacttcgtagcccggctggccattgagcggacggttccggacgacgcgctggccttcggtgagatacgtgcccctcagctccacctgggtccattccatggcggggtccagctcgttgaattgttcccggacgtccgcgaacgggatgggcgttgccgagtaattggtcaccacacggttgatttcagccagggtttccgcacgccggtccatctgccagcggcccaggaacacgcaggcggaggcgaagatggcagccagcagcaaataacccagccacttgctggagaagaggaaacggtacattcagctgtcctgcccagggtcggtggacgcccgcgagtcatcgaggggcagggtttccttccagaggccccgtgtctgaaggtagtcctccagccattcccggtggtcggcgcaggcaagccaggtcttgcggcgttccggcgagtggatcttggggttgttccagaggagctgccatgaagcctgcgcacggcacgccttgcgggaacagatggcaccggcttccgccgctgcgggatcggttccggcggcgaagtcaaagatgctcacgaggccttcctttcctgcccggacggagattcgtcgtcgtcaataatcagctcgccctgcaggagttcactgccgggatcctcccgggcgggcggcaccgccgggccttccagctcagccagcggggccgagtccagcaggaggtcgctgtggccctccgctttgtcattcccgtttgcgatgatcaccgcaatccaaggcaggaacaccgccccggccactggaatgatcttgaaccagccgtccaccacgaaaatcaggaccaggcacaccatgcggattcccatggccaacgcgtacttgatcatgcgctggcgcatgtcttccgaatgggctccagcggcatccgtgatgctgtggacttccgaatcgccggagaaccggccgggttctccaggcgcggattgtcccgcatgattttcaagggtcacggtggtttatcacgctccaaaggcttgcatcaattctctcaccatcagcagtggcgcccaaacccgggccggggcgggcgctaagatcgaagtcagccaaatcacccctatctacagcggccccagcgcgccgcagaattccggagcctctttcatgactgaagcagccaccgccccccgcagcgtcctgatcaccggcggcaaccgcggcatcggcctggccatcgccgaggccttcctggccaacggcgacaaggttgccgtaacgtaccgcagcgaaacgaagctgccggagggaatcctcggcgtcaaggcggacgtcacggacgaggcttccgtggacgcggccttcaaggaagtggaagctgcgcacggtccggtggaagtcctggtggccaatgccggaatcaccaaggacaccctgctgctgcgcatgagcgaagacgacttcacgtccgtcatcgacaccaacctcaccggggctttccgcgtcatcaagcgcgcgtccaagggcatgatccggctccgcaagggccgtgttgtgctgatttcctccgtatcgggcctgtacggtgcgcccgggcagatcaactactcggcctcaaaagcgggcctggtgggcatcgcacgctccctgacccgcgaactcggttcgcgaggcatcaccgccaacgtggtggcgcccggcttcatcaacacggacatgactgccgaactccccgaagccacccagaaggactacctttccagcatcccggcgggccgctttgccgaggcctccgaggttgccaacgtggtccgttggatctccagcgacgaggccgcctacatctccggagccgtcatccccgttgacggcggcctgggcatggggcactgaccggcgccggcaaactagcagccaggcgcttctttgtgtaggtcacacaagggaattggccggggccgctggcatgatggactgcaggccatcagcaatttagacgtttcagacaaaaggagcccgcatgggactgctggataaaaagactgccatcgtgaccggatcctcccgcggaatcggcgcggaggtagccaagaaccttgcccgcgagggcgccgccgtcgtggtgaactaccgccagaaggcaccgcgcgccaacaaggttgtgcaggggatcgaagccgacggcggacgtgcagtggccgtgggcgcggacctcactacccaggaaggcgtgcaggcgctggcctccgccgccatggagaacttcggttccctggacatcctggtgctgaacgcctccggcggcatggaaaccgggatgggcgaggattacgcactcaagctgaaccgtgacgcccagatcaacatgctcaatgcggccgtacccctgatgaaggaaggctcgcgggtggtcttcgtgaccagccaccaggcccacttcatcaacacggtgcccaccatggaggcctacgagccggtggcccgcagcaagcgcgcgggcgaggacgccctgcgtgaactcatccccaacctggaggagaagggcatcaccctggtagttgtctccggcgacatgatcgaaggaaccgtcacggccacgctgcttgaccgctccacgccgggcgccatagaggcccgccgcgctgaagccggcaagctgtactcggtggaggagtttgcagaggttgtggccggcatggtcaccgccgacgtcgagtcaggacacaccgaatacgccggcggcgcagactacttcggcaagggcacgaactagctctacggttatatgcaagatggcacgtcgcaccgcgacgtgccatccggcatttaagggggcgggttttactaccgggttcagacgccggcgacgtgccggactgcgtcgaggtacggcatgttgacggcggcgtctgccacggcccgcacggcgggtttggcgttgaacgcgacgccgatgccggccgccccgagcatgtccaggtcgttggctccgtcgcccacagccacggtgtgctccagggcgatgccctcggcggctgcccattcgcggaggtacttttccttggcggcgcggtccaccactgcgcccagcaccttgccggtcagctcgccgtccacgatctccagctcgttggcctgccagtagtccaggcccagctcggcggcgatcggctcaaggatctggttgaacccgccggacaccacggctaccacgtgtcctgccgccttaaaagcggccacgagttcggcggctcccaggctcagctttacttcgttgcggacggaatggacgacggcggccggcagccctgcgagcacagccacgcgggcgtgaaggctttgggtgaagtccagctcgccgcgcatggcggcctcggtaacggctgccacttcttcccgcttgccggcgtaggcggccaggagttcgatgacctcctgctggatcagggtggagtccacgtccatgatcagcagcttgcgttccgccgccctgaggccggccgggacgagcgccgtgtcgagcccggcgatgggggcttcggcaacggcgtggcgcagtgctgcgagcccggcagcggtggcgtccggaagctggagttcggccatgtggacctggtagcggctgtcgccggaggaggcttcggacagcacggcagcgccctgggcggtgaggatggaacggagctgctccagcgcggttggagacacattcaggccatagctgacggcagtcacgttcgaagtcatgcctgccatcttagccagcgggggaggggtcccttgaattcattgcatgtctgctggaaggtggcaagcggacaataattacgttcacacctggaggaatcattgattgaactgctcacgccgcaggagattgacagggcccgtccctcgggccagttcgtcgctaatacgctgcgggacctgagggagcggaccggacctggaacgaatctcctggagatcaacgactgggctgcggccatgatcagtgcagcgggagcccgctcctgctatgtcgactacgctccctcgttcgggcgagggcctttcgggaaagtcatctgcacgtccgtcaacgatgcagttctgcacggactgcctcatgactacgtcctcaaggacggggacctgctgaccctggacttcgcagccagcgtcgacgggtgggttacggactccgccatcagcttcgtcgtaggggatgccgctgcccccgaggacacccgcatgatcgaaacaaccgagagggcactgatggcgggcatcggtgcggctcagtccggagcgcgcatcggggacatctcccacgcaatcggctccgtgcttgagtcggccaactaccgggtcaacacccagttcggcgggcacggcgttggaagcaccatgcaccaggacccccacattcccaacaccggcaaagcaggccgtgggtacgagctccgccccggactgctcctggcaatagaaccgtgggtcatggacggcaccagcaaactttttacagctcccgacggctggaccctctgcagttccaacggccgccggaccgcccattccgaacacaccatcgcggtcactgaatccggtcccgtcatcctcacgcaaccggcctgacgggcgcctggcgaagctgcgcaatcagcgtttcgctgttaccttgccccggttatcagtcggcctcttttttgtcctagtgtctactcctatgagtgatgttctggaattggcttccgtcagcgttgtccgaggtaaaaaaaccctgctggacaagatcgactgggaagtcaatgaaggcgagcgctgggtaatccttgggcctaacggtgccggcaagaccaccctcctgcagatcgccgccgcgcgcctgcaccccagcagcggcaaagccggcatcctcgacgagaccctgggccgcaccgatgttttcgagctccgcccgcgcatcggcctgtcctccgccgcgctggccacccagatcccggaacaggaaaacgtcctcaacgtggtggtcaccgccgcctacggagtcaccggccgctggcgtgagggatacgagcgcgacgacgagcggcgggctttccgcctcctcaacgactggggcatgggtccgctcctcaacaggacttttgccaccctgtccgaaggtgagcgcaagcgtgtccagattgcccgtgccctgatgaccgatcccgagctgctgctcctcgacgaaccggcggccggactggaccttggcggccgcgaggaactcgtccacaagctgggagagctggcacaggatgaggacgcaccggccatggtcctggtcacccaccacctcgaagaagtcccgccgggattcacccatgccatgctgctgcgcgacggcggagtggttgccgcaggcccgattacggacgtcctgaccgctgagaacctcagcaagacgttcgggcttgacctggacatgagcgtcaacgccggccggtacaccgccgtcgcccgccgctaacagcggcagcgcagcaccttggatcttctcagcagcattcttgtggccatcgccggcctctgggccggcaccatcaatgccgtggtgggttccggcaccctggtgacattccccgtcctgatcgcactgggggttgccccggtggtggcctccatgagcaacgccatggggctggtgttcggcactgcggctggcgccttcggctaccgccgggaactgaaggggcgcggacgccagctgatgcggctcctgccggcttccctcctcggcggtatctccggcgcctacctcctcctgcatttgccggaggaggtcttccactacgttgcccccgtcctgatcgtcctggccctcctgatggtgatgttccagccccggttgcagtcatgggtgcggtcccgtgaggagaacccggaacacgctgtgcgcgacaagcggcacggcgtcctgctggtggtgctcgtctatctggccggtgtctatggaggctacttcgtggctgcccaggggatcctgctggtgggcatcctgggtatcttcctcaccggcaccatccagaacgccaacgccatgaagaacatcctggtgctgggagtgaacctcgtggccgccgtgtcctatgtgctcttcgccttcgaccggatcaactggcttgtggtgctgctgatcgccgtcagttcgagcatcggcggacttctcggtgcgaaggtgggccgccggctctcacccacggtgctgcgcgcagtgatcctggtcctgggcctggtggcgctgggattcatgatcgctaatctgctgaaataatcacccggtgacaatccactatcttgaatccgccgcggacccccgggtctccgactacacgcagctcacggacgtgcacctgcgcaagctgcgcgaacctgccgagggcatgtacattgccgagtcatcccgggtgctgcggcgtgccctggcagcaggacaccagccgcgctcgttcttcctggcggagaagtggcttgaggacctccgggacgtcctggatgcctacccgcaggttccggcgttcatcggcagcgcggccctgttggaggacatcaccggcttccatctccaccgcggcgccatggctgccatgcagcgcccggcgcccgtcccgctgccggggctgctggccggggcacgcagggtggccgtcctggaggacatcgtggaccacaccaatgtgggcgccatcttccgctcggccgccgcgttgaacattgatgccgtcctcgtgtcgccccgctgcggggaccccctctaccggcggagcgtccgggtgagcatgggcacggtgttccaggtgccgtgggcccggctcaccatctggccggaggacctttacctgctcaaggaccacggcttcaccgtagcggcgctggagctcactgacgacgcacaggacgtggatgccgtcgccgcccggaaccccgggaagcttgccctggtgctcggcaccgagggtgccggcatgagcgccgtgacactcgccgccgtcgacatcgccgtaaaaatacccatgcgcaacggcgtggattccctgaatgtcgcggccgcatcagctgttgccttctgggagctgcggccccgggactagggccggcatgtggttcgcgggcacccgcgttctccgctatcattgatagctggctgtagtgcgcccccgggcgacgctggcgccatcccattcatacctggcagctggcaaaatccagttgtgcgaacaaaggtccaattatgaagtctgatatccacccgaagtacgaagctgttgttttcaacgacctggcttccggcacgaagttcctgaccaagtccaccgtttcctcctcgaagaccatcgagtgggaagacggcaacacctacccggtcatcgatgtcgaaatctcctccgagtcccacccgttctacacgggcaagcagcgcatcatggactccgcaggccgcgtcgagcgcttcaacgctcgcttcaagggcttcggcggcaagaagtaacatacttccgcaaggttcttttgggaaagcccgcaccggttaacggtgcgggctttctgcgtcccggcagtctgttacgggcggccggcaattctggggcaggatggaaggcatgaccgccacaccttctccagcacagcactccgcctcccgtcgccacggtgaatacaaagtgcccggcggcaagcttgtggtggtggacctggatgttgtcgacggccgcctcgccaacgtcagcctcagcggcgactttttcctggaaccggacgaggccctcctggacatcaaccgggggctcacggggctgccggacaccacgacggcggctgagcttgccgccgtcgtatcctcttcgctgccggccggcgccggcctgttcggcttctccgcggacgccgtcgccgtcgccgtccgccgtgccctggcgaaggcaacctcctggtcggaccaccactggaacctcatctcacccaccgtcctgcccaccgaaatcaacgtggcactggacgaggtcctcaccgaggaggtcggcgcgggccgccgccaccccaccctccgcttttgggattggcaggagccgtccacggtgattggcagcttccagtcctaccgcaacgaggtggaccccggcggcgttgccaagcacggcattaaggttgtccggcgcatcagcggcgggggagccatgttcatggaggcgggcaactgcatcacgtactcgctgtacctgccgcagaccctcgttgacggcctcagcttcgcggactcctaccccttcctggacgcatgggtcatggcagcactggagaagcttggcatcaacgccttctacgtgcccctgaacgacatcgccacggaccagggcaagatcggcggggcggcgcagaagcggcttgccaacggcggcatgctccaccacgtcaccatgagctacgacatcgacgccgacaagatggtcgaagtcctgcggatcggcaaggaaaagctctcggacaaggggacccgcagcgccaagaagcgggtggacccgctccggcgccagaccggactggcacgcaccgccatcatcgccgccatgacggaggtcttcactgaccggtatggcgccacaccctcccagctgacggagggcgagcttgccaccgcacgggagcgcgtcggcagcaagttcggcactgccgagtggctccaccgcgtcccctgagcccatccactgcgctgatgccggggttgggtgcgcagggaccgcgcctgcgcacccaacctgggtttaactgcgcgggacggtacggagtacgcgctgttagggtgccggtgaattgacgacggcggcctgcgccgtgagtgcgcgcagcaggtggctgcgctgctccacgatgatgcgccgcagggcgcggggagcgtccgcgttggcggccagccaatcatccgagcgcaggatgacggggtgcgctgcggggtcgttgccctcggccaggtcctgggccagcgggtagaggccccggacaatccggctggcgatctcgatgctgcgttcctcccacacgctgcgcaggcacccgaaatagggctccacgtacggctccagcagatccgcgggcgccgtcatgaacccactgatggtggcgctgagcagctggttggagagctcgttcccgtccactgccgctttccacgctgccgccttggcctccgggtccgggcgggcggcgagggctgtggcatggccggcgcgtccggacgccgtgctgtcacgggcgagttcggcgtccagttcttcaattgtcgcctggccattggctgccagggcatgccagagctgccagcgcagctcggcatccacggccaggccggccactgatgccgtgccgtcaaggagtccgcgcagccggggcagcatggcatcatcgtgccggctggcgctggcgagggttcgtgcccaggccagctgctggtcggagccgggtgcggccctgtccagttccgccgctgcggctgacaggaacgtggagcgcagggcatcgcgttcgccggccggcgtgtagcgttcgacggcggtgcctgcgttgtcgaggatgttcagcaggacgccgattcctgattcggccggaccaaacgcagccacggcttcgacgtactgcgccgccgggctttccccgtcccgggccgagttccagagcgccgtccagcagagggcgcgggccatggggtcctcgatacggtccaggaacgtacggacagttgcctcagacgcggggtccagccgcaccttggcgtaggtgaggtcgtcatcgttgaccagcaggagcgcgggccggggcttgccggcgagctgggggagttccatccgggcacccgccacgtccgtttcgaagctgtcggtgcgcaccagggccccgccgccgtcgaaattgtaggaaccaacgcgcagccggtgcggccgcagctcctcccgtcccgtgaccgggtccgcggctgcctggacgatgaccgccctgcccggcacgccgtcatcatccgcgcccggtacaacctcgcccggcacaatctccagggacagcgtggagatgcccgaggtctgcagccactgctgcgcccagccggccaggtcccgtccggaggaggcactcaatgcggcgagcaggtcctcaagggttgtgttgccgtacgcgtgcttgcggaagtactcgcgtgagccgctgatgaacgcctcgaacccaacgtaggccaccagctgcttcagcaccgaggcgcccttggcgtaggtgatgccgtcgaagttctgcttggcggcttcaaggtccgggatgtccgccacgatcgggtgggtggtgggcagctggtcctgcacgtaggcccaggccttgcgcttattggcgaagttcacccacgcggtgtcccagtccgtggcacggtccacacccagggtgcccatgtagtcggcgaaggattccttgagccacaggtcatcccaccactgcatggtcacgaggtccccgaaccacatgtgcgccatctcgtgcatcagggtattggcgcgcccctggtactgggcgtccgttgcacgcgaggtgaacacgtagctctcggtgaacgtcaccagtccagggttctccatggcaccgaggttgtattcgggaacgaaggcctggtcgtatttgccccagggataggggtagtcgaagagccggttgaagaagtccagcccgtttttggtaagccggaacagatcggcggtgtcaaatgcgtctgccatcgatgcccggcagtacagggcgagcggcacgtccagggaggtgccgtcgtcgagcgttgcctgccagcggtcctccgccttgaagtacggcccggccagcaccgtggtgatgtaggtggacatccggccggtggtggcgaagtcccaccgggcggcggagggatcgctgctgaggagggtgcgggccgcctccccgccgttggaggcgacctgccagccggccggtgcggtcacatggaaagtgaaggaggccttgaggtcgggctgttcgaagttggcgaagacccggcgggcgtcggctggctcgtactgcgtgtagaggtagcactggccgtcggccggatcgaagaagcggtgcattccttcgccggaacggctgtacagggcggtgccggtgacagccacctggttttcggactgcaggttgtccagcctgatcctggcgccgtccgccacgtcctccacgcgcagttcctccccattgaggaaaacactgtggacctcgccgatgaagtccaggaatgtcgatgcccccggctgcgaggccgcgaaggtgatgatgctgcgggttggatagcccgccacctccggatccgccgcttcccgcacgtccagggacacgtcgtaaccggtggtgctgatcagggctgaacggtgggcggcttcatcgcgctgcagattctcatgtgacacccagctatctaatcacgcggttatccggcgatcagcagagccgccgccagccccaggagggcgatcaggaaccatgaggccagtgccgccagcagcgcccgcccgccggtgtgcaggagcgtccggatccggacggctgaccccaggccgaagagcgcggcgcccagcaggatgtcctgcagcgccgcccccgcctcgagccagccttcagccagccagccggtggagcggaggcccaccatcgccacgaagcccaggacgaacagcggcaccaccggcggcagtttcgcgttgttgcggtccgcggggtcctccgcccgcggcgcgaaccggtggtgggctccggcgagtgccgccaccggcgccagcaggagtacccgcgtgagtttaacgacgacggcgatgcccagtgccgctgtcccggcggtttgcgccgtggccaccacctggcccacatcgtgcactgacgcgcccgtccaggcgccgaacacgggcgcgctgagccggaggggatggaccagcaggggcaggacgccgatggcaagagtcccgcagagcgtcacgagcgccaccggcaggacggtgtccacgtgccggatccggcggaccgcggccatggcgccaatggcggaggcaccgcagatcgagaagccggtggccaccagcagcgacgtcaccggcggcaggcggaacagccgggagatcaggtaggtgccgccaaagctggccgccactacggcgacgatcaggaccagtgccagccagcccaggcccagcacgtccatgatgctgactttcaggcccagcagcacgatcccgccgcgcatgaggtgcttccccgcgaagtccagcccgggccgcgccctgccggccgtccacaccccggccgcgggaaggttggcggccaggacgcccaggaccactgccagcgtcatcgcgggaagcgccgggaccagccggtgaaccaggaacgcagccgccagggcggctgccgctgtggacaggccagggagaagcctctcgggccgtccgggcaggtccggaacggggttgcggaaggatctgcggactggcactcacctactgtgccggaaaagaggcgcaatgcacgaaccaggggacccctgccaacacgccagaatggatggcagtaatgaaaacgaaacaaaaagatggttggctattggacatgtcagacctattccaggattactccgtggccgccggccggtccggagcctacgacgagatgttcgcgcccgggcaacaggccagggactcgtacgggcaagtggcggacgccctccgcaaactctccctcgccgatgtgagcgcgcgtgccgactcgatggcgcgtaccttcctggaccgcggtgtgaccttcgactttgcgggggaagagcgccccttcccgctggacatcgttccccgggtcattccggcgggggagtgggacgtgctggagcgcggcgtggcccagcgtgtccgggcgctggaggccttcctcaatgacgtgtacgacaagatgaccgtcgtggccgacggcgtgatcccccggcagctggtcaccaccagcgcgcacttccaccggcaggtccacgggttcgaaccggcaggcggcgtccgcgtccacatttccggcatcgacgttgtccgcgacgccgccgggaccttccgggtacttgaggacaatgtccgagttccctccggcgtgagctacgtccttgagaaccgccgggccatggccaagggcctgcctgaggcgttcggccaacagctcattcggccggtcgaggagtacccccgccgccttctctccgccctgcgcaagaccgcaccctccggcgtcgacgatcccaccgtcgtggtcctcacccccggcgtgttcaacagcgcctacttcgagcacaccctgctcgcgggcctcatgggtgtggaactggtggaaggccgcgacctcatctgccgcggaaaccgcgtctacatgcgcaccacggccggcgaacagcgcgtggacgtcatttacaagcggatcgacgacgatttcctggatccgctgcagttccgctccgattccatgctgggttgcccgggcctcgtcaacgccgcccgggcaggcggcgtcaccatcgccaacgccgtgggcaacggcgtcgcggacgacaaactggtctacagttacgtccctgacctcatccgctactacctcagcgaggaacccatcatcgccaacgtggacacgtaccgcctggaggagaaggaagcccgcgaatacacgctggacaacctggccgaactggtggtcaagccggtggacggctccggcggcaagggcctggtcatcggcccggacgcgtccagggatgaactcgacgccctccgccagcgggttatcgccgatccccgcggctggattgcccagccggtgctgcagctctccaccgtccccacgctgagcggggacaagttcggcccccgccacgtggacctgcggcccttcgcagtgaacgacggcgacaacgtctgggtgctgccgggcgggctgactcgcgtggcgctgaaggagggctcgctgatcgtgaattccagccagggcggcgggtcgaaggacacctgggtcctggccgactctccgcaggtgccggtggaaaccgtgccccggccgtccatctctgtccgtgagcgcgtctcggtatggccggtcgaaagcaactggcgggaccgccagtcggagcagcagcagtgagccgggccgtgacctggcagtttccttttccagtttcgggcccgcaggaggtagccgcgaatgcttagccgtattgccgagtccctattctggatcggccgttatgtggagcgtgcggacggcaccgcccgcatccttgacgtccaccttgagcggctcaaccacctgcccatggacgagcgcaagagcgtggcccaggaactcctcgcggtcatgggcgcacgcccgcagagcgaggacttcggcctgcccgagcttctccacgcactggcctatgacaagaccagcgccacctccattgccgggtccttgggcgctgcccgggagaacgcccggcgcgcccgggaaactgtctcctcaggcctgtgggaaagcctcaacaccacctattacgggctgagccagcaccgcaaggacgtggttggcacctaccggttctgcaactggaccctggaacggaccgccatggtcagcggccttgcggacaccaccgtcagccacgacgaaagctggctcttcctggtgctgggccggtccctcgaacgcgcggacatgaccgcccgcatgctctccacccgggacgtgctctccgccgggatgtcctgggtcaacatgctccgctgcgccggggcgtacgagtccttcctgcgtacccgccgtgcagccttcggcgaccagcacgccgccgagttcctgctgttggaccggctcttcccgcgctccatcgtctacgcactgcgcgacgccgacgagtgcctggccaagttggatccctccgcccagcgggtggggttcatcaacgacgcgcggcggatcgtgggccaggcccggacgttccttgagttccaccggacggatgacctgatgtccgagctcccggagcacatggagcgcgtgcagaaagccgtagcgcaggcgtcggacgccatttcccgtaagtacttcaatcaggcggatgaactggcctgggtgggagaagtttcatgacccggctgagcatcgtccataagacggcctacaagtacaacaagcgggttaccctgtcctacaacgaggcacggatgaccccgctcaccgattcccagcaggtggtgctggaatcggtggtcaaggtgtcgccgtcgcaggccgccgtcagcacctaccgcgactactggggcaccagggtcacggcgttcgacatgcagatgccgcacgaacaccttgaagtggtctccaacatcacggttgaagtccaccgggccgagaagatcccggccgaggcggacattgccggctgggatgtccttgcttcaccggaaacgctcaacacgttcagcgactggctgccgcagtccaggctgagcggtccgggggacgaagtcctgggcatcattcccggcgtggtggccgggaaaaacccgcacgaggccgccatggccgtgtttgagtggatgcgcggcgagatgacctacatgtccggttcgacggcggtgaccaccaacgcggaagaggcatggggccagcgccagggtgtttgccaggacctggcgcacctggcgattggtgcactgcgcagctgcgggatcccggcacggtacgtgtccggctacctgcacccgcggtccagtgccgggatcggcgagacagtggcggggcagtcacacgcctggctggaattctgggacggtgactggcgcagctgggaccccaccaaccacaagcccgccggcgacttccacgtcacggtggcccgggggcgggattaccgtgacgtgccgccactgaagggcatcctgtccggcggcggcggctcggcgctgagcgtcagcgtggagatcacgcagctcgcctgaccagcgagcctgccgagccgcgctcttgctgagggcggccgaagtttgaagcgccggtcaaccaggcccttcaccgacttttccgcgtccaaccgggcagcaaattcgccgggcgctacacggacctgacgttacggccctgtgtgaaggacggacccgcccagggtttcctggatgaggttcgggtcctcacttaccacggtccagtttttgccgacgttgacggcacgttgcccagccggcttccaaagatccagctgcgactccaagtgcacgtcgtcggtgtagatcgcaaggtaggtgaactcactgcagcttccggaggaggcagagaatttggaagggggcgtgtccagcatcagctcctggcataccaggcctgcagattccacggcttgcttcaagtcacctatcgactcaaacgttccgccatcctccggcggcgtggcgtcggaagtagagcaagacgctaagaagagagcaaggaaagctgtggcagtgcccattgcgagtcggttcatatctggtccccatttcagaagtcgtcccgtcgtcccagcctacgatgatccgcgcgcgccgcgcgttcagggcatcctcgcgtacgcgcccagaccgattaacggtgcacccggtaccgcaggtagagcatccggttgccctgaatcaccacgtcaggatcacggcgggggcagtgcggcggtgctactcctgggcagtcctaatggcgccgctgagctgggtccaccaggtcatgggctcagtcaccctgaagcggcggccggtgatggtgtccggggtgatgcgcacgaacacatccttcttgccggcctgccacgggaaaaggaagagttgcgtggtgtccaggacctgttccgttccggtgacgacggcggccgtcccctttaccaccacgctccaggccaggccggtgtcaggatccactccgtcggcttccacggccaccgcagcgtcctcagaggctccggagagcttggttccttcactcgtgcggaacaccagggtgccgccgtccaccgtgtagttgatggggaaaatatccggcctgcctgagaccaggacggccagcctgccgacggacacgttccggagcatggcccagcactcgtggtgttcaagattctgcacttcagatatcggttcgccgctcatgccgcgagcttaccctcaccaggggctgggtttgtagtccttcaagaacaccccgtactggtcctccccgttctcgcccatgacgatgggatcgtagacgcgggcggcgccgtccacaaggtccaggggcgcgtggaagccttcctccatgagcctgaccttggtgaagtgcggacgctcatcggtgatccagcccgtgtccaccgcggtcatcaggatgccgtcgctgtccagcatctcctgggcgctggtgcgcgtcatcatgttgagcgctgccttggccatgttggtgtgcgggtggccggggcccttataggcgcgggagaactggccttccatggcggagacgttcacgatgtacttgcgccgggctgtggaacgcttcatggcgccgcgcagccggctcaccagcaggaagggcgccgtcacgttgcaaagctgcacctcaagcatttccagcggatccacctcgtccaccacctgggtccagctgttaatggtggccaggtccggaaccaggccaccggcgtcgatagccgttccggaggcgatccgctccagtgatgcggaaccggtggacagcgccagggacgtgatggcgtctccggccaggaccgggtgttcggtgacgctgctggccagcgccagggggtgcttatcatgggcgtggccgaacgtcaccaattcggggccgccgtttgcctgctccagcgctgccggcaggggctcgtcctcggcatccaccaacggcttgtaggcattgccggaccggcggacggtctgggccgcgttgttgatgatgatgtccagcgggcccgactcattgagggagtccgttagggccatcacctgggcgggatcgcgcaggtcgatgcccacaatccggagccggtgcagccactctccgctgtcctccatcgcggcgaaccggcgggcggcatctttggggaaccgcgtggtgatggtggtgtgggcaccgtcgcgcagcagccgaagcgcgatgtacatcccgattttggcccgcccgccggtgagtagggctcggcggccggtgaggtcggtccgggcgtcccgcttgctgtggctgaaggccgcgcactccgggcacagctggtggtaaaaggcatccacctgcgtgtagtgctgcttgcagatgtagcacgggcgcgaccggatgaggtgtcctgcgactttgccggtggccgaggtggccagcttgtttccgcgggtctcgtcgtcgatccggtcgggagcggcggtagcggtctgtgccagcacggctcggtctgcctcggagatcaggtcacgtttggtgacccgccggtgcctcttgacggccttgaacatcttccctgtggcgcgccgcactgagatgtagtccgggtgctcctcgtcataggcgtggatggtgttcaggaccttgaggcaggcctggatttcctcaggggtcagatcgggggagctcattgtaccgattttacagcctgggacactgccggccgcacctgtggaggcgggccggccctcgggtgaggcgctagatcctggcccccggcgcagcgtcggcagcagcagccgcagcgtgcgtctcggccaccctgtctacggattcctgcagatcggggtactggcccgccgccgccttgaccgcgttggggacaaggtggaggttccgggcagcaagctggcgctcctcgtcagtgggttcgggaacggtctgccccttggcaaggaccgtaatgccggactctgtgaccttgaagccgcgggcacggtccagctcagcgtccagcccgatcgccgcccctgcgggcaccttgacgttcttgtcgatgatagcccggttgacaacggcgcccgcgccgatctgcaccttgtccatcaggacggaatcgataacccggctgctggtggccacgtagacgtcgttggacaggaccgagccctccacgatgccgccggaaatcaccacgccgctggagacaatcgaatccagcgcggtgcccaccgtgttgttctggccgcgcacgaatttcgccggcggggagatgctctgcctcgtgtaaatgggccactcggagttgtagagattgaagaccggcagcggggaaatcaggtccatgtgggcgtcgtagaaagagtcgatggtgcccacatcccgccagtaggtgcggtcacgctcggtggagccgggaatgtcgttgagggtgaagtcgtaaacatcggcttcgccctggttgacgaagtaggggatgatgtccccgcccatgtcgtgcttggtgtccagccgctcggcgtcgacatggagggcggccaccaaagcgtcggcgtcaaagacgtagttgcccatggaggccaggaactgcgagggatcggcagcgaggcccggagtgctggagggcttttccacgaacgccgaaatcttctgcgggttgtcctggtccacctcgatcacgccgaactggtccgccatgtgcaggggctgccggacggcggcaaccgttgccttggcgccgctgttgacgtgctgctccaccatctgcgcgaagtccatgcggtagacgtgatcggcgccgaccaccaccacgatgtccgggttggcgtcatggatcaggttcagggactggtagatggcgttggcgctgcccaggaaccagctcttgcccacacgctgctgcgcgggcaccgaggcgacgtagttgcccagctgggtggacatgcgccaggtctccgagatgtggcggtcaaggctgtgtgacttgtactgcgtcagcacaacaatctgcagatagcgcgaattcaccaagttggacagcgcgaagtcgatcaggcggtagctcccggcgaagggaacagcaggtttggcccggtctgccgtcaatggcatcagtctgtttccctcgccacccgcgaggacaatggccaggacttttttgttcaacggcatgatggtcgctcctgtacgccttcgtaactccccaagacagtccggtacgcccggactgtcttcacactagaacagttaagcgggaaggactaccttgggtcttgtgcgaatagacattgtgaccaaagagttcccgccggagatctacggtggcgccggagtccacgtggccgaattgagcagggtgcttagtaagcatgttgacctgcaggttcgtgcttttggggctccccgcgacaccgactatcatggcgccaccgtaacgtcctaccaggtgccggatgaccttggcggagccaacgccgcggttcagaccctcggtgtggacctgcggattgtcccggacgtggaaggcgcggacgtggtccattcgcacacgtggtatgccaacatggcggggcaccttgcctccctgctgcacggtatcccgcatgtcctgagcgcccacagcctggagccgctgcggccctggaaggcggagcagctcggcggcgggtatgcgctctcgtcctgggtggagaagacggcgtacgaggcagcggcagccattatcgcggtttcggagggcatgcgccaggacatcctgcgcagctacccggacgtcgatccggaaaaggtccgggtggtccacaacggcatcgacgtcgagctgtggcaacgtgacgaaaatgacgacgccgtccgcgcgctgggcattgaccccgccaagcccagcgtggtctttgtgggcaggaacacgcgccagaagggcgtgccctacctcctccgcgcggcggcaaagctgcctgccgatgttcaactggtcctgtgcctgggcgccgcggacactcccgaacttgccgccgaaacggcacggcttattgaggagctgcaaagccagcggaccggcgtggtgctcattgagcggatgctgccgcgccacgagctcatccaggtgctcagccacgcgaccgcctttgcctgcccctccatctacgagccgctcggcatcgtcaacctggaggccatggcgtgcggcgcagcggtggttgccagcgccaccggcggaattccggaggtggtggagcatggccagacgggcctcctggtcgacctcgagcaggtcaccgacggcaccggaacgccgctcgatccggagaagttcgtgaccgaattcgcggcagccctcaccgaggtggtctccgacccggagcgcgcccgcgccatgggccaggctggccggctgcgtgccgagaagcacttctcctgggaatccatcaccgaaaccaccctcgaggtgtaccgctccgtgcttcctgcccgcagctagtaattcttcgcaaatatcgacgacggcgccgcttccctcgcggggggagcggcgccgtcgttgttcatgaggccagcggacggtcagttgcgcttggccgcggccgtcctggccagctgtaccttctcgtccacgggggcctggccgctggccctctggctgcggaagtaggcccgtgcctcgtcctgccgttccttctcggcgcctgtggccacggcggcgcgcacatggtcatcgccgtaaccgaacgcttccacgaggtccagggcgtgcggccggatcttcaccagcagcctgttgatgtattcgcccaccgtccggccacgctgcatggagaggcgcccgttcatgaggtaccaggagaggttcttctcgatcagcgacaggccgaagaggtcccgcagccaggtcaggaccagcttggttccgggatcttccatttcgcggagcgcgtccgtgaaggcctcccattgcaggagctcggcgtgcgcttgggcggcgtcgatgagttcgttctggtgccggttgaacagcgcggcgcccttctcctgggagagcctgttgctgccccggagcgagcccgctgcctctgccaccatggtctgcacccggtcagtgagcagcgcacgctggccttcctcgtcgcgcagggcgatggcagcccgctgcacggaaccggtgtcggccatgaactgggcaacctggcgcaaaccggtccgatggattgcggcgccggtggcctgccccaccacgtaacgggccaggacaccgaagtccacgttccggaattccttggcgtagtcagccagaaggcgcttggccaccagttgcagcagcaccgtgttgtcaccttcgaacgtggcgtagacgtccaggtctgcccgcaatgaggcgaagcggttttcgatcaggaagccggcgcctccgcaggcttcccggcattcctgcagggtgtccagcgcatgccaggtgctcagggccttcagtgcggcagccagggtttccaggtcctggcggtcctcgtccgtgtcgtgggcgcctgagaagacgtcgtcgaacttctcgagcagctgctcgtgggcgaacccggcggcgtaggtggttgcgaggcgcgtgaacaggcgccgctggtgccgctggtagtcgagaaggacttcctcatcggtatgtgaggaggcgttgaactggcggcgttcagtggcgtatccgatggccgccttgagagccactttggatgccgccaccgcagcgccgtccagcgatacccgtccctggaccagtgtgccgagcatggtgaagaaccggcggccggggctggcaatgggcgacgaataggttccgtcaggagcaacgtcaccgtagcggttgagaaggttggtccgggggatccggacgttggtgaagtgcagccggccgttgtcgatcccattgagaccgcccttgatgccatcgtcctcacccccgattcctggcaggaactccctggtctccggattccgaaggtccacgtagaaggcatggacgccatggttcactccgcgggtgacaagctgggcgaacaccacggcgcccagtccgtcggtggctgcattgccgatgtaatccttccaggcggcgcggaagggagtgtgcaccacgaattcctccgtggacgggtcataggtggcggtggtcgcaatgctggccacgtccgagccgtgtcccgtttcggtcatggcgaagcagccgggaatgtccaggttcatgatgccgggaagccaggtggcatggtgttcggcagtgccgaggtgcatgactgcagagccgaaaagaccccactgcaccccggccttgatctgcagcgaaggatcggccaccactagttcctcgaagccggcgatgttgccgccgtggtcgtcagaaccgcccagcgctgccgggaaagcgcggtggaccgcttcattctccaccaggtaccgcagctgtccgaacacccttttcctgtgctcggtgtgggtcaggccctcgatcttgtggagctcggggcgggcggcaagctcccgggcctggagccggacatctgcccacttgcccagcagttgccggccaagtgcttccacgtcgacggcgggctgggcccgggaaggccccggtgccggtttggcagcggcggggcgctgccccttgccggcgggacggtccactacttcagtcatgtcaatgtccttcgttggtgctgacagtgctttgtggtttcaggtggttggttacgttggctgcgggtgacgtttgttgtccggcgggcagtgcagggtcatccccgtgcagtcggcgagagttcgggggcaatgcctacgcagagccatgctgtgatctgccgtgccatggcctcctggccgggcttgccaggggagtccggagtgctgagccattgttccccggcgttcctcaccagtccgatcgccgccttgggccagtagccgatgaccgcctgcttgccgtcgcccaggtgcgacctcatgggggtggcaatcatgtcggccacggcgtcaaagaagtgtccgagtgccccggacactgcgcccgaggaaccctccgggtccccgctgccgtaccgggtgacgaacgtgtagacgttcgggctggtgtccgccatctggaggtaggcggagaccatggccagaagaccttcgcgcggagtgtccgcgttctgggcggcttcctggatccggcgctgcatctggctcaggacaacttcgccgacagcctgctggaggccggctttgtcgccgaaatagcggtagaagacggacttcgaggtgccggctgccgcagcgatctcttccatggaagcgtcgctgcccagcacgtgcactgccctccgggcggacttgatcagctccctgcggcgttcctcccggtggctctgccagcgcgaagagcgcccgtccgggctgccgggtgcagacggcagggctgggccgctttcgtggttgttcacgatactcagcgtatcaggtacgctgggtatcggtaaccgcacgtgacccgaggagatatccatgtccattgacggacagtccaccgctggacccgaagaagcaggcagcctgactgcaggaatccctggcctgcgcagggcagtgatcgtcggagggaaccggattccgtttgcccgcgccggcggcgcctacgcaaagtcggccaacctggacatgctgaccgcggctctggacgggctcatcgcccggttcggcctgcaggacgagcgcatcggggaagtggctgccggtgcggtcctcaagcactccagggacttcaatctcacccgcgaagccgtgctgggctccgcgctctccgccgagactcctgcgtacgacctgcagcaggcctgtgccaccggtctggagaccgtggtgggcctggcgaacaagatcaagctgggacagatcgactcagcagtggccggcggtgtggattccgcctcggatgctcccgtggtggtcagcgaggggcttcgcgaagtgatcctggaccttagccgggcaaagacgctgccgcagcggttgcagatcctcagccggctgcggcccaaggacctggctcctttggctcccgggacggccgagccccgaaccggcctgtccatgggggagcaccaggccctcacgaccgcacagtggaagatttcgcgcgaggcccaggatgagctggcctacaacagccaccgaaacctcgccgccgcctacgactccggttttttcgatgacctcctcacgccgtaccggggtctttcacgcgacggcaacctccgcgccgatacgtcgctcgaaaagctcgccaccctgaaaccggtcttcggcaagaacctcggtgccgacgccaccatgacggccggcaactccacgccgctgacggacggggcctcaacggtcctgttggcctccgaggcttgggcggacgcccacgacctgcccaagctcgcggccgtggtggatgccgaggctgccgccgtcgactttgtccacggtaaggacggcctgctgatggcccccgtgttcgccgtgcccaggctgctggcccggcaaggcctcacgcttgcggacatcgacttcttcgaaatccacgaagcctttgccgccacggtcctcagcaccctggcggcctgggaagacgaggaattctgccggacccgccttggcctggagggcgcctttggcagcgttgaccgttctcgcctgaacgtcaacggctcgtccttggccgctggccatcctttcgccgccactggcggccggattgtggcctctctggccaagcagctccacgccaaaggcagcgccaccggccggcccgcacgcggcctggtctctgtctgcgccgccggcggccagggcgtcgtcgcaattctcgaatcgctgtaggggacacagatgacagacaagtacgcacaactggtacaccacggcgttggcaggaacgtggccaaaaaactcggactgccccagcccgcggttcttcgcaggtaccagccggggcaacccttgatcaccggccccgtcctggtgcagggaaataccgtagaagccgacaacctcgccgccgaactgctctcctgggacctcgatgtcaggcggcacgcggtaccccgcgaaaaactgggtgccatcatcctggcactggacgaagtggccagccccggggatctcgaaaagccaatcctcacggcggctgcctcactgcgggacctcgcccccggcggccgggttgtcacggtgtcccggccggcggcggaggcagattctcccgccgctgccgctgcccggcagggaattgatgggttcctgcgctcgttggccaaggaactgcgcggcggcgccaccggcaacggcatcgttctccgggaaggtgtccaggcgacaagcgcaagctccctgggcgccctccggttcttcctctcgggccgttccgccttcgtggacgggcagttcatcacggtgtccagcacctccggaggccccgcccgcgacttcgaccagccgctggacggcaagatagccgttgtgaccggcgcggcccgcggcatcggagcagccattgcacgcaccctgcaccgtgacggcgccacgctcatccttgtcgacgttccggccgctggtgaccagctggcaaccgtggcgaacgaggtccgggggacagcgctgcagctggacatcagcagggacgacgccgggccgcggatcatcgagcacgcggcacagcgccacggacgcctggacatcatggtccacaacgcagggatcacccgggacaagctgctggccaacatggaccactcgaagtggaactcggtgatcagcatcaacatcaccgcgcagctccggatcaacgaagcgctgctcgcgtctgaacacttccgggaatccccgcgtattgtgtctgttgcttccaccagtggcatcgccggcaacagggggcagactaactacgcggcgtccaaggcaggggtaatgggaatggtcagggccagcgctccgctcctggcatcgcacgggggcagcatcaatgcggtggctccgggcttcattgaaaccgagatgacggcacgtatccccttcgctgtcagggagatcgggcgacggctgaattcgctgcagcagggcggccagccaacggatgttgcggaaaccatcgcattcctggccagcgacgccgccgcgggcatcaacggggaggtcctgcgggtatgcgggcagaacatggtgggggcatgacctccgcccggccggtcattctgggggagatgccgtcgctgtccaagctgtacgtcaatgcagcagcacaggccgcgcgccgccggctgttgggcacccatgacggaacggcactgccgggtgaaagccatgaagtgcggggggtcgccgttgatgttgccacgctcaccgcataccagcaccttatcggcgaaacagccagcgacgtgctgcccgccgggttcatccatgccctcgcctttcccttggccatgagcgtgatgaacagggacgactttcccttgccgttgctcggtatgatccaccttcgcaacagcgtggagcagcggattcccgtgttcttcacggacgccctggacatcactgccagggtggagaaccttcggggtcaccgtgcaggcacgcaggtggacgttatcgccgaggtccgccgggctggaacagctgaaatctgctggctgggaatctccacgtatcttgccaagggagtcttcctccctggcatcgacaaaccgtccccggctcccgaccgggccgaattcaaggtgccagatcccacggcgctctggcacctcggtgtggataccggccgtgcttacgcggcagtatccggcgacttcaatcccattcacttgagcgttctctccgccaaggcattggggatgcggcggtccatagcgcacggcatgtacctagcctcgagggcgctcgccgatgtgggcccgtcccgtggggattccttcgcctgggaggtggacttcgacgccccggtgtttcttccctgcagggttgcgttggagatcacaacggtggagggttctgccggagcgtggtgccggtccgacttcgtggcctggaacccccgctcaggccggcgccatttccacggttcagtgagcgccctgtagctttactcagctagctgtccggacagcccgcaggatccggtggaggctcaggaggaccgattcggacgccgggaccattccctgatccggctgcctcccggcggtggaagcgatgcacgcttccaccgcggtctttgccgccccgagcttctcctcctgcctgaccgggtcatcctcgctgaacgaacgcagaagatcaccggttgacttcagggcatcagccagcggctcgttatcctgcagcggaaccccgtacggcacgtcgctctcatagatgacatccgagagcacgtccgttatgtcctggatgtggaaggtcacccgctccagttcgcgcaggttgcggtagtcgaggtcaacgtcgcgggggtggagcttgcgccgcgggtttgccctgcggctggcgtccgcttccttgacgagatgccggacggagcgtgcggcggctgaaagctcgtctgaacggcgcgaccagtcctcgtgcttgggcggccactcttccagaagcgccttgcccatgtccgtgagctgtttgccgagcgcgatgcgcaaatcgtccaggctggctgccgcggcattgaagtgcagcggcggaaagatcaggaaattgacgccgatacccacggcgaccccgacacccatctgcaggaggtagccgaacgaaaaatcgtccggattactgccgccgaccagcaggaccagcagcgccgccgtcggaatccagtcactacccttgccaattcccggaaggccgcccagcagcacgccgatgcccataatcagtgacacggcaaggggcgacggatcggtcacgttgaccagcacgaacgcaaggccgatgcccatggcgagtccggcaagggcctgcatgccctgcttaaccgagccggcaacgttgtggtacatggccaccagcgcgcccagcggtgcgtagtagggatagttggcagccgcgcccggcatcagcggagcgataaggaaggccactccggcagcaactgctgctttcgccgccagttggagccgttgcgttgcaaaggccgcagacagccccgataccgcctggttgaggaaaagggtccccttggcccagcgggcatctgggcgtacttgaggcttggtcatcagcacaacgttacgggcgacttacggttgcggacaaagctgctggtcaggcgtccgcggcggcatgggagcaggacagttcaggacaaatccgccgccgagcggcgtacttcagcggccaggcggtgtgcacggcccggtgtccggccatcctcctgccgctgcgggatgtagccgaagcccaggccgtagaccgggtccgcgaacccgagggcggcgttggccccctcatgtccgaacgcgcggtggctgccgaagttccgcgacgggtgcggtttcatgaagacgacggcgaacgcgttgtccaggccggaggaacggtcaaggccccacacctgttcccgggacatgaggccaacggtggcagtgttgaggaacggtgcccctccgttggtgcccgtggttgccgcggcgtagaggcgggccaggccctcggcgcttcccacccctccggccgctgacattcctgcggcccggaccgcgcggatgttggggagttccatgatggtgctcacggaggcgttgctgttcaggccttcaaggctgagtggatccatccagggttgctccggatcggccgaaaagaggacgttccggtagcgggattcctgttcctccggcagcccgaggaaaaagtcgacaccgaacggacgccggatcctccgttcatacgcctcctgcagcgtttctccggcagcgcggcggcacagttcctccatgatgatcccgatggtgagcgcgtggtagccgaactgcctgccgggctcccaggccggggctgctgcggcgagccgggcagcggcggcaggagtggtgaactcttccagtgggaagccgccttcaacgcccatcagcccggcctggtgggacaaggcctgccggacaaggagccggtcttttccgtgcaccccgaattccggccagtagttcgcgaccgtttggtccagatccagcagtccgtcctgcaccagcagtccgatcaccatggcggccacgcccttggaacaggaatacgcccctgtcacggagtccggagccacgtcgggaccgccggacaggcccactacctggactccgtcctggtaggcggcgagctgtgcgctgtactgcgggtcctcgccaaggaaggagtcgaacagttccaggacgccgccatatccgggcgccacaaagccgtgtgatgtctgcatggcgcaattctaaccggaaagcgtttaccgagtggctccgcctattgttcccgggcggccccgtggccggacgccacttcctcgccctctttgacgggtccgggcggggtgccgtcgccaaagggacggccgccaagtgcttcccggccgtgggcttccagccagccgctcaggtccggtcccgcaggaacgatgccggtggggttgatgtcctcatggacgatgtaatagtgctgcttgatctgcacgaagtcgatggtgtccccaaaaccgggggtctggaagaggtcccgggcgtagccccagagggcgggcatttcgttgagtttctggcggttgcacttgaagtggccgtggtacacggcgtcgaagcgggccagcgtggtgaacagccggacgtccgcttccgtgatggtgtcgcccaccaggtagcgctgccccgagagccgggcttccagccagtccagtgcggaccacagccgggcgtaggcggcgtcgtaggcttcctgggaccctgcaaagccgcagcggtaaaccccgttgttgacttcggtgaacacgcgcttgttgacctggtcaatttcttcccgaagtttttcggggtacaggtccggcgctcccggacggtggaactccgtccattcagtggcgaagtccagggtgatctgcggaaaattgttggtcaccacggcgccgctggccacgtccacgattgccgggacggtgatgccccgcgggtagccagggaaacgcttgaagtaggcttcctggagtctttcgatacccaggaccgggtccacgcctcccggatcgaggtcaaaggtccacgatcgcgcatcgtgggtggggcctggctgtcccagggaaataacgtcctccagaccgagcaggcgccggacgatgacagtcctgttggcccaggggcacgcccgtgcggcgatcagccggtaccggcccgcctccacgggccagccgggctcgccattggtgcccggggaggaatccttggtgatgcggtcctcgatgtaattggtatcacggttgaattccgctccaccggtgacgtaggcgccccgggtgctgtgctctgtcccgcccaccccggcggcttgctgagtggtgtccgtttcctggctcatgggaccagcctatgctcccgcgtagaggactgtggagatgggttgccaggcccacagccaggagcccgctaccagggcagcgaagaggacgatccagacagctgagggaaccgacgtggcacgccacaacaggtaggcgtcagagctggccagccgttcccgccggtgcaggtgaacgtgcgccagcttgatcaggtcgcgcacggcggcaaccagcagtgccatccccaggatgacggccacatgccctacgaatgcctccggaaccaaaaggatgagaagcactgtcaccgcgatcgcggtgacagtaataaggatgccggcaagattccgcaggaacagcagcgaggcagcgagagccaagccaccggccgctatggcggccgggccccacccattgaaaccgcaccagacaaacacggcacccacgattgccgggaccgggtacccccaaaagcacgaccatgcactggcgagcctgctgcggctatacgtggtggtggtgccggaatggtcgaggcggagccggatgcctgatagctgctggccactgagcagtgcagcgaccgcgtgccccatttcgtgcgttgccgtagccagcaggccgaaatacctccacgaacgccgcgggactgacagtgctgcagctaccaccagcgccagtaccagctcggtaagagtcaccctcggggcgtccgcgcggctgaaggcgtccagcagtctattccagaggtcgccgggtatgttcatcaaggccaggtgccggccgggtcatcgtgtgccatatgcgccacagtaccggggcctcccgggtgccggcttaaaaccgaaaggcacgccaacgtcagggcgtgccttaggatcggtggggccacggacgttcccgaagccccacgtcgactgtattatctagccttcgcactcggtgcagtagctgtggccatccttctggcgagcaatctgggaccggtgacggaccaggaagcaggaatagcaggtgaattcatcttcagcctgcgggatgacctgtaccacgagctcttcggccacgaactcgcctccgggcacgcctgcgccgtcgagcccgtcagcttcatccagctcaagcacaacgctgcgtgcgtcgggagcatttgctgactggagctgctcgagtgagttgtcctgcgattccttgacgtcggagcgcagttcatcgtaatcggttgccactttaggtgcttctcttttctttggttcgcctgtcgcgtatgaaacgtacagcatcaagaggctattccccaatagccggagtatgttgaccgtccgctgggtaagggttgaacggacgcagcccgcggtttatcaccgcagcacgggcgcagggcagcggaggacgcaacgtacggcggcgttatccgcactatgagtaaggggtatacgtggagcagctcactgcagagttcggtggttcccgacgggcaggtaccggtgttggccctgtcctggaaaaatttcaggacgtgacgaggatcgctgtactgcgtggcggaggcctgggcgatctcgtctttgccatccccgccatatccgcccttaaggcggcctatcccgacgcatcaatcacgttgctgggcactcccgtgcaccaggcactgcttgccgccaccagaagtcccgtagacgaggtgtgcatcctgccgtttgctgaaggcgtccgcccaggggaggagaacgcggaggagctggaaacattttttgacgacatgcgagcaaggcggttcgacctggcggtccagctccacggcggggggcgctactcaaacccgttcctccttcgcctcggggcgctgcacacggtgggcacccggacggcggacgccgccagcctggagcgtacggttccttacctctattaccagcacgagccgctaagggcactggaagtggccggcctggccggcgccttcccaatcgacctggaggctcgcctggcgccggcaacgggactggcccgccccgccgccgtgatggacgacgacggggccgcggctttggtggtggtgcatccgggggccacagatccccgccgccgctggccggttgggcggtttgctgaacttgcggcggcgtgtgccgcggacgggcttcgggttgttgtcgtcggggacgggagcgaacaagaactggccgcacagattgcggagcaggcagcctccccccatgtccgttccctggcgggggacctggacatgggcgggcttgtggcactcttgacccgtgcggctgtagtggttggcaacgacagcggcccccggcacctcgcccaggcgctgggagtccccaccgtgggaattttctgggcgggcaacgtcattaacgccggtgcgctgggcaggagcctgcaccgcatccacgcatcctgggtaaccgcctgcccttcctgcgggatagacgtcacccaggtcggctggacggcgcccagatgcccgcacgacgattcactggtggccgatgttgcggtgcaggatgtctacgaggacgtgcggagcctggccgccaccgaactgccggacgaggacgcatgagcggcggggaagtcctcgcccaggccgcgccagggaaccggggcgacggaagaccggaactcctggtgcttcgggcactgaagctgggggacctgctggtggcagtgcctgcccttaaagcccttcgccgtgcctaccctgggcatcggctgcggtatgcagcgcagggatggctgtccgaggcattggggctggtgggcggctacgagctcttgcccacccatggcctggacgagccgctggctgtggaacccggcgtggttgatgttgcggtgaacctgcacggcagtggtcctgagagccagggacggattgaagccttgcaggcgcggcgcacgatcgggcaccggagcaaacaccgggacgggccgccgtggcgtgccaggctgcatgaaagggagcgctgggccgcgctcctggaatggcacggcatcgaagctgatccgctggacatccggctgaatgcgccccatcagtccagccctgttcctgcagccaccgttctccatgtcggggcagcctatggcagccgcctctggcctgccgagcggttcgccgccgttgcttccgcgctcgccgtggcaggccacaatgtcgtctttaccggcggcagcggggaaagggaacgtgcagtggaggtatgccggctgtccggcctttccgacgacgcggtgctggccggaaggctgggattgggggagttcgctgccaccatcgcagcggcccggctggtgatctccgcggataccggtgccgcgcacctggcctccgcgtacgggaggccgtcggtggtgctgtttgggcctgctccgcccgaaatctggggcccgcccccggggccgcatatagtcctgacccgggctgagctgcggcggggtgacacgtttgcccgccagccggaccccgccctgctggcagtcagcgtgcaggatgtcctggccgctgtgggggagttgggtggcctgtagagcgttctaatccggggcagcaaaactgggaaccggctctctttgtgcgcctccacggcctaaaatgctgctatgggcactgagctggaaattgccttggtgttgtccacggctttcctttggatcatgggcacattcgcaattctctccgctattgaccgcccggagaggaaggcccggcgccgggagcgcagggccgcccggggcggaaaacgccgcgtcctgtacgggcccgcagccaggagttcgcggctcgcagaaggcaccggacccccgcggacacttcatccgcgctgacgccgccagacggcgcccggccagtacgggccgggccgacactgcggatgtgtttaaagcgggttgcgaaggcccgcggccccctgttaccaaattgttgacaacagccggctgcctggggtgcgcctggcccgctcgtgcaggtgagcggtggctgccctccaggcagccggtgggcaggcatggggcggggcagctcaccgcagccgctgcggaacctggcctgcgcagaccaaagatcggctgcgcccgtgcccattgtcctccctggccacaccggtaggatcgcttcaagctacaaacccaatacacttccgggggttggttcatccatgtttcgtagcacgcgatcggtgaggcagctgctggcggccggaatggtaaccctgagcctgattgtcctggccgcctgtggatccaccgaggaaaagtccgtacatttcacggcggccggagacatcggcctgggcgagggtgcactggcggtgctggacacggtggccgaactgaagccggacttcaacatcgcactgggtgatttcccctatgagcccggtgccgaccaggaattctgcgacatggttaccgggaagctgggagcggacttcccttaccagctgcttcctggcaaccatgaaagtgacggctcggacggcgacataaagaagttggcggcatgcctgcctaacaggcttcccggcctgcaaggcgagtacgcggagcagtggttcgtagacgttccgcaggaagagccactggcgcggatcatcgtcgtttcaccgggcatcgaatttccggctggcaagctcgactactcaaagggcagcgatcggtggaactggacggaaaaggcaatcgacggagcgcgggaggagaacatcccctggacagtggtggccatgcataccccctgtttcacgatgggacggtatgcctgcgcagcgggcgaggcactcaccaacatgctgatcagcaagaaggtagatgtggtcctcaacggacatgagcacctataccagcggactcatcaactcggcttcaatgaccggtgtgagtatatggcagtcaaaaccgttgagaagaggtgtgtagtcgacaccggagactccatgacccagggcaggggaacggtcttcatcactgtgggcattggaggacggacgccccgcgaaatcaatcgcgacgaccccgagtcgcactacttcgcatcctggtcagccggtaaccacaattcgaccctggggacgctggacgtcaccgcaaccggcagccgcatggacgtaaaactggtcccggcggacggctacaccttctctgattccttcagcatccggaagtgatcacggatgcagggtgcgccacaaaactacagtcagggtggagtgagtggagccggcgacggctggggggcgagcgcacgtggtctcaggcgtgcgctctcgtcgccggctccgtgaaccacattaggatctgcgtgacgcgggcacacgagtagttggtacctgctttggcagaaccccgtacgcggcccaccgtgctggcagcctgcactataggtaccgagacaaaaaagttccgggaaaatctatcaatgatttcccggggcttcccttttggggcacctgaccgtacccggctcacgagccaggtacgtcagccccggctggcccggcctgtagcctgaagctaccgttgaatcatccttgggggaccaatgaaacgccttgccaccgtactgctcgccgcgccgctggtgctgagcggctgtgttgtgccttacggcggagagaacctcaggggtcccgccacggcagttcccagtgacggccactcccgcctggatgcggcaggcatcgaacaaatcaaggcgtccaaggtcgcgcgcctcgacatgtcctcggggcagctgaccaaggagagcgtcggactggaagatggcagcagccaggcgcccgacgtactcttgcgtgatggtttgatggctctggaaatccaggggccaagcggcacggtgagcgccgagactgaccgactacgcctcaacggcatgaacaccggttccgacttcagcgaagtcagctatttcctcacggcaccgtcccttgaggactacattgcactgatccgcgacggagtggaccgctacggcatcgacagggaatcggctgaagagtggatccagtccatctccagccgcccggatgacaagagtgacttcgccatcaccccgggaacatcgacggggctggaaatcacctacgaccttcggtacgacgggtcgaaggaaacccaggtcgtcatcgtgcacgtcaacccgctgtcgacccactgatggacgtccatcagtgggaccccgcgctcccggtattctgccggaaacgatatgaccgccagggggaccagggccagagattgtcaccatcgaggccagccccgagcgttcgggagcaccccatcggcacccctgctcccgggcagcagcctgacctccaagcttgacgaggcgacccgtgcgaagctgatcgccgccggcgtcgacctggtgggtgagcgtctcgggatccagtgcggaatcgacgaggccaggaacaaatacccggtcctcacccctgacctcacagtggccgacagtcaggtgtgtgttgagatcgaccggataacgtccacgccgacagggtggagcaggacccggcgcaccagcggactgctggccgacgccggcttgcgcccggtcgagcccgcgtcccagtgcggcgactgcttcctgggacgagccctcctccacgacgagctgctaccggttatccatgagaaggcatgaacccgttgtgttgccggtagtcactttcgacgctcaagccaccgtgcgtaaagctcgccgctgttcttcaggaccgacgccgaataggccaggccgccggtgatgctgatcagggctgcgccgactaagccaatgatgggaaggagctcctgggacttgccttcgagcatgaacaggatcaaggcggctacgatcactacagaaacgatcaccgagactttgatggccagcgggttggtgcggagggcctgctctacgcgggggatgtcggaggccggcttcggaagcttccgtgagaaccggacgcccagcgtcacgagccagcccagggccgagagccctgcgcccagagccatcgtgaagatgccccgctcggggtcctggccaagcaaccccgagagccccgcgtcgaccgccccggggatagcgatgactgccccgtaccaccaggcaaagaacacccacgtccggcgctgcgcgtagccgaaggcctggacccgtggatctgttgccaccgcggcggcatcccccaatgtcatagaccgcactctaccggcgtcgaccagcaacgccttcactcaatggccgaggtgacagtcggtaatgccggcaaacggcagtgctccccgcatacatggcgcataacaccgaatcaggactgcgggcgctgattcatggagggggcggtgtcctcacacacgaacgttactgagccggtccgacgtgtgcgtttttcgatacaggccatgcaattgactacgcgcggccccccttggtggcgcccatccatcatggcgtggttggagacacaaaaaagccccgggaaaatcagtgattttcccggggcttccccttgtgcgcggacggggacttgaaccccactctcggcgcgtcgtcctcaaggaaaacccttagaatacgcgcttcttgttacttttcgtcccgtacaaaaggcaacatttccagttgttcaaccacgccaaccacgcgatgcatgcactgtcagggcaggttcggcttctgcccaatgcagccctttcgttccttctaaacctactgctgtccgccgtggagggcttccgcgcatagaggtatgggaatcaaccgtatcgctcctaggaccaattagtggcagtacctggaatccctggaatggatggactcatgacgccggagcagctcgccaagcgactcggcgtctcactgcgcatggtgcgtgagatgtactacacggcgtcttggcctcacctgcggctaaacaaacgcgccgtgcgtttcaccgaagaccactacaaccagatcattggaatgagcgaaaggcgtgcgtcaactgtgatgagtagggccacgtcgtcgcataaggcttccggactggcagcgttgctcggtagtaagaagtccgcttaccttgaaccaatctcgcgtatcgagtttgaaatcgaggacatcccggatgagggccccaccagccccgacggtccccgtccctacgcgggcatcaacttcttcgaggtctcagtggaccaccgccgacggggctacggggcgaaggctatcgagctactaaagaacccctacggcggtcttgcccgggtcgcgttctctgatgacgctgacaagttctctggctccgtgggaaggaggggatgagcacaggaccaagcccgactcccgcgcgcggtacatagtcctggtggcccccgccgatagcctgagacgaccgctcgtcctttttgggaccgatgaaaagccttgccaccatactgcttgccgtgccgccgctggtgaccggctgggcctcgttagccgattcacgtaggcctcccattcactgccaatcggtgcctgtgccaggttttatctgcgtcatggacgcccggcgatcgcgcctctatggcattatgccctcatgacgccacagcagctccacgaatgggccaagggatccctgaccgatgaggcaggcaccgaactgcccctggtcgctgtcatcgacggcgggaagccctgatggcacgtccacgccgtgcctgggcggccgcggccaaggccaagcaggaatccggtgccttggggaagctgacacctgtagagcccgcatcgcgacgcggcgacggctcacccaaggccggtcccggccaggtctacgcggtcagctccggaaaggtctaccacccggcctggtgcaactcggtgggcaacgtctgggacgagaaccccaagcgtctgctcgttgtcgaggagagcgccgtcggtgaccgcgaggcgtgcaaagcctgtgatgaaccactgcaagcctaggagtgacatgggaagactcgaagaagcagcacacgagatccttgcccagcggcagcgggatctggacggacagtccgagcactttcaacggcgggatgcagaacggaacgctgcaatcggggagtttctcgccttggcaaaggagaagggatttcccgtcgaaatcaccttcaggcaatcggccgagcggaatggcaatctcggcttcaacgagcgggacaccccgggctgggtggtgcggacggagactcctggggagtaccagatgtgcattgccaggggcgttctcatgaccgtagacggcaatctgaggaacttcaccgctgagccggtgcatcacataccgggtcacgggccaagggatgtttcccccttctacaaggcatatccgtatggcagcagatcggacgcttttattctgctgtcggatgaggaggccagcccgtacggcgtcgaccagaagtcactcgctgaatgtgcggcctggtacatgactgctgctggcaagtagcgcccgcggggaagtgacggaccgctgagcgtttcagcccccacttggggctggccgcacacattcgggtatgaacgtcattcccataaaccgcaagcccaagggcatccgcaccggcgggcagtttgcctcaccaaccacggcgaggcctccgtctccctgccgcccgcccctatggggcgccgtgccgctcccgcgtccagcaaccggcacgtccccgagacgctccgcatggcccacttccaggacccccggctcacccacgatctggagtgggagatcgagcgcagcataggtgtctccgacctggagatggactaccactgtgaagccctcagcgaccgtgtgccccacctgcaggtggaggaggcctacggctactacagctgggctgtggaggccaagtacaccggcggggactggaaggccatcgtggccgaagctgccgcgacggacaccgcgaggcacccgggaggctcgctgggggaagggtaccggccgccgctgacgacacaccaggccggctacatggacggcaccctgaccacgggggagaagtacaccggctaccgggacgccacggagatctgcaaggacatcaggactgacctgaaagccgccgtcgcagctaactaactccaggccgggctgaagtacgcggtgaagaaccacaagtactccggcggacagtccatcagcgtcaccatccaaggcgtccccgacatcgaccggctggacccgaccgagctggaccacaacggcatgcacaagcagatgcgcgaagccaaggagctccaggagcggctcgaggccatcaccaacgcctacaaccggacagaccggggcaacaactacgactacgccaacgtcgcctcctggggccgcgccaacatcgaaaccgatcgtgaccgggagttccgggagtcagaggcagcccggcggcaggcagcccgggccggcagggccgcaactgcctgatcctggcccgacatgcagaagaccccctggacggcgtccagggggtctttactgtcaggagggtagagcagggtcgttagatgcccgcaccggtcgcaccgagctcggcctgctcaggcgtgaagccttcaaagagcagctggtcaaccaggcccgagcgcgagaaggagctgagttccaggtaatccttcgccttcttcactgcctgctcgttccagtcgacagtcacgcgctcagcggcccagatcgcgtcctcggtggggtacttctcgaactccagctgcttgaccagaccgctctgtgagaacgcggtgaagtcaaggtactgctcagccttgcgcagtgcgttctgctgggcaggtgtgcccttcttggcagcggcttccgcgtctgcctgggccttcgcggcggcatctgcatcggttttggctttcgcagcagcgtcggcgtccgccttagctttggcagccgcctcagcttcagcggcggccacggcgggatccttggccggctcggctgcagcagccgcggtgacctcaggggcggaaacggcgggcaccgatgaggtggcggcgccggcgcggacggagttgatgatgatgctcagcaggatgaacgcgccggtcacgatcagggcgatcttcttgtgcttgtcgtagccctccagcggaagaccctgcttgtcgcgcattttgttggtgaggatcaggatgaggtcgatcagggcccagatgcccaggccgccaatggtgaccagcttgaggatgccggtgcccaccttgcccaggtagaagcggtccatgccgagcacgccgaggaggagggagaggagccaggtcgtcaggaacgacttggtgctgacctgcggcgcctggccatagccaggcgccgcaggtcgatagggggcagcgtagttgggagggaaggcggcattggagggttgctggctcatgagagtcctttcagaggacacctgaccgacgtgcgatgcgaagcgtgcggagtgggtgcggtgatggacgcgctggagaaatctcggtgccgagcgggccgcaggagcgcggaatggcgcaggccggcagacacaagcatggtcgcttcccccaaagagcgtcacgggcgcagatgcccgtaagacggatggtacacgtcattggacacgtctaatccaatcggcagaaaaattacccgccggcaggtgtcgccatgtcaagggagccggcactacgagtcgccgctcacccctttagagttagtgaagaaccgaccacaacccgggcgaacaatgactattgactggaccaggctgattcagcggaccgccaagcaagggctaaaggccttccttgaacgcaggaaaacggcaatcgaccgtggccggcaaatggtgaaccaggtcaaagcggacatgagcaacattgtcgacctacaccacaggcgcggagccgttctgacgtttgcgtttgtcgatacatgccatgcgttttactatgcgggtcaccccttgcgggtctcgcagatccgagttcacgtggttagaaaccgatctggcgtggtaggagacacaaaaaagccccggaaaatcattgattttccggggcttccctttgtgcgcggagggggacttgaacccccaccccctttcgaggactagcacctcaagctagcgcgtctgccattccgccacccgcgcaggtggtaattcggaaaccgtttccgcctttcagcgtttcgcgtttctccgaagcagcgagaaaaactctaacacgacttttcctgaaacatcgaatcgggccaagtgggtaggctgagggcagtgcatcagcgctgcaccagccagtcatttcccagtgaggagccctccatgcctgacgtcctgcccgaggatgaagttgtccggatctgccaggagctcatccggattgacacctccaacttcggtgacgggtcgggaccgggggagcgcgccgcggcagagtatgccgccgggcttattgaggaagtcggcatggacgccgagatctttgagtctgctccggggcgggcaaacgtggtcacccgcatggccggcgtggacccgtccgccagcgccctcgtggtgcacggccacctggacgtggtgccggcgcttcgtgaccagtggtccgtggacccgtttggggcggaactgaaggacgggctgatctggggacgcggcgccgtcgacatgaaagacatggacgccatgatcctggccgtgctccggggctttgcccgcacgggcaggaagcccaagcgggacatcatcttcgccttcttcgcagacgaggaggcgggcggcgcctacggtgcccgctacgccgtggacaagcgtccggagctgttcgagggcgccaccgaggcaatctccgaggtgggcggattctcggccactatcggcggccagcggacgtacctcctccagacagcggagaagggcatctcgtggctgcggctcgtggcccacggcagggcggggcacggctcgcagatcagcacggacaacgccgtgactcggctggccggagccgtgacgcgcatcggcgagtacaagtggcccattgagctgacccccaccacccgccagttcctggacggagtgacggaactcacgggcgtggagttcgacgccgacaaccctgatgtcctgctcagccagctggggaccgtagcccggttcgtgggcgcaacactccagaacaccaccaaccccacgctgctcaagggcggctacaagcacaacgtcatcccggaatccgcggaggcgctgatcgactgccgcaccctgcccggccagcaggagcacgtcctggaaatcgtccgcgaactggccggcacgggcgtcgacgtcagctacgtgcaccaggacgtctccctggaggtgcccttcgcaggcaacctggtggactccatgatcgacgccctgcactccgaggaccctggcgccaaggtcctgccgtacaccctttccggcggcacggacaacaaatcgctgagcaggctcggcatcaccggctatggttttgcacccctgatgctgccggatgaactggacttcaccggcatgttccatggcgtggacgaacgggttcccgcggattccctgaagttcggtgcgcgggtcctcaacaccctcctgaccaactactgaggggccgccatgacccccgaggaagtcctgcccgacgccctcctggagcggatccgcggccgcgccgccggatatgaccgggagaacgcgttcttccacgaggacctcgaggaacttgtcggggccggttacctgaagttgttcgttccagcggacgacggcggcctgggctttggcctcgaagcggcggcacagtgccagcgcaggttggcaacggccgcgccagccacggctctggccgtaaatatgcacctggtgtggaccggcgtcgcgcatctcctcaaagcccgcggcgacagctcccttgacttcgtcctcaaggaagcggcggagggcgcgatcttcgcgttcggcaactccgaggccggcaacgattcggtcctgttcgattcgcggaccgcagccacgcccttggccggcggcggatactccttcaccgggacgaaaatcttcaccagcctgtcgccggcgtggacccggctgggcattttcggcaaggacccggacggccgggatggggaaggcgaactggtccacggcttcatcaccagggaaacgcccggataccgcatcgtcgacgactgggacaccctgggcatgcgggcgagccagtccaacaccaccatcctggatggggccgctgttccgccggaacggatcttccgcaagatgcccgtcggtcccagcagggaccccctcatcttcgctatcttcgcctgtttcgagacgctgctggcggccgtctacacgggcctgggggagcgcgccctcaccgtgggcgtggagaccgtgaagcggcgcacctcgttcaagaacaacggacgcagctacgcgcaggacccggacatccgctggaaggttgcggaggcagccatggccatggacaacctgtatccgcagctggccgcagtagccgccgacgtggacacgctggtggaccatggaccgcaatggttccccaagctggtggggctgaaggtgaacgcaacggagaccgcgcggcgggttgtggacctggccatccgcgtcagcgggggatcgagttatttccgcggctcagaactggagcggctttaccgggacgtgctggcaggcatgttccatccgtccgatgacgagtccgcccacaacactgttgccaacgcctggctgggtccgctggaaggctagaccgtccgctggacctgcagcacccgccgtcgcaaccagaagcggcgccccccgcccacgtaaagcttgctgcgctccagctcccacttgccgtactcggaatgttccaccaggcggcgccgtgcctcaggcagtgaatcatcaggactgaccgtcagcacgaggtactcgtactgcctcaaatagtcccgttcccgatggaccgagctggtgagaaattgttccttcattgctctccattttcgtccttttccggctaacgtgaagtcatgagcatcgatccgcgtgtcgcgcttcagtccttgaccaccgctatggaagaacaccttatagcagcatccaaccgccgcggagatggtgacccctccgtggaggcagcgttctttgccgtcgcagacgccttcgaagtttacgaggatgcgctctatgaggcttacaacgaggtgacgccgctccaagtctttgacgacgaggaggacgaggacgaagaaagcgacgtggatgacgatgaggacctggagatcgtccaggagtaggactgacttacagcggcgctgaaacatcctcaagggcccgggcaatttcgggcggcagcggtgtgagttgcgcgtccaacagctctttgagctgcgcgggtgtgcgcggacccacaatggcggtggccacgccgtgcttggacaggagccagctgagggatacgtcctgcggcgtccgccccaagcccttggcagccatgcagacagcctccacagtccgggacggcttctcctccaggtacggctcaacgtatccggcatcggccgctgatgcggcccgcgatccggaggggatgccgccgcggtacttgccggtcagcgcaccgcggcccagcggcgcccaagccataaggcccaggcctgcatcttcaagcgcggggatgagctcagcttcgggccggcgctgcaggaacgagtactcggactggaccgcaaccagcgggaacccggcaaccgcagccgccttcgccgtctgccacccgttgaagttggaaacgcccgcataccgcgcccggccggtactgactgcgaattccaaggcagacagggtctcgtccagcggaacgttggtgtcccaggcctgggcaaaccagatatccacgtagtcggtgcccaacctcgccaaactcgcgtcaagtccggtgagcatggcgttgcgcgaggtgtccacgccgcggcggccatccggcgtcgtcatccccgccttggtggagatggaaatctccgtccgcgccacgacgtcgcccagcagtgagccgatcattgcctccgaccgtccgccggcgtaggacgcggcagtatcaacgtgccggccgcccgcactaaggaaggtacgcaggagttccgaggcgtcctgttcgtcggtttcgccggcccagcccatagtgccgagggaaagggcggacacacgcaatccactgttgccgacgtaacgctgctgcatagcagcaagcttacgggcagaaccggcactgcctatgacgtagggtcttagcgtgaactggtttgaggcggccctgctgggcctagtgcagggactgaccgaatttctaccgatttcatcaagtgcgcatcttcggattgtggggcagttcctgcccaatgccgctgacccgggggcagcgttcacagctatcacccagttgggtactgaaaccgcggtcctggtctatttctggcgggatattgtccggatcgttaagggctggacgggttcgctttccgggaaggtatcgcgtcaggacccggacgcccggatgggctggctggtcatcctgggaagcctgccgatcatcgttctgggcctcctcttccaggaccagatcgagtcggtgctccgcagcatgtggatcgtagccaccatgctgatcgtcttcggactcttcctggccgtcgccgacgccatcggcaagcaggaacgggacctcagccggctgacctacaagcacggcatcctctatggcttcgcgcaggccctggccctgattcccggcgtttccaggtccggaggcaccatcacagccggcctcctgatgggttacacccgcgaggccgccgcccgctattcgttccttcttgccatccctgcggtgttcggcagcgggttctaccagctctacaagacggtcaccaatgagggcatcgccggaccctacggattgccggaaacggccctggccacgatgatcgctttcgttgtgggatacgtcatcatcggctggttcctgaagttcgtctccacccgcagctaccggttgtttgtctggtaccggatcttccttgggctggcgctgtacctcctgctcggtttcaatgtcatcagcgcctagcactaggcttggtgtgtgaaatcctggatatcccgccccgttcctgacgtgcccggaagcatgcccgccatccggctgttcgacacagcggtgcgccgcgaggtggtactggagaacgagagccggccgtccatgtacgtctgcggcatcacgccgtatgacgccacccacatggggcacgcatccagttacgtggcttttgacctgttgaaccgggcctggcgggactccggccgtgacgttgcctatgtgcagaacgtcacggatgttgatgatccgctcctggaacgcgccgaggctacaggtgttgactggcgggatctggctgccggccagatcgagcttttccagacggacatggaagcactgaacgtcctgccgccggaccactatgttggcgctgtggagtccattgggctgatcgtcccggaagtggaacggcttgtgagcctggggctggcctacacggttcagggcaccaatggcgagcctgacggggacgtctattacgacgtcgaggcggcgggcaagcagtccgtcgcagcggatgcgtggtccctgggatgcatctccggactggcggagagcgagatgctcgagctcttcgcggaacgcggcggcgaccccggaagggccggcaagcggcaggccctggacccgctcctgtggcgcgtggcgcgtgaacgggaaccgagctggcccggcggcagtctgggagcaggcaggcccggctggcatatcgaatgcacagtcatcgcacagaagtacctgccttcacccttcaccgtccagggcggcggttcggacctcatcttcccccaccacgaaatgggcgccggacacgcctactcccttgcgggtgttccgctggcaaagcactacgcccacgccggcatggtgggcctcgatggcgaaaagatgagcaagtccaagggaaacctggtgctcgtgtcgaaactacgggcggcaggggaggagcccgccgcgatccgccttggcatcctcgcccaccactaccgctccgactggtcctggacgaacgaagggttcgaggaggcaaaggccacactggctgcgtggcgccgggccctgcgccacgctcccgagggctccgccgcgccgcttgtggccgagatgcgcgcagcgcttgccgccgacctcaacgctcctgccgccgtctcggcggtctcccgctgggcggagcaggcaaacgccgacggcggaccggcaagtcctgccgaccaggccctggtcaaggacgcggtggacgctttgctgggagtgcttctctaaccgcctgttcacagcattgggcagcgccccctttgcagggcgctgccggtcacggccggtcctggccccgacgcttcagataacgctcgaactcgcgggcaatcgactcaccggtggcttccgggagatcggccgtgtcctttgcttcctcgagctgccggacgtaggccgcgatttcgggatcctccgtggccagttcgtccacgccccgttcccacgcgtccgcttcctcagccagttcatgcgtgtccaggggaacctggagcagttcctcgatccggtgcaggagcgccagctgggctttcggcgacggcgcctgggcaacatagtgcgggacggcggcccatagcgaaaccgtggggatgcctgccagcaatgccacctccgacagcacaccgacaatacccaccgggccttcatactgcgaggcttccaggttcatccgttcacgcagcggggcgtcgtccgacgaggtgctgaccggaatcggcctgctgtgcggaacgtccgccaggagagccccgaccaggacaacatagtcaacgttcagcgcctcggcatggaccaggagctccgccgtgtaagcgcgccatttataggacggctccgtgccctggacaaagatgacatccacgttcgagtccggagcgcttgccttaaagatccgtgtggacggccatttgatcttgcgttcaccggcagcgttcctgcgcacggtgggccgcgtgaactggaagtcgtaatactcgtcggcgtcgatggaggccactttcttgccgccccacaatttgttcaggtagcgcagggagtcgctggccgcttcccccgcgtcattccagccttcaaaggcggcaagcatcactgtcacgcgctgtccgtcagctaccggctgcaggaaccgctcctgttcgggcccggcacccggttctgtggtgtctccctcgaagctattcatttcttcaccctacgtccaaggaccacggcagtgcattgaatgaagcgccgaaacatcacgcaaaagcagcgcggccggtgccggggagcgcgatattcgccaagggcgtagccatcaaccggcgcccagacagtccccgtagactgggggcatgcgattgccagccgacagttccccgcttaaagccgtcctgtgggacatggacgggacgatcgttgatacggagccctactggatcgccgccgaacacgcgctggtggaagcccatggcgggacgtggtcccatgaccaggccatgcagctggttgggcagtcgctgactttctcggccgggctcctccaggatgccggcgtggagctggaaatccgggacatcatcgacaccctcacaggttcggtggtcagcagcgtccagcgccaggtgccgtggcggccgggtgcacgcgaactccttgaggaactccacgtcgccggcgtccggtgcgcactggtcaccatgtccgagggcccgctggccaggcaggtggtggccagcctcccacggcaatacttcgaggtcctggtaacaggggacaccgtaacccagggcaaaccacaccccgaggcgtacctgaccgccgtcgaatggctgcaggacgcagacccggacctgggcctgcaccactgcgtcgctttggaggactcggtgcccggtgtctccgcggccgtggcgtccggcgtggccaccgtggcaattccccatattgttccgctgcccgaggatgagcgctacaccctgtgggattccctggcaggccgcaccgtgaccgacctcgaatcgctcctcctcggcgtcccggggcttcgcgggtccgctgaaccagcccggccgcttggggaccgccggtgaccgagaccactgtcccgcccaggcgcgaaggcattccactgggccggattgccggcgtcccggtggtgctggcctactcctggttcatcatcgccgccttcacggtcatcgtgtatggacccgtcctggccgggcagaacccggccctcggcgtcagtgcctacatcgtggcgttcgcctacgccgtcctgctgctcgtctccgtcctggtccacgaactcgcccacgccctgacggcaaaaatctacggctggcccacgcagaagatcgtgctcaacctgtggggcgggcacacccagtttgagagcttcaccgcttcgccgggacgctccgtcctggtggccctcgccgggccggccgcgaacttcatcctggccggaggagcatggctccttctcagcacggtaagcatgggcagcgttgccgagatcctcaccaatatctttatgtgggccaacttcctgattgctgtcttcaacgtgctcccgggccttcccttagacggcggacggctggtcgaatccgcagtgtggaaggccacgggcagccaggccaagggcacggtggcggctggctggggagggcgcatcatcgtcgtcgccatcggttactggttcgttgccaggccgctgcttgccggggatgctcctgacttcagcctgctgatgatcaccgtgctggtaggtggtttcctttggatgggcgcctcagcatcgatccagcagggtaccctccgggggcggctccacctggtcagcgcggcagggctttcgacccccgccgccggcctgccttcagcggccacagtggaggacgcacgccagtacattggcgggggcgccacgtcgctggtggtctgcggaccggacggccggccggaggcagttgtggatccggccgcactgtcctcggttcctgtccacgccgcggcgtcgacccccatcaccgccgtctcctatgcgttggctcccggcgcctatgtccccgaatggtccaaaggacaggaactgctccagttcctgtcccagctggaaggacggcactacgccgtcgtagaccacaacggcaaggtgaccgggctgctctcccaggacgctgtcctggccgccatcactggaaaaccgcgacggcccgatacgcgccggcaggaccaaaaccggtagagttacctgccggccggtgcattgccgccgcacacgccggaatgtttccacacaacatgcaggcgccacagttttacaggagcgaggaaagtcatgagcagcgaaaccgccgtcaacgaagccacaggagcagcggtcccggccggggctgcaaccggcggctcgcagccggtgggcgccgcgcggcgccggggacccttccgcgaaggcgagcgcgtccaactgacggacgaacgcggccgcatgaacaccatcaccctcgaaagcggcggggcattccacacccaccggggcttcctgaaccacgacgacatcatcggcatggtggacggctcagtcgtcgtgaacaacgttggacagcagtaccagaccctgcgccccctgctgtccgattttgtcctgtccatgccgcgcggtgctgccgtcgtttaccccaaagacgccgggcagatcgtcaccatggcggacatcttccccggcgcccgcgtcgtggaagcgggtgttggctccggcgccctctccatctcgctgctccgggcagtcggtgacaacggctacctgcactccttcgaacggcgtgaagagttcgctgacatcgcccgcggcaacgtcgagacgatttttggcggcccgcaccccgcgtggcaggtatcgctgggcgacttccaggaagaggttgtccggagcgaggcgccgggttcagtggaccgcgtggtgctggacatgctggcgccctgggaatgcctggatgccgtggccacggtgctcgcccccggcggtgtctggatcaactacgtcgccaccgttacccagctttcgcgcactgccgaagccatccgggccgatggccgtttcaccgaacccgacgcctgggagtcgatggtgcgcggctggcacctggaagggctcgccgtcaggccggaccaccggatggtggctcataccggcttcctgctggtcacccggcgcctggccgacggcgttaccggcatctccgtcaagcggcgcccctccaagacagacttcaacgaagaagacgtcaatgcgtggacgcctggtgctgtgggggagcggcaggtctccgacaagaagctccggcgggcagcccgggacgccatcgcgggcacaaacgtcaaggacgatcccgaggtcacgaactagtccacatttcgggagtctccatccctacctgccttgttggggctaatgtcttaatagaagcgcaggaaggggctgatacatcatggagacaccaaaccaggactccggacgtacaccggcagagcagtctgccgccaacgacctctcggttgcagaccgccaggtcaacatcctccgggacaagctcaggcacatagatcgccagctggctgcggcaacgcagaacaacaccaagctggtcagcatgcttgaaaccgcgaaggccgaaatcctccggctaaagaacgccctggaccaggaagggcaaccgccctacagcttcggaaccatactccagctgaatccaaagcggcagccgacacccggcagcagcgggcaggcggccaccgaggaatcggtggacatcttcaatgccggccggaagatgcgggttggcatcagtcccctggtgaacatgaaccagctggccgtgggtcaggaggtcctcctgaacgaggcgcttctcgtcgtcgccgggctcggctacgagcgcgcgggtgagctggccacgctcaaggagatgctgggagcggaccgtgccctcgtggtggggcgtgccgatgaagaacgggtcgtccggctttccggcgcgctcctggcccaaaagctccgggtgggcgatgccctgtccattgactcaaggaccggatacgccctcgaaaaagtgccgcgctccgaggtggagaacctggtcctggaggaagtcccggacatcacctacgaggacattggcggcctggggccccagattgagcagatccgcgacgccgtcgaactgcccttcctccaccccgacctgtaccgcgagcacggcctcaaggcgcccaagggcatcctcctctacggccctcccggctgcggaaaaaccctgattgccaaggccgtcgccaactcactggctgcacgggccgcggagcgttccggcaacgtggacctcaaaagctacttcctgaatatcaaggggccggaactcctcgacaagtacgtcggtgaaaccgagcggcacatccggctgatcttctccagggcacgcgaaaaggcctcggacggcagccccgttgtggtgtttttcgacgaaatggattccctgttccgcacccgcggcaccggaatctcgtccgacgtcgaaacaaccatcgtgccgcagctgctcagtgagatcgacggcgtggagcggctggacaacgtgatcgtcatcggtgcgtccaaccgtgaggacatgatcgatccggccatcctccggccgggccggctggacgtcaaggtcaagattcaccgtcccgacgccgaggccgccgccgatatcttcaacaagtacatcaccactgaccttccgttccatgaaacggacctggcagagcatgacggcgatgtgcaggccacggtggacgccatggtccagcggacggtggaagccatgtattccacggacaagtccaacgagttcctggaggtcacctatgccaacggtgacaccgagatgctgtacttcaaggacttcaactccggagctgtggtgcaaaacgtggtggaccgcgccaagaagtacgccattaaggacctcctgaccacccaccaaaaggggcttcggatcgagcacctgctgcgcgccgtcgtggacgagttccgcgagcacgaagacatgcccaacaccaccaaccctgatgactgggcacggatctccggcaagaagggcgaacggatcacctacatccgcaccattgtccagggcaaagccggccaggaacccggtaaatccatcgagacgatgccgtcaacaggccagtatctatgaccgctgcaccggagcccgccgccgggggaacattgccggccggcggggccatgcgggtcatgggcgcggaaaccgaatacggcatccacgccccgtccgcaccctcggccaacgccaccatgatgagcgccagggtggtccaggcctatgcacaggtaacccgccagcgcgccgccggcggtgccgagacccgctgggactacacggacgaggagccgctccatgacgcccgcggctggacagtggaccgcagttccgcccacccaagccagctgacggaccagccgccggtactcgatgcggaggcggtggcgctggcctacggccgcgaagaacttgaactcgacggccaggacgagtccgggacactcctgatgaacatggtcctgggtaacggtgcacggctgtatgtggaccacgcccaccccgagtactccagcccggaggtcaccaatccccgcgatgccgtgaggtgggatgcggccggcgacctggtggcgctggccgccgttcgccgcctggcggcagatccggaccttccgccgatcaatctctacaagaacaacacggacaacaaatccgtttcctacggctcccacgagaactacctcatgccgcgctccgtgcccttcggcgatattgtgcgcgggctgacgcctttcttcgtcagccggcaaatcatgtgcgggtcgggccgtatgggcatcggccaggacgcctcaacgccgggataccagatcagccagcgcgcggatttcttcgaggccgaagtagggctggaaaccaccatccgccggcccattatcaacacccgggatgagccgcatgccacagcggacaagtaccggcggctccacgtcatcatcggggatgccaacctgagccaagtctccaactacctgaagttcggaaccacggcgatggtgctcagcctcatcgaggcaggattggcgccgaaggtcgaagtctacgagccggtcgccgcactccaggcggtgagccacgacaccacgctcaccgccacgctgcggctgctcgacggcaggcgggtcaccgccttggacctgcagtggatgtatcacgaggccgctgccaagctggcccaggacaccggtgtaggagacaaggtggacggcgacggacacacacatgatgtcctggaacgctgggccaccgtcctcacccagctcgacaacgaccgggccgctgccgcttcctcggtggaatggctggcaaagctgtctctgctcgacggataccgtgaacgtgacgggctggaatggaacgatgcccggctgggcctcgttgacctccaatgggctgacatcaggccggaaaaaggtctgtactaccggttcctcgccaggaaccggatgcagaggatccttgaagacgcggccattgcaggagcagtttccgaaccgcccgcggacacccgggcattcttccgcggcagatgcgtcagcagcttcggcaaggatgtggtgggcgccagttgggactccgtcatcttcgacgtcccggggtacgggcggctccagcgcgtgcccaccagggaacccctccggggaacgaaagccctgaccggcgcgttattcgaacgctaccgggaggcgggcccgttcctggcagagcttctgggacataacgctccgcctgcggcgtaaaccgccaccggaagcccacaccgtggcaggatgggcatatcggaggatccgccggatccgatgacggatacaaggaggggtaacaatggcaggccaggagcagcaacagccgcaatcgcgcgacagccaggtcgacgaggacattcccgaggcgccgcccgcgccgccggaggcacaggcatccgcatcgactgaaggcgtcgacgaccttctcgacgagatcgacggcgtcctcgaatccaatgctgaagagttcgtccgggcgttcgtccaaaagggcggtcagtaacccggattcggaggctggcggaagccgcggaaggcccgaatctgtaccgacgttgaaggaccacgttcaaggagtgcatgagtgcaggaatcaaccgccaaccaggtagccgccaacgccacctcatcgtttaccgaacacctgcaacgggaccggcccgaacttcttccgtataaccggtccctccaggcaggcgtgccggcggctgcccccttgcaggttccgcatgccaccaccattgttgccatgagctacgacggcggcgtgctgatggcgggggacaggcgcgccaccatgggcaacatcatagccagcaggcacatcgaaaaagtcttccccgccgaccgctactccgtcctggggatcgccgggactgccggaatagccatcgacctgaccaggttgttccaggtggaacttgaacactacgagaaaatcgagggcacgctcctcagccttgaaggcaaagcaaaccggctgggcgccatgatcagaggcaatcttcccctcgccatgcagggactcgccgttgtgcccctcttcgccgggttcgacaccagcgccggggttggcaggcttttctcttacgacgtcaccggcggccggtacgaagaacgtgaacaccacacagtgggatccggctcggtctttgcccgcggtgccctgaagaagctctggcggcccaacctcacggcggccgaagccgtcgccgtcgccgttgaatcgctgtacgatgcggccgacgacgattcggccaccggcggtcccgacaccgtgcggcagctgtggcccgtcatctacaccgtggacagttcgggcgcgcggcgggtgccggacgccgaactggccgcagcatcgcggaacgtgatcgaggcgcggactatcgccggacgggaggcctaagatgacgcagcagttctatgtctcacccgaacagctaatgaaggaccgcgcggattttgcccggaagggcatcgcccgcggccggtccgtcgtcgtcatcagctgcgaggacggaatcgcactcgtcgccgagaacccttctccgtccctgcacaagatcggcgagatctacgacaaaatcgcgtttgccgccgtcgggaaatacaacgaattcgaaagcctccgccaggccggggtccgttacgccgatgtccgtgggtactcctacgaccgggaggacgtcacagccaggggactggcaagcgtctacgctcagagccttggagcggtgttcaccgctgaacaaaagccgtttgaggtggaactggcggtggcagaggtcggcgccagccaggcggatgaccatctctaccggctgacttttgacggctccattgctgacgagcactcctttgttgtgatgggcggccaggcagacaaagtctcctccgtcattggtgagggctggcgcagctcactgaactttgcagacgccgtgcgcctggccatgacgggcctggctccggccggagagccggaagaacaggcaaaagcacttccggcaggcgcgctggaagtggcagtactggaccgggaatcagaaacctctcgcgggtccaggcgcgccttccgcaggctcaacgacgcggacatcactgcactgctggcctaggaggacaggacatggacaagagaatcttcggcatcgaaaccgagttcgggatctcatactcgagcccggactcgaggccccttgcccccgaggaagtggcccgctaccttttccgcaaggtggtcagctgggggcgttcgtccaacgtgttcctgaccaacggctccaggctttacctcgacgtgggatcccacccggagtacgccaccgcggaatgcgacgacctggcgcagctcattgcccacgacagggcgggagagctcatcctcgacgatctcgtggacgaggcacaggcccggctcgcagccgaaggcttcaacggaacggtgtacctcttcaagaacaacaccgactccgccgggaactcctacggcagccacgaaaactacctcattccacgccgcggggagttctcccggctggccgagatcctgatcccgttcctggtcacccgtcagctgatcgccggcgccggaaagatcctgaagacaccccacggcgccacatacgcgttctcccagcgggctgaccacatctgggagggtgtttcctccgccaccaccaggtcgcgtcccatcatcaacacacgcgacgagccgcatgctgacgccgagttctaccgccgcctccatgtcattgtgggggactcgaacatgtccgaagccacggccctgatgaagatcggcacagtggacctggtcctgcgcatgatcgaggccggagtaatcatgcgcgacatgcggatggaaaaccccattcgcagcatccgcgaaatctcccatgacctcagcggccgggcattggtccggctggccaacggacgccagctcaccgccctcgaaatccagcaggaatacctgaccaaagtcacggcattcgtcaaggagcacggcccgcacaacccgcacgtcccgctcatcctcgacctgtgggagcgaacgttgaaggccatcgagagcggcgacttccgcgggatcgacaccgaaatcgactgggccatcaagaaaaagctcatggacaagtaccgtgaacgccacggcctggggctggacgccccgcggatagcccagctggacctcacctaccatgacatctcccgcagccgcggcctttactacctgctgcagtcacgcggtgcggtgcggcggatcgtggacgacacagtcatcaaggacgccgtggacgtcccgccgcagaccacacgggccaagctccgcggagacttcgtgcgccgtgcccaagaactgggacgggattacaccgttgactgggtccacctgaagctgaacgacagggctcaccagacgatcctgtgcaaggaccccttccgcaacgtcgacgagcgcgtggatgccctccttgactctatgggctgacacccagcttcaggggctattctggatagggccctttagagggaccccgcgatgccggccgctgccatgcggaacatcgcatccaccctgccccgacgaaagttttcttacgtgcgccgactactagcaatccttcttcccggtctgctgttgctgaccgcctgcggcggttcaaccgcagagccggaacccaccagcgtatccgccggcgagactgccaagttcgactccctcaaactgaccgacaacggggacaagaaagcccccggtgtggaattcaccaagccgttggaagtggcagagcccaccatcaaggtcatcaccgagggcagcggtgaggcggtgaaggcaaaccagatcgccaacatctccatcctggcgctcaacggcactgacggcagtacccttgaggacacctttcccggcgagcccgagccccttgagctcaacgatgaactgaagaccagcagcgaggttatctacaacgcgtttgttggcgccaaggttggttccagcctggccctggctgtccccgggcagcagagtgcacctgccccgagcccctcggacggagccagccccagcccgtcccctgcggcgcagcccacccagctgttgatcatcaaggtcctgtccgccgaggacgttgctcccgtactggaaaagcctgagggcgaaaccgtcactccgccggcaggactgccaaccgtgtccgaaaaggacgggatccccgagatcaacgtcgagggtgtggctgccccgaccgcactggtttcccaggatctcatcaagggcaacggcgccaccgtgaaggaaaccgacaccctcaccgtgaactacgtgggcgtcacccttgagggcggcaccaaattcgactcgagctttgaccgcggcgaacccgcgagcttcccgctcaccggcgtcatcaagggttggacccagggccttgccggcaagacggtaggctcccgcgtcctcctggtcatccctaaggatcttgcctacggcgacgccggacagggcgaggccaagggagacctggtgttcgtggtggacatcctcggggctaagtagcaacacttactgtcgaagcaccaccggttgccgccacgccgtggccggccagcggctgcatcgaccggcagcacagataaaagcagcacagacatcaaaaggagaaaccatgtcattcggtcagcgcgaattcgaccgccagaagcccgaaatcgatttcccggagggtgacgtccccaccgagctggtcatcaccgacctcattgagggcgacggacgcgaagccaaggccggcgacaccgtctccacccactacgtcggcgtggcctggtccaccggcgaagagttcgacgcctcctggggccggggagcgccgctggacttccgcgttggcgtcggccaggtcatccagggctgggaccaaggtctgctgggcatgaaggtgggcggccgccgccgcctggagatcccctcggagctggcctacggctcccgcggcgccggcggagccatcgctccgaacgaagctctgatcttcgtggtggacctggtaggagtccgctaaaggattaccggtgccgtcaagagcgcggcagcatcaggacgcaaaatcctggtgctgccgcgctttctgcgttccgccgcggactttagtaacgtaaccagagtgcccgtatcccgtactgaacgcctcctcaacctgctgatcgcactcctgaacacccggtatgggttgcgccgccgtgagctgcgcgaaaaggtttaccacgattcttccgggaatgacgtggctttcggccggatgttcgaacgggacaaaaacgatttgcgccagttcggtttcgaggtggaaaccctgacggacatggggtggagcgaggatgatcctgccaccacccgctaccgcatcggcaaagaatccaaccgccttccggatgtccagctggggccggacgaatggactgtgctcctcctggcctctcagctttgggagcgtgccgcccttggcactgccgctcagagcgccctccggaaactccaggcgtcaggtcggctggccgacgtcgccctgcccgccggcgtccagccgcgcatcaagccggcaggacaggccttcgacgacctggtctctgcactgcacgcccggcacccggtcaccttcacataccttgcgggcagcacaggcaacgaggagctgcggacagtggagccgtggggcctggggagccggtttggccagtggtacctggtgggccatgaccgtgcccgggaagcgccgcgccacttccgtctttcccggatcaccagtgctgtcacaaccctggacagggagctgtatacgccgccggcggacttcaacgtacgccgggagctggaccgcctccctgaactgccgctgcgcagcgccgtcgtggacgtccgcgaaggaaagctgctggcactgcggcggcgcagttccgcggagggcggctcggccggccggcctgaggccggctacgagcggctgtccgtgcagtacagggaccccgaggcgctggctgaggaagtcgcctcctacggaccggacgcgctggccgtagccccgcctgagcttgtggctgccgtccttcgcaggctgtgcgcggctgcggagttcagcgctgaacctgagcctccgtacagcttcggcgctgcccgggccgctgctgtccgcaagcgcacgtccgaggaccagctcaagcggatgcttcagctggtgcccttcctggtgcacaaccagggcctgcacatccaggacgtggcagatcggttcggcatcaccaggaaggagttggaggacgatctgcagatcctgatctgctccggcctgccggagggatacccggacgatctcctggacatccactgggacgacgaccatgtgtacatcacccaggacctggacctcacaaaacctgtccgcttcactgtggaggaggcctgcgccctcctggccgggctggagacgctgaacgggctgccggaagtggccgagggcggcgcactggaatcggtgaccctgaagctgctggcggccgcgggtgaagaaggcctccgcgcggcatcccttgccgggccggaagtggcgcccgccgacgctgccacccacgccaccgtcaggcgggccatcgaatcccgctcccagcttcgcctccggtacctttcgccgcagcgggacaccatcaccgagcgggacgtggacccgttccgcctgtattcactggacagcacctggtactttgaggcctactgtcacctggtgcgcggcctccggaacttccgcctggaccgtgtccaggaagtccgcccgaacggtgctcccgtcccggacggcatcacgcccgccgaaggagtccctgccaggctgttcaccgccagcgacgacgacaccaccgttaccgtccagctcacccggcaggggagggggctggcagatgactattacgcggaacgcaccgcagagttgcccgacggcggactggtggccgagatccggttcggcacgacggactggctgccgatgttcgtggcccagcatggcggttctgccaggatactggcaccagttgagctggcggaggcgtcccgcatgtggttggcggcatccctggccaggtacggcggctagacttctcagcatgccttggtggtcctggatcctgatatgggtggcgctcgttgcgctctcactgctcttctatgtcctgttgggcattcgcctgttccgccagttcatggcaacagtcaaggatttgggggccgccggcgataagctggggcacctgggccctatggatgtgccggatgctgcagatccggcaacgccccctccgggtgcagcggtttttgcctcgcccacgctcatgcgacatgattacgaggcatccaagtcgtcccgacgggaaatgcgccgcctgcgacgtgtgcagcgcaagaaagaccggggccagccgcaggcgctcggcgatctcgactttacttagaagtaaaatgtacttagatgaaaggatttcccgtgggaagactgtttgatggcccctggcccatcgtaattatcattgttgttgctttgcttctttttgccgcaccgaaacttccggccatggcacgcagccttggacagtccatgcggatcatcaagtccgaggtcaaggaaatgaagaacgacggcaagcccgagtccaccgacgcctctggcccggtggaaggaaccatcgtcaaccaccccaaggcgaagcccggcgagccgaccgacggcactgacgttccgccgtcgaaccgcgcctgacccccagtggcactgtcgcgggcccgtaaagccaatcccgaggggcggatggctctttgggaccacctcaaagagctgaaaaaccggctgatcaagtcggccatcggcgtcgtcattggcggcatcggaggatggatactttacgatccgctgctgaaagccctggccgatccggtcaaccgcatctcccagcagacgggcgggctttcggcaatcaactttgggaccatcgcgtcccccttcgacttcaaactccagatgtcgctgctgattggcgtggtgatttccagcccgatctggatctaccagttgtgggccttcatcacgcccggactcacatccaaggagcgccggtacacgctggggtacatggcggctgcggtcccgctgttcctggccggcatctgggcaggctggcttgtggttccgcaggtggtccgggcactcacccagttcactccggacggttcgtccagtgtcatcgatgcgcgcacctatatcgagttcgtcacccggatggttttggtgcttggtatcgcctttctggtgccggtggtgctggtgggcatcaacatggccggcgttatctcagggcagaccatcctcaaggcttggcgcatcaccgtgttcctggtgttcgtcctcgccgccattgccgctcccggcgcggacgccatttcgatgttcatgctggcagggccacttctggtgctgttcttcgccgcaatcggtgtttgcctgatgaacgacaagcgccgggcgcgccgcgaggccaagcgggcagccgaaacggacgcaacagcagacatcgccaccccgggcagtgagctgaagaacctctaggcgcccgttaggcttggggtatgtcctccaacaccgggccttcttcctctggaccgttccctcccgggcccactgacttcgaagagctttcccccgccgagcggtaccaggcaagcgctaaacgcagggccgaggcagcgacgtacctcggagcctttgtccgcactctcgacttcgagctcgacgacttccagcggcaatcgtgccagtccctgcaggagggcaggggagtgctggtggcggctcccacgggagccgggaaaaccattgttggggaattcgccatctacctcgccctggagcgcggcctcaaagcgttctacaccacgcccatcaaggccctcagcaaccagaagttcactgagcttgccgagaagtacggcgccgacaacgtagggctgctcaccggcgacacaagcatcaacggcgacgcgcccgtcgtcgtgatgaccacggaagtcctccggaacatgctgtacgcggattcggcaacccttgacgaccttggctacgtggtgatggacgaggtccactacctcgccgaccgcttccgcggagcagtctgggaggaggtcatcatccaccttcccagcgaggtgcaggtggtttcgctcagcgccacagtctccaacgccgaggaattcggcgcgtggctggacaccgtgcgcggcgataccgacatcatcgtctccgagcaccggccggtacccctctggcagcacgtgatggtggggcggcaggtcatggatctgttcgcgggggaaaccaccttcgatgaaatcgccccgccggtggacggggacgggactctgcctgtaccgtccgcagacagcaccaaagggcgtggcttcgacgtcaatccagacctcctcaaggtggcgcgcagcgaaatccagcagagtttccgcagccgccagggaggcccgggcggccgcggccagcgcgggaggcgaggcaacgaccggccaggccggggcggcgacgaacgcggtgtccgtccggcgagccggccacaggtcatcgcaagccttgaccgcatggacctgctgcctgcaatcaccttcatcttttccagggcgggctgtgacgctgcggtggcgcagtgtgtggggtccgggctgtggctcaccaccgagaaggaacaacgcatcatcacccagcgcgttgacgaggccgggcaggacattcccccggatgacctggacgtcctgggcttctggacctggcgtgacggtctgatccgcggcttcgcggcacaccacgcaggcatgctccccacgttcaaggaagtagtggagaagcttttcgccgacggtttggtcaaggcggtttttgccacggaaacgctggcgctgggcgtcaacatgcccgcccgctccgtggtgctcgaaaagctggacaagttcaacggcgaagcccacgtggacattacggcaggggaatacacccaactgaccggccgtgccggccgccgcggcatcgacgtggagggccacgccgtggtgctgtggcagcctggaacggatccgacggcggtagccggccttgcgtcccggcgcacctacccgctgaactcgagtttccggcccacctacaacatgagcatcaacctgctggcacagtttggccgggcaagggcccgcgaaatcctggagtcctcctttgcccagttccaggctgaccgttctgttgtgggactggccaggcaggtgcgcagccgggaggagtcgctggccgggtacgccaagtccatgacctgccatttgggtgacttcaccgagtacgcacggctgcgcagggaactgtccgacgccgaaaacgccggctcccgcaccaagtcccgcgtccggaaatcgctcaacgatgattccctggcccgcctgctgccgggggacgtggtggatgttcccggcgggagggcacccggcccggcaattgtgctgagctcggaccacaccagccgtgaaccacggcccgccgtcctgacgctggacaaccaactgcgcaggatcgggaccgacgacctggagggacccatcgctccggtgacgcgcatccgcattcccaaatccttcaacgccaaagtgcccaagtcccgccgggacctggcctcctcggcacggaatgcactgcgcgaaaaccggccgccagcccccggcaataaccgcaacaacgactttggcctcgccaccgccctgccgaaccaggaaaagcgcatcgccgacctccgccgcgctcttcgcgcccacccgtgccatggctgcagcgaacgcgaagaacatgcccgctggtccgagcgctggtggaagctccgccgcgaaaccgacgggctggtccggcagatccagggcaggaccaacaccatcgccaagaccttcgaccgcgtctgtgatgtcctttccacctacgggtaccttgaacaagcagcggacgggcggctctccatcagccctgacggccagcggctccggcggatctacggtgaaaaggacctgttgatttcccagtcgctgcggcttggcgcgttcgatgacctggacgccgtggaggttgcggtcctcgccagcgtgctggtgtaccaggcgaaacgcgaagaccgggggctgaggccacggatgcccagcatttcgttggagacgtcagtggatatcgtcgtccgtgaatggtccgcgcttgaggacgtggaagaggacaagaagctaccgctgacgggcgagcctgaactggggcttgtctggcccgtctataagtgggccaagggccggcatctgcaggacgtcctcagcggcacagaccttgccgcgggtgactttgtgcgctgggtcaagcaggttgtggacctcctggaccagctcgccaagatcccggggctggatccccgcctggcccggctctgcgccgaggccatctccctgatccgccgcggtgtcgtggcctattcctccgtcctctgaccagcaatgccggctccccgccggcgcgcccaaacgccaggagcactgccccgtatgtcccagcctgaaccgctgcccgccccgcgcgcaaaaacagtcctctaccggaacggctccgtatacactgccgccgacccctttgccacggcaatggtggtggatggcggcacggtggcgtgggtgggatccgaacaggcggcaacctccatcgcggacagctccatggaaatcatcgatctccgcggagccctcgtggcgccagggttcgtggactcccacatccacctgacggagacgggcatcgcgttggactccctccggctgggcggaatccggtcagccagggagctgctcgacgccgtggctgccgtccccggtgacggcccggtcctgggccacggctgggacgagaccgcctggccggacagcagcctccccaccgccgcggaactggagcgggcatcagccggacggccggtgtacctgtcccgggtcgacgtgcactccgcgctaatttccgagtcactcgccgatgcggtcggagtccgtcagttggacgggttcgacggcggcgccagggtgcgccgggcagcgcacacggccgcccggcaggcaacccgccgccagcccgaagaagcgctgaagcggcatcaggcacgggcactgaccgaggcggcagccaacggttacgtggcggtagcggaaatggggtcaccgcatatcggcggtgccgaggacctgcggcttgcaggggcctggaacagcggtacccccgaggttttgccctactggggggaactggcgtcctcggaagagcatgcccgcagcctcctggaccagtttgggttcggagtgcgggggcttgccggcgacctgaacatcgacggctccgtgggctcccggacggctgccctgcggtccggatacagcgatgctcctgaagagcagggaagcctctacctcagcgtggacgaggccgcggcgcacctggcggcatgctcgcttgccggagtccagggcggtttccacgtgatcggcgacgccggactggacgccgcgctggccgcactggaactggctgccaaggaagtgggtgagcagcgggtgcgcgctgccgggcaccgctttgaacacgtggagatggttgattcggccgccgtcgaggtgctgtcccggtatgccgtgacagtcagtgcccagccgtcgtttgacgctgcctggggaggcccgggaggtctctatgagcagaggctggggaagcggagccggtccatgaacccgttcgccaccctctacgcagccggggtgcccgtatgcttcggcagtgacagtcccgtgacgccgctgcgcccctggtccagcgtgagagcatgcctggagcactacaacgaagatgagcggatctccgcccgtgccgccttcctgggccacacgcgtgcgggctggcgggcagctaagtacgccgacccgatggccggccagttggtaccgggggcgcccgcgagtttcgccgtgtgggaggttgaggaactgatggtgcaggtcgccgacgggcgggtccagtcctggagcaccgacccgcgggcgcgcacgccgctgctgcctgccctggataccggctctgacccgatgtgcctgcagaccgtccgtaacggcgtcgaactttacgcaagcccggcgctgcggtcctgaccggaccgctgccgtcctataattgatagttgcgcccgccgccgatccgttcgcagccgggcgcgttgaccatttcccctaggaaaggccccctgtgcgagtcctcaccatcattcccacctacaacgaactggaatcgctgcccaagacccttcagcggcttcgcgcggcagttcctgcgtcggatgtgctggtggtggatgacaacagcccagacggtaccggccagctcgcggaccgtttcgccgctgaggattcccaggttcatgtcctgcaccggaagggcaaggaagggctcggggccgcgtatattgccggtttcaggtggggtctggacgccggttacgacgtactggtagagatggacgcggatggttcccaccagcctgagcagcttccccaactcctggaagctgtggagcagggcgctgaccttgccatgggctcccgctgggttcccggcggtaaggtcgtgaactggccgctgtaccgccaggccatttcccgggtgggaagcacctacgcccgcctcatgctggggctgaacatcaaggatgtcaccggcgggtaccgtgcgttccgcaggacaactctggagaagctcaacctggaccaggtggattccgtcggctacggcttccaggtggacctcgccttccgcgtggcccggatgggactccgcatcgaggaacgtcccatcactttcgtggagcgggaacttggagcctccaagatgagcggcaacatcgtggtggaggccatggtcaacgtcaccaagtggggcctgcaggcccgctggaacacgctgacgcgcagaaaagcagccggccgcccctaaggctgcagcaccgccacggcggacagctgaaccaacagaaaagggagccgccccgcacgaaagtgcagggcggctccctttttgtcagagcaacaggccaaaacctttacgcggaccggcgctctccgcggcgttcgcgcaggatggtcagccggtcttcgaggatttgctcaagctcgggcagcgagcggcgttccaggagcatgtcccagtgggtacggacagctttgtcgttgctggtgtcgggccgttcgccatcgaccaggagcgcttccttgccggtcttggaaacccagacaggaggaatttccgcctctgaggagaaggtgacgaagacctgctcgccgtcctcgcaccggtactcaacacgctggcgcggagccggctctactccggactcggtctccatgctctgtgcaccaaggcgcatgccccgcaggctgcgatcgctcatgatttctccctctggtcggttcgcggtgtacaacaccgcgctagccggtggcggccaagcgccgccggactactgtgtgctctgtgctgcatctttagattcaacgcatcgcgaagcttcgttgttccagcggatctgctccggccggacaaatacacgattataccggcacccgggcggaacagccaaaaggagggacccgcccttgagcggatccctccctcacgccagccaggatgctgaaatctggtgtcggcgccgggttctagggttcggagggtttggccccgacttcgtcgaacaggccgccggcggactccggggtggtcccgcccagggcgttgccgattcccttgagtgcctcgccgacctcactgggaatgatccacagcttgttggaggagccctccgccagcttgggcagcgtctgcaggtactggtaggccagcagcttctggtccggattgcccttgtgaatggcgtcgaagactttctggatggcctgggcttcgccgtcagcacggaggatcgccgctttggcgtcaccttcagccgcaaggatcgaggcctgccgctggccctcggcggtgaggattgctgactgtttggttccctcggcagtcaggatggccgcgcgccggtcgcgctcggcacgcatctgcttttccatcgagtcctggatggagtggggcggatcgatagccttcagctccacacgggaaacccggattccccaccggccggtggcttcgtccaggacgccgcggagttggccgttgatctggtcgcgggaggtgagtgcctcctccaggttcagcccgcccacgacgttacgcaaggtggtagtggtcagttgttccacggcctgaatgtagttggcaatctcgtacgttgccgcgcgcggatcagttacctggaaatagacaacggtgtcgatggagaccaccaggttgtcctcggtgatgacgggttgcggcgggaacgaaaccacctgctcacgaagatcaagcaacggcaggagccggtcaacgaaaggtatcaggatggtcagccccgggttaagcgtcctttgatatttgcccaaccgctcaactactcccgcgcgggcctgcggaatgatccggaccgcacggaccaaaacgataatcacaaacacgatcaggaccaccagcactatggcgagtgcggctcctcctgcgttatccatacatctcctttttccccaattgttcaggctgtatcaggacttgccgtcggcatccgatgccgccaagacgacggcggtggcgccgtctatcgcggctacgactactttttgtccggcgggaaggacccccgccgcggagcgtgcactccagatatccccgccgattttgaccaggccgccatcggacgagacgggttccatcacgactgcctgttcgccgatcaggcggtcgacgttggtccgctgctcggacggtccctttttcaggtgggagagggccactggccggacaaacgcaatcatgagcagggagacgacgcagaaaaccacgatctgcagccaggggtccgcgccggcgaaatccgcgaccattgcggcgagggtacctccgccgagcataatgaaaaaaaggtcaagcgtgatcatctcgatcactgcaaaagcgaggaaagccgagagccacagtgcccaccagttttcgcccaaccattcgaacatcgtgctcccccttcgctacgggaggccccagttagggcccgccagtaactgtccttccatcgtagtgctggcgtccgccttatggggggcactgcacttttgtagggtgcatagtggccaagtcgttacgctggcgggggccctgcgggcctgaagacgttgaggcggaaccttgcctccgactggattatcccgggctggctttcaagccggctggcgatggcactgaggtctacgtggtgccccgcgggtcccatgaaggcaaggtcggctgcctccttgcgggtgagtgatagagggaattcgatgtcaagggtctccgcgaccgtgaaatggggtaccatcgccgcagccagccggctgtccttgtcttcttcgatacccagcatgcccgtgatgcgggcaatggaaccgaggtgcccggagcgtggcgtgaccaccaccagccggcctgttggccgcaggacacgagcaaactccgcggcattgcgcggcgcgaaaatgaccgtgatggcatcgaccgagttgctggccaccggcagcggctgccacacgtcccagaccaggttcagtgcctcgctgttgagccgggcagcgcgccggagggcgaacttggagatgtccatgcccatggcggctacgctccggccttctgccgccgcgtgatccagcaggacccgcaggtagtgtccggttccggttcccgagtccaggacgacggcgggttcactggacaggaagggaacgacggcggccgctacagcatctgcgaggggccggtagtgcccgctccccaggaagttgaaccgggcgtccaccatcccggcggtatcagcttcgaaggcagtgcctttgcccacgagcaggttgtaatagccctgacgggctgcgtcgaagctgtgccctgagccgcaggcaaggcgggtctgccctgtggcaccgggccccacccgctccaacggctgggagcacacaggacacagcagcgggaggtccgcgggtgaaggcatagccactatcttagggctgtccaccgggcttcccggcgggcggaggcagggggcccgcgcctcgccgtatctgtattggccctacttgggtcgggggagagcgatggggccgtcgccaaacccaagtccctcacgcgccttgccgattccgggctccgcccagcgtgcggcgtactctgcattgctgctgagcgagcgcaactgggcgcggtcaacgtagagaacgccgttcaaatggtctgtctcgtgctgcacgatgcgggcctgccagcctgcgaactcccgttgtacctgtgagccatccggcgcctggaactccagcaggactctttcaggccgggcaaccactgcctgcagtccgttcagggagaggcacccctcgtaaaaggacgcctgctccgtgcccagcggagtgtaccgggggttcaggagcgccatgaactccaggggactccgcttccgcagcgcagccgcctcggcgtcgacgtcgtactggtcctcaatgacggcgatctggaggggtattccgagctgtggtgctgccagccccacgcccggagcttcgtgcatgacctgccgcatgagcgcgatgagccggtcaagctgatcgggagacagctgcccgtcaaaagctgcggcgcgctggcgcagggcggggtggccggcctgcactatgggcggcagcgtccccgctgacaggatccgctccacagattccctggtctcttcgtcgctgagggtggtgtccggcgctttctggctcatggtgaaaagcctactggcggtgtgggatcctgccggccggcctgggctaatgtcttttccatggctgaacaccactccctgaatacccctgccctggactgtgtcctcagattcatccgtgtcctcgaagcaggcggaggatccgctgagattcggcccttcctggccgagtccttcgtgctggtcgaagcgccgcatctcctggcgccggaaggttccacccggacactggcctctgtccttgccggtgctgaccaaagctcggaggtggtgtcggaccaggtgttcagcatcaggcgcaccacctgtgaaggcgggagggtggcggtggaggcggactggtcggcaacagtcctgcttgatctgccgtactgggacacgggagagaccatccgtgccaggacgtcatctgtcttcgaggtcagggacggcaggattgtgagccaggacagctacgactgttacttccggggtggttcctgaccggcatgcccttccagcgttcgtggctgctgcatggtgaagcgcctggcagtccagcggttaatggctggaaccgaagcggcggcgccaatggccaggtttcgcagctgcaggaagggtgacggcaggggacggcccaggatcatgttgatttcggactggcgcctggcgatgacggcggcacgccgctgtcgggcctcgaactctttcagtgccccttccacgggctctcccgccacgccccggcggatcaggggcgacagggcctgcacagccatccagcccaggttcatgccttggccgccgattgggctgatttcgtgcgcggcgtccccgatcagcagcgcccgtcctgccacggtgcggcgggccagcgtggaccgtacgctgaacgcgctcagcatggtgttggtctccacatccggcaggattcccgtccgctgcagcaccaggcgggccaaacgatgggcgtctgctgcctccgccggcttgccgagccgtaccacccaccgccgcagaccgcccggcagcgggaatgactcaacgattccctcggattcaaggaagaggactgccatctgcccgtggtgtccggagtctgcaaagtcgcccatcaggtagtggtccggataggccttggtgcagacgggcacgccaagcaccttgcgcaggtgcgatctcgcgccgtcggcggcgaccacaaaggacgccgggaagtcccgctgtccctccccaccagcagaaggttcgacgacgacggcggcccttgcgccgtcgtcgtgcagtcctgtgacccttacgcccctgacgatcgcctcgctgtcgagggcaaggacgcgatcctccaggagctgttctgtccggtactgggggagggccagcacgaacggaaaggcctccgaaacgccgtcgaaggacatgctccccaaagttctaccaccgctgaccgcgaggcctgtacggatcggcaccccctcctggaccatggcggcggccagctgtacctggtccagcgcgtcgagggcaggcgggtggattccgatggcgcgggtatggatgttccgttcagtcctctgttcgaggatgcggaccgagactccctcctggagaagtgcagcggccaggtacagacccaccggtccgccgccaacgatcaccacatctgtggccatgtcagttcctctggtattcgagaagctgatggaaggcgctgccggtccggaccgcccagccggggggagcgagggccgttagttccccgcgcgtatagctccggcggatggaggtcagcccgtccgcgcggatgaaggagtggcggaaaggaagtgctgcagcgctgaacagggcgtaggcggccgggctgcggcggagatcgttgtggagcgctgctttccgggcaagcgtttctgagtgtgccagcagctcttgcagttggccggcatcaaggtggtggaggacatggttcgagatcacgaagtcgtactgctttccctcctgcacaaggtcggcgctgtgggcctgccggaaactgatgccggcaacggcaggcctgcggagggcgaaggcggcggcgcggggatccgggtcgatgcccgtgatgtgcagtgtgagccggtcgcgtgcggcccatcgcgccagcatggtggcgaggtctccgcctcccgaaccgatgtccaggaccgtcgccggacgggaagtggccgcaaggaaagggcgtaattcacgaacgtacagccgccgccacccggacagcacccggttcaccagggcaaactgcctgtaggtgttgtccagggcctcagggtcgcagtcgggcaggtccatgatctccatggccccggcgtcgcgctgccgcagcaggaagtccacagggttcaggccaccggagcttccgccgccagccgttcctgcccgttgcgctctgccggtgcagtgcgtggtgcctgccgcagtttggtgaacagtgccgtttccaccgtgagcccgggaccgaacgccatggagcagatccgctcgtctccgggctcgggggcctgttccaggatgcgcttgatgacaaacaggacggtggcgctgctcatgttgccgtagttcctgaggatttcacgggccgggaccagctgttcttccgtcaggccgagccgggattcgactttgtccaggatgctcctgccacccgggtggatggcccaatggcggatggaggagtaggggagtgccgcgagttcagggtcccgggccaggagcggctgaagcgcgccaacgatgtggtcatcgatgatgtgcggaacgtaattgcccaagaccatttcgaatccgttgtcgccgatgttccatgccatggagtcttcgccgactggcgtgaggacggtttcgaaatgatccagttgcagcagggcgttttcctccgtgcccggcctggctgtaacgacggcggccgcggcaccgtcggcgaacagcgccgatcccatgatggtgtccgggtcattggatgtgcggacgtgcagcgagcacagttccgcacagacaaccaggaccaccgcggtggggtcggcctcgcagaacaacttggcggcccggagggctggaaaggccgcataacagcccatgaacccgaggtggtaacgctggacggcaggatccaggccgagttcccggacgatcttgtagtcaggcccggggttgaagaatccggtgcaggagacggtcaccagatgagttatgtcaagtaaatcgagttccgggcaggcctcgacggcggcacgggcggcggcgacgaagagttttgtggcctcgcggccgaagatctcgttgcgtaccttggtgctgggattcagcagcaggcccgtggcggcatcgtagaactgcgggtcctcagcctgaaaatcattggtcatttcctcaacggcagtaaaccgggtgtcgatggccgccgcgtcgaagcatgtgcccaccaggcgcgaaccgagccgcgtcagtccgggctgggccgcgaaaacgtcccgggcctcggactggatcagcattgttttcggaactgcagtttcaagtgaacgcacgtagaccgtcattggttcattcttagcgagcggcgggataaaggcaacggtgatcgcggcgctgacctgcggatttgttcagtgtttctctgggacgtcagcgtggcggatccggccgcttccggctggctgataaaacgccgataatctacattatgtaaagtagaacagtgattattgcatccgatgcacgatcacctctcctccgcccattgccacccggcacccccgcgactgcagcagaaaagtgcctgtgacctgcggaaacgcatgctattgcctgttgtgaccgctggtaagccccaccgaagcagagccttcgtaagcggagggcatcaagctggaacagccctccgatccgcggatttgcgcggacttctgcattaattgcatgattcttgcatccaatgcaatgtatcaggaggtttcgtggcggtcgattcagcgggacgggtgctcgacttcggcgctgtgcgcttccttcaccccgaggaccacgtgttcacccagatgcttaccggctggcgcaaccagcagctgagccggaacctggcgtttggcaccatcgagggccgcgaacggctagtaacgcggttccaggagtccacaaacgagtatccatggcagtggaccccagctcacgtggacgagttcttcggggatctgcgcagcataaagcacggccgcgcagtccaccatccggagctaccaggcagcgctgagggccttctgcgcatacgcagcgtcgcctgattatggctgggaccgggtctgcgaacagcacttcggtacgcaccctgtccaagtctgtttcgactggaacaccgcggtccatgcccaggcgaccgaatcggctccgaagcggcgccccttcacccggcaggagctgcaggccttctttgaccgggccgatgacgaggtggaccgcatcgctggcctgggccgcaagggctggctgccggcctaccgcgacgcggtcctcttcaaggtggcctactgctggggtctccgccgcaacgaggtcaagcatctgcagaccgtggattttgcccgcaacccgcacgcccgggaattcggcaagtacggggtcctgcaggtccgctacggcaaggccatgaagggttcaccacccaaacgccgcagcgtcctgaccgtgttcgactggtccacggagatcgttgccgactggctggaacgcggccacccgcacatgaccaacggtctggacctgttcccttccgaacggggcacccttgtttcagagacggcgctgaaccgaaggttcaaccggtactgcgaggatctgggcctctcccccggcctggacatccactcgctgcgccgctcctacgtcacccatctgatcgaatcaggcatggacgctttgttcgtccagcaccaggccgggcatgagcacgcctcaacaacggccctctacacctccgtctccagcgactacagggtcaaaacactgcgccgcgccctggactccacgatccgggacgcgctggccggaatggaagactgaacgcatgaaacgagagatcgactaccgctggcggcttgcagaactcatggcggcccggggaatgcacaacagcaccgacctcagtcccttgctgaaggaacgcggcatcgaactctcggcctcccaggtctaccggctcgtcacccaacgccccgagcgcgtctcactcatgatgatcgccgcgctctgcgacattttctcgtgcgggcccgaggacctggtcaccgtcacggcaacggacgccaaggtccgcaaggtcgcctctgacgccaatgtcgtggacctgaacaagaccatccggcccaaacgtgcccgcgtaatccgcgatgacggctgaaatcacaccgcggattgccgtccgcggccggccccgcaccaccggggcgttcatttgcgacagatgctccagggcagccggcaaacaccgcgccagctggccggaaggcaggatctgcgggacctgcttcacgatcgccatgcgcacccacggcacctgccccggctgcggaacagagcgcatgcttcccgggcggtctgctgcccacggcgaccaaccggtctgtgtcgattgcgcaggcatcacgcaggattaccactgctcccgctgcggcacggaaaccgagcactaccgccagaacacttgcgcgcgctgctcacttcgggacgacctcaccatcctgttgcgcgtcgacgaggcccagggaccggaaacgacggcgacgaaactgctcggcacgctctgccgagcccagcgccccgaaagtatcctcacatggctgcgcaaacccggtgtccgcgacttgctcgcccggcttgccaccggcggcatccccctcagccatgaagcactggaccaggaaccaaacagcctacgggtggagcacctgcgcagcctgctcacccaccacaacctactgcccgggcgggatcactacctcgcgctctttgagcggtggctacccagcaaactcgaggacattgatgacaccgagattcggcgacccattgagtccttcgcccgctggcaccacctccgacgcatcaggaccatatcggcagccgggaagcccacccagggccccatgcacagctcgaaacaggaaatcaccgaaaccatcaaattcctcacctggctcaagctcacccacggacgaacggtcgcctcctgcctccaggccgacgtcgacgcctggctggccgacggccccacaaccagacacgccatcagaacctttttcgcctgggcagtgaagaaccggacctgcaccaacatcaccattggcttccggcaggccaagacagttcccctactcacccagggccaacgactcgccatgctcaaggcctgcctcaccgacaacatcgacaccctgtcctaccgggtcgccgccactctcctcctgctctacgcccagccggtcgtgaagatcgccgcgatgaaaagcacggatgtgatcctcacacccgatggtctgcgcctgtcactcggggaagaacacccagcgccagtgcccgaacctttcgcctcactgctcacagaacacctcgcctcacgccccaacatgcgcaccggcagcagctccggcagcccgtggctcttccccggctaccgcgccgggcaacacattcaccccaacaccctcatgatgcgtctcagagaaatcggcatagacctcctgggcgcacgcaacgcgtccctccgcgccctcgtcaatgaggtccccgcgccgctcgtcgccgagatgctcggctacagctaccaggtcacgcaaaagcacgccatggcatcagccgaaccctgggctcgctattcgcatatccaacccggggcggataatggcggataccccctgaaaaggagcgagtaatgggaaccaacagtgcgcatactcatcggatctagcagcccgcaaagcattcatgctctcgtgacatccagcgacgccgagaaggcttcgtggttgacaggcatcgctctcgtcccacagacgcctgggcagattacgctatcgactgatgcagacatgttgggctcagcatcgtggcgcctcgacagtctaagcctgatgaaagttttgagcacggcgggacatcccctggaagttccatcaggccccactggcaaaacgacgcaattccaaggccgcgcgtccatccgcgcttgggagattgcaggctccctgcacgtcgacctcgagctgccacacctagtagcaggcaatcaggacggcgcttcagcctcctgggaagaagtgggcttagatgctcatattctcttggcggatacacacgtcatgggtagggcggagatgctcatctcgtttctgcgagttcgatacacctgatcgagaccccaacggcgactgagcacaagattctccagctccgcctctcgacagtgacacaacgcaagatctcaaagcgaattctagggaatagttcgaaaacgaatatgcaccgttaccagtaaagctgtaagcgggctgagaggctccgcccccggccaatcgacctcccctgttcctcgccttgcggccccgacggaactcccacgcgacgtgacgtaaccaagcggatgcccaaaggcgacggcgcgccgtcgttctgtctcccgaccaatgaatgccaactgatcttgccacagtcatgttttcgccagaggccagtccgtcccggacatagcgggtgcacccaggtgtggcacgccttcgaatattccgtgagacgccgccgctcccccgcggcggcgtctgacgtgggaaggcctgcactccgcactcggtttgcttctgtctggttgacggtgccggccggcctcaaagaaccaaggttcgcggagtcaccgtgaggttgattccagcattggcgcccagaaggtccttcgcgaaatccggaacaccgatgtgcccccgccagcggccgggagtatcgtccatgtcccgtaactggtccttgtcctcgggattccagtcgcggacagctgtggggatggcgctgttccaggccgcccaggctttgggcagcggccggtccttgccgggaggctcgatgtcgacaaccagggtgtcctgccagtcttcggtttgctccaaatggtcatcaaagaagaagtgtccctccttttccctgatggacatcaaccgcagtctgagcgcatgacggagtcggggcacctccctgccgccgacccgtggccgcggtgctttcgaggaaaggaaagtggtcagcagcggcagcggcgagtcgatcggatccccttccttccaatgttcgatctggacaggacagaagtgcgcggcgctctgttcatggaccataaccggcaggccccgtatggccaggcccacgtcaagctggaactcaacctcaggcggggccgctttcccaacagtgaaaccggccagctcaacttcgatcttgaggtcgccgaagaggaagcgctgaaggttctggtatccctcttccgaattgacgatgccgtaacggccgctgtggcttcggtgcaccaccgccaacggcgcaccctggacagcggcgttgtcgatctggaccaggccgtcgctccgtgctcctaccgctttggacgaaaggcccaaggcgacgtcatagtcgccaggattggagccgacaagacaaaacaattcgtccagcgggaacccgtcgtcgggcatctgcgtcccaacgaaagccttgcgtgtcagcgtccgcctgagggcaggcggggtgaggtactcatacatcctgtccggcccgaagatgtctgccccttgaacaccaaggacgtcacggatcttctcaaggaggccaaagccgacggcgaagcgtattccgccatgtggtgtggcataggtgaacacccgggccacgtatctggccccggcggcaggatcgattttgccctctttgccggcaagggtttccggtatgacgcgctgcagcagcgaccggcagatcagccctcccatcgagtgggcaaccaggaaaaccttgggggcaccggtcttgtcaagcaccagcttaatgagctcaaacagatcccgtgcggcgtcttcgaaggagaagctctccccctcctcgccgaaagtgtccgcggagtcatcgtaaaaacggtggatccatacagaggcaggctccacggaaccggagtccacgctgttgaggaaggcccactggtcgccatggaccgggacttcgtacttgtggtcggtgacaagtcgcagcatcggagactcgaactggtggaactttgcgcgtccgttgccgtccgcacggacatggacagagccctggctgaacccgtaaaacggatcatccacggcattgtttatggcagagcctgtcccggcgaaaccgcggacataaatcaccggcagcctgccatcatcgccggggaatcccatgcctcgtcccttctgcaccaacgaatccggatctttttaccaagaggtgctggctcctgttgtgggcagtggatcactgaaggcgttaccgccgcgttacggcgctgcccatctcctcgcaccagtggacaacagcccgtgataacgcggccgtaacggcaccgcagtgtactggtctgaggtgaccagcttccgaggagccagccatgaatgaccgagtagtcgtgaatgaccagccagctgctccccactgtgacgtaaagccccagacccgtccggtcctccgcccggatctttcgacccgcagagagcgccttatccgcctgctgaggctcaagtgggtcaatggcactgtgctgcactactggttcctggacgcgccggcgccacagaaggaagcagcccgcaaagccttcatggaatggaaggacctgggcatcggcctggaattctccgaggtggaagaccgcagcgaggcggaagttcgtatcgcatttgaccagggcgacggctcatggtcgtacgtcgggcgcgatgtcctggggattaacgccaacgagccaaccatgaactttggctgggatctcaccgacgattacggccgcaccacggcgctccacgagatcggccacacactgggactgccgcacgaacaccaaaaccccttctccggcatcgtctgggacgaagcgaaggtctatgaatacttcggcggcgcacccaaccactggccatcggagcagaccctgcacaatgtcctccggaaaatcgataccagtgaggtcgaagggtcatcctgggaccctgattcggtcatggaatactggttccccgccgggctgatcaaggaacctgcccgtttccagtcggggctacacccgccgggaggcctgtccaccgcggacaaggaatgggtgcggaaattctttcctccgctgcaccccacactgcctgtcctccagcccttccaatcggtgccgctctcactggtcccgggcggccaggccgactttgcgctggaaccgcaggcatcgcgcaaatacgagataagtacctttggcgcggccgataccgtactggtcctgttcgaggaagtgcagggtgagttgcgcttcgttgccggagacgacgacagcggagaagaccggaactcacgggtgtccgcaaagctattccagggcaggcggtacgtagtgcgcctccgcctgtactgggccggcgagtccggacagaccgcagtcatgcactggtgaccgggccggccattcttgcgccaaaatttcggaaacgcgagccaactcctgattttcctccagcaagatcagagcacctgaacagacatcccgccagggagagtcagcttcaggcggttacggacaggccgggcacatgccctggcctgtccacaggcattgaactaaaccgggaggggtgagcgcgatgatgcaagagcacaactggtccggaccctctggtgagtccgatgaagatccggaggtcccctccacaggcttgttgatcatccgcacctggcacgaaccggggcatccccagggcttccgggcaagaattacctacggacagaacgccggcaggggcccaaatattgtttccactgctgacccggcagaagtactaaaggttgttaagcgctggctggccgcccagccaggggtcaccggccgaaactaggcgctcccttaccacgcgttgctggcgttgaaggacggcagcaaggagctccctgaccggctccgcgggcagcagtcccatgtcttcctggagttgctcccggtaccgctcgtaggcccgcagcgcagccgcgggattacctcgctgcagttcggcccgaatcagcagcctgacggcattctcatagagcggttcgatacccaccgcagcctcagcagctgccccagccgtcccgcaatcgcccaggctgagtgacctcgcagcgatatccgtgaaaatttgcagcctgtcctgctgcaggcggccttgttcaaacagcacccagtcctcataccagccgggaagcagttgtgcgtcacgcagttcgcccagcagggaggcagcgcccgcgttgatgccggcctggcccaatgcccgcgcatgttcccggatccggttcagatcgacgtcaacctgatcgctcagggacagcagcctgccctcgttgacgatcaggcccggcacctgccgggacgtcaagtggacgctgacccgcaggctttccaaggccttggaatcggggtactcgggccacaggagccctacaagataactgcggagacgtgggcccttgatggccagggccgcgatgagccgctgctgccgtgttgcgacgtggacgacaacgccgtcccggtgcagacgccaggacccgagcaggtccagtttcaattctccatagccgtcgtcgtccatgggaacccgatttcggttcaactaaaggtggtggatcagtagaactgaggatcctcatttcgattgcccttgtcaatgtgttctgtcccctttttccaaggggagagaccgctatcggtatggcttcccggccagccagggccatggacccaccgggactttcggctctgccggctgcagcagcaccgcttcatgctgtatgtccgtgcaactgcacgggatgtcctgaagcagtgtggccaggaggctgcaaacagtgcccaataccggatcacatccgcagaggccaccctggaggcgcgcctcccaggctgcccgcaccatcatgaacggcgggtataccgggccggccatcgctgtggccttggctggaggatgggggctcctctccgggttgttgatgcctcggggcccgctgacaacagctgaagcactgacaaccatggctgtcagccttctcgtgggcatttctgcgggtgcactgatgcggtcgcgctgggcgattctggtttcacctgccgtttccgtcgccgtgtttgaggcagcacgcatgggtgttgaaggaccgaccgtggacggtgtccaggccagcccctacggcctttttgcgttcatcgtaggacgtggtttccacgcccttctcggcctcacgcccatgattttcggcgcggccatgggagctggacttatgcggtccggccaacactcccccggtcgccacgcagcactttggcgcagaactcggagaaccgtggccgtcgccgtcggcctggcgctcgttgcgttggctgccgtgattgcccggccggcatcgaccgcccccgtggcgggccctgacggccaacccctggccggaagcattgcagagcttagctctgtgcggaccggcggcaaggacctgggcctgatgctgcgcggtgccagtacccgtaatccggtcctgttgttcctggccggcggccctggtggatccgaactcggcgccatgcgcaaccatctccctgccttggaagaaatctttgttgtggccacgcttgatcagcgtggcacaggcacgtcctacccggaccttgacccaacctccaccctaagcctggagggatacatcgaggacacgcttgcggtgaccaattacctacgggatcggtttggccaggaacgcatatatctcatgggccagtccggcggaaccatccacggcgtcattgccgtacagcgggccccggagctctaccgcgcgttcattggggtgggtcaaatggtcagtccgctcgagaccgaccggattttctaccaggacacccttgactgggcgaaaaagaccaataaccaggaactggcccgtcagttggaggacatcggtcccccgccctacaggaggatgctcgactacgaaaccgccctgtcccatgaatatgctgtctacccctacgaccacaccggcaattccgaaggtgagggcgggttctctgaaaacttcttcgtccccgaatacacctttaccgaccaggtacatctgctcggcgcgttcatggacaccttcgccgtcctgtacccgcaactccaggacaccgacttccggaaaacagctgtctcgctggatgtacctgtcttcttcgtccagggcgcgcatgaggcgcgcggccgggttgaacccttccgcgaatgggtgtcggttctggctgcgcccggcatagaggtggtggaatttgagaaatctgggcaccggccgctgttcgaggagcccggcaagttcgtcgcttacatgcgggacactgtgcttgccggcacgccataacgagttcctgcccgggaaggcggaacgcagctgggcgggtcagcgcgtggacccgatcccggcccctaccagcgctccgacgccaagacccagcgcaaaaccgagaaacgggctgtcgaagacagccaggccaagggtgatgcccaccgcggcgccaagcagggagcagatccagagcggcttgttcacagggctccctttgtcatcgccgcaccggcggcgtcagccgtcataggccctctggagttccgcgatgtccagctttcccatacccagcatcgcctgcatcgctcgctgcgagccgtgcggatcggggccggcaatcagtgaaggcaggatcgacggaacaatttgccatgacactccgaagcggtccttcaaccagccgcactggctttcggagccgccgtcggtgagtgcttcccagtaccggtccaccgcggactggtcctcgcagtccaccacgaacgagacagcttccgtgaagctggagccccgcgcaccgttcagcgcagtgaatccgcggccttcgagttcgaagtcgacggcgatagcctcacctgccacgctcggcccgccctccccgaagcgcgaaacgttcaggattttcgaatcgtcgaagaccgaggtgtagaactgtgccgcttcttccgcctggttctcgaaccagaggcaggtaccgattgtccgtggcatacgaggctcccttccggctcgagcctaatgccgcattccacaccgcacaacggctggcattaggctcgaatccatgagttcccgcgctgtaaaagcaccaaagccgcccaccatgcccctgctgctgggagccgcagcagccgacgccctcctgatcctggtgttcgcagctgtgggacgcgatgcacaccagcgtggcgacattctgaccggcgtcctgctgacggcctggccgttcctcgcgggcgcggccctagggtggctggtggcaagggcatggcgggacccattgtcggtgcgccgggccgggcttgccgtgtggctcggcagcgtggcgggcgggatggccttgagggccgtgacggggcagaccgtagtgctcccgttcgtcatcgttgccttgctcagccttggcgtcttgctggttggctaccgcctgctgcttgcgggtgcgaggcgccgccgcgagtgagcggccgaacgcagtatgcgccgtccgcacgcagatgctgatgtaataggctggcagcagaagccggccgggcactgccacggcgcaacagatccgaaagggttcaacgtgatcaccgcattcgtcctgatcaagaccgacgctgcccgcatccctgagacggccgaggaaatctccgcgatcgagggcatcagcgaggtatattccgtcaccggcgaatgggacctcattgccgtcgcccgggtccaccggcacgaggatctggccgacgtcattgcagaccggctctcaaaggtgccggcagttgtccacaccacaacgcatattgctttccgcgcctactcccagcatgacctggacgcggcgttttccctgggcttcgaacagtagccaggccgccctcagcgggcggtaagggaaacccacttctcaaggacggctgcggcggcgccggaatcaatggactcggcggcgcgggaaaaagcgttcttcatccggtccaggaagggttcgtcggccgcttcgtcgaaagccaccagtccagcagcagcgttaagcaaaacggcatcccgggcggggccttccttgccggcgaggatgtcacgtacgacagcagcgttcacttccgcgttgccgccgcgaagctgctctaccgttgccaggctgatgccaaggtcctgcggcgaaaaagtcatttcgctcacagcgccgtcccggatctcccagacggtggacggcccggtggtggtgagctcatcgaggccgtcattgccccggaagacgagtcccctgctcccccgctgcgccaggacccccgccaccagcggcgccatcctggcgtttgcgacgccgacagccgaggcctgcactttggccgggttagtgagggggcccaggaaattgaacgcagtgggaacagccagttcccgcctggggaccgcggtgtgacggaatgacggatggaacacctgcgcaaagcagaaggtaatccccgcctcctcggcgttgcgggcaacctcatcaatggtcaggtccagccggacacccaaggcttccagcacgtcggcagaaccggacgacgacgacgccgcacggttgccatgcttgaccaccttagcgccggccccggcagcaacaagggctgccattgtggagatattcaccgtgttcaactggtctccgccggtgcccacaatgtcgagtttttcgcccgaaatgcggatggggtttgcgtgggcaagcatggcatccaccaggccggcgagctcctccacagtctcacccttggcgctgagggccacaaggaatcccgcgatctgcgccggcgtggcctccccggacatgatggtgtccatcgcccaggacgtattgtcagcagtgaggtccgtcccgctgatcagtgccgagatcaggcggggccaggagttgccggacggtgcggaagcctgtgaagtcaccccctgatgctatcgagcgttggcggggactgaccaatatgaacccctgcgggaacttttccgcgcgaattcgcgtctttgtagaaaaagtcccccaaaaaggcggtttgcgttgggcagcacggacttttacagacataatgtctatgtgacatctgcgacccatgcccccagtaccccggcgcaccccacgctgaaccgccccaacatggtttccgttggaaccgttgtgtggctgtcgagtgagttgatgttcttcgccggtctcttcgccatgtacttcacgctgcgctccacgagcgcacagatgtgggcggacgagacagccaagctcaacttccccttcgcgctcgccaacacgattgtcctcgtggccagttcctttacttgccagatgggcgtcttcgccgccgagcgcctgcagccgcgaaggaccgggggtgtgttccagttcgcccgttggggaatgaacgaatggttcaccctgaccttcctcatgggtgctttcttcgtcgccggacaggctaccgaatacgcgatgttggtctccgagcacgtatcgctctcctccaacgcctatggttctgccttctacatgaccaccgggttccacggcctgcacgttattggcgggctcgttgccttcctgctcatcatgggccggtcttttgccgcgaagaagtttgggcattttgaagcgacttcggcgattgtcacctcttactactggcacttcgtggatgtcgtgtggatcggcctcttcctggtcatctacgtactcaagtagccagctttgattctttttctacaagaggcagaatttcaggtagcggctcccggagccggcgcaggatcgaataaaggaaccaccacgtgaaggcactctcacaaaagcggcgtcacccacttgcagcaatagcgctgctcctgatggggctcctcatcacgggtgggctctacgccgtggccaccaccgtcaatgaggccaaggcttccaccacctcctacagcgccgatgacgttgaggagggcggcaagctcttcgccgccaactgcgccacgtgccacggcatgggtgcaagcggcaccgacgcaggtccgtcgctggtcggtgtgggtgcagccgctgttgacttccaggtgggcaccggccgcatgccgatgcagatgaacggtccccaggcgatgaaaaagccggtccagttcaatgatgagcagaccaaccagctctcagcctatgtcgcatccctgggcgcaggcccggcaattcctgaagaaggcctgcttgacgaaggcggcgacgccgctgccggtggagagctcttccgcgtgaactgtgccatgtgccacaacgccgccgctgccggtggcgccctgacccgcggtaagtttgcacctgccctggcagacgtttccggcaagcacatctacgaggcgatggtgaccggtccccagaacatgcccgtgttcagcgactccaacatcacccccgaagacaagcgcgacatcatcaccttcctgaagcagatcgagaccaccggttcccccggcggtgccgacctcggttcgttgggtcctgtagctgaaggcctgtttgtatgggttgccggcctcggcgtcattatcgctttcacgatctggttgacctcccggacatcctgatacctgcgccaccgcacacttctgctgatccgtcagcagcttgatattagaaactaacccggtatccgccgggacgagagaaggatgaggcgaattatgggcaaccatagtgacggcagtccgaaccactcgggcaccgtagctacggctggtcagaatgaggtggagaagttccaggatcctggaattcctccgcaccgtttgcgcctggctgacacggacccgaaggccgcaaagcgggcagaacggcaggtcgccttactatttggcatctctgttgttggaaccctgatcttcctggtggcgtacttcgccattgacctgggagccgaagactcgagcattgccaccatcaggcttcagaacatgctgctggggctgggaaccgcgttcgcgatgctcggcatcggtaccggcatcgttcactgggccaaggccctgatgccggaccacgaagtttccgaggaacgccacgcgatccgctatgaggaggaccgccaggcggctgtccgcatcgttgacgacatcgttgaagagacgggcatcaagcgccgtccgctcatccggaacacgctcctgggtgcggttgcccttgcaccgctgccggcagttgccatcttcggtgacctcggcccgcgtcccgacaacaagctcgcccacaccttgtgggcaccccaggagggtaagctcaagcggctggcccgtgaccccgacggaacgccgatcaaggcatccgacgtcaccatcggatcggcgttccacgtcatccccgaaggcctcaatgacctccacgagggcaagctcaacgaaaaggccaaggccgttgtgctgctcatgcggctggacccggcatcactgaacccctccgagggccgcgaggactggggatacaacggcattgttgcctactccaaaatctgcacccacgtcggttgccccgttgctctgtacgagcagcagacgcaccacctgctgtgcccgtgccaccagtccaccttcgacctcacgcaagagtgcaaggtaatctttggcccggccagccggcctctcccccagctgcccatcgcagttgacgacgagggctacttggtcgccaccagcgacttcaaagaacctgtaggaccaagttactgggagcgtgatatgcatgagcgcagcatcaacagctgagcccgctttcgtcgccaaaaccaagacaggccggtttaccgacttcgttgatcagcgtgttggcggttccggaatcctccgcgaattcggccgcaaggtcttcccggaccactggtccttcatgttcggcgaagtggccctttactccttcgtcatcctgctgctctccggcacgttcctgacgttcttttttgatccgtccatggccgagacgcactacgacggttcttacgttccgttgaagggcgtggagatgtccgtggcgtacagttcgtcgctggatatctccttcgatatccgtggcggcctgttcatgcgccaggtccaccactgggcagccctgctgttcgtggcatccatcgccgtgcatatgctgagggtcttcttcaccggcgctttccgcaagccccgcgaaatgaactgggttgtgggcagtgtgctgctcatcctggcaatggctgcaggcttcaccggttactcgctgccggatgacctgctctcgggcaacggccttcgcattatcgacggcgttatcaagtccattccggttgtcggtacctacatctcgttcttcctgttcggcggcgagttcccgggtaccgcagtcatcggccgcctctacatgctgcacatcctgctggtgcctgcgctgatcctgctgatgatcgtcctccacctcttcatggtggtcgtgcacaagcacacccagtaccccggccccggccgcaacgacaacaacgttgtcggttacccgctgggccctgtttacgctgccaaggccggtggattcttcttcatcgtgttcggcgtcctggcgctcatggcaggcttcttcacgatcaacccgatctggaactacggcccctacgatccctcccccgtctccgccggtacccagcctgactggtacatcggttttgttgacggcgcgctgcgcctgatgccaggtactttcggtgactggcaggtggagcagacgtggcttggctttgtcttctcgttcaatgtcctgctgccggccctggtgcctgcaggcatcctgttcaccgtgatgttcatgtacccgtggatcgaacgctggatcaccaaggatgaccgtgaacaccacgtgctggaccgtccccgcaacgcccccacgcggactgccatcggcatggccggctttgtctggtactgcgtcatgtgggccgctgccggttcagacctcatcgccacccacttccacgtctcgctgaacgacgtcacgtactggctgcgggccctgttcttcattggcccgatcattgccttcatcgtgaccaagcgcgtcgccctggcccttcagcggaaggaccgcgaaatcgcacttcacggacgggaaacagggcgtatcgtccggctcccgcacggagagttcatcgaggtgcacgcgccgttggacgagtacaagcgttacaaactggttggcttcgagtcccctgaggtcctccctgccgtacccaacgaacacggtgtggtgacccgcaaggagaagcgccgcgcgttcctctccaagtggttcttcgaggaccgcgtcgccccggccagccccgctgagctggaagccgcccatggccatggccatggccacgaggcagtcgaggcaccagaagcagcaaagagcctgtcccactaggttctggaagccaagatgaaggcccggtccaccaggaccgggccttcatcttttaactcgcgccaggggcgggaacacggttcgggtgtcccctcaaccggcagaggtgcctagtggttgcgggccctgcgcgcaccgggccgctgcagcggaacccacagcttgtatctgtcagcgcggtagtacgacacggagtagtccaccatcgcccgggcaacaaacgcatggcgctggattttcagcaagggtgacccgacctccacgttcagcaggcgggctgtggagggcgacgcagctgtcgcctcaatcatgtcctcgccccactccatcacgaggccgaactgttcactcaggacgttgtagagcgacgtgggcggttccccgtccagcaatcccggcacgcggtgcgcgggaatgaagttctcgtcaacgctcatcggctcgccgtccgccaggagcagtcggcggaaccgcaccagcggcgtcccctcgtccaactgaagctcccgggccaggaacgcactcgcagtgatttgctcgaagctcagtacctttgccgccggtaccatcccgcgccgctgcatctcctcgctgtatgacgtcagtttgacctggagatcgagtttcggcctgcggacgaaggtccccaggcccaccaccctctcgatgacctcctcgccaaccagggcatcgatggcctgccggacagtcatccgcgcgaggccaaaacgctcggcaagatcgcgctcagagggcagtgccgatcctggcgggcaggactgcgcaatgtaggaacgcaggagttcacggagctggacgtagatcgccgttccactggtccggtcgatgtcgccagtgatggctgctgcactagaaggcatggcgggtctcccctgcattagagttcaccttccaattttagggcaggtctagaccagtgcggtccatcacccctgtcgcttggtggagctggacggcgggcagctatatttgtcaggaaatgtcatatggcggcgttaggccgccacaacaaaggagtcacccttgccagtacacaaggccgtggtcaaagcctctgtggggctgcacgcccgtcctgccgccgtcttcgtacgggctgttacagaaaccggcctgccggtgaccatcgccaaggacggtgcccagcacgtagacgcacgctcactcctccaggtgatgaccgcagacttccagcacggctgcgaggtggaactgggtatcagcgatgccatgctggatggcgctcagagccgccaggacgctgaggaagtattgcgggcactcagcgacctcctggagtcccagggcgccgcctaaggcctgctggagacactcaaaacaaagacgtcgggccccaccttccggtggggcccgacgtctttgttttatgctcgggtgttgctagtgcgcgtggtctccgcggctgtactcatagacccagccgatcagggcaacaacggccatgccggctgcgatgtagacgatccagaagcccactgccagtcccaggaagcccgtagcgcaggcaagacccaggaacagcggccaccagctccaggggctgaagtgcccctgctcgccggcaccttcgtggatctcagcgtcgctgcggtcctcgggacggaggcctacgcgcttgccggtgaacccaaggtatccaccgatcatgccggcgaggccgcccacgagcaggatgcccaggatgcctacccactcgccccagttcgtcaggaagccgtacaccagggagatcggaacgaagaagaaaactccggcaccaaaaatccaggattcaattttcattgtcagttgtccctctggtcggcgtttccgagcgtcttggctgcgggagcgggtgactcaacggtgtggacctggcgaagttcagggtggtgcaggtccagcgccggccgctccgaacggatccggggcagcgaggtgaagttgtgccgcggcggcgggcaggatgtggcccactccagtgaggcgccgaagccccaaggatcatccacctgtaccttctccgcgctgcgccaggtgatgtacacgttccagaagaacgggatcagcgatgcacccaggacaaacgaggcaaccgtggagaactggttcatccaggtgaaattgtcttccaccagatagtctgcgtaccggcgcggcatgccctctacacccagccagtgctggatcaggaaggtgccgtggaagcccaggaacagcagccagaagtggatcttgccaaggcgctcgttcagcatcttgccggtgaacttgggccaccagaagtagaacccggcgaacatcgcgaacaccacggtgccaaacaccacgtagtggaagtgggccacgacgaagtaggaatcggagacgtggaagtccagcggcggggaggccaggatgatgccagtcaggccgccgaagaggaacgtgaccaggaagccgatgctccacagcatgggggtctcgaaggtcagggaaccgcgccacatggttccgatccagttgaagaacttcacgcccgtgggcactgcgatcagcatggtcatgaatgcgaagaacggcagcagcaccgagccggtgacgtacatgtggtgcgcccacacagtcacggacagcgccgcaatggcaatggttgcgtagaccaggcccttgtagccgaagatcggcttgcggctgaataccgggaagatctcggagacgatgccgaagaacggcagggcgatgatgtacacctccgggtggccgaagaaccagaacaggtgctgccagaggactgcaccgccgttctccggatcgaagatgtgggcaccaaagcggcggtcagcgcccagggcgaacagggccgctgccagcggcgggaaggccatcaggaccaggatggcggtgacgaggatgttccaagtgaagatcggcatccgccacatggtcatgcccggggcgcgcatgcagataacggtggtgatgaagttgaccgcacccaggatggttccaaagccggacagtgccaggccgaagacccagaggtctccgccgatgccggggctgaaggtggtgttggacagcggcgcataggcaaaccagccgaaggacgctgcaccctgcggggtgatgaaaccggacaccgcaatggtggagccgaagaggaagaaccagaaagccagcgcattcagtcgcgggaaggcaacgtccggtgcgccgatctgcagcggcatgatgacattcgcgaagccggcaaacagcggcgttgcaaacatcagcagcatcacggtgccatgcatcgtgaacagctggttgtactgctccttggtctgcaggatctgcatgccgggctcgaacagctcagcgcggatgagcagcgccatcacgccgcccaggcagaagaacacgaaggacgagatcaggtacatgtacccgatggtcttgtggtcggtggaggtgatccagttgacgacgatgcgtcccttggacttcggaaccacgggagctggaaggactccggtgggtgcggattgagtgtacgtagccacgtcgctccccttacttaatttcgttcacgttcgggttgcggtcgtactcaacgccgaggagacccgtgttgcctgcttcgcgtagttcgtccatgtgggcctggaattcagattccgacaccaccttgacgcggaacagcatttcggagtggtactcgccgcaaagttcggcacacttgccgtcgtaggtgccctctttagtgggggtgaacctgatgtagttggtcttgcccgggatcatgtcgcgcttctgcaggaaggcgggaacccagaaggagtggattacgtcgcgtgcattgagctcgaggtcaacggacttgttcaccggcaggtacagcgtggggagctgctccttgtcgatggtgttgccggtgaggttggtctgcacgccggcttcatagacgtcttcttcgatgacgtcgccggccttgtagttgaagtcccacgcccactgcttgccgcggacgtcaacaacgacgtcggcgggctctgagcggttgtcgatcgcctgctggtcgcggtcggtgaagtagaagaacaccacaaccatgaacagcggaatggtcaggtaaaagacttccagggggaggttgaagctggtctgccgcgggaacccgacggtgcccttgcggcggcggtatgcaaccaggcaccacacgatcagaccccaggtaatgatgcccacaaccagggcggcaatccatgagttgacccagaggtccatgatgcggtcggtgttgctggtggtgccacgttccgtgggcaaccaccctttctctacctctggcgaacatccggtcaaaaccaacgcgccggcaattgccaagcttgagatcgttgtgatcgttttgcgtcggctgccggttcggttctgcgaactcacagacggcccttcctacttgttgctgctgtccgggaagactcggccgccccgggcacactaaaagttttactactcggtgtagagcttaccgctccgccgggcgtttcgcccacatgtcggcgccgtgcccctgtaccgatattttcggcagggggcccggcgccggcatcgggcgaaataaccggcttagtggaacgaatccccacaggcgcaggagccgccggcgttggggttgtcgatggtgaacccctgcttggagatggtgtcctcgaagtcaatggaggcaccactgaggtagggaacgctcatcttgtccacaacaacttcgacgccgtcgtagtcccggactgcgtctccgtccaggagccgctcatcgaagtacagctggtagatcagcccggagcagccgccgggctgcacagcaacccggaggcgcaggtccgtacggccttcctgctcgagaaggctgcgtaccttgcctgctgcgacgtcggtcagtttgacctcgtggacgggcagttcatcgctggccgtgctggttgtaccggtgctgttctcatttgttgcggtgctcattggcctaccttcttaggacggtctggcggcgccgcgctggcggtgcctgcccctacggtttcggtatgggctatagctacatgctacgcggggcggacgtgtagctctaactcctgacgtaaccatggatggtccccccttgttcccagggaagccgttaatccggcccgggaacgcttcccggcagccgccccgggtgaggaccctaaagcccctgctcgttgatccgggcgaggagcagcgcctctgccaggatggctttgcggaagtcgccgaggtgaagtgattcattggcgctgtgagcccgggagtccgggtcctcaacccctgtcaccaggatttgcacgtccgggtacagctccgtcaggtcggcgatgaaggggatggaaccgccgatgccggtttccactgccggtactccccaggcctcccccagtgcccacatcgccagcgaggccgccggcgaggaggtgtcggtcaggaacgggtttccgctctcccccggtgtgaaggtcacccgggcaccgaagggagcgttcgactccacatgcctgcgcacggcctccatcgcctcttccgggatctgtcccggcgccagccgaaggctgaacttggcccgcgctcggggcaacagggtattcgaggcagcgtccacggaaggcgcgtcgaacccgatgatggacagggcgggcttcgtccagagccgcgaggcgatactgcctgacccggccagccggacgccgtcgagcactgatgcgtcagcccggtaatcctcctccggaaggtccacggcggccgtgtcccttgccaacagtccctcgatgacaacattcccttcgtcatcgtgcagtgtggcgatgagacgggacagcagggtgggtgcatccagcacgggcccgccgtacatgcccgagtggacggcgtgctcaaggacctggacttcgatggtcccgtccacgaggccgcgcaggctggtggtcaacgcgggaatgccgactttccagttgctcgaatcggcgaccacgatgacatcggcgcggagcagttcacggttttcctccaggaatgaccggaaggtgggtgatcctgcttcttcctcgccctcaaaaaagaacgtcacgccgaggcaaagcgcgctgccgagtacctctgaaactgccgcataggcggcaacgtgtgccatgatcccggctttgtcatccgctgcgccccggccgtacaggcgtccgtccttctcgacggcggtgaatggttcggtttcccacagcccgggatccccggtgggctggacgtcatggtgtgcgtagaggaggatcgtgggcttgccgtccgtggcaggcctgctggcgacgacggcgggacctccaggtgtgccgtccggcttgtcgcaggcaaggatctgcacgttgtccaggccggcgccgcgcagtagttccgccacggcgtcggcactgcgttccaggggcccgcggtcaaagcttggccacgcaatgccggggatggcgaccagctctttcagccgttcaagggtaaggccgaaggacacgtcaatggcggtacggagatcttccgtcgagctgtttccggccaagcccggggatgggtgggcactgggattctgcggcgtagccgtgggcgatgaagtcatggcaaaaacattacccgcgtcacatcccccgctgtggggctcggcgagggttaggcataaactccggggtctgccgcaaggtattctgttcaggtgttcggacgtaaaaaggaagcgccctcggcgcagcaaacagtagaccaacaggctgcggaggcggcggcgcgggccaacggattgagtggcaagggggccccgactcccacccgcaaggcacaggaagcagcccgcaagcgcccgctggtccctgaggaccgcaaggcatcgaaggctgccgagcgccaggccatccaggaccagcgcctcaagatgcgccaggcgctggacaccggcgacgagaaattcctgcccctgcgtgacaagggcccgcagaaacgcttcgcccgtgattatgtcgacgcgcgcttcagcctgggtgaatacctgatgttcggtgccctggttttcgtcctcgtgtcgttggtggtcccggcatccagcgacatgatgatctacgtcctgggcgggttctgggtaatgttcctggctgtcttcgtggacgtgttcatcctgtcccgccagctccgcaagcggctgaccgcaaagttcggcgaggtggagcgaggaaccgtctggtacggctccatgcgttcccttcagttccgcaaactccgccttcccaagccccaggtcaagcgcgggcagtaccccgcctgacaggcaataggctggtaaacgcgaaaccccggcggtcggtccgccggggtttcgcttttaagaacgtgggcgcgcaggtcgccgcgttccctccagtcaggaccggcgcttcttcgccagttcgcggttgatgcctgcagcccagaacggcccctcatagaggaacgccgtgtagccctggaccagcgtcgccccggcgtcgagcctgtcctggacgtcctgcgcagtttccacgccgcccacagccaccagggtgagtgcgtcgccggtgacctccttcagcctgcgcagcacctcgagggaacgctgcttcagcggagcgccggagagcccgcccgcgccgcacttctccacctggtctgccgccgaggccagcccgtcccgggcgatggtggtgttggtggcgatgatgccatccagcttgagatccagcgcaaggcgggcgacgtcgtcgatatcctcgtcgctgaggtccggtgcgatcttcacaagcaggggcacgtggcggccggcagcccggtcagcttcttcacccacggcggccagcaggggccggagcgactccacatcctgcagcaggcgaagcccgggcgtgttgggcgaactcacgttgaccaccaggtaatcggcagcgggtgcaaggctgcgggcactcacaagatagtcatccacggcgtcggccagctccacagtcttggtcttgccgatattgacaccgatgacggggcgtacgtccggatgccggcgctgcagggcagcgcgcgctgccttcagccgcggggccacggcagttgcgccgtcgttgttgaatcccatccggttgatgacggcgcggtcctggaccaggcggaaaagccgcggcttctcgttgccgggctgggcctgccccgtgatggtccctacctcaacgtggccgaaccccagctcggtcagtgcctcgatgccgtgcccttccttgtcgaacccggcagcaagcccgaacggtgacggaaaagtcacgccgaaagccgtggtctgcagggacggtgcgggcgcagtcagcttttccaggacctttcccccgccggagcggtgcgccagcctgatggccgtgaacccgattttgtgggcgcgctcggcgtccatccatgaaaaggcaagcctgaagaaagtggggtaaacgcgcatgcctctagttttccgtcttggagggcccagaccaaaatggacaggtcaaactggccagcggattagcataatcccatggagtggcagcaggacatcctgggcgagggctttgagtcgcacgcctttcaggctttaggtccggacggtgtggaacgcacagccacactggtccggttccgccccgccgtggaatcgttgacctcctccccccggcgccgcagggtggttcttttcctgcatggctggagcgactatttcttcaacgtggaccttgcgcgattctggtccgcggccgggtaccacttctacgcactggacatgcataaccacggacggagcctgcggccggaatcgccgggcggctatgtgtcggacctcggggattatgacgccgaaatcgacatggcgtgccggctgatcgcccaggacggggcagacctgtccctgacactcatggggcattcgacaggagggctggtggcggtgctttgggcaagccggcatcccggaagggtgtcacggctggtcctcaacagtccctggctggagatgcacggcagttcattggtacggcgtgcaaccgcggggatggtgggtcccgtggcacggttccggcccgaagccgtgctccggctgccggagcggggcttttactggcggactatcagcagttcggccgacggagagtggacgctggatgaccgctaccggccccctatggcctttcccgtacgcgcaggctggctcagtgccgtgctggccgggcattcccgggtggcgcggggactgaacatcgaggtgcccatccttgtcctgctgtccagcggaagcgccaacgggctcttctggtctgaggagatgcggcggacggatgccgtcctcgacgtcaacatcatcgctgcccgtgccctgacccttggccggactgtcaccattgagcggattgacggcgccctgcacgatgtgttcctctcccccgccgccgtgcgcgccgacgcctacgccaggcttgcgcgctggctccgggcctacggggacggggaaccggacccatccggcagcggggacagcacatgaccggcgcgcaagtccgcagggacacggacacagctctctggaccgccgacatcctggggccgcgcttcgagcggcgcgtccttcctctggctcctgatgacgagggcgacgtctgtgcaacgcttgtccgctgcctcgccaaggagccggcgccgctgcagacgacggcggggcaccctgcagttaacgcggtgctgtacgtccacggctgggcggactacttcttccaggaggagcttgcggagtacctgaccgacgccgggttccccttttacgccgtggacctgcgcaagttcggccgcagccttcggccctggcagacgcccggcttcactgatgacctggccgtctatgacgaggacctcgccgccgccctgggggcgatcagggaagacctcgcagaacgcctggggcctggggttgcacccaccgtccatgtcctggcccattcgctgggcgggctgattgccgctctgtgggctgaccggaacccgacggcggtgggcaccctgatcctgaacgcgccgtggctggagctgcagggcagcagtatcatccgcaccattgccatgcacctggtggacccgctgtccagggccgacccccgccgtcccttatggcttccggagatgcccggctactggcaaagcgtcagcagcgaggcccacggcgagtggcaactcgaccccctgtggcgtcccagggcatcattccctatcagggcgggctgggcgaaagcggtccttgccggccatgccgcggtggagcgccggctggacgtccgggccccggcgctggtcctgctctcgagccgtacccgcatccagatcgaatggtcggcggagatgatggaggccgacgccgtgatcgacgtcgaggaaacggcccaccgtgcgctgcgcctggggcggcgtgtggcggtcttccgctatcccggcgccatccacgacgtcttcctttcccgccgcggcgtgcgcgaggaggcctgccgggacctggcagcgtggctcagggcatactccgcctgaatggtgacccgcctgatccgcgggcgtgccgactgcagtgcctggaacctaggaacccgcaggcgccgccgcgtccacggccccgccgtagcggcggtcccgctgtgcatattcctcaactgccgcccagagcgtgcgccggtcgacgtccggccacagggtgtccatgaagacgaactcggcgtaggcggactgccagagcaggaagttggacagccgctgctcccccgagctgcgaaggaacaggtccacgtccggcaggtccggctcatcgaggtacttctggatggtgcgctcggtgatggcaccgggtttgagcctgccggcggccacctcggctgcgatggcggtgacggcatccgtgatttccgcccggccgccgtaattaacacacatggtcaacgtgcaggtgctgtttcccgctgtgaactcttccgcttcctcaagctcgcggatgaccgagccccacagcctgggccgccggcctgaccaccgcacccggacgccccattcatcgagctggttccgttgccggcgcagcacatccttgttaaatcccatcaggaaacggacttcctccggggaccggcgccagttctcggtggagaaagcatacacgctgacgtactcgatgcccagctcgatggcacctgccatcacgtccagcagtgcaggctccccggccttgtgcccttcaatccttggcaggccgcgctggttggcccagcggccgttaccgtccatcacgatcgccacatggcggggaatgaactcagccgggatggagggcgcaacggccccggaggggtgcgggtacggggcagccaccgggtgggtgcgcttccgcgaggcggtgttctttttgccgagggccactgtcagctacgctccacatgtttgagggacttcagcacccgttcgaggtgccattgcaggtatgcggccaccaggcccgctgcctctttccggtgcacgggaagggagccgtccgccgtcgtccagtcaccggtcagcagcgccgccagcagcaccacagtctccggcgccggagccggcgagccaggaggcctgcatccgctgcagaccattcctcccaggggagccgaaaaggcggtgtgcgggcccggcaggccacaccgggcgcagtccgtgaagctgggggcccagccgccggtggccagtgcccggagaaggtaggaatcaaggatcaggccggcagcatgttcatccctgctgagggacgccagcgcgcccaccagcaggttgtactgcgctgtccccgcctcgccgtccacgtccgtcagcttctcagctgtctcggtcatggcagcggccaccgtgtaacggccgtagtccgcggcgatgttcccgccgtaggcccccttggccacggcctgggtgacgatgtccagggtcttgccggacacgagctggaggtccgccaccataaacggctcgagccgcgcgccgaaccggctgctggtgcggcggacccctttggcgacagcccggacctgtccgtggtgcttggtcagcagcgtgatgatccggtccgcctcacccagcttgtgggtgcgcaggacgacggcgtcgtcccggtacgcgcgggaggcgaaagagtgttgggccacgccttctatcttcccattctttgccggcacagccgtgccgcgtgctgccgtgccgccggcagcttccggcggcacggcagtgcgaaggtcaggcctgggcgtcccggatggcgcggttcaccgcagagatgaccgccttcagggaggacatgctggtgttggcgtcgatgccgacaccccagagcacccgctcccccactgcacattcgacgtaggcggccgccatggcgttgccgccctcggagagtgcatgctcgctgtagtccaagacccggacatccacgccgtcttcccgcaggatgctcaacagcgcggcgatggggccgttgccggtgcccgtacgggcgacctgcgccccgtcaatggtgagggacgcgtgaagcgtcatcccgccgtcgtcgtccgtttctgtcttgacggcacccagggcgtagcggccccactggccgtcaatcttgccggagggcaggtactcgtcctggaagacctgccacagctgggcaccgctgacttcgccgcccaccgtgtccgtacgcttctggataacgccggagaattcgatctgggcgcggcgcggcaggtccaggctgtgctcattcttgagcaggtaggcaacgccgcccttgccggactgggagttgacccggatgacggcctcgtagctgcggcccaggtccttggggtcgacgggcaggtacgggacctgccaggtgaagtccgcaacgtccttgcccgcggcggcggcgtcccgttcgagggcttcgaagcccttcttgatggcgtcctggtgggaaccggagaacgcggtgaacacgaggtcgccgccatacggtgaacgctccgggacgggcagctggttgcagtactccacggtccggcggacgtcgtcgatatgggaaaagtcgatcatggggtcgatgccctggacgaacatgttcaggcccagggtcaccaggtccacgttgccggtccgctcgccgttgccaaacaggcagccttcgatccggtcagccccggccatgtagcccagctcggcggcggcgacgccggttccacggtcgttgtgggggtggagagagaggatgatgccttcgcgcgggtgcaggtggcggctcatccactcgatggaatcggcgtagacattgggcgttgccatctccaccgtggcgggcaggttgatgatgacctggcggtccgcggaggcttcgaaaacgtcggcgacggcgttgcacacacgcaccgcgtactccagttcggtcccggtaaaggactccggggagtactcgtaggtcacgtgcgtgtccgcgagggtttcctcgtacttcttgcacagccgggcgccctggagcgcgatatccaggattccgtcctcgtcctggttgaagaccacgcggcgctgcagtacggaggtggagttgtagaggtggacaatggcctgcttggcacccaccagcgactcgtacgtgcgctcgatcaggtgctcacgggcctgggtcaggacctggatggtgacatcgtccgggatgtggttgccctcgatcagctggcggacgaagtcgaagtccgtctgcgaagcggaggggaatccgacctcgatctccttgtagcccatccggaccagcaggtcgaacatcttcatcttgcgcgccgggctcatcggatcgatcagtgcctggttgccgtcgcgaaggtccaccgcgcaccagcgtggggccttggtgatgactttgtccggccaggtgcggtccggcagctcaaccttgatctggtcctggaacggcgcgtaccggtgggcgggcattcctgagggcttctgtgcgtttcgcattactatcggggccttttctgtggttctacgttgaaagggtggccgggcaacacaaactccgcagcgagggtggccttgcgctagatcgcgtctgaggcctcgccgcggcagctaagaagaaggagctctgcacgcaccttttgagagtaacacgggtgcgtaagatgaaagagcactaccgtcagtaaagtccaccatgcagacgccgcgcgctgtttttcctgccgccgctctccataagaaggagtttcagtgcccatttcggggatcgacctgtccaccattgatcacacggtccggccgcaggatgacctttaccagcacgtcaacggcgcttggctgaaggccaccgacattcccgatgaccggccgctcgagggcaccttcacagccctccgggacggttcggaggtcgcagtccgcgacattattgaagaagccgcgggcaagggcggggccgccagcgggattgaacggaaaatcggggacctttacaacagcttcatggacgaggccgctgttgaagctaagggcctcgagccgatccgccagcggcttgcagaggtgttcgccaccacttccgtggcggacctcgtgtcgctggcgggccgcctgttccgggccgacgtcggtgggctcttctacatctaccccgccccggatgcgggcaaccccgaccggattctcctgtacaccgggcagggcggcctcggcctgcccgacgagtcctactaccgggaagccaagttcgccccgatggtcactgcctatgccgcgcacgtgaagacgatgcttgacctggcgggcgttgccgacgcagcggcagcagccgcgcgtgtggttgccctggagaccaagctcgcgtcccaccactgggacaacgtcacccttcgggatccgcaaaagacgtacaacctgaagacggcggacgaggcatcagcactcttcccgctgctgaccacctggtttgaggccgccggcatcgatgccggcaagcggcatgagatcgtcatgagcactcctccgttcttcgacggcgccgctgccctccttgagtccgagccgctgtcccactggcaggagtggctcgcgatgcgcgtggtaagcgcagcagcaccgtacctttcttcggctttcgtggacgccagcttcgccttctacgggaccaccatcagcggcacgccccggaacaaggaccgctggaagcgcggtgtggccgtcgtcgaagcggccttgggagaggctgtggggcagatctacgtggcccggcacttccccgagacccacaaggccaggatgcagtcgctcgtggccaacctgacagaggcgtaccgccagagcatcacggcagtcggctggatgggtgaggccaccaaggccgaggccctccggaagctggagggcttccgggcgaagatcggatacccggaccagtggattgactactccgccgtcgagatcgaccccgcagacctcttgggcaacgttgagcgggcgcacaacgccgacgtcgaccggcaccttgacgaggtaggcaagccggtggaccgcaacaagtggctgatgaccccccaaacggtcaatgcctactaccaccccatgatgaacgagattgtgttcccggccgcgatcctgcagcccccgttcttcacggctgatgctgatgacgccgtgaactacggcggcatcggggccgtcatcgggcatgagatcggccatggttttgatgaccaggggtcccagtttgacggaggcggggcgctgcggaactggtggacggaagaggaccggcaagcgttcgagaagctcaccgcaaagctggtggcccagtacgatgtgctttcgccctacgcggctccaggacataccgtcaacggacgcctcaccctgggtgagaacattggcgacctggcaggcctggcaattgcctacaaggcgtaccgcatcagcttggaagggaaggaaccggacgtcctggacggcctgaccggggaacagcgcttcttcgcttcctgggcggcgggctggcgccaggtcatccggcccgaggaggccatccgccggctggcaacggacccgcactcccccaatgagttccgcaccaacgccattgcgaaaaacctggatgccttccacaacgcctttgaggtctcggaacaggacggcatgtggatgcctccggaggaccgcgtcagcatctggtagccggacgccgccggatagcggcgaaggtagcggagtgggataatttggtcatccttcgaataggggggccatcatggccggccttagtgctcttcgacctggtcgccgctcccgggcatcctcgccccggctcctggcggcattacttgtgctcgcactcggcgtgctgttcgcttcacccgcccgagcagtcgactacggacatgacgtctcatggccacagtgtccgggcggccttccgatgccgccggataacacggagttcgtggtcgtggggctgacgaatggactcgctttcactgagaatccctgcctgggctggcagttccagtgggtgctcgagcacggcgtccgggctcaggcctacgccatggccacgttccccaccgccgcgcaatacaacacctacggcgacgacggcccctggcccgcaagcaccaggccggaccggctgcgcaacgtcggttacgccgagggccgcgcggcactcgcgtccctcgatgaggtggggtggcggccggagagaatctgggtcgacgtcgagccccgcccgcaacagccctggcccagttcgacagcaacccagcggcaggagaaccggtacgtcatctccgggctcctggccgctctgtcggacgccgggtatccccacgggatctactcctatgtgagcgcttgggaggccatcaccggatcgtggcagcttcccgacgtgccggtctggtcaccggcagggcgtctcgacttcgccagtgaagcatccgacctctgtgtgaaccccagcttctccggtggcaccgtccacatctcgcaatggaccgatggcacctacgacttcgacatgacgtgcattggggtctaccaggcccatgtcgcgacgatcggctggcagtcgagcgtctcggacggcgccaccgcaggaacgaccggtcgttcactgccgatggaggcgttgcgcctgtcgatggcaggagacttcctgccgggcgacattctgtggagggggcatgtgcaggacatcggctggcagccatggacgacgtcggcatcaccaatcggaacgacagggcgcggtctgcgcctggaggcgtttgagctgcggttgacggggaatctggcctcgcagtacagcatcaggtatcgcgcccacgtacagaacatcggctggcagccgtacgggatcgacggagccacggccggcaccgtcggggaaggcaggcgggtggaagccgttgcgatcgagttggttccgaaggtcgcaccagcattcactgccgtgtacgccgcccacgttcaggacctcggctggatgggagacgtttcggatgggaccgtcgccgggaccacgggccgggccctccgggtcgaggcattgcgcctcaacgtgtccagcatggcttatagcgggggtatcgagtggcggggccatgtgcagtcgatcggctggcagccgtggacatcgtcggccaatcccatcggcacggccgggcagggcctacgtttggaagcgtttgaaatcaggctgaccggtgagatcgccaaccattacagcatccactaccgtgcccacatccaagatttgggctggcagtcatgggtcgccgacggcggaacggcgggcacgtcaggtgagggcaaacggatggaggcagtgcagatcctcctcgcgcccagaaccggcggttattcctgaacgataagcgccgggttcgcctgctggcaggacgcatccttcgccgtctggttgacgatgtcctccgggagcgcggctggagccccgtacgtgactccggttgtgaagtcggtgcccaggaagacctggacacccgcgatgttgggcgcgggcagcatctgcgcagcagggattcccagcacggctgcaacgtccgcggccacgtccgcgaagtccgtgccgtagtaaaccaccgattgctccaccgctgtggcctcgaactggccggcctggctgaacccgcccgagatcagggcctgcacgatttcctgggctcgtcccggaacgccggtgccgttggccacggtaacgggctgcagtgatttgtcgtaaggcgggagcggaggtgctgtctcggtgggtgctgtcgtgggcggcgcggaggtttccgcaggcgacggggaaggtgccgtcggatcagtcaaatcgacgtcctgccgcagggcggcgaacagttgggaaccattgggctcggcgatctgcagcctattggggtcggccagcgccggcgtggtgggcacggccacgaacgccaccttgctgatgtcgatgtccttgagccggttgccgatggtgagcaggctgggcacggaggccagcccttcgtccacggtcaggttctgggtgacgacgtcggcgatcttgagcatcctgccgggatcggacagcgtcccgtcgtccttgatcttgcgggtcagggaggacaggaagccttgctgggccttgatccggcccaagtcgccgccgtcggcaaatgcatggcgcgtccgcaggaaggcaagggccatttccccctggaccgccgacgtgcccgcgggcagccggaggcgcgaatcaggatcgtagacggcgtcgctgatgcacacctcgactcccccgacagcgttggacagttcctttacggcggtgaagtcggccatcatgaagtggtcgacttccaggccggtgagcttgttgacggtgtccacggcgcagccgatgccggcttctgccatggcctcgttgatcatcacgccgctgcgggcggggtacacctggttggtttcttcatccttgcactgggggatatcaaccagcaggtcccgcggaaagctgatgacgctgacgcgcttgttgtcttcggagatgtccatcatcatcatgacgtcagacttgccgtagcccctggaatcgtccgcggtgccgtactcggcgttcttgccgtcgcgcgtatccgaaccaaggatcaggatctgcatccgtccggttgcatcgctcacctgctcgttgttgccgccgccggcgttcagcggagccttggaaaggttgctttgaaggcgcaggaaccagaaacctgcaaacgcgaggccggcgaccatggccagggaaaggacacccgtgactatcttcagccacgttggcatgccgcgcagggcgccgaggtggcgcgcagctccaggggtgccgtccgcgtgcctcgatactggtcccccggctgacatgtcagctccgttttcgcgcttgtcgcggcctagccccacgtggtgaaccttcctctaaattcgaaatccggcccattttagtggtccaggctgggaaattgccgggcggccaagcggccgcgccttttcaaagggctcagaagcccagtttcaccagctgtttcgggtcacgctgccagtccttcgccaccttcacgtggaggtccaagtagatgcgtgtacccaggagcgcctcgatgcccttgcgcgcattggtgcccacctcacgcaaccggctgccgcccttgccgatgataattgctttttgggagggacgctcaacgtaaaggttgacccgcacgtcgagcagcgggctgtcttcgggccggtcctcccggggaacgatttcctccaccaccacagcgagcgagtgcggcagctcatcccggacgccttcgagtgccgcttcgcggataagttccgccaccatcacggcttccggctcgtcggtgagttcaccgtccgggtacagcggaggcgacggcggcatgtggctgatgagcacgtcggcgacggtgtccacctggaagccgtcggtagcggagacaggaacgatgtccttccagccttcctcccccagcacttcccggcccagggcggccaccgccaggagctgttctgtcagtgcctggcggtccacagtgtcggctttggtgacgatggcgatcaccggcttgcggcccacggcggccagctgggcggcgatgaacttatccccggggccgatcttctcattggcggggaggcagaaccctatcgcatccacctcggccagcgtgtccgcaacgaggtcgttcagtcgcttgcccaggagggtgcgggggcggtgcagccctggcgtgtccaccaggatcagctgcgcatcctgccggtggacgatgccgcggatggtgtgccgggtggtctggggcttggcggacgtaatggccaccttcttgcccaccagcgcattggtcagggtggacttgcccgcgttgggccggcccaccaggaccgagaaccctgcgcggaaaccgccgaaatcgtcgtggctctcggccttatttttcttgctcacgtgaaactccctgctgggttgcttccgcctcttggaagaggtcctcaaggtcagtgtcttcttttgccacccgcgccgcaatgatatggctgacgcggttgcggcggccttccagccggtcagcccgcagggacacgccctgcacttccaccgtgcttcccacgatgggtacgcggcccagcgcttttgcgagcagcccgccaacggtgttcacttcgtcatcatccagttcgatgtcgaagagctcacccaggtcatcgatgcccatgcgggcgctgacccggtaggagccgtcgccgagctccacggcctcggcgctttcggtgtcgtactcgtccacgatttcacccacgatttcctcgatgaggtcctccagggtgaccagtccggcggttccgccgtactcgtcgatcacgatggcaacgtgcgtggattccttctggagctcccggagcaggtcgctgacgggcttcgattccggcacgtaccgcacttcccgggcgagcgactccaccagcggcggttcctcgtggggtgccagttcgtggatgacggcggcaacgtccttcaggtagatgatgccaaggatttggtccgtactttcgccgatgaccggaatcctggaatagccggagcggaggaagagggacattgcctggcgcaggctggatcccgcctcgatggtgaggatgtccgttcgcggcaccatcacggcacggaccagtgtgtctccgaagtcgaagacggactggatcatttccgcttcggtgtcctcgatcatgtcggactcgctggcgcgttccacaagttcacggaattcctgctcgctgaagaacgcctcgtccccgccgggggcaccgggtgcagccgtgctgccaaggctgacgagccagccggggatcggccccaggacccaggtcaggaaacggatcatcggagcggtggagcgaaccacggccgccgaatggagcctgccgagctggcggggggaaacacccacgatgacaaagcccagcaaggccatgatgccggttgcggcaaggcctgccagccacacgttgtccagcaggctgtagagcagcacggcgacggcgacggcggatgccatctcgaaccagatgcgccagaaccgcagcgccctgatatgtgccactgggtgggagaggatctgccgcagggcggtcccgcggctcttaagcagggcgtcttccgcgtcatgccgcggaatgaagttgaaggcggcctcggccgcggtcaatacggccgcaacagccaggaaagccaaggccattgcgacaaggagcagaggcgtcactgggtggtctcggcgggcgcttctttgccggtgaagccggacagcagctcacgctggagcccgaacatctcggccttctcctcgggctccgcatggtcgtatccgagcaggtggaggatcccgtgcgtggtcagcaggagcatctcatcctgcagtgagtggccggcgttcttggcctgcacccgggcaacctgcgggcagatggcaatgtcaccgagcatgccctggggggtgggtcggtccggcgttccgggggtcagttcgtccatgggaacggagaggacatcggtggagccgggctcatccatcagctcgatgtgaagcttctccattgcgggctcgtccaccagcaggacggacagttcggcctgcggatggatatacagctgctcaaaaacataccgggacaacgccacgatctccgcttcgtccacctggacgccggactcattgttgacctcgatgctcacgcgtgttccccccgtttggcggcgcccgccgaatgttttacccggctgcgctgggtttcatcccagatgctgtaggcattgacaatgtcgcccaccagcctgtgcctgacgacgtctgcggcatcaaggaccgagaagctgacgccctcgatgccctggaggatttcctccacgatgcggagtccggagcgggtgccgaaaggcaggtcaacctgggtgacgtcgccggtgaccaccatcttggaaccgaagccaaggcgggtcaggaacatcttcatctgctccggcgtggtgttctgcgcctcgtcaaggatgatgaaggcgtcattgagcgtccggccgcgcatgtaggcgaggggcgccacttcaatggtgcctgccgccatcagccgggggatggactcggggtccatcatgtcgtgcagggcatcgtagagcgggcgcaggtatggatcgatcttgtcgctcagggtcccggggaggaagcccaaccgctcccccgcctcaacggcggggcgggtcaggatgatgcggctgacctccttttgctgcagtgcctggacggccttagccatcgcgaggtaggtcttgcctgtgcctgccggaccgatgccgaaaatcaccgtgttggtgtcgatggagtcaacgtaggtcttctggttcagcgtcttcgggcggatggtttttccgcggctggacaggatgtcatgggtcagtacgtccacggggttctgcagcgactgggtacggagcagcgcaacaagctgctgcagcactgccgggctgatcaccgtgccgcgggccaccagcccacggacctcgtggaggaggcgcatgatgcggggaacgtcgctggcaggcccggtgatggagagctcatttccgcggacatggaagttgacggccggaaactgttcctcgatgtaccgcagtgcctcatcgtggctgcccagggactggaccatctggtcggagttgtcgaaaaggactacctcggtacggctgccggggagggaatggggaaattcccccgcagcgccttctcccgtgttgagccggcgcttgccattcgctgattcagtcatagtgatggcccgcaggcccgtgatcccctcaaagtaccgaacaattcccgctgctggcggccgacgaccttgcgcttgggcgatggaccggttgcgccttgaccagcgtccctccatcttacgccaggaccgcatcaacctctgaaaggggaaaggcatggacacctcgggaaacatgggcggcgctgccggttccgccattaggtatcgttcccgttgcagttcgtcccgtaggcccgtatccggccttgctgctccgggccctgtgccatgctggaaatccagccactgctggatccgccgcttgggggagcggcccgccattcatgaaaggacaggcaacaaacgtgccggaatctgctgcgccccgcagggcaggacgacgtggcggcattgtgcgccctgccgtcgtggcagtggttctgatggcggctccgttcctgacgggctgcctggccgagccggatccttcccccaccgccgttctgggctccggccctgccgccaccggcacggcgccttccacgagcgcccctctcgaaaccacgcagtcgtccaacaaagcgccggtctactggattggccggagcaacagcagcatctttctttaccgggaattcagggatgtgcctgagcaggagaatccggtgacccgggccttgcgggccatgatgtcggacaagccgcttgacccggatttctttacgccctggcagaatcccggcaagctggccacgtccatttccggcaaggacgtcatcacggtggatgtgtccgaggacgccttcaacagcaaccttgacgccgacatggccggccgcgctgtccagcagcttgtctatacggccagcgctgctgcggccagttcagggctcatcgattccgggcagcagattcgcgtgcggatcctggtggacgggcacacggactacgttgctttcggacatgtccagctgggtgaccttatgaccaggtccgccggcatggtggcccccgtgtggatcattgatccgcaggagaacacggaggttgccgccgggagcgtcaagatcaccggccgcagcaccctttccgggggcaagctccgctggcagatcctgcgggccgaggaggatggcaccaaggtcccgttcctgactggggaaacgactgcagccgccgagccgggccaggcaggactgtttacgcttgccctcacgctgccggccggagactacgagctgaaggtggcccaggccggtaccggcgatcagccggaccagaatgaggactcgcgggcttttaacgtccgctagtttaccggccaggccgggaggttcagggagagggtacggtccagcggcccaggacatcgctggcaagcacgacggcggccggtccggcagttgaagagcgcagtacgtggtgccccagcagggcggtgacggcgccctttccgcagagcctggtgacctccctggggctgatgccgccttccggcccgacgatcagcagcacctcgcggggttccattgcctccgcgtccagcgaggcttccagtacggtgcgcagggggcgcacggcgtcctcgtggaggatgaccgccagccctgcggcctccacgaggccggccagcgcggcagtgtcgacggcgggccgcacctcggggacccatgcgcggcgcgcctgcttggctgcggccgtcaccaccgactgccacttcgcgtgggccttcgctgcccggtcgcccttccatcgcacgatggaccgttcggactgccagggaatgacggcgtcgatcccgagttcagtggccgtttcaatggcgagttcatccctgtcgcccttggccagggcctgcaccagcaccagcctcgtggccggccgctcctcaacagccagggaggcgcactccacctcgaggcctgcgggcgacgccgcaaccacccgtccgctcatccgcgtcccggcgccgtcaacaatgtcgacgggctcaccgggggtgagccgcttgaccgtgacagcgtggcgcgcctcggtcccctcgaggacaaaggcccgccccaccgtcatgtggtcaagcgacccgggcgtagtgaaaaagacagggttgctcaccgctacaggttaccgagccggtcccggagcttggcgaacatgccgccgctggctgcaagcttgccctcggtaatctgctcaccgcgcatcttggccagctgccgcaggagctcttcctgggcggcatcaagcttggcgggcgtctccacctggaggtgcaccttgaggtcaccgcggccgtagccgcgcaggtgggtcacgccaagtccacgaagagtgatgatctccccggactgggtcccgggcttgacgtcaatttcctgtgaaccgtcgaacgtctccaggctcacttcggtgcccagggcggccgccgtcatcggaatgtgcagggtggcatggagatcgtcgttgtcgcgcacgtaggtggcgtcgttgttcacgcggatctcaacatacaggtcaccggacggtccgccggccgggcctgcctcgccctggccggaaagctggatacgcgttcccgtggctacgccggcaggaaccttgatggtcagcgaacggcggctccggatgcgcccctgtccagtgcactcgttgcacgggtccttgataacggtgccgaagccttcgcaggttccgcacggggctgcggtcatgacctgtcccaggatggaacggacggcgcgctggacctggccgctgccgccgcagatgtcgcagcgttcaggatggctgccgggctggcagcaggaaccctcgcaggttgggcacgtgacggcggtgttcacgtcgagcttcttgttgacaccgaacacagcgtcgcggagttcgatccggacgctgatgagggcgtcctgcccgcgccgcacgcgggaggccgggccggtggaaccgccggcaccaaagaaggtgtcgaaaatgtcctggaaggcgaagccctggccagcgtatccgccgccgccgaagccgttgtccgtcccgttttcgttgcccgtggtgtcgtagacccggcgtttctgcggatccgacaggacttcgtaggcgtgggttactgccttgaagcggtccgacgcatcctcacccgggttaacatccgggtgcagggtgcgtgccagcttgcggtaggccttcttgatctcttctcccgtggcctccggtgagactccaaggacgtcgtagtggctgctcaaagttcgtatctcttccttgttgtactgcctgcagttggactgccggaaatgctgtgtgtgtccagtggcccggggtggaactcaggggcccaggatccgggaaaggtagcgggcaacggccctgacggcggccatggtggtgggatagtccatccgtgttggccccagaatgccaatcttcgctgcactgtccgggccgtagccggtggccacgaccgatgcctcggcaagtccgtcgtagggattctcgcggccgatgctgacagccaccccgcggtggtcctgcgccatctcgctcagcaggcggagcatgaccacctgctcctcaagggcttccagcaccgggccgatgctcagcgggaagtccacgttggacctcgccaggttcgcggtgcccgccatgaccatgcgttcctcacggctgctctgggccagggcttccaggccgatagcgagggcctgggccgcctgcctctgccccggggcggccgtggccaccactgcaggcagcgactgggcgagctggctcagcggcgttccggcaagcgatccgaggaaccgtgccctgaggcccgccagggcctcgtcccccaggtcctggccgacgtcgataacccgctgctccaccttgccgctgttggcgatcaacaccaccagcaccttccgcggggcgaggaggacgaattcgatatgccggaccagggccctgctcaggtgcgggtactggaccacggcaacctggttggtcagctgggacagtagccggacggtgcggtccaggacatcgtccaggtcatccgatccctccagcagtgactggatggcgcggcgctccgccggggagagcggcttgacggcagagatctggtccacgaagagccggtatcccttgtctgtggggattcgcccggcgctggtgtgcggagccgtgatcaggccctcttcctccagggctgccatgtcattcctgatggttgcgctggacacacccagatgatggcgctccaccagggctttggaccccacgggttcgcgggaatggacgtagtcctccacgatggcacggagtacttcaagtttgcgtggctcgctcacactccacctccatccagggtttggggcggtcgcgccgcctgcactgtgccgctcatcgtttagcactcgacatgcccaagtgctaacagtctattatgcctctccccgttgctagcattggtaccgctccgggcgaaattccggacctgtgatcgagcgctaggcggagttaatcaatgcagtaccagaactggggcccccaggacatgtccgctccgtcaaaggctgaacttcctgaggtccctgttgaacgcggcatggtgctggaagacgtccagtccggctgggtgggcgcggtgacccgcgtggagaaatccggcggcatgcatgttgtggccctggaggacaggcgcggcaaatccaggtctttccggctgggcttcggcttcctcctcgaggggcaggccattaagctcctcccaccggcgccgcgccaggcgaccgccgctgccgccgccaggacagcctcgggttcggtccgggtagccggccagcgggcgcaggtcgccaaggccagcaggatctgggtggagggtaagcacgacgccgaactggtggaaaaggtctggggagacgaccttcgggtggaaggcatcgtcgtcgaaccccttcacggcatcgacgaccttgccgcggcggtggccgagttcaggcctggagcgggccggcgactcggagttttggtggaccacctggtgcccgactccaaggaatcccgcattgcggacgccgtaatggcctcaccgggggctgccgggaacgtgctgatcgtaggccacccctatgtggacgtctggcaggcgatccggccggctgtcctgggcatcgaaaaatggccggtggtgcctcgcggtcaggactggaagaccggcatccttgccgcgttcggctggccccatgccaccaaggaggacatcgggctcgggtggcagaaattgctgggtgcggtccgcacctacgcggacctggaagcctccctgctggggagggtggaggaagtcattgacttcctgacggttccctgagcggaccgccgcgccgctgcccgaggagccctggggcatcatccgcggctccagccagtattcttgatactgcggatctgcgacatttgcagtccttcgcaaccgatatgcattcttagcccgcaccattgcactttcagaaggaacagactgtggcagaaaacgcacgcgatcacagggacacccagggcggccagggccgttcggaataccatggcgttccggcgaatgcgctgcccctgacagccagcgaagaccggcagtgggccaccatggcgcactttggcggaatcctgggctgcgttcctgctctgctgatctacctgattttccgggaccggggacctttcacggcgcaggagtccaaggaagcattgaacttcagcctgccgcccaccatcgccgctgtggtggcgaacatcctcgtgttcgttccagtggtcggcaacatcttcgccgtgattgccaccctcatctggatcgccctgacctgcttctccgtggcagccggcatccatgtcaacaagggccagccgcaccgctacccgtacaacctgcgctggattaaatagtccccacccgcaccctaacctcgcaagctcggccagggaaccctgcgggcgtgggcccaccgcctgcagcccggcatcgaaaccgctagtccggcaggacccggcgcaccaccgcgtcagccagcagcctgcccttcagggtgaggaccagccggcccgcgaaggcggcggcaggatccaccagctcttccgcgatcagcccggcgacctcctgccgtcctgcggcgccgagcgaggcgatctcgaggccggagtgaaggcggacctcgagcatcacccgctccatattccgggtttccgaatccagggtttccctacctgccgccggtgacactccctgtgccaggcgtccggcgtaggcagtggggtgtttgacgttccaccagcggacaccgcctacgtgcgagtgtgcccccggtccgatcccccaccagtcgtcgccgcgccagtaggcgaggttgtggcggcaagcctgctccggtgtgcgggcccagttgctgacctcgtaccagccaaggccggcattggtgatcagctcgtcggcgagctcgtacttgtcagcgtggtcgtcgtcgtcgatccctggaacttcaccacggcggatctgggcggcgagcttggttccgtcctcgatgatcagcgcgtaggcgctgatgtggtccggctggtaggacagcgccgtctcgagcgagtaccgccagtcctccagcgactcccccggcgtgccgtagatgaggtcgaggctgacggccagtccggcgtcccgggcccactgcaccacctgcggcacgcggctgggcgcgtgggtcctgtccaggaccttgaggacgtggggaacggcggactgcatgccgaacgaaatccgggtgaagccggcatccttgaggatggcgagggactcgggggtgacggagtccgggttcgcctccgtggtgacctcggcgccctcctcaatcccccactggtcgatggcgcgccgcaggatcagggccaggtcctccgcagggagcagggttggcgtgccacccccgaagaacaccgtgctgagcggccgcgggggaaggcctgattccttgaggacgctggccgccagggacacttccgaggccgcggtggcggcataggcatcctgggaggcgccgccgccgagttcagtggcggtataggtgttgaaatcgcagtacccgcagcggacggcgcagaacgggatgtggacatagagcccgagggcccggtccgccgcaccatcggctgcctggggaggcagcagaccgtccgacggcgcagggtcgccaaagggaagaacgctaggcactgcagggtcctcctgcagtgccggccgctgtaaccactacttcctggccttgtccttggactcgtcggtggtgagcgcagcaatgaaggcttcctggggaacctcgacgcggcccaccatcttcatgcgcttcttgccttccttctgcttttccaggagtttgcgcttacgggagatgtcaccgccgtagcatttggccaggacgtccttgcggatggcgcggatgctttcgcgggcgatgatcctggagccgatggccgcctggatgggcacctcgaactgctggcggggaataagctcgcgcagcttggtggtcatcatcacgccgtacgcgtaggccttgtcccggtgtgtgatggcggagaaggcatccacctgctctccctgaagcatgatgtccaccttcacaaggtcggccacctggtcgccatcggccttccagtccaaggaaccgtaaccgcgggtcttggacttcaggatgtcgaagaagtcgaacacgatctcggccagtggcaggcggtaccggatctcaacccggtcctcggacaggtagtccatgccgcccatcacgccgcggcggctctggcagagctccatgatggctccgacgaattcgttcggggccaggatggtggcggacaccatgggttcgcggacctcggagatcttgccggaggggtattcgctggggtttgtcacgtggaccaccttcttgtcctccagcgtcacctcgtattccacgttgggcgcggtggagatcaggtccaggttgtactcgcgttccagccgctcacgcgtgatttcaaggtggagcaggcccaggaacccgacgcggaagccgaagcccagggctgcggaagtttcgggctcgtagaccagggcggcgtcgttgagcatcagcttctccagcgcatcgcgcagcaccgggtagtccgtgccgtccagcggatacaggccggagaagaccatgggcttggcatccgcgtagccggggagcgagtccgcggcaggcttggcaaggttggtgacggtgtcgcccaccttggacaggcggacgtccttcacacccgtgatgaggtagcccacttcgccgacgcccaggcccttggagggggtgggctccggggagctcaccccgatctcgaggagttcgtgggtggcccgggtggacatcatctggatgcgttcgcgggggtgcagcatgccgtccaccacccggacataggtgaccacgccgcggtaggtgtcatacaccgagtcgaagatcatggcgcgcgctggagcgttggcgtcgccctggggagccggcaggtcgcggacgatcttgtccagcagggcctcgacgcccatgccggtcttgcccgaaacgcgcaggacgtcctccgggtcgccgccgatcaggctggccagttccgccgcgtacttctccggctgcgctgccgggaggtcgatcttgttcaggaccgggatgatcgtgaggttgttttccatcgccaggtagaggttggcgagggtctgggcctcgatgccctgggcagcgtccaccaggaggatcgccccttcacacgccgcgagagagcgagagacctcgtaggtgaagtcaacgtgtccaggcgtatcgatcatgttcagcgcgtagctggtgccgtcgagttcccacggcatgcggaccgcctgggacttgatggtgatgccacgctcgcgctcgatgtccatccggtccaggtactgggccttcatgtcacgggactggaccacgccggtgaactgcaacatccggtcggccagggtggacttaccgtggtcaatgtgcgcgatgatacagaaattccgaataatggccggatctgtcgcggcgggcaccggtgcggtgcgggccatgggagacacgcaggggtccttactcttggcattcacacggccatcgcctgggcgcgccgtgggcggcccgcggactggccgcatattttcaacctccagtgtcccacgtcagggcctgccacaccgcatcctgagtggagttgccgccgtcattcccccgcccgggaggcagctatagggtggctggatggttttcaatctccgatcattgcaggacgcggtcaggacaggcctgcgaacactcaaaagggtgcgaggggctgccagggcagccagccgcccctcccccggccgtgccactcaggcctccggcaacgggcaggttcagggccgggccagcgccgccgctgcgtaccccggggatttccacggcaaattcaccgtcaggtatgcggccaggccagatggtgaaccggatcctggggaagtggtgtgggcgtgggtgccgtacgaagaagaccacagccgcggaaaggaccgccctgtcctgctggtgggccgcaacgccggctacctgctcggactgatgcttaccagcagagaccgtgttcccgattctgcagcatcagcggactacgtggacctcggagttggcggctgggaccggcagggccgccccagcgaagcccggctggaccgcgtcctccagctccgcccaaacggcatccggcgggagggtgccgtgctggaccgcgaccggttcgatcaggtggcctcgtccctgcgccggcgacacggctgggcctaagccctgaaatggcaagagttgccgctgacctgctattctttatagctgtgtgtccgtgcaggtcgacggccactgatggttggccgccataggtatccccacgccgctcagtcaatggccaacctgaaagccctctagaccatttccgcattaaaaagagagttcacacgtggcgaatatcaagtcccagaagaagcgcatcctcaccaacgagaaggcacgcctgcgcaacaacgcagtcaagtccgagctgaagacggccatccgcgccgtcaacactgccgttgagtccacggacaaggatgcagctgctgctgccctggttgctgccagccgcaagctggacaaggctgttagcaagggtgttctgcacaagaacaacgcagcgaaccgcaagtcggcgatctccaagaaggtcaacgcactgtaaggtttccagttcgtttgaactgatggttgtggccggtaccctcgggtaccggccacacatctttaagcgcagtcctacacccgaatcctcagcttgcgcgcggatcagggccttgtaagttccggtgcttgcgcgggctgcggactttcgcggacgcgcgccccggcagggccccgcaagccgggtaaccgatcagcggccctggacggacatggcaatgaccgtgaccgcgtgctccaccgcatatacggggtcgcgggaaaggcctttgacctgcgcatcggcttcggcggtggcctggatagaccggaccagcccctccggcgtccatcgcctgacatcccgctgcgcctgctcaaccagccagggctgcatgccaagctccgctgctatctgggcggaggatccggatgcgccggcaacccgcgcaactgttcgaagctttgcggccagcgcggccaccagcggcacgggatccgctcctgtggcgagggcatggcggagcgtggacagggccaagggagcattgcccgccatggcagcatcggccaccttgaacgctgtcgcctcgatacggccgccgtagtagcggtccacaatgtccgaagtgacggtggttcccgcatcggagatgagctggctgcacgcggcggcaagttccgaaaggttggctcccaccgcgttgacgagggcctggacggcgtcctgctcaatacggcggccgccggccttgaattcggcagccacaaaggccaccttgtctgcgtctttcttgagcggttggcagtccactacgggccagccccccttcttgacggcgtccaggagtttcttccccctggctcccccgccgtgccggaggaccaggaccgcatcgggttccgtatgttccacataccggagagcatcagcgaggaaagcctcgttcatggcctcgacggcctccacctcgatgagcttgctctcaccgaagagcgaggggctgacctgcatcagcaaagtgcccggctcataggcagccgcgttgatgcggctgacctccacgtcgggtgccgccgcccgcacctgggcgcggattcggtccatggccctgatgcccagatactcttccggtccgctgaccagcaccaccgctgcaggtgctacgtcccgccaggtggccgcattggatgccggggaacgggttgctcgcttctgcgcagcggccatcgtgggttccttccggaaagttttgtggagtatcccagcctgccacgtccggctccccgctccaagccggggccgggtcgcagcgccatcttccacgttgtcccgggtgcctgccggaagccccagcggcggagcgccaggacagccctatcctccagggcttcgatgagcgaaacgagacgccggtgacaggacattaccaacccgccggcctggcgcggtcgggcacaagcccagacggtttcatacgtcagaacagacaggaacagcatggtgaccagcccgtgaatgccttccggccagggcagcgatgcccccgggagctgtgacgtgaaccttgccgtggcggcgacgccggcactgaacgacccggccaccccgatgaggacggttgccgcccacggggcaagaactaccagtggaacagctgccgtccccagcaatgtcacaggtgccaccaggggtgaggcaatgaggtttgccaacagcgagtaggtggaaaactggggttgcaggagaacgatcaccggcccgcacagcagctgggctgacagcgggacggccaccgctgcggccgcccagcgcggaacgaacccgggcatccaatcgatgatgcgccggccaaggacaataattcccagcgtggccagaacggacaggagaaacccgaagctggaccccaggccagggtccgtcagcagcaggccgatcaccgcaaggcacaggaagctgaggccccgtccggaccgcccgccggccagtgatacgacggcgatggcacccatgagggctgcccgcaggacgctggcatccggccccacgaggagcacaaagagccaaaggccggcgccggccagggcagcggcggggaggcgcggcaggcgcaggccccggcaagcgagcaacagtgccccaaggaccaggctgcagttggctccgctgacggccgtcaggtgcgtcatgcccacccccttcatggcagtctccagtccctcgtcgagcgccgtggtgtctcccgtgaccatgcccgggagcaggccgcggggatcgggggcgaggaaggaggacgcggccacgaactgttcccgcagttctttggccgatttctccaggattggcacggcggtggcctggcctgggcctgaggaggctgtgagaatcgcagcttcctccgttcccggcactggcggccgaagctttcccgttgcgcggaccagctggccggtcaccacactgccccagtcgccgccgcccataaccacaagctgtgcccgggttcggagcaggacaccgccggtgctgacatcgcgggtccagacaggcactgaccatcgttccggcgttcctgcctggccaggggctgtgagcgcccgggggccgccggccacttcgacgacggccactactgatttccctgcagcaacagcctcagccaggggcccctcgaaccgctggctggctgccgcagccgagtgtgcggccgcggccaccgccaggaagagtgctgccgcgcaggtggacaggaaactgcgccgggcgcgcgggcgttctgtccttggtcccatgcggcgttgccatggttgaaatcgtcggctgttccgggctatcaacagcatccctgcaagagtaaaactacaacagagtgccgccagtgccagcggctgcagccaaagccccgcgatggaggcggcccatacggccacagccggcacggcgagacggacgtcagtgcggcggcgggactcctcgctgccggcagctgcgtcgttccctgccttccccttcgtttttccctgccaggctgaatcccgtaccccgtcacactgctcttgtacccggcgccggaaggtcgcggcaccttcgaggccccgccgccgccctggctcctttccggggttctcagccgcactgttcccggcgtgcggggcgttgccttcggcggacacggtgttgccctctggtcccggcacagccgcggcgcccctgactgcagactccacataccgctgccagggactggtcggggtctccctgcggctacccatgagacacatccctcatccgggacacctcataccgtcaccagcggcagcaatgcctccagcatcttgggcccgacgccgtcaactgagcccagttcctcggcgcttttgaaggccccatgctctttgcgccagaccactatctgattacgtgccctagccgtacccttgagctatgagggtcggcgtgtacctgcgaatcagcctggacgatgagcgcaccgggctagggattgagcgccagcgccatgactccgccgccctgtgtaagcgtctgggctgggaagtggcgaaagtctacgccgatgaaaacctcagcgcctataagcgttccgtagaccggccggcctgggaagagctgctggccgacctcgaagccggagccatccagggtgttgcctgttacgacgttgaccgcatcgcccgtcagcccaagcagctggaacggctcatcgacctgtatgagagcaagcgccgtctggtctttgccaccgtggccggagagatagacctgtccactgcggacgggaggttcttggctcgcctcctcgtgaacgtagccaacaagagctctgctgatactgctcgccgcgtcgccagggctcaactccaacgcgcccagcaaggcaaggtcgccggcggtggtcaccgcccctatggatacgagcgggataacgtcaccgtggtgccggcggaagcggcagtcatccaagacgcggccaagcgggttctcctgggcgagacgctgataagtatctgcaagtccttcgacggccagtatccgacaccaggtaaaagcgtgaagtggagccggacggtactgcgagccatcctgctgaatccccgcatcgccgggctgcgctcgtacaaggggtcggtcctcataggtgaagacggctcccccgtgaaagctatctgggaacccattgtgtccgtcgagacttgggagcagttgactagcctgctgacagataagagccgccaggcgaatggcggccgggtagaccgcaaatatctgctcagtgggctgctggcctgtccttgtgccgccaggatgagcggggctacgtctaaaggtgtgccggaataccgctgcaccccggacagagggtgtggccggaccaggcgcaaggctaaagcgctggatgagtatgtcgaaaaggaactgctcgattatctggagcgacagtcgatggagccggtaggtgacgtttcacctgaatccgtactggaccgggacatcgcaaacgccgagcaatccctctccgctctcatagacgagtggacggccggccgtatctccgacgccgtgttcttcgccgcccaggcccgcaaggaagcagccctcaacgctctcaagggtgagcgggcacaagaaaaacgccgccagactatgaaagctccggtcggcgctggggtgaggcagaagtgggcgggacttacgctgcctcagaagagggcgattctgtttgaggtgcttcaagctgtgaaagttcatcccaaacctgtgacggctccaaaacggttcgatccttactactacgagttgattcgacggacagattgaggagccgggcgatcttggcgagccgggccggtgagaggtcaggagcgtcggagagaccccgacctcttcgagaattcacggctagtccagactgacgacaatctcgtcacgattcgcggcgggaaacttcgcggcgacgagggactttatttcttcgactgcaccggcagagtccctctcgctttcgtgtacgccgccgcgcacgatcagaaggccgccctcagctgtagggaaccaagccgaccagtgatactccctcatgccgcttcagcttcgggctcggagttcagcaccaaccgaatgtccctgccgtctatctcattgccccagctctcccagcccggctgtggccgtcgggcgaagagttccacatatgggccaggcgaacaccgctcgatgatggcgaactgttcctccggcttatggctgtgctcctgaagcggggcatagaaccaggtgccttggcttttgaactggataggcaggttcccccgcgtacaaaagagcaagtgctccgtttggtgccgaaggtaattgccaagccggaagtagggcttgatccaagtcagcgcggcgcgataggtaaagccccacgcctcaatgacgctcatctgctggtcgagtcctgagttggtagcccacatccataaatgcgcgttgtccgtggccaggcgcttcactggcaatgccttgattgcgtccagtgacatcaccggatagtgagccgaagccccccacttaccttgttgatgcattgcccagggcgggtccgccagtatggtcgtataccttttcattgtgatacggctcctttcggggtcgtttgccgtatcactagcctcccgattatgagtcgtccggtcagttcgttttctgattaggaatgaagtcagattaaggaagaaactagattagaaaatccccttactcatggtaagtttctggtaaaagtttgcccgtgaggtagtcgtcgatgagctggcgggtactatcaaagcccaccccgaagccggtgtagtagccccgcactctcagagcctccagtacttcggcttgctctcgtatgtgtgggtcagccagtagctcaccatcacgccggtatatggccgtgccttcggccttcagctctatgaacagcccgccgtagggtcctatgggagcggcgattaagaggtcaggccagccgcgatgactggcggagcgcttacgcttggaggcttggcccatagtgagcttcatgccggccgcgaagtcgctgctgaacatggcattgggatacttgagccggagataatcacagatagcaagttggagcgctgattcgggctggcggcgcatatagatgttccagttatgactccattttaacccaagttaaaaccccctatatagccagggggcaaggcttttaggtggagaacctttgcagaatttcctcgtaaattgcgagggattcccggttctcgtcggtcggttctttggcccgcaacttctcgatgatgtttccgaggtcgcgcttgatgacccagtgggggtcgtaggccggtcggggccgagggacgaagtcgttcatcgtgcttcacccccttcagcgggagtgtcttcgcgctccagaaggaagcgcaggaatgcagcctgattgtcgatttcccgctgcttgcgaggggaaacccaatcgagcaattctgagttatcggtcacgatactcaccccttcagtcaatgtaagggccggtgttcaagaccggctgaggtttcaggcaagataggcgaaagtcttgtcagcggcttgcttggcccgtccgaacaggacgttgagagtgcgcttttcttccgtggacacgtcaccctcgttgtagcgggtgttccagtcctggtactcagtgacggcgttgagagcgccgtacttcgtatagcgcagaccgtcgtcaatggtcggtgacgattcgagcagaccgatcatggcgtactgctccctggagaagggggcggtttccttggcggtcttcgggaacagtttgcgaaccatgtcctcgaactgtcgcttggtgaagtcctggtcgagcaggtcgttcatctcggactcgaactcatcggcgtacttccaggtgaggttcagcgttcggcgggcctcgtcaatagagttgagagccgatgccgtgtgcttgacgctccaggactgaaccgcggctttgaggccgagattgagcgtgttcatgcagacctcccgaatgggggttgcgtggacaccgaagcgcagactgccgtcgtgcgagttcacgaagcccaggtacagcttcacggggtcgctgccgccgatcagtatgtccttgggaactcgtgccatcagggtgttcacccggccgccggacaagctcatcgcggtttcaaacaggatgggcggttcgccatcggcctgttcaaactcgttctgggttacgtcgagcagggtgaacgcgaagtccaccagctgcgccggctgaatcggggtgtacgtgccgcccatgatggacagcagcgtgttatccgacagccggacgatgcctttcttgtcgagggccatgaggcgctcgccattgggcaggggcacctctacgggcaactcccccacttcccagttcaagccggctgcttcaagcagctcctgcttggacttcgggtaggcgggcaaaagttgccccagctggtgccagggaagctcgcgtccaacgctcatcattgattcgacttcatgggacaaaacaatcaccatccatttcggggagtagtggggcggggtgagggtggaaagccgtcattttcgagccaggtagccaggccggaaatgacttcgagcaggtcatcgagataatcgatggtgctttcgcctccggtttcccggagttcattagcgagctgaacaatcttgtccactgctgcatttgggtccatacgaaattgcctaacttttgaagttacaaagggacaatttcaatatgcgctattcccgctaatgttaaaagggcaacaaaaaacccggcaaggcgttagccaaataccgggtgctgcatcgtgagtaaagcacaaacccgcctatccagtaaaggaagtcgcaacttgcgacgtatcggcgggctctcttgaacaatgaccgttcgttctgaatataacaaaaaagccccggcatttctgccgaggctatacctgcactcacactgaactccgcttttgagattagcgcgaaaagagtcttttgagaagagcaatgatcggtcggctgagaatatcgaagaccagcttgaatgccttatacagaccgttggctttgatttcttcgtttacgcggttgatgtcttcttgggatagggccatgggagcctcctacttatttagtttcttagctgtacggttggctacggtatggccgagagccagtccgatggcggcggcaagaccggatgggacgccgaagtcggcggcgttgtcgaggacgtagaacagcacggcaccaccgacttgaagcgcgatcttgccattctcgccagcaaagaacttctcagtagccgctttgaccgcatttggagccgcagggcttgcgggagttgccggagtggtagaagtaggcggctgaaccactggcgttgtttctgcgggctttggtgcgttctggagcgtttctatctgtttggtcaggccgtcaatagtcttctgctggccttggttctgcgtggtcaagtcggagaccttctgctgcaaggagctaatctgcaagtcccagcggtcagtcttcgccgtgcgtccccagatctggaagtcggtggccgcatccgcctcttggtcgtcagacagaatctccatcgcctgtagccaagtgcggcccacggcagcctgccggaactcctcacgactggcgttccggcctcttatctgcacgaacagcttgttccagcggccgtactcgttgtccgcgtctctaatcacctcttcatctccttgcttattttttgatcgcatccagccttgaacgccgtagtaattgggatgggccaccactcgcggagcactccccttgggattgttttgctcgaacagggtgtaagtgttgacgtcggcccgcaccactacaccggtatgcccataacctccgccccagcgtctatccatgcacagcacgtctccgggctgcgggtagttggtcgggctgttggcgattacgtcgaaggctttgcggtcggcgttggccagtaggtctttagcgtggccccaggtgtgagggagcttttggctggccgtccagaccattgagagcccgacgcactcccctgtgttctccggagtgttcccaaccttcggaacgccggtgtacttggctatgaaagcgtcgaggttcacgggcgtggccggttagtgaacgaaatacggttatgaacttctttgaagccttcgcgcatatcggcgtacatgtcggcttgctggttcataatcgtgctgtgagcttcgccctggagccgaacaatacgaataagctcgtctaccttggtctctaggttgtcgcgctttcgacgccggccaaacatggctctatcctcttatgttttcagtatgtagcttgcgctaggaattacaagaggtttagcgctggacactcataacggtaactatcagcccgataactgcggccagcgcggcgctcattaccgtgcggaagtaaaactgcttggtttcttctatggccttgagacgattgtcgagtgcggtgaggtccttgaggtggtcttctttggtgacatagaaggccttgaagtcgcggaactcagctttgatttccgacaagtcttctcgcatatatttgatgtcattgcggatgacggcgacagatacgtcgtcgatgttgccgtcgggagtaatgatgggcggattcatcggactaagcccggtactcggttaccacaatcgaagacctcaaaactcctccgaacttccgggctccggagtctccgttgagcgtgacagtcgatccggcaccattaccggccctaaagcggaaggttataggcgatgtagtgcccgccgtcatggtatgcgtcagaaccaccggtaccattgcatttgcagcgacagcggctgaagaagttgcacagatagcgtttgtgattgcgtcttggaacaggccagcattgatgttagcgacagttgctgtggccatgaatgtagccacctgaattaccagtttgtttgcagccgatttcggcgtgatcgacactgtcagaaactcagttccttcagtgatctgtggaatggtgtcgtcattcggaaccgccgttgccccagaggccacggcaacggtactggagtccacaacctgtacgggtatgccgttagcgagcatcgtggcactgacgctcttagagtccgtggtcgtaaccatcgtgccgtccgcctggttcgggacgagatggccgaccgtgttgctggaaccgccccacaaatatggcatattcagagcggctggcgtacgggcgtccgtgatgttggctgtgacgatggtggtggtagcagctgctatagagatgtccgccaggacgatgtaggggttactggccccgatggcggtctggatggtgcctgccgtgggcacaactggggaagcagcggcggtcccggccacgaccataagcttgaaggcgttctggttgttggtcgtcgcgctggtgatgagggcgatgtcgatataagcgacaaggcgatccttacgcggcagggtggcatgggcggcggtgacagtgacgttctcgaccgcatccatccagccgatataggcgacgttcgcagaagtcggaattagcgcggctgcaaagctcagcgtggaatccaggttcacgtcgacgctcatgttcgcgccggccgaccgctggctggcgtttaggcctttgatgtatccggtgcggaagaaagcgcgccagggtttaccgtgaccctcctcgttgacctttcctccgttgatggcatatcggcccatttacgctttatcctgtttattactcttatcttttagtgtaagtgtccggccggttttgtccaacactatatctttaggattcgcggctcgcatggctttccaactggcgggtgacatatctagcttagtttcagataccgccccatcaatttgaacacttacgccgacttgctcttccactaaaagaatctgtccatcagctagttcaaccgccttccggacaatctgctccgggaaaggaaaatcgttcatcaaacacctccttgcaagtaataggccttggcgtacaggtagacggtgtgattgatggtgtctgcgttttccacggtgtatttgaaaacctgtaggccggagctgtcgttgccatcggcccagtcagcaatcagattgaagcgcatcttcttgccgccactcgcggtcaggctcgaaccgttggggaagagatgggcgctactcccgtcggtgtcgacgtacatggagaccttgaagtccagcagctgcagacggcccagtgcggaggtcacgttgaaggctccgctgtataggttggcgataccaggcgtcacgagcaccccgcccgttgtcaccagattggaactgacgacgatgaggctgtccgcgccgatgggctgggcctgcttgagggcggccacttcccggcggagtgaagccacctcgcggatgaggcggtcttccatggattcagttgtgcggttgatactcatgattattggctcaggcttagtttgacgctctcgttatcgttctcgtcgatggcaagttcgatcttctcgatacggaagtagccgttgacgtgagacagaatctcgtgggcgctaaggtcgactctgatgtaatcgccgatgccgtagtccgtgataaatggagccacgttgccgtcgacctcgatggccggtatctcgaagggccaggcccaggtatcggcgtaggcgatggcgtgttcgagcagggtgtcttcctcggagattgagctgtcagtgatgatcttctcccaggctttgtagtttcccagagagtccgaacggatgtacgtcgccttgactgcggcatcaccactgccggccccgtagtaggaaacggcattggcgagattctgggcgtccaaagggctcgacaggcgcttgatgttgccggggtaggtgaagacgatgtcgtcgcggcgggagcccatagtctcgtaggtgttgaagaccttgtcggcggtgaactcaaagtcgaacgtgccgctttccagcttggtgagattttggatggcctctttgacgaccacctgtggtgagtaatttcggatacgggatacactcagcgccggtagagaaccgatggtgacaccgaagtcatacggaccgcctacaccccagccatggttctggacaaaggtgatgaggtcagccgcaatctggttgccgtagccggtgaactcctcctcgttgagcgcacccatcagtacgtgccgatgagcaaacagattcaggaagccttgcgcccgtacttctacgtcctgctccgtcggagataagcgcacttcccgcagcatgacgataccgccgcaaagataggtgctccccctccgcacccgcacttccgtccagcctggttgaagtagggattgaggcgtggtgttcataagccgggcgtagcgctccagctcggcaaggtctatctgccagatgatgtcttcggcttcattgcgctgcagcgtgaggcggcgattcttggcccgtccagcgaagtcagctatcagttcgccatcaggcgtccagagttcgaagtggtacttactcgccattacagcccgatataggcgggccgtgccgccacctccaaggtgcccgtgtccgaagtcgaggaggaggaaaagctgaaggtcgtgatgccggagggcagactgaaccattcggagtcgaccgacttggcgttcagcacgctcatgccgttgtacaggacagtcttatccgccatgtcgatgacgattacgtccgacgcgctggtagcggagagagtcagctggaaggtctttccgatttcgatggcgtagatggtcgggttcgtgaccacgccgcggatggtgagaacgggccaggagtcggcgttgccgtagttgttgacgctggccgtgccgccagtgctggagtcgtagatagccgggtaggtgatgggataagtgacgccgccaggaacccggatgccgaactgtccgctggttaggctctcgatgccgtagagcaaggggtccgggacaaccatgacgatcaggaagcggccgaaaccaatgttgtccgtggtctgtttgaagctcttgatgtaggcgtccaaggtgaactgagccccggataaggccgtgaaggtgaccgttgccggttcgggatagccggtactggaatcccgtcttactcgacaagccgatgccagattgcgccgggcctgctcataggtcacggcgtcggctccgctcacaatgccagacagtgagatggtgcgattaccgtagtaggccgcgctgacgcgcccgccgtcttcgcccggcttctcgtaagcgttcagtcgcacgtccggagcatcgaaaccttcgatttgttgcagcgtgtagctggtgacaccggagccgagtatttggagcgagtcgatagtgagggagctcagcattaggagacccccgccaagcgccaccccagctcccggttggctgcgtcaaagtcaaagggcgagtaaatgttgttcgtctggtggatggtcacgccaccgccacccaccatgccgcggctctcttcgttggtatagacgttggcccctttgggcaagctgaccagctccgggccgcgctcgccgacgacggccagaccgccggagaagttacggacgcccgtggcgaagccaggtatcttgagcgctttaccggcactgcttatcccggactgaacattcttgagtccgccaaaggcgttcatcacctgatttatgagtccaaggatcgtgtttagcgggccggcgaacggtcccaataggagcatccctatttgagcccagttggaccggatgaagttcggaaccgaagcaatggctccctttacccggtccatgttgagtgcgactgccacggccaagccgataacggcagctatggcaattcctactgctgcggcggtggcggcggcagctgtaccgaaggcgatgatgaccacgccgacaatggcggctacggagcccagtatggcgatcatagccaggaagacaccacctgctatcaggatggtccccgtcagtcgctgattctcctgcacccatttggctagcgaaacaattatcggagtgacggcctgtagtagcggcaggagggcagtctgcagagctgtgccgatttgctgcttgagcacctccgtctgggccgctgcttgagcctgtgaaccagcaaactgcttggtcagccggtcggcatcaccgagctgggcagtagtttcttttacgatgccgccgaaaatggcttgtcgcacaccagcgtccgagctggccttcatcaagtcctgggcggagtacccggcctcttccagcatcatgctgaggttcttcgtgacgccggcgttgtcgaccagaatcgagttgccgttcttgataccttcagtggcgcttgcaacagcctggccgaagcccagagctgcctgccgattgaaggcagctgaatccttgaagcgttccattagagtgatggcttccgggaggttgaagccggccgccagaaggttcttcagaccggtggcagattcagcgacggtcatcaagccgtctttggctaagttctgagctgcccgtttagcggcgtcagcatcgtgaccgaaggccctggctaccgaggaaagaccggtcaggccactctgcaggcggttggcagaatcaatggactggcccatgaatccagccagttgatgcacagcagcaccggcaccagcagcgacggcggcgaggggcaacacattgttcttgaagccttcgatggcagtggaagacctacgactttgagaactgacaccatcaaactcagagccggttcgattcagctcgcctctcaccttgtttagcgtggcggaagcttcgtcaatcgctcgaacgactatttgtaattcattggccgccacgcatggtgttcctgcttaattctcgctgctgttcaagctcttgatgcttttgaactttagcttctgcactaatcttaaccgctataacatccaaaaaccattggggctgctcgtagtattcccacagtgtccatccatattccttgcacaccagggcagcgaaaaaggctggatgcagttctcccgcgtgacccttcagcagtgatttgtaatcgctctctagtttgtggaggtctttaccggtaaagggttttggatcttatcgacctccgccttgatgaagtcgtagtcagcttcgggcatatcgagaatcgcgtcaagcacgccctcagacttgccatcgacggacaggacaatcaattccagcgccttgttcgtggccgccagggcggcggtgccgtcgaacttagtggcctgctcgaccgacacttcggtaacggaggacagcatgacggactggacggcctgcttgatgcggccggtgatgtagccgcgcagcacgaccttcttgtgcagaacaggcgtttcaacttcgatggattcttggagttccattagtagctggctaccgcgttagtcagaaccgcgttccacgaatagccgtcagtcaggctgaagagggcttggaagccgacggtctgctcaacgatgttggccaagtcttggtccgtaccccagtcgctgaagttcaccttcgggaaagtgaagaccagcttcggattggcagcggtgccgatggtcacgtcgctattcaagagcgtgatgctcatagcctggttggtgttggcgaagaaagcgtcgtggtgagtagctgcgtcaaacagggcagtgaagtcgccgtcaatcaccagctccttgctgtggattttgctcggatcgttggagcccaggccgtaccagccttcggcgttcttgctgactttgaacttcacgtccttcaagacgatgggtgtggcaccggccaggccggcgacagtcgaggccagcttcacggagatgtgtttggccttgaactcgttttcagccacgtaggcgacggtgttgccagcggaagtcgtgggcttcttcgacaggaactcagcggcccaagtcgcccactgtccaacggcggcttctagttcgaagctgtccatcacaccgtaggcgtagcgctcgtctcgtagggcgtccttcagggcgagcgtcatcgtcagctgctcggaaacttgagcctgactataggtgtggtccttgatggtggcgtcagaatcggcattgtccgtggtgacaggagcagcgccgaaggcggaggccaggatgaggccgatggacttgtcgcagaccttgcccttaatcatcccctgcccgtagtcgcgcataatctcggcggagttgtacttgtccagcacgttgagggccgattcgttcatctccttgtcagacttctgcttgaagtctgcttctaactgcttcagccagtaggtaggagcaacagcggtgccggcagtgctttcctttccgatgccgtaggcaacctttcgaccaatatgactgttactcattcacctgctctcccttgtttatgatgcctaattcagcggcccgtttcttcttagcttgttccacggcttcttcaatactgccggcttcagtcggatacggccggttttccagcattaccgtaaagggctggagtaatccgttgcgctgtaatttccgttgggccatctattagtaatccttttgcttagtatcgtaattaatttattacctaacgtctacgtctttcactgcggctaatcggatttccgtcgccagtaccaatccttggccggcttcttgcagcgtccattccatcggaacggccttgaggaagtcacagctggcgttcaagtcctcagactggtcgaaagcatcaagcacggcatcaaccaagtcgcgcatcacgtcaaaggccgcgccccagttgttctggtcgacgttgtagtacagctccaccatgaagccataggcccgctggttctgagtggaggtgaagacggtactctctaccgccgtcggcaccacagaagccgcaggatagccctcaaactcattagtcgggtactcgaccacatgctcgaaggcatcgcttccagaggcctgtacgccttccaggacggtttttatctcattgctgatggtgcttagattgctcacctactttcctccgatgatgtttttgattgcttggtcgaaggcgtcgtttatgccggcacgggaactattggccgcccggtccatgaactgattggggcgctgccctctgctgctgcgggcgaagactgccccgcctctccccctccaggccatcacccgccccgggcgaatcatggcgcgtttggggccataaagcccggtgccttcatgcacgtagagggcgtacttcacgcctggccggattaccactgcattagcgagacgggttatgccgatagagctgcggagctgtcccttgtctatcggcgcttcctgccgggcgttgcgctgaatcaggatggcggagtattccaaggccttggcgacctgggcgcgagtgcgctggggagcctttgcgaacaacgcttcaagctcggagaaacccttgacttcaatctctatggtgcgggccatgcctagaccctcttgtcgtcagccaacgtgagcttcagatgagggaagttgcccaccaggttcttgcggacggctttgacgaagtagatgatgctgtcgccgtcggtcagccggtccccctcgcgcacgtcagcggtggaatccacaaagcagcggtaagtcttggcataggcactgccggcctgctcgccaggcacgtcttcgagcggccggatgaagcaaggaatggctgacccgacagtctgatacgtcttcttgatgccggtcgtggcctttggccgtgacacggtgacgctctgggtgagcaaaggcgtgaacactagacgttcctcacccggtaagcggctaacacccccaagtcatctggtgcgatttcttggatgcggtgctcgatggagtagtcgtccagtgattccttggacacggtgttgtcccggaacagctgcgtagccaaccggacggcgaccatttcgatgtctttgggtacgccgttgctgtcgtacttgtaggtgactttgacgaaggtgtaattcaacggcactatcaggcggccactggctgtccactcgtaatcgtctgcgcccaggacttcccagtcgtcggatcgcacgtcgcgcacttcgacggaggtgatttcagtgatgccggtatgtttcagccaaagccgtgagccctggccctcgtgcagctcatcagtgactgtctgggctccggtagcgaagtggcggccggtgtaggtgtcaatccaggcactcgcccgcgccagcaggtcagtcaggtaagtatcctgagctgaatcagtgatgctgagggcgctctttagttggtcggtggttgcatatgacatttggttcttggttcctcaccgctgccctcgctatgaagggcagggcgcgaagaactaagcgttcttttcggcgggcttcagtccttcgcctttgacggcttcgactttggcatcttcggtcttgccgcgctgggctacgagagcagcagcgtggtctttgttcttctcgtcgaacttctcgacgcggacttcgagggtcttgccctcggcgtccttgcgattcttgtccaacagagcggcggccacatactttggaacggtgaacacgtcgcccttgaagtagggagtgacggtgtcggtcgcgatcaaagtaacgggcgtttggtctttcttatctgccatgggtagatatcctcagattagttttcttatacgacggcggtcagcttggcgaaggcgtcgacgatggtcagctgaccatccaagcgctcagtgaccttcacagcggcgcggtgcttctcgaagctggtgccttcctgagtggagacttcagccgagacttcctggcggtcgccgatgtagtagtagctcaggtcgccgaaccagatttcagactcatccgtaccagcgccgaggttggtcgggatgtcgttctgagtgatgacggggcggccgaagagcgtacctacgcggttgtcaccagcgttgaagctctcctcgaacaggaacttgccgtcggtcgagcgcaggctgcggacgagcttcaggatggcgtcgttcatgatgaaggtggaatcggcgcggtactgctcaggcagggtgtgaatcaggttcaccaagtcagtcgaggcgaggtttgcaccggcctgagcgacagtctgagtaatggtgtaagcgcggagacccttgggctggcccgtaccggaaccggtcatgtaagcagtgtcctcagtgcggccgagcttgttggcgaacttgcggatgaccagctcagcgatgccctcgttgatagcagcgtcagccaagagctggcggctcatgcgggacagtccggcgagcaggttcacgttaaggattacctggccgaaggtcgggtcgctctgagtgatcgtggcgagttcagtcgtccagttaacggagacatcgttgccttcggtctggatttccatcttgtcgctgcccatcgggatgatggtggcgtagtgcttcagatagccgactttgtacttcttctcgaccagggtgttgtagaactcggtcggaaccaggtaaccaccattggcgtcggtcgaaattgataggtctttggtgaaagcggagtccatcaggttgccgaggaatttcacggaagccacaacgtcagcattgggggtcttaccggcagcgatcttctcggttacttctttgcgctcaccagcgggcagctctttcatgagcttggcgacttcttcagcgacagtctcgcttactattgatttgagttcttcaggtttcataacctctttctctagtgattaattagtcgatcttgccgaggttgtaatcaatctcggatttaacgccagcgcgcacagcttcgcggacttcatcggcggtcaagctcttgatttccggttcagcttcgccctcggccttgtcttcggtttcgccttcaacttcggtgccatcagatgcctctagctctgacttatcctcagttacttcagtcacttcctcagcttccgcttcggtttggtcgttaacaatttcagcaggctcttcggctttagccgtgagcaattcggtaagtgtctttacttgggttgtgagctctttaagagcattggcagtttccatgtcttcattatcagaattttcgtctgattccgtcaatgcttttattagctgccgcgcttggctggtcattgttttgcgctcattctcggagaatgtgccgtctttgaagcccaggactaatgcttccgggttagcaggaacggttacgcaagaaacttccagtagttcgcacttcgtgaaggtgtagccggtcatccagtcgccgtcgtactccaacgggatgaagcccacgctgaaggcgcggagatagccgcccttgtagagcttgaagatggtgtcggcccactcgtactcgtccttggtggcgaactgagccttgaaggtcaggttgccgtccttgatgccgacttccaacgccttagcaactggaggcatggagtagttgtggccccacggcactaccgggttgcccaggaagcgcttgagctcccagccggcctgctcaattacgtcgccgtaggaatccttggccttggtggaaccgatgaactcgatagtgcggtcgtcttcattcagactctttatctggaacggaatgaccgtgcggatggtctctggcttcttaccctcaagctcttctagcttctgctcaattcgtaccgatttgccgaatacggaagcggtggcttgctccctatcctgctctatgccggcgactgtcttcatttatgctttatccttgttacctttagcgcaatcataattcattcacgtcttttagcacaggcaataaggtgcagcggcagttagaatgcaaaggcgccttcgatatgctcgtaattcagctttagcggcgtatcagcttcgtccggctggaattcatcgcccttattgaaataacggccggtcaggtcgaccaccttgccgtccatcggcccgcagtagggacagacgcgctcgtccttggcggtgaaccattccttggcttcgaccacgtctgactgcttccaggcagcttgagaggcgaagttattggcccggatggtctcagtcctggcgatacggtcagcccggaatccggccgcggccccgtagaccttctcaacccgggcggtcagctggtcgatgctctcgccttcggctaggccagcagccagttccgcccgcagctgcttatcggtctcatcctcaatcccccggctcaccttcccgttgcggttggtgatgaagtcagtgacgtaggggtcttcgtagtcaaagccagatagcccgacgagcagcatggcttcctggccggcctcgcgaacatggtcggtgtagatcggcgcgaagaacgccaccaggcgcttgaggctggcctccttatcgaacagcgaaccgggagcccgcttgagtgttttatcttcagcgaaactgggtaagttctccagtacctccaccttctgcatatcgaaatgcagtcgtgccttcatcaggaaacgggactggtaaccgttggagagtttcgtctggatgccatggaaggcgtcgccgattagctcgcgttcgtcttcgtcttggtagaggcttcgagccactgttttcccaggctcttcttaccctcagtgtcatcggccggcagctcggtgggttctggctccggcggcaggagggcctgctcgatggggcggagcgagttgggtacgaacagggtgtctcccccgttgatgccctcatcccccagctcggcgcggacttcgttgaccgtcttgtacaggttgaccgatgatgtgcgctccttgagcaggaactctttgtcttccggcaccgggtcagtgaaaccgatgatgagcttgctgtcgtactccggcgccagacggtggttgataaccgaagctttgcgggccatgagcggacggacgacgcgcttggcgtggttgtactcggcggcctccatgttggagcggccgtcgccctcaatgagtcccagcatcacgcgggaaacgccgaacatggccagtatctgatcgcggttgtatttgcggctctccaggaagtccatttccttctgcgtcatggtgagcttgttcagttttaggccagcttcgagaatagcgaccttgtgggcattggcagtgccctggtactcgtcgttccattgctctttcatgcgctcaaatacctgtggggtcagggtctggtccgtctccagtgccaagtctggtcgggcagagttaaagaagaagttccggttccagtcagcggcgtgggcgtccgtctcaatcgccctggcggcggcacggacgacactcatgccccggtagatgttgttcggatcagtcagggggaagtgaactatatcggcggcgtcccaaggaatgtccttgccgttcacgcggtagacccagccggtaattgccccgtcgtcaccaacaacgtgcttcatcaagtgcggcatcatcggccacagctgctctgcctttcccaggccgttgcggagaatcccccagaacgcttcaccagcgagaaccatgtgcaggtcagtcagctcctggaagcgctggccgtccatgacgacattgggatggtcgagcaagtccagcaggatgtggttgtccagctcttctagcgtgggctgagagcgcaggaaagccttgtagctcccctggtgcttcagcatccggccggccatcttgccggtcttggtcgtgccgcggttggcataggcccggtagtcgatctgcgaggtgtccttggcaatggtcgaggctgccgcatagacccagtccaggtactgctgcatataagcacgggtattagtgagcttcgtaccgccccgattgaatagagctgaaccgctcgtccataattcatccagcgtcattgtggcgctcttcttcttgcccagctggccgagggtgctgtcaatcaggtttgaggttagttcctttaagcccatatttcctagtgtttagttatttctatactaatgttaattctaatgttttgatacggctataagaacgtgaggcggggaacgtttacgttatgtctaatcttcatcacgccatatcgcagcgaatccaccgcatcatcattttcctttagcggctcatccatagctttgccctctttatcaagcctccaggtgtagttctccaattcccaggccaagttcgtgcaggaagggtcgatcgtcaactcgccattggcgaatagtgcttttgtttggttgatacctcccagaactgagtctttgcctttgaccgccccttcgagattgatccccagctcgcggccgacctgaacgatggcgatggggtcttcggagtccccgacagcttcatccagctgcacgccgctgataagagaacgcagcttgcttgcccgctgtacgtcatccaggcgtgattggtacaactcccgctcgacgtgtattcggtcgtctgctgatatggccaacagataggcggccaatgggtggttgtagccgaagtcgatacagagcgcccggcgcacgggctcgaacggcaggggcttgatatgggcgtcccggtcgaactcctcgtagaccaggccttccatcttcttgaactgcgccagatactcctgggcgaactgattcggcgatacctcccgcttggccttgtcgatttcagacgggtctaggaaaggattgtcgtagctggagaagtggaagaactcgtagtcttcatctgtggcgggcctttggctcagacggaagagtgtcttgtatcccttcggcgtccccatgaagatgccggagcccttggtatctgagagcagtggccgcagcacctcattccaggcgccgtcgaagttgcgcatggaatcgacttcatccagcaccaggaggccggcgttcttgccgcgcgccgtgtcgatgttttcccagccagccagtttgatgatgttgtcgaagcccaagtgactgcggagggtgacctctaaacgctgttcatccttggataggaagttcggtgtttcccgcacagcattcagcaactcccgccagacgatgtcgcgggcctggtcatgggtagtggcgaaataccggacgggatagggctgatacaacgcgaaggctttcatttcctcgacgctgtaggtggtcttaccgaaccggcggccacacaccagaaccttgaagcgagctttactcttggctatctgttgttggttcggatggagcatcaccaaatctcgctgccacggtgctgtcgagcaccaaaggctttagtgcttcaccgccgctggtgacatcaagcttgtcgccatacttcttcggcttcagctttgaggcaatccacttacgggtgtcgacgcgcagccttgagcgctggacgtgctcgccgttgagcttccagccttcggagccgtctttgttggtgacttccatccagtcattgctgccgtcgtcggctatatcaatcatctcgtcgaccagagaatctgctgcttcggctttggcccgctcgtactgcttcagaaactcagcgtttgtcctgagccaggagaaaaccgtggtcatgctcggcatttcctcagcggcgcataccgtcctcatagacttaccactggccagttgctcacaaagccggtcagccagctcctgagtaaatatcgagggccggccgatggaattcgtttgtggagtgtcggccattcatggagtcccagttattgccctgattatgagctaaacggctaaagctgccaagggctattgaaaaatcaagacttgcgcgtagaccacactgatgagccagacgacaatcaatcccgcccagaggatcacagcgccgagggacttcatagcactcacgatcggcgttatgaattccatgattatgaggagtagggcaaaggacaccgcaccccaaacaagaagcgcctgaagcgagcttccttctcctcggtatagcgccgtcagcgcggccagctccccgactccgaccgatagggagaacaggacaacggtgaaaacggctacgcccttgtcgatccttgaagctttcttgaactcttcggcatgagttacgccttgctttagacctactgccacggccactagcagggtcggaattgcggtagcgccgacttggaaatatgcgagaggtacctgagacatactcgtcatcgtgccagacagaggcgcgtcccttggccaaggagagttcgtacacgcataggctgtagggaattccgttcaatcagggagtacgaaatgagtgaatccagtggtggcatgggcgacaccgcagtattggagcgaacggccgctgaccatcggctagaactaaaactcaagttcgaatcgcgtgactacaccttgccgcaactgcgtaggcgcctccaggatgttgaggcactgctgatcgtgcttctagcagataggacgctgctgccactttcatccggcaaaagggctataacgtatcgccctcgtacccgccggtatgtgaatgaccaagcactggtgcaggagcaacaggcagaactcctcaagggcgtaaccatcgagaaagtctcgctaagtagccccttggagattctggcagtcgttacagcctctgcttctgccgtcgccgcggtaatcaagctcatgccgcggatcattgccatcaaaaacgagtggaatgagagccgggttcagcgggctgaatccaacctcaagattgaccgcatcatgcttgagcgcaagctggttaaagtgctctccgacgagacggacaagcttagtgagactcgctacctagaggctggtccaagtaaccccactaagaaactggtaaaagcagctgcgcgggccattggacagctcgacgatgccgagactaaagactgacaccgaccaaaacacgcccaaaagttgaccagacttcgaaagggcacccccgctagtatctggggacaccgcgaaacggctggggagtcgccttagcaaggaggtatccccgtgcagtttatacaagttacaccgtcacccgccccgaatgacccgctacggcagctacggccgattgctccagacatcgatatgacctggatttggaccggaattggagcattagcctgcctggccgtggcctgcgtattcctatttctgctcgtacagaacctgcgcgggtacggaagcgcccccgcctggttccacgtaatcggcatggtcggcgccctagccgcaactttcatcttgggaactatctcaaccaacgctatgtgggagccaataaaacccctagcgcagttcaccggtcccggcgctttggtgttactgattggatttggactattcgtctttgctaactcagacaagtgatagccttttatctatggcacgcaaagtggtaacccttttggaagatgacctcgacggctcggaagcgagcgagaccgtctcatttgccctcgatggcagtgaatacgaaattgatttgaataatgaccacgcgaacgagctccgcgaggcgttcgctcgctttactaacgccggccgtagggtatccggtggacgcggccgcccggctggtcgtaaatcagcttcccacggtggtccagacgctaaggctgtccggctgtgggctgctgaacaaggcttgcaggtcaatacccgtggccggattcaggcggatatcgtggagaagtacgaagccgctcactaggccgacaccaaccaggaagatagtgcgcacgtctgactggtgccggctttttccacagtaaatctgtggattgcctgggtacaaaataaagaatcagggttagaactgaattaagttctggccctgatttctttttttgctctcgtatatcccccggtgccacgctcaattcatggtgaagaaaatactcttagtggtgttactcgccctgggtttgacggccggctccgctggtgtcgcccaggctgccgttcctgaatctgtccccacggtctccgtcggcgggctcgatcccgagtactggtggctcggcggttacgtcgacctggaccggactgaccaaggggccgtaacttccggctacgctgcggcgctggcggggactatctgccttcagacctccggctgggtctgcccgttcgccgcgttcattctcacttcggcggcgttctacatagcgaccaacggctactgtccgaataaactgagaatctacctgagcttgctcttcaacttcccgatgaggtgtgcgtgatggaccgtaggcgtggaatcatggtcggcctgattgtgggcctgattgcttcatccggcgtggcggccagctctcagactccggtgtgggcctttgtcctgtctatgatttgcgtgctgattgcggtggggctgattgctgtggtgacggggactgctcggcgctgaacgggcgcacttcctcgccgcgtcggacgccgccggtgttggtgatgtggctccgcagatatccggggttgccaagtaccttgtccgaatacacgcacaactcgcttgagtgaaggacgcaggccacttcgtcgaacttcggcccatctacgctgacaatgcgggtatagcaacggcggctagtgcatttgtagcactcgtttttgcgcctatatgtgctcatcgcttcaccgccctgaagcctggccgctctgacagtgaatccagcttccgcttacgtggagcagtcttcttcggctgctcctctttttgtgcctggagtaagccgtcggggtcgttgtagaccacctggccgggtaggagttggatgggctcgtagttcggctcatggcaagcagggcagcatggaatggtacaagttctattcaagtgccagctcttgctgtgcccacaggttgagcaggtcttctggcgactcacctacttcgcctcctgcaatttcagccagagtagggcgagggcttcggccatggtgggggcgagaatttcaactatctgttttctaaggtcttgccgtgttgtgctgttgtagtatccgactcgccagcctgcgctgctttgcgtggggcgaattttcagcatcaagtttgtaccggcatttggagcatctagcctaagtttgcggggtagctggtcggctatctcttgggcggtgggggcggccgaatacctaccgaagccgcactttgtatcggtacgcagctcatgggttacgccatcgcttgtatcgccaaactcgtaccagtaattaggcgcttcttgcgggaatcctgccgccttgagcttcttcgctgtttcgagggtgactacgagtacttccattaccgacatccctctggctgatggatgacgatggtgatgcctggtgcgttcgaaatcaccggcgtgatgcacggcaccggagtgggggcagctgtaggagctggggtggctggaaccggagtagcctgggcggctgtcggctggatggtcgacgtgggagccgtagtggtcgaagtcgtcgtagtagtggcgctgccggtgggagctgctggcacgacgacgtgctccgccggagcggtgccagtggattcttggagcttcacgatgtcttgctcgttgttggtggtgcgggcgtcgatgttgtcgatgcgctggttcaggcccggtaggtctagctcactggagctgacgccggagaggccgaagacagtggcgactgtggccagaacgccggagattaggagggagcgcttcatcggttggcctcctctatgttggcgagtccgcaccgttgctcccgccgtaattgattgcgccccatacgaatgaagttctcatgcggctcccacagcggcgttcggggttcgtcttcaccgatcaattcctcatcgacgacggccttgattcggactagagcttcttcaagagtaattatctgttgggaaaaatcaggatgattctgaacgctattggcccacaagcctaatgtttctcttatcttgtcgtctatcacgctcatttcgcggttctccgtttatgccaaacgcagacgttcgacttgcaagtcctagcggcatgatatggccgggtgggtttatactttcggacttccttcaacatacgcttcgtaatgtagagcgcagtgagcgggtcggtttcggtcagcaattcttgctgcatttggtagacgccttatttaggtgtcctgattatgcgccaagcactttaggaatgcaagggctttatgcacaggtttgttcgggtcgtccaatgtagattttctggcgcgcacttttagggcattcctactcaacccttgacagaatttccaccgacataattatgcaatgcatattagaacataatttccgcaggaaaccttgacacggtcgcagtccgctggcgacgtgttgatgccgggaataccgaacaagcgggcggagaatctaagcatgactgtagggcagtggatgcttacgttcttctgggataactctgacttgttggaaggcttgaacaagtggggcggagtcgctatggcgatcattggcgctgccctcacggtgccttacgcggtccggcacagcattcgaagcatggtcgagcgcgtccgcactttcgctgcaacggtgcaggctggagtcaaagaattgatccggagactgcgctgccaaccgaaagaagtgcaatcagacttcggcagtgagggaaacctgggggcagtgggtcatgatccgtccgtccacatcagcgatccttggccaaccgatggttccatagacgacaagcacacatggattcggagcgaattgcagcgtatcgaacgtcgtcaccaagatcatatagagaacaatgaacgagtcatcagtcatctcaaaggcctgcacaagggcacgcgcaaaacaatagaagaaatgcaaactgaaatgaaggctcaagaggcagcggcaatcacgattgatacgatcggcctcctgcccattctgtcgggcataatcctcaccggcgtcccagaggagctttccaagacgggtgtctttgggtggtgccttcttatcggcgcttccgctattacgatccgagcaatgcgccgcagcaagaccagtggcgtctggaaggctgagcttaagtaggattgcctgatggatggggagacagcacggctgatcgtcgtggctttgggggcaatcatcgcgggcatcgccggccagttgatagcaggagccttcaacagccggaacacgattgcgaacatcgaggcagcacgagtggctgcggagacacagcgagaagccgacagggacgtagagcacgaccgctggttgcgtgaccggaaagttgaggtttactcgaaatttctcgaagaggtgcatgaactggaactgtccatagccgaggcaaaagtggggtatgcaggagacgggccagggttgtccaagaaagccaggaacttatcgttgctaaacttgcgcgtactggctcccaggctggtcgtagaggcagcacaagaagttgtgcaatccctaagaaacttgattgttgagctgatttccgtcaaagacagatcggcccccgacgaagcggcttttcatgctgcgaccgaagattttcgggacaaggtgaccctcttggaattgagaatttctaaagacttgggaattgaagtgatgggctgatggacttcaatcccgacacctggggaaccgtcgccgattgggtcggcggcgcgggtacaacacttgctttcgttgctacggcggtagtgatctaccgcgatgccaaagtccggcggctagcccaggctcggaaggtggtctacacgtcggagcgtacggatacctattcgttggctacctacgccctccataacgaagaagatggcccgaccccgtcgatacgccgacacattctgaagaatctcagcgatgagccgatttacatggcctacttctactaccaggatcgtcagaagcgccctcagttccttgccaagcagaacatcgtccttcctggtgcggagttcgtttacgaaagcgacgacgcgtggctccccctggttctgttccgcgataattctggtgtcggctggattcgcaccctaggtggttcggtctaccctgcgggtgggatacataagctcaaccaaaggcagctagaggacgttttgttcgctcaatatatgcgaagggaatcagtcagataaccctgtctgcttcttccgcttgcgcggtgccatgccgccgatggctccccagtagaccgcccggtcgtggtcgaaggcgaacccgcctccccggctcttatgcccgccggcttttccgatctgtttatagaagtctgctccgtacagttgcttgtttttggcagcggcctttttgccgcctgattgagttccggccacctatttgttctccatgcttagttctaattgcttcaccgcaggcgcttccgctatcacctgccgtactccgaagtgctgactgaacggcagcttcgcctggtcgagtactcgcttgcctggcttcgaaagcttggccgatatttcgatctgccggttgcgcccatgggaatccttgatgacatcgcgggcggtgtcctgggtgtaggcggcaaggtgatggctcaacatctcccgtaagtcatgcaggtggtaggccacctctcccctatcaacgttcaggacgctgagttcccggtcatcttggatggccagcttgagcttcacggaggctgctttgacggcggcctgagctgcttccagttccttatactccggcaggtcattgaccagctccgtccgtcgttccttgattgcttttagttccagctcggcggcatgtatctcaccctctagtgagtggatgcgatttagttgagccatatcgatggccatttttactttttcctctcgattacttttatggccggaaggcggtcgtcacaggtcaggcagagcttgtgttcgtcagggcggcggtagttgattttcaccgtccagggatgggtgcagtgcttcatggcttcacctgcagcgcagtaatcagtccctgaacgtcagcttcgttctccggtttgtccttgccgataatccactgcgagaactcggtagccttttcgcccgtcagccctttagcgtggagagcggctttgagttggtccatgctggccggattgatgaggccgggcttgctgcgaacaggggctggtttgggcggcggcgtgtatgtcgctgccggagacgtagtctcggagacatgagcgggcttggcctcaccgggctttaggtttttgctctccgggttatcgatgttgctttccagctcatccttactccagaggtcgagggctacaccgaagcgcatggctgcgttgcggagagcgtcaccgacacgttccttcgggtcggggccgtcgccgtatcccagtcgcgtcactcccccaaccgttaggcgtatccagaggccgccggcctggtcgtaggctggcaggccttgctcgttcagcgctaccggctcccatgtccaggttgggtctactgtattgagccggtcagttacggctgcatgacccacgtaatccaggtgcgctgcgggtaggccgtggtacttcccgcactccgagcaagtacctttggggctgtcctttttgaagggcttgggcagtttgccaacagtaccggcggggaacggctttcgtaattcagcccatatgtcttttggttcagttgttgccattacagttcctccgccttgatacggaggttcttgcttatccgggctaggaagtcccgtgtctcatcgagcagattgccggcctcctggctggccacagcgggaagttcaagggattcaatagccagagccaatgccagcagcttttccttgtccggggctaagagtgcctttcgcgcagcttcttcgacctccgcagtttgggcagcttccgcggccgctttttcagccgcctcacgttcaactgcaaggcgcttctgtcgctcagcttcgatggcagcctcacgctctgccgcttcctctcttaacttgatgttctcctggcgaatacgttcctgctcctcggccgcggccttttcctgggcgatacgctccgcttcggccttggcctttgcggcctcctgagcttcgaacgcttccttcgaactggcgactagattctcaaaagtttcgtccgtcatgtcgtccaagctgtacagactcacgtccggcacgtatttggatagcttctcaatacgttcagcgtgtcttgccgccttgcgttcagcctgctttatttcggcgaacttctcctggttttcgagatgctcctcgactggaacgatgagggctttgatgatgttcgccataccgtcgatggcctttccctcacgcagcgactgctctttgagagttttgcgggtgctctccacttcaaccctgacggccttcagcgccaagcgcttcgtgcgggcttcatgcatcagggcggtttggtcttcttcagttacgacgatgtcggtcgcgccggccgctaggactttcgccttgccgtacgcctcaccgaagttcgacagcaggacttcgaccttggtttgttctagcccattgtctttgccgacgacggccagttcagttacttcttgattgagttgtgttggttgattcacttagttctgtggcttcacgccacctccgattactttgatgttctgagctatctctcgtcgccgccgtagtcttactaggctcaccgagctggaaggcagatgcatggtcctgatattgccgatgatctgctttacgcgctcctggccggctaaggattggggacaaccgtgtatgttcttcgacgaatcacggggctcgtagcaatacgagcaggcgacctcagatgtgttcatggcagcctccacacatcccgtctacgacgatttccccgcagcagttgctcggccgtaacagctccaggaagtcctggtactgaggctcatcagactctaggagggtgaagcggaataccgggcctttgacgtgcgtagtgcgaatccggcaactttcctggcgtagttcgtgaagccggccaccgtatcggaagcagatttcattcagttcgatattggttgcgccttgctccccacgctcttccagaaggtcgtagatgcgctctttctgcgtcttagccattgcacaccgcctggctgtaaaagacgttcaggagcgagaagtaagtatcctgcgtgatgaggccagcctcgtactgaagcttggttacccataccttgtctataagattcatcgggcacctcccgtcagggccaggcccaggaagatgaggccgaaaaagaatgcagctataaaagcggttccagagagccagccgattacttcatttcgggcagaacgccaggagggggaattggtatatcggggttgtttgttcattggttagacgccttatttatataaagattatgcgccaagcactttgggaatgcaatacacttatccacaagtatctagccaaataatcagcacccatttataatgcctatataacccccggcaaagttggtttagacgcctatctccgccgggggttagtttgtgtcttacttcgtcttctggtgccggtcgtataacctacgagcaaggtgcgctgctgggggaagctggctgggctccgtacagccccgtccagcactggaaagaagcaagcaatgtctactgaagccacgcccgaaacaaagccgccggcgaaccgcaccaagctgattctgatcgtcatcgggggtttggtcgtcgtgctcctggccatcatcgccatcgccgtttcctcccaagcgattcgagccggtgaggaagctgcggccaaagagagcgctattgcccaggagtccaagatggccgcaattgctgccgctggagagaaggccctggctgaccagcgcgctgaggacgctaaagacgcgagctacgtttgtgaacagcggctgctgaaggtacacccgacggctacggttcaggccgggaagaccaagtccacatacagggcttcagacggcagctttgacaccgttggcgcttacacggatgcccccaagggaaacaccatcccgatgcaattcaagtgctcgtccaaaaagggcagcggcacgagctggacggtgttcctgagcaatgacggacacggcgacaagattcccggaacgtgaaaaaaccccctcgctacacctctgctttagttctaaccctcatcagcgtcgttgtccttacggttgcggcaattcttgtcacccgcggccttatgcctgtgggcaccactgcacaaacgccaaacttcacagactgggtgagtgctttaggccaggcggtaggcgccctaggaaccgcgggggctttgtggctcggcgcttacacgtaccggcggcaggcgaatgaccagcgtcgagcgcaggcttctgccgtgaccctggtcatgaaagaaaaggcgggctggagtacttggaacggcttggttagaaatgacagcccattgccaatctttgatgtggcgctggtaggcgtagacgcaaacggtaatgatgtcgccaagacgaggcatgagcgaccctacctgccaggaacagtcgatcgtggagctaattcatacagtggcagtttggagaaactaagtctgaaggaagcttcacacgtttgtttcaccgatgctgcgggccacaagtggaagcgttcaggcaccggcgttctggaggaagtccgggactaccgctacctggcggacaaagacactatgggtgaatgatgaacgcctcgtagtaaatcttcgagcccgtctggctgcgattgtccggcaccacggtggtgacaatctgcacctgaacgtggcctgattcgtagctccggatgagtcggttcacctgttcacagagatacttggcggactctgcgtaaacggtcgaaagccttgcagacatcgtggactcctagctgggggtaggtagcggaaaccttacgggagcttgtttgtgccaggaaacccttgagaccccctattcaaaaaagggggcatacgttcggataggctacgctcccgtataagcgcttcgcttagggagtggtcgtaaaggctggttgtttcttctgcaaccaagggtgaattcgagcatggcacgcatggcaaaggctaaccacgttcttcatgtgatagcttccccatcggcttataggtatgacgtggtggaagcactgcccctttcccaggcatacatagcaacgtccgatggtgtgggccatcttgatcttgtcgaaccgcgcacgcatttttgctaggcgggcgggcttcatccatcccctggtcggatcattggccttttctatcaattcgaataagcgagcttctataaccgccctccgagctgcgccttgagcaaagcactgaagtaccgtgccggcgctttaccagtccgggcttgttcggctaggtcgctgaacttctgacagcccagggcatagatggccttgcagtaccaggcgcggaactccggactcgtaacgtcaccgtaggctccgagcagagcgtcgacttcatccctagtcttatgacattcacaactgcaattgtcagttgcaattgaaggttcgaagaaccttttttcaattggttgcctaccggcagtaaagggttgatagtttgcggatatcttttctagggccatagcgaatacacctccttgcatggcgcataagggcttgatgattgttctgaaccccatgcggccgctaggagtgctttgatgtattcacaggctggtagagagaggcaaggatttcccattttcgccttgcaacggcgggcgtatgtattccccgccagctttaccttggccccgctttggggcggggttgcaaactaacttccttacttttggtcgccttatctccacccgtgcccaatcgcacgatgggtgcagccacaacgacgaggatgctttttggatactctctctaccagcctgtgaatgtgcgggggcaaaagaaatgcccctctttcgaggggctagtccaacttcgtatctagcatatcaaaaacagcttagaatacaagatttcgactaaccgctctggtcagtctattgaagttggactgacttcttgtattttcgcttatgtctctgaattaagcaatagcaattatgccgacaattcttcattatgaacttatcggataatcgcgtccgacgtacctacccggatcaaacagacaagcaccagtgcctccaccgggcacggacaactcagctcctgaaacgcgatgtcggagctacaccggtcacctatatggcggccggtttttattcttctaccactaaaccctcaataatcctgtatatataaacgcaagtaacggtgtccgggtctaatccaaacgcttccgcaagttcccgtgcgtcactggtcgcccgcttcatacactccgcccaggttcgccgagactccatactgaagacgccatcgaagtcggcgtagcgctgcaactcgtggtcgtaggcttcagcctggtagcagtagctatccatgtatctatccattcaggactcttccggttctgagagacaaagcaccacgcagctgtactcctgattcaggttgaagccgtagcgggcggatacagcctcaatcgctttcttcgctgccgcctcttcatcgttgaggaagcagtacacctcgccgcgatggtagtgcttcttgtgtcccccaggcggcgtcactccgacgacgtactcaaacatgggcatctgtcgctaatccctctccacgtattccttgatggtccccatgcaagattcgatgtacaggcgctcaagccgctcccgttccttgtcttccatttccaaccagcctttctgctgcttcactgaacagcacggtgctgaacagagcctgctcccctagtttgtgaatgatgtcttccaggtacttccggcgggcttcatctggcaccagccacagcaccagcgggaacgcccgatcttcgggccaggccccggaatcaatcgcctggatatagcgccgcatcttggccgtcagctgggcttcccactccacgccggaatcctgctcaccgaagtagcaggctccgccaatttccaagtagaagtcgggcttcaataagacgtggccgacacgggtatggcaccagggctcagtcctaaaggtcatgttccgagcgcctgcttctatgaggcggacgaacgtttccgcgatgtccagggtgtgaggttcgggagtccgtgccttggtggaggcgagctggtagacgtactccgcagagccgctgtaagccccccacatccgcttcaggtaacccagttgggtaagacgcttcaggtgcctacaagagcgcacacgttggccgtcaggggtgccggagcggtagtggatacgccggagctgggaggtggtgagctgccggaattgggtgacggtttggaggacggagcgttgagtagaagatagagcagaaaaactattcatttagaaagtaccgcccgccgcgtaatcaggccgctgacctgcacaaataaggtgttcaggtgtgagcggaatcaacgccctcgtcaactgacgaatcaacagggtgttcagtctcattccgggtcctccaaccggccaatctgcggacgccgcttctgctctggtgctttgtgtctcgtgaggaggtctgcttccacttccgccaccggccggccgtacttctgcctcgaatactcgactgcttctctggctgcgccagtagccttcggaggcggtggggtcttcaacgtcaccacgggggcattaccgctgctgctcatcagcttggcggccacggtgtaccgcgggaggttcgacaggtcatcggcggtcagcgggccgaaggtctgctgcatcgacttggcgtcgtcactggcgaggcggaagacgatttgggactgggcgttcttgctcagcgtttgctggacagccttcggcagctggtcggcgtattggttggccaccatcaggcccaggccatacgagcgggcgagggcgaaggggtcggccttggtggtgttcatcatttcgcagaacatctggaactcatcgaccatcatgacgttgggctctcggtgctccggcggccggcgcagggttgcgtcccagaccaggtcgaagatgagctgtccaagggcggaggcgttggtggagcccatgtgcgcttcactgagcggcaccaggagaatcttgcgcttgcggactatctcgtcgaagtcgagcccgtccttttgagagacgatgttgcgaatcatccgggagcccaggaaagcatcgaggcggttcacggcggagtccacggtcatatcggccttgtcgtccagccagcgccattcctggatgatgtccggatgggtgttccggtttagccggcgcacctgggcgttgcgatactccttgttcaccaggagttgcttcacgtcgtagagcgtgagcttgttgagggccgcggtcatgacggcgttccggaggacgcgctggagctgtgccgaccaggtatcacccgagaggttcttgaacatgccgatgacatgcgaggtcgtgcgttccgggtcgccacctgccaaaacattcagcccgattggccggtcagtatccagcgggtcgagccagatgatgtccctaatccgatgcaggggcagggctctcaagatgtcgcgggctaaatcaccctttggttcgattagtaccaagcccatattccggtcgaccatctggatagcggcgttttgcatgagtacgctcttgccgctgccagtcccgccgaggatggaagtgtgaactgttaggccggattccggtatcgccacacgtcggttctgcatcttcggcgtattgctcgtgccgatgacgatgccttcgctgtcatgcaccaccgtgggggcgatgcgcttagcccgcttggagccggaaccgttcaagggccagcccatgagggcggagaactctttggcgttgatgaggatggggaagccggcagtactggcccgcagattgatacgctcccccacgttcggcatgaggcggcgctggaatcgggcttgcggagcctccacggacttgaagacggacgacaggtctttcaccatgccctgggcgtattctccggtcgctccaagcctcgcaatggctgaaaaggtatggtcggccactttgtccttgtcggcgctctcagaggctctaggacgctgaggaaacagacaccactgtaggacggtagcttcgccggtattcaggcttttgaattgggcgttcatgctatgcgaggttccctgcacgtcgaggatgcggagcgacttgaacaggctcgtagtaggcatggccaactccgtagctgcttgccacttcgttgtgacgatcgggtcgtcccctagttcgattttttccatggagccgtcgatgtgctcgtagaacaactcatctaagcgggcagcgatgcggcctggcgtatgtaggaaaaagcgctcccccttttcgtcggcgtagcgctcgaagctcacggcgtaaatgggctgcatgaacttcggcttgggaaggcccgacagggaacggataaaggccatcacttgctcgtggcccatcgtggacgggaagaaaatctcgtaagtgcggcgctggcggtcagccagctgctgtgcggcgctcatgattaaaaagacacctccgacaagaccgaatcctaagactgcaaattcgctaaaggtaataacggtgagggtgaaagcggattgtaattgctgctccataaatgcatgatgcgctcatgcttgcagaatttcgatagcggcgcataataggaaaagcagcctagtcgttgcctttagagagccgttcccgcggcctctattcattttgattggctgataaggggcggaaggcgcagcgaagaagagtagcgaccctcgaccgtgtttgggaagtgaagcgtggctgtagtacggagtgatgccacatgatgcccaggccccttaccagctcatcaatcacaacctggtggcccgtccatacagcaccatccccaccaccgtcagcacgagcccgatgaggatatagatgagatacggctgaaggaccgccagcaggatttgcatggccaggaagacggccaacgctatgaaaagggctgaccgcacctcccgcatgtacttcatcgaaaccagtcccgctcgctgtcctggaagagcagccagcgcagctcgaactcggtgtcagacttggcctttcgtagttcccgcttggcctggcgatacctcgccggctcgctctggggttgcgggttgtccggcgggtccattaaccgagcggcgaagattacggctcctacgatcagggcgaccactacagctgcaccagggttttgctctgccccctcagccagcttgatgaggacaacaatcacaatcagcggtatggcccacatcagcgatagcccttcatgtatcgatcctgaatttgagccatgttcatcattagcgtggactcaaagaggagagccgcttgctcgatgcggggacgggccatcactgcctcatccaccttgcggtcaacctcggccatgatttcaatggcctccgtgacgagtacacccccttgacgctgccggtagcgggccgtccaagccaggttcatctcgtaggtggccgccgtggtggtggggatgatatcggccgggtaactgcgctgctgggccagtccgttgctctgccgctgttggaggttgtattcgttgctcattgctctctcctttggtgttcaccgggggtatttccgccggtgtttacacctctaattctccgagccgggagagagcatggctattcaaataaagtcggtgttctggtctgaatctgtttgaagttagattaacaatgccgtttaaagtaataagcccgccacccctcttggggtaacgggcgatgaaggaaagctaactaaactgcttcctcgtcgtcgcacaggtcaagctctgccaattcaaaattgaactccgcctcagcgggttcatcgtctccaccactcatcagttcggcggccaatgcctgggctagcggccacagcaactgttcctctttcgtggtgcggtatgttccgaggccccaaccgcgacggtagtttgacgctttctttttctcagtctcaatattcaagattaccgagatgatgtggttgcgccgatcgtcgagagagccaccgccaaagaagtggtgctgtcgtgcttcacagctttgcacctccggcacgatgaggccgtcgatgaacttcactgggccgatagggtaagtaacccactcccggagagcgtcttcggcgtggggcttcgggcatctgcaatcgccgtgtccgagcgccttgaccaggagctggcaggtgccgggtttgatgactccccggttggcagcgaccgtgttgagctggtcaaggataatgcgcgcgttgcagtggaactgcgacaggtgttgctggtaacttctcattggttttgtccttacttgagtgggttgggctcaggttgggggcttgaggatgcgggtcaccggatggcacctcctttcaactggactagttacaaccgccaacccgtgcggataattctgggatactcctgctttgcagtgtgatcttagtcacatacagccgtaccgcgccgccaactagctcatggcggtgctgctgggaataaggagcccttctgatgctgctgcgactgctgttttacgcaccttgaaagataatcgtccagtccacgatgcgttgggcaagcaccggcccgaccttcggcaaggcatccagttcctccacaccggccgtgttgaggttgattttcgctcccgcagggtccccggcgttccctgcatcggccgcacttccggtgcctagttccggacgtgcgccaccagtacctgctgccggtaactcctcgccgtcccgcgggacgtggatcttttgtccgtcctccaccacgacggccaggttcagccggttgaggtccgcgccggggattgcacctccggcagctgtgatggcctggtgcaccctgcttcccgccggcagctgcaccactccggggctggtcacggctccggcaacatggaccaccacctctgcggcgggtccagatcccgtgtcttcactctccggcgcggggtggccaccgcttccctcgttgctcgtagcggtggcctcggctgaagggtcagcggcagggctgccggggctgacgccgctgagcgggaggatctccggcccgcccgctgccgcctgccaccagaaccacgccgccgcagcgacagcaaggatgccgagaagaaccgccaggcgggggcccaaccgccaacggagcgccggcccaaccgcagaggacgcgggatctgggttctgtccggtttcaccggtcagcaccacgcgggaagcgtccggatcggagcccccggcgcccttgtactcgaagagctgattcccgtcggtgtccagcaacaggccggacggcgcctcgccgagggctgcctgcagcctggtcctggcatggcgcgccgaatgacctgcttctccagcgtcccggcgtgacatagcttcacgctagggaccactcggcggaggcgacagggcaaatgcttgttatgtggaaaggcccgcgccgagacgcacgggcctatcggctgcgcggctcccatcaagacgagctgttgatcgctagactcgggcccagcagtcatcgcgtgggggccgatctgtcctgacgctacgggcaccaccggatccgaaggaccccatgagtaagccaggcccagcagttgaggcgctaccgccggttattgtctacgcagcgctgaacccggaaatcccgctgaaggaaacagcagtggtaccgatgttgaacgccgggttgtccgccgcagaggcggccggagtcacagaacctgtgcccgacgagaacggctggaactggggaaccctgactgccgcagcgctgggactcatgctggtagcggccaatatcctctccgggatgttctccccgggatggctcaacacgctcccgccatggctcttcttcgggtacatgtttgggcttttgcccgctgtcgcgttggccgggatgattacagccaggatcagaggcacccgccatcaacgctggcttgtatgggcccagcaagtagcgttggtgaacggggacaagctcgtctacatgggtgaagcggacggcgacgaccttgtttacacttcccatttgatcgaacgaattcagcgggccagggctgcactgctccctcgggctgacgccgcggcggcgtcggcagtcatgacagcgctgaactcgctggccggtttcattacccatccggcgcccgaaccgcttccgcctactgccgggatgctcgacagcacagtgaaggaactacgcgaacatcaggcggccacagccgcttccgcgaaggctgcccatgagcggatgggaacgtccctgaaggcgctggagaccctggctggcatcaagtacggcggtagtcgcgatgagaatgtcctgctctaacgaacgtttccgcttggcgtagatctgatataccgagcctcttcgacgctccccctgttctgcggtggagccagatgctctgtctgaagaattagccagtcagcctatctccaacatctcgcccggttccgggacagccggccagaactgctcagccctcacattcgacgcagtaggcatggccgtccttctcgcgcgccttctgcgaacggtgtcggaccaggaagcaggagtaacaggtgaactcatcgtcagcctggggaatgacctgtacaacgagctcttcggcaatgaactcgccaccaggcgtcaggccgtcaagggtgtcaacttcgtcgagctcctggaccaccgacttcgcatcgggtgctttagtagtcttcagggcctccagcgagctttcctgggactccttgacgtcggtgcgcagttcgtcgtaatcggttgccacggaagtgcatctccttactcttttgatctggtgttaccggtcctgcaacgtataggacgcagcaagaattccccaaagatgccggcacatcacagggcctttcagaacacctgcgactccaggaagccgtaaacgaaccagatcaggacaccggaggtgatagtaagggcgctggtgcccggaatgcggccccggcgacggacgagactgacaacgccgagggcgatagtggcaagggctgcggggaaagtgacgctgaagaggaagtagaccaggccaatcccggagtcgacaccatcccccgcggcccacacagcccaaaagactcctgcggtattgagcaccaggtcagcaaggcaagatgacctgcattcgcctttcgaccattgattcggcctcgcgttggttatagcccgtttttgtcgtccccacctccgtgacgttacctccagctagggaatatagggctcaagacgcttgagggggagacttaaagccccacaatggtgtagcggcgttcgatcccagccgtggcccgcccccagatgctgcccgccacccggtcctggtgaagcctgaaagcatcggggttgctgaaatgttcgtcgacctgccacaccagggggtctccagtaggcgtcacgctgaaggagacacagccgggttcagcccgagttagcgtgacgtgccggtcgagatgctgaacgacgatggcaacctcgtcgttgttacggcacacgagctgtccgctcaaatagacatcagtcactggccaatactctcgtagttctcgggcagcccgatccagccttccggtgttcagtttctccctcagcttccctgccggatcggtgggtgagcaccgggccatcccggtcttgcgcaggcggttcttgggtcagaactgccgcttggggccgcagagccaaagcactacgcttactgctgctcagccccggtcaacttcccggatttgcgagtgaccggcggatacccacgatcctgacgaccacccccgtcaggaccaagccgattcccagcgccatcaaaatccacaccggcacccaagcggcatcgatgttccggtagcactccgccgccagcccggtagtccgcatctggatgtcggcctcttcagcagcactgctttgcggaagcagcgggctgccgcacagcggccccactgtcttcatcccaataacaaaactcagtatgtgcagggcgaacccgacggcgattgtcagaatccagccccgccgctgactaagctcctggttgatgtccacggtcgaatttcccagcgagtcccgaacctccatgttcagagcctaatggaagttccccacggggtgtttccacaagtcatttcggggggggcggttaccttggacgagttggtgttcgttgactatatggccgatcacctggctgctattcccggagttcttgcggtaactctcggaggttcccgggcgaccggcaccacggccgctccagcgactgggatttcgccgtgtactacgggaagcatttcaaccgagaagcggctcctggagcgtgccgcttgcgcgacatggaccggctcatcacggggctgcaaagcgagccaaccgcgctggaggaaacgatcgatcaggcaatccagagcttcaacaaggctcttgccgaagcaaggccctagtccggcacggccgccgtggccagccgcaggaccggtacccgttatgtggccgatcggctgtccgccggctcctcccccacaatgacagccaggacgcccagccctgcgtgggcagccagtaccgccgggagggagctggcctgggccggggggcactgcggcaatgcgcgcgccaaccgttcagccaggctttgagcctcttcagggttgccgaagtggtggacggcaaggcggacggcacgggcgggacgggctccggcgtcggtggcaacaatctcttccaggcgggcgacagcctttgctgccgaccgcaccttttccagcggtacgatcttcccgccgtccaccgccaggatgggcttgatggccagcatggtgcccagtagggacgccgcgggaccgatgcggcccccgcggcggagctgctccaggctgggaacgtagaaatacactttggtctgcgctgcctgttccgccgcggcagcggcaacagtggctgcgtccccgccctcggccgcggcccggacgcctgcctggaccgccatgccctgtgccatcccgacggtgcgggaatcgaccacctccaccgggatgccgacacgggccgctgccagcctggccgcatccgccgtccccgacaattcaccggagatgtggacagacaccaccgcctcgaaaccccgttgctgggccgagcggtaggcctgctcgaactggccgggtgacggccgcgaggtcttcacggacgttccgctcgccagcgccagggcaatggtctcggagatgtcgtcttcgccttcaccgtagatctcctcccccaccattacgggcatgggtatcacggtcagccgtccgtcaccgctgagtccggcggtccagtcggccggcagcgccgccgcggagtcggtcaccacggcggtacgtacgacggcggcagcctgggttgcagggggttcctgcacgcggcggcgtgccagcaggcgtgcacggacccggggccaggcggcgtcacggtcgggcaagggggcctcctggggtcacagcaggccgccggaggataccggcggcctggcccggcctaggccgggacgatgttgaccagtttaggggcgcggacaatgacggtgcggatgccgcggccgtcgagggcgcgctggacattctccgaggccagcgccagctcccgcagctcgttctctgtcacggaggggggaacctccagcctgtcacgcactttgccctgcacctggacgacggcggtgacggtgtcctgcacgagcaaggactcgtcgtgcgccggccagcccgcattggccaccgaggcagggtgccccagcacgttccacatgtcctcggccgtgtacggggcgaacaggctcaggatcacggcaaccgcctctgccgcctcacggaccgccgggtcagttccgcccgcccctgagtcgatggccttgcgggtggcgttgaccagctccatcagcttggccaccaccacgttgaacttgttggcgtccaggagttcggcggcatcggcaatggtccggtgcgtgacggaacgcagggcgcggtcgccggcggtgacgtcgacgcctggttcgctggccacgtcctgggcgaggcgccaggcccgggccaggaactttgcggagcccgacggcgagacgtccgcccagtcgacgtcgtcctccggcggggaggcgaagatcatggtcaggcgcacggcgtccacgccgtacttgtccagctgctcaccgaggtccacgccattgcccagcgacttgctcatcgccttgccgccgttgaggacctggccctggttgagcagtgcggtgaagggctcgttggcttcgatcaggccgaggtcgttgatgaccttggtgaagaaccgggcgtacagcaggtgcaggatggcgtgctccacgccgccgacgtactggcccaccggcatccagtcgttgatcttctgcggatcgaaggggccctcggtgtagtggggggagacaaagcggaggaagtaccaggacgagtccacgaaggtgtccatggtgtccgtgtcgcgcttggccgggccgtggcaggtggggcagtcgacgttgacccaggcctcggccgcggccaggggcgaagtgcccttcggcgagaggtcctcaccgcgcaggtcggacggcagtgttacgggcaactgctcgtccgggaccggaacctcgccgcaggacgggcagtggatgatcgggatgggagtaccccagaaacgctggcggctcagcagccagtcccgcagccggaagttcacgaacttttcgcccgtgccctgcttctccagcgtggcgatcgcggccgggatggcctcggccttgggcaggccgtcgaggtcgccggaattgatcagggtcccctcccctgccgtggcggtaccggacacggcggggtcttcctcgccggtgtccaggacggcccgcacggggagatcgaacttccgggcgaagtccaggtcgcgctggtcgtgggctggcacggccatgatggcaccggtaccgtagtcggccaggacgtagtccgctgcccacaccggcagcttctcgccgttcagggggttgacggcgtaccggccggtgaagacgcccgtcttttcgcgttcggtggactggcgttcaatctcggagagcgccttgacctgttcgcggtagtcgtccagggctgcggcgtgctcgtcggtgacgagttcgacggcgagcggcgcgtctgcggccaccacaaagaacgttgcgccgtacagggtgtccgggcgggtggtgaagactgtgacctccttggcgggcctgccgccgtcggcctcgatcacaaagttgacgtgcgcgccttcggaccgtccgatccagttcttctgcattgccagcacgcgctccggccagtgcccccgcagctgctccatgtcatcgagcaggcggtccgcgtactcggtgatcttgaagtaccactggttaagggacttcttggtgacggtggtgccacagcgctcgcaggccccgttgacaacctgttcgttggccaggacggtctggtccttggggcaccagttgaccggggagttcttccggtaggccaggccgcgctcgtagaaccgcttgaacagccactgcgtccagcggtagtactccgggtccgaggtgtgcagccgccgggaccagtcggccgagatggcgtaccgcttgaacgacgccgcctgggtgtcgatgttggcgtaggtccactcgctggggtgggcattgcgcttgatcgcggcgttttcggcgggcaggccaaaggagtcccagccgatcgggtggaggacgtcgtagcctttctggcgcaggtagcgggccacgacgtcgcccatggcgaacgcttccgcgtggcccatgtgcaggtcaccggaagggtaggggaacatgtccagcacgtagcggcgctcgcgtgacccgtcgtcgacgggcgtgaagaccttaaggtcttcccacacctgcggccacttggcctccatcgccgcgaagctgtaggtgccctcctcgggcacgtccgctgacactgttgctgctgttccggtctctgtctccggctgaacgcccactgctgccctcttctgttctgttacggcatctgtgctgccataacggcctgatccccctgctgccaccgggaaatgctcccggacacacaaaagcccctcgccatggaggggctgccgcacgctatccgttgtttcggataccgggcggctggctaagcagaaggatcgcacgcatgcaaccactttagcgcacccatacagcaccaggtcgcaaacaagcggctgaggtggcagttaaacggaagaggggccggtgactccccgccatggtgtggtgggcaccgcgaagcgggcgggcgggagtcaccggcccctcttggggcagctctggtctacctcacgtcctcgtcgacccagtccatggacttggtgacggccttcttccacaggcgcagctggcggtcctgctccgcctggtccatctgcggctcccagcgcttgtcctcggaccagttggccgagcattcccccaggtccttccagaagccgacggccaggccggccgcgtaggccgccccgagggcggtggtctccacaacctttggccggataacaggaacgcccaggatgtccgcctggaactgcatcagcgcatcattggccaccatgccgccgtcgaccttcagctcggtgagcggaacgcccgagtccgcgttcacggcgtccagcacctcccgggtctggaaggcggtggcttccagcgcggcacgggcgatatggttcttgttcacgaaccgcgtcagcccaacgatcgcgccgcgtgcatccgaacgccagtacggtgcgaagagcccggagaaggcgggcacgatgtacacgccgccgttgtccttcacggacgcggcgagggtttccacctcgggtgcgctgctgatcattcccaggttgtcccgaagccactggatgagcgagccggtgacggcgatggagccttccagggcgtagtgcggcgcagcatcgccgagcttgtagccgacagtcgtcagcagcccgttcttggaatggacgatctcctcgccggtgttgaagatcaggaagcagcccgtgccgtacgtgttcttggcctcgccggcctcgaaggcagcctggccgaacgtggccgcctgctggtcgccgaggatgccggccacgggaacttcccgcaggagctgggaggtgtgcacggtgccgtacacctccgatgaggacttgatctccggcatcatggtccggggaacaccgaagatgccaaggatctcgtcgtcccattgcagggtttccaaatccatgaacagcgtgcgtgaggcgttggtgacgtcggtgacgtggactccaccgttgacgccgccggtcaggttccacaggacccaggagtcggtgttgccgaacaccaggtcaccggcctcggctttggccctggcaccctccacgttgtcgaggatccacttgatcttggttccggagaagtaggtggccagcggcaaacccactttttgcttgaagcggtccgccccgccgtccctggccagctcgtccacaatgtcctgggtacgggtgtcctgccagacgatggcgttgtagacggcctcacctgtggtcttgtcccacaccacggcagtttcgcgctggttggtaatgccgacggcggcaatgtcgtgccgtgtcaggttcgcctttgacagtgcggaggcaatgacctcccgggtgttgttccagatttcggcggcattgtgctccacccagccggcctgcgggaagatctgttcgtgttccatctggcccgaggacacgatgctcccgctgtggtcgaagatgattgcccgggtgctggtggttccctggtcgatggcgattacgtactggttcatgatggacgtccttgtctgtatcggtgcgttgggcagtgtttgctagtgggtcaggctgcggcggtaacgatgatgggcgcgaggttggccacgatgccggcaagggcaccgcctaccagcgggcctaacaccgggatccaggagtatccccagtcgctggagcccttgcccttgatgggcagcagggcgtgggcaatgcgcggaccgaggtcgcgggccgggttgatggcgtaaccggtggggccgccgagggacacgccgatgccgacgacgagcagtgcgacggcgagcgggcccaggcctgagggggttccgccgaaagtgaggatgacgaataccaggacgaatgtgccgatgatctcggtgaccaggttccagggggtggaccggatggcgggcccggttgagaagacgccgagtttgctggcaacctccggctccgcgtcaaagtgctgcttgtacgcgagccagcacaccaccgcgccgaggaaggcacccagcagttcgccgccgaagtacgtgagcgtcgaggcgaagtccaccggcacgcccggcgcgtattcggcttttccgttgaccagcagcccgagcgttacggccggattcaggtgggcaccggatttcgcggcaacgaagacgccggcaaagacagcgatgccccatccccatgtgaccatcaggaacccaccgctgttgccttttgtcccccgtagggcaacgttggcgacgacgccgcaacccaggagggtgagcatcgccgttccgaatacttcggaaaggaaaactattccaagagacatctttgactccttattttctgatggaggtccttcgcgggttgaaggaccgtgggccggggcgggttgccgccccggccggcagccgggtgctaggcgaccaggctgtgggtttctacacggtggaacctttgcagcacgtcctgcgcgtgcttgatttccgctgcgcggacctcggcgttccagccaaggggaaccgccagcacatctgccacttcgttcagcagttcgcccgtcaccaggcccctgaatgccagggaggtccggcggatgaggacgtccaccaggtgccccacctgctcgtgggcggccatgaactcaagttcacggacgctcagttcgcgggtggagtgcagcagcctgtcaggtccggcgtcgaggtgctccatgacggcctcggcacgggtcccgtacctggtcaggagtaccgcggtacggtcggcgtcacggccggaagccatgtgcgccttgatccacttctgcacgccgggctcatcagcgggaaagcctgcgccgccgccgatggggagctgtgcggtggagactttgcggcccattccgatctcggccagcacgtcgttggtcatgtgttcggcgagggcacggaaggtggtccatttgccgcctaccaggctcagcactacggcgccctttccgttcccgtcctgccccggttcgcggcgctcgatgcggtagtcgcgcgaaacgaagccgggctgggtggcatcgtggcgcggcagcggccgcacgccggaaaaggtgtagacgatctgttcacgcgtgacggggaggtccgggaagacgtggccgatcaggtcgaagaaatactcgatttcctcatctgtgcagacggcatcctctgccatgttcgcgtccacatcagtggtgcccaccaggacccggtcccccatgggatagatcaggacgatccgtccgtccgtgtgctcgaagaagatttcccggccgcggcaggcttccaggagcgccgggttgtccagcacgatatgggagcccttggtgccgcccataaaggtggaggcagtgcccattgcttcgttggtaaggtccacccaggcgcccgtggtgttcacaatgacgtccgcagtgaaatcgaattcctcgcccgtcagttcatcccgcagccggacagtgcttcccctgccggtgcccggattgggcttgccggtcatggactgcagtgaaacatagttgctggcgcgggccgtgaaaccctgggcgttaccttcgcccacggccgcccggccggctttctccccgtcctggaggacgtccagcgtcaagcgctccgggttgtgcacggacgcgtcaaagtaggtggcggtgtacttgacgtccgggcggagtgcgggcagttccgcgcgggcccgccggccgctgcggaactggtgccgcgggaccgtgccgccgtcgcgggagaacgaatcgtagaggctgaggccgagcttgatgaggaaggcgccgcgttccttgggcttgccctgctgcttgtgcgtcaggaagcggaggggtgcggagagcacgccggagaaggtgctgaagatgggaatggtggtctgcagcggcttcacgtagtgcggagcgatgcgcagcagccggttgcgctccacgactgattcctggaccaggcggaattcgccgttttcgaggtagcggatgccgccgtggatcatgtgggaggacgcgccgctggctccctggcagtagtcgccgcgttccacgagggcaacgtccacgccctgcagggcgaggtcacggaaagtacctacaccgttgatgccgccgcctaccaccagcacctttgcatgcgggcggcgccgcagatggtggactgaactgcgctcagctcccggcttctctgcaggtgttgcagaaggtcggccggttaaatccttgggtcccaaaacgactcccttgggctttgtgtggcgcgggcaccccagtgggcgggcccgccgttctccactattctttggactaatggaaaatggagtcaagcactatgcacaaacgtgcacgagggagcggtaatggacccgtcaaggcactctgaagccctgcgagctgcacaaatgtattacctgcaggacctgaccatggatgcgatagcccgggagctgcggacctccaggtccaccgtttcccggctcctgtcctccgcacgcgaatccggactggtgcagatccagatccgcaaccccttggacaccggaccggagcttgaaggcaggatccggcagcgctacggcgtggatgtgcacgtggtgccggtcctggaaacactgaatgaagctgaaacgctggaccgggtggccatgcaggcagcgcgcaccatcgggcccgtggtggactccaatgcaatcatcggggtggcctggggatccaccctgagcgccgtcagccgccacctcacccgcaagatcacccacgacagcgtgatcgtgcagttgaacggcgcgggcaacatgcacaccaccggcattacgtacgccagcgacatcatgcggcggttcggaagcgcctacggggccagggtggagcagttccccgtaccggccttttttgaccatgccgccacaaaaaccgccatgtggaatgagcgcagcgttcaacggatcctggaactccaggcgaagatgagcatcgccatcttcggtgtgggttccgtggacgcggactaccccagccatgtctacgccggagggtacctggacgagaccgacctcaacatcctggccacatccgacgtagtgggtgacgttgccactgtcttcttccggggcgacggatcctccgacggaatcatcctcaacgaaaggtccacggggccggccctggcagagctgcgccaggtccgtcggaggatctgcgtggtgtccggtgtctccaagatcaaggggctccgcggcgccctggccgccggcctggccaccgacctgatcctggatgaggccaccgcgcggcgcctggtggattacgagggcctcccggcagccaatgggtagagtcgtggctatgagaacctcaccgcggctcagcctgaacaacggcgtgctgatccaccaactcggctttggactgtacaaggtcccggccgcggacgcggaagggctcgttgccaccgcgctcgccgccggctaccgccacttcgacaccgccgccatgtacggcaacgaaaccggcgtggcccgcgggctcagttcccagctgggcggggatgccggcagcggcggatcgggtgaacttttcccctccctgtccagggaagacgtgttcatcaccaccaaagtatggaacgaccatcacggctacgacgccacgctgcgggccttcgacgactccatggtcaacctcggcctcgattacgtggacatgtacctcatccactggccctgcgccaggcgcgggctttttcccgatacataccgggccctggagaccctgtaccgggaagggaaggtccgggccatcggcgtcagcaacttccagccgtcccatcttgaccggctgctccaaaccgcagaggtggttcccgccgtcaaccagatcgagctgcacccgtggctgcagcaggcggaactgcgcacgctgcatggcgggctgggcatcaggacggaggcatggagcccgctgggccgcggccaggtcctcgcagatcccgtggtccacgcctgcgcctctgagcacggcaagacccctgcccaggtgatcctgcgctggcacatgcaactgggcaacatcgccatccccaaagccagcacagaggcccgcatccgggaaaacctcaacatcttcgacttcgagctctcggaccgggacatgactgcgatcgcagggctcgaccgggggcaccgcaccggctcgcaccccgaccacgtcaactaaggccgcacagatgaccacagcacaccccgggcccgcctcgcccgcctacttcagccacggacttgcggcccgcacgtcgtcctcatcggtggagatcgacggcggcaaggttgccttctggacctacgaaccgctgcatgccggcccggaaacgcggaccatcctggtgatccatggcttccgcggagaccatcacggactcctgcgcgtggcagaccagcttcccgaaatgcgcatcatcatgccggacctgcccggattcggcgactcggaagcgttcacgtccggcccgcattcggtggagcggtacggctcgttcatcacaggattcatggcagccctcggcctgggcccggagacggtcctgctgggccactccttcgggtccatcattgccgcgcacttcgtcgccgaccacccgggaaccgtcaacccgctgatcctcatcaacccgatcgcggcacccgccctcgaggggacgaagggtgtgatgacccggctcgcggtcctctactaccggcttgccgcgcgccttccccggcagctgggactggctttgctgcggagcccgctgattgtccgggtcatgagtgaaaccatggccaagacagccgacagggacctgcgccgtttcatccacgatcagcacaacgcctacttcagcgctttcgccagccgtgacagcctccttgagtcctttaccgcgtcggtcagcagccacgtggccgaggtggccggccggctcacccttccggtgctgctgatcgccggcgaaaaggatgagatcgcactcctccccgaccagcgccgcctggctgcgctgctgccggacggcgaactcaaggtgattcccggcgtcggacacctcatccattacgaaacccccgaaccggcagcctcgttcatccgcagcttccttaaggaccaccccgcgtgaagattgtcatcgacgcacgttttacccggaccgaccaccacgacggcatcagccgctacggggcaagcctgatcgcagccaccgcgaaaatcgcggacgtttcgatgctggtctcggacgtacggcagctccccctgctcccggatgttccctacacgctgatcagcagcccgttgtcgccgagggaactgttcgtggcgcgcaccattaacaggctgggcgctgacgtggtggtgtgccccatgcagacgatgggcacctggggccgcaagtacggcctggtcctgacgctccacgacctcatctattacgagcacccggccccgccgggattcctgccggcaccggtacggctcctgtggcggctctaccacaaggctttttggccccagcgcctgctcctgaaccgggccgacaccgtggccaccatcagccgcaccaccgaagcgctgattgcgaagtaccgtctgacccgccgtcccgtgcggatcatcagcaatgccccccaaccggagcaggagcacggaccccggcccgctggcgccggtgcggaccgcgcgctcgtctacatgggctctttcatgccgtacaagaacgtggaaaccatggtggcggggatggcgggcctgcccggctacaccctccacctgctcagccgcatcacgccccaacgccgcgcggaactggaacgcctggttcctccaggggcgcacgtggtgttccacaacggtgtcacggacgaggaatatcacgcgttcctgcgctcggctgcggcgctggtcagcctgtcccgggctgaaggctatgggcttcccctggtggaggccatggcgctcggcacccctgttattgccagcgacatccccatcttccgggaagtaggcggcgacgccgccctctacgttgacccggagtcccccgagcagtttgccgatgccgtgcacacgctccaggacaacgggcactgggaggagttgtcgcggcgctgcgttgcgcgtgcccgggagttcagctgggacgagtccgcccgccagctggttgatgtggcacacgaaatcgtggtccggcgccggcgctaacggaccaccgctagagcacgtcgatgccgtccagccggagctggaagggttcgctggagcgttttgcagcaacagcagccctggtgacccgcaggactcgggtgacagcggcagcctgtccataggggaagaagaacagggtgcgcacgtcctccgccgaccggcggggcgacggcggaccgctgagcaccacgggtgcgggaccggcggtccgcaaggtgatccccccggaggcaagttcagctgccacggcagcggtgtaatgttcgacggcggcgcgcggcccggtaacggaggcgatgcggaccgcggggggaagctgcagttccatccgcagggagagttcccgctccgcataaccggcagggtcccagcggagcagggcacccacggcagctgtgtccgcggcggtgaccaccaccagcccgccgtctgctgccggacgcaccagcgcggcggcattgaaccaccgccgcacagtatcctcgccggcgcgcagtgtctcccggcgcaggagggaatcaccgtccaggagcagtgctgccgcgtatcccccgtccgccacgggttcggcacccaccgtggccaccaccagcgccttgcccggacccaccgcagcctttacctggtctcccgaggaagtaatgacggtctttcccggaaaggcgcggccgagttcctcagctgtcctgatgactccggtggcacccttgcgcaggcgcttgccgccgcagtgcacgcagtgccagtccggcgccggggtggagcaccagcggcattggggcatggcggacgtgccgctggctcctgccacggccagtggtccttggcagctgccgcagcgcgccggctcgcggcacatctcacaggccagcgacggcgcataaccggcccgggccacctggaccaggaccggtccgcgctccagcccctccttggcggcccgccacgcggcgccgggcaggcgggcaatcctggccagcggatcccgctcctgttcaaagctgtcagcagtattgacgatgcgcggcaccgtcctccgaacgtcagggcgcccggcttcgacagcacgtgcccaacccgcccctaccagccgctgggcttcagtgcttcgggagtggcctgcaaggaggcaggcggcatcttcctgttcggcccgcaggagcagcacctcgcgtgcatgcgcatagggggcgcgttgctcgatgtggaggtcgtcgccgtcgtcccagcaggccaccaggcccaggtcccggacaggggcaaaggctgcggacctggtaccgatggcaacccgggcagtccccgccaggagccgaaggaaattccggtagcgcggggtgggaccgtcgtcggccgtcagccgggcaactgcgtcttcgggcaccaggccgcggagcgcttcttcaaggcggtcaaggtcgcggtaatcgggcactaccaccaccgcgccgcgccctgcggcgtacgctgcggctacggcttccgccagcagctggggccatcctcctggaccaaaaccctgcagcgggttcagcacggccctgggcgaaccgccaccggcaaggtggtgcaggaaggcctgtccgctatggtaggccgcccaggcacccggcagggcgtcctgcgcgggacccgcctgcagggatgtggccccgcctggttctgcctggttcggaacttcctgtgcctccggctccaccgccaactccttttccagcctggccaccctgggcgggacggcgacccggaggacgtcgctgagggtaccggcgtagcgtgcggcgacggaggaaaccagctcccggacggcgggcgtcagcacggacaccggggacacaaccttcgccaacggaaccagtgtgtgtccggcgtcggattccgccacgcgttccatcaggaacccgttgagatcctggccgttgaacttgaccttgaccctgacgcccggcctggcggcatggtcgagggtgtccggaaccccgtaatcgaagagccggtccaggtgtggcaaggaggattccaccaggaccttggccacgggcagatgcctggccagctgcggcccggcgggccgtgcggtggacggaaagccctgcagcagtgacggctgcacggcgccggggaggtccagggacgcctggacagggctgtcagcagcgatggcagtaacctcccttcggctcccggatggacaagcccagccaagcacggggcactgacatgttgccggaggcaaataaagccaaaaatacaggcaaagatggcaggcaaagactaaaggccgggagcaggcctgcacccaggggcctaagcgttgaagaatgccttcaggtcatccacgcggtccagccgctcccaggtgaagtccggctcgtcgcggccgaagtggccgtgggcggcggtcttggcgtagatgggccgtttcaggtccagtgcgtcgatgatggcgcggggacgaaggtcgaaaatctccgcgatggcggcgctgatgcgggccgggtccaccgtttccgtgccgaacgtttccacgtaggtgcccacgggacgggcctggccgatggcgtaggcaatctggatttctgcacgcttggccagccccgcggcaaccacgttcttggcaacccagcgcattgcgtacgcggcagagcggtcaaccttggaggggtccttgcccgagaaggcaccgccgccgtgccgggccatgccgccgtaggtgtcaacgataatcttgcgcccggtcaggccggcatcaccaacggggccgccgatcacgaactcgccggcagggttcaggatgttgcggacgcgggagaggtcgaggttggcccctgccagcaccggcttgatgaccacggaggcgaggtccgcgcggagctggtccaggcttgcgccttcggcgtgctggctgctgatgaccacggtttccacggagaccgggacgtccttgtcgtagccgaccgtcacctgggtcttgccgtccgggcgaaggtaggccagctcgcccgatttgcggacttcggtgagccgctcggacagccggtgcgcaagccagatgggcagcggcatgtaggaaggcgtttcgtcgctggcgtagccgaacatcaggccctggtcgccggcgccctggaggtcgtagtcgtcctcctgccgtccttcgcgggcttccagcgagttgaacacgccgccggcaatgtcgttggactgctggccgatggacacggacactccacagcgggcgccgtcgaaaccgttggccgaggaatcgtagccgatgcccaggatggtttcgcgaacaatctgcgggatctccacgtaggcatcagtggtgacctcgcctgcaacgtggaccaggcctgtggtggccatggtttccaccgctacccgcgattccgggtccgcagccagcagcgcgtccaggatggcgtcactgatctggtcgcagatcttgtccggatggccctcggtaaccgactcggaagtgaagagccggagcgcgttgggcgtggccccggacgtgtggggaaggtgcagcggtaaagtcactcaactaccttactggttggaatacggacacccgccaggagacctcgggagatgtctccgtgctaagcaaacgtggcctgaaacactcaggcgcggggcgaaacggagttcagttcatcggagatccggctgatgatggctgccgaaacttccgtcttggttccggacgcctcctgtggttcggagcccgagcgggccaggatgacaacggaattggtgtcctgcccgaagaccttgtccgttcccacgtggttgaccaccaggaggtcgcagcccttgcgctgcagcttcgcccgggcatgcgccaggacatcaccgtcgccgtctccggtctcagccgcaaaaccgacaatcagctgctgccgcccgcgcggggcggcactgttccggagttccacaagttcgtgcaggatgtccgggttgcggaccagcgtgatgacgggatcgtcccggtcgtcgcgcttcttgatcttggtgtcggagacggccgcggggcggaagtcggccaccgccgcggacatgatgacgacgtcggagtcagctgccgccgcaagggcggcttcccgcagctgcagggccgtctccaggggcaccacctcgacgccggccggcgggggaacgtccatgtgggctgccagcaagcggacggttgcgccggcgttgcgggctgcgacggcgagggcgactccctgcttcccggaggacctgttgccaaggaagcgcaccggatccaggggttcgcgggttccgccggcgctgatggtgacggtgcgtccggccagcggcagctggaaatcggactgcccctgcaccagggccatggcggcatcaaaaatggcttccggttcggggagcctgcccggcccggaatcggcgcccgtaagcctgccgctggcgggttccaggacggccgcaccgcggctgcgcaacgtttcgacgttggcccgggttgccgcgtgctgccacatctcagtgtgcatggcgggagcgaacaggacagggccgcgggccatcagcagggtgttggtcagcaggtccccggcctgtccggtggctgccttggccaggaggtcagcggtggccggggcgatgacaatcaggtcagcctcatggcccagacggacgtggttgacctggtggacgtcgtcgaagacgctgttgctgaccgggtttccggacagcgcctcccacgtggcagtgccaacgaaccgggtggacgcctcggtggggatcaccgtgacgttgtggccggcttcagtaaaaagccggaggagcgatgccaccttgtaggcggcaatccctcccccgactccgaggactatgcgcacgtgacctccgtcaacagcaagtcagttcggcggcagttttactctgcagcttcgatcggcgtggaaaccagcttgccctcgttgatctcgcgcagggcgatggacagcgacttctcgttcagcttggtgtcaaccagcgggccgacgtattcgaaaaggccctcatgcagctgggcgtagtaagcgttgatctgacgagcacgcttggcaccgaaaatcaccaggccgtacttggaatcggctgccttgagcagcgagtcgatcggcgggttgatgatgccttcaaggttcgtggacacgaattctccaaagttctagcgggctgacggttccggcgctccatgcgggtgcggggtcagccccatgagtgaaacaagctcgtccgctgcccggcgaacgtcgtcattgatgacggtgtagtcgaactccggttcagcagcaagttccagtttagcggtttccagccgacgctgctgttcctccggggtttccgtgccgcggcccaccaggcggcggaccatttcgtcccagctgggcggagccaggaagacaaactgtgcatctggaacggcggccttcacctgccgggcaccctgaaggtcgatttccaggagcacggaccggccctcggcgatggcctggttgacggtgcttttcagggtcccgtacgtgttctgcccgtggaccacggcccattccaggagctccccgtcagctacgagctgctcgaactcttccttggacttgaagaagtagtggacgccgtcctgctcgccgggacggggcgcgcgggtggtggcggacacggacagccacacctcgggatagttgtcgcggatgtaagtggacacggtgcctttgccaacagccgtcggaccagcgaggactgtcagtccaggtttcttgctcacgtattcctttgccggggtttgggataggcgggcttccggcccgccctaactctcgtctataaaatctaccagcgcgcggcgctggtggatgcccaggccgcggaccctgcgggacgccgcgatccccagctgctgcatgatggccgcagcccgcaccttgccgatgccgggaagggcctcaaggagttcggagaccctcatgcgggccagggcatcgtcctgcagcgcggagctgatgatgtccgcggcagacctctcgccgttcttgaggctttccttggccgccgcacgggtggccctggctgctgctgccttgttcagggcctcagcccgttccgatgcggataacggccgcaggaccatggtgcacacccccggattcggtggacgggtccacgggcgaccgcccttggacctgtcctgaaactaccctttggtgctgcccgaatcaatgcatccggtgaaacggacactattcgccgcggagtccgtccagcgtccgttgcgccgcgtcccgcaggccgcgctgctccggcccggcggacaggatgtccctgctcgaggtgccgaggacctgcgggtaggcggcgccgaaagtggcgcggaggccggcaggcgtggccccctgcgctccaaggcccggagccaggagcggtccgcgcacggcggccaggtcaaggtccagttcggacagggccgaccccacggttgcacccaccaccaggcccacggagccgaggggcccctggtagcggcggttttccgccgcggccgactgcgtgatcctgcgggccacggagtccgctcccccgacgtgctggacggaggcgccctctgggttggacgtgagcgcaaggacgaaaacgccgcggccggtctcggccgccaggtccagcgcggggcgcagcgactcgaagccaaggtaagggctaagcgtcaccgagtccgccgcgaggggggaatcgtccccgagccaggcgtcggcgtaggccgccatggtggagccgatgtcaccgcgcttggcatcggcgatggtgagtacgttctcatcgcgggcttcggcaagaagctcctcaaggacagccattccggcggagccatggcgttcgtacagcgccacctggggcttgatggcggcagcgagcgaacccacggcctccagaactgtcagcgagaagcgcctcagcccgccggcgtcgtcgtcaagcccccaccccttcaacaaggcagggtgtgggtcgatacccacgcacagggggccgcgggcggccatggcggcacccagccgggagccgaaagactcccggccgggtgcgtcagcggacggcactgcctgctcaggcacgctgcagtgccgccttctgggacgctgctttttgagactctgccaaggatgcggcgtgctcctgcaggctggtgacggaccattcgtaggtccgcatcgcctcgatggcctgcacggcggcgttgaactccgccaccgtggtgatgcagggaatgccgatggaggtggccgctgcgcgcagttcgtagccgtcgctgcgggcctccccgccggacggggtgttgaagaccatgtcgatctcgccggcgatgacgaggtctgcgatggtgccttcgccctcggcgctgctgccctctgccaccttgcggacaggggtggcctggatgccgttgcggcgcaggacgtccgcggtgccaccggtggatacgatttcgaagcccaggtcggagagccgcttcacgcccatgatcacggagcgcttgtcgcggttggccacggagacaaagatcttgccctcggtgggcagcgcgttgttcgcggctgcctggctcttggcgaatgcggtgtcgaagtgcttgtcgatgcccatgacctcgccggtggagcgcatttccgggccgagcagtgagtcaaccaccttgccctccagggtgcggaagcggctgaacggcaggactgcctccttgacggacaccggggcatccagcggaagcgtggacccgtcgcccacctcgggcagcatcttgtaggcgctgcggagctgtccgatggtcacgccggtgccgatcagggcagccgctttggccatctgcacaccggtcgccttggagacgaacggcacggtgcgggacgcgcgcgggtttgcctccagcacgtacaggacgtcggaggccagggcgaactggatgttgatgagcccgcggacgcccacgccctcggcgatggcgcgcgtcgccgtccgaacccgctccagcacgttggtgcccagggtgatgggcggcaggacgcacgcggagtcgccggagtggatgccggcttcctcgatgtgttccatgatgccgcccaggtacatgtcggtgccgtcgaagagggcgtcgacgtcgatttcgacggcgtcctccaggaagcggtcgatcagcaccgggtggtccggggtgatttccgtggcgttggcgatgtagcgggacaggttgggctcgtcatagacgatctccatgccgcggccgcccagcacgtaggacgggcggaccaggaccgggtagccgatttcgtcggcgatcttcttggcatcctcgaaggacacggcggtgccgttcttcggggagatcaggcccgccttgtccaggacgcgggagaacatgccgcggtgctcggcgaggtcgatggcctccggggacgttccgaggatgggaacaccggcatctgccagctgctgggccagcttaaggggggtctggccgccgagctggacgaacacgcccatcacgccgccggtgcgttcctccgcggcgatgacctccaacacgtcctccagcgtcagcggctcgaagtacaagcgggtggagatgtcgtagtcggtggagacggtctccgggttgcagttgaccatcacggtctcgtagccggccttgcgcagtgccatggaggcgtggacgcaggagtagtcgaactcgatgccctggccgatccggttggggccggagccgaggatcaggatggacggcttggagtgcagcgcaacctcgtcctcctcgtcgtacgccgagtagtggtacggcgtgtaggcggcgaattccgctgcgcaggtgtccacggtcttgtagaccgggcggatgcccaatgcctggcggacgccgcggaccacggcctcggagttgtgcgtcagggcaccgatctgctcatcggagaagccgtggcgcttggcgcgcttcagcatgtcagccgtcagcgcaccggcctggcggatttcgcgggagatctcgttgagcagctggagctggtccaggaaccaggggtcgatcttggtggcctcgaagaggtcctccacgctggcgcccccgaggagggcgcgctgcacctggtgcaggcgttccgtcgtcgggcgctttgccttttcgatgagctccggcacttcccattcgggaacagagctgaagtccagctgcgagcccttctgctccaaagagcgcagggccttctgcagggcttcggtgaagttgcggcccatggccatggcctcacccaccgacttcatggtggtggtcagcgtgttgtcagcagccgggaacttctcgaacgcgaaccgcggcaccttgaccacaacatagtccaaggtgggttcgaaggacgccggggtcttctgggtgatgtcgttggggatctcgtccagcgtgtagcccagggagagcttcgtggcgatcttggcgatggcaaacccggtggccttggaagccagcgccgaggagcgggagacgcgggggttcatttcgatgaccaccacgcggccggtggcggggtcgatggcgaactggatgttgcagccgccggtgtccacgcccacttcacggatgacggcgatggagatgtcgcgcagccgctggtattcgcggtccgtcagggtgagggcgggcgccacggtgatggagtcgccggtgtggacgcctacgggatcgaagttctcgatggagcagaccaccacgacgttgtcgttcttgtcccgcatcatctcgagctcgtattccttccagccgaggatgctctcttcgagcagcacctcgctggtggggctgtactgcaggccctggcccacgatgcggcggagatcgtcctcgttgtaggcgaggccggagcccaggccgcccatggtaaaggagggccggaccaccatggggtagctgaggtcttcggcggctttcagggcctcgtccatggtgtggatgatgtggctgcgggcggactcggcgccgcagcgttccaccacgcccttgaacttttcgcggtcctcaccgagttcaatggcggcgatgttggcgccgatgagttccacgttgtacttctcgagcacaccgttcttgtccagggcgatggcggtgttcagcgcggtctgtccgcccagggtgggcaggacggcgtccgggcgttccttggcgatgatcttctccaccacctcgggggtgatgggttcgatgtaggtggcatcggcgaactcggggtcggtcatgatggtggccggattcgagttgaccaggatgacccgcaggccttcctccttgaggacgcgcagcgcctgggttccggagtagtcgaactcggcggcctggccgatgacgatcgggccggaaccaatgacgaggacgctcttgagatctgtacgtttcggcattacttcttgtcctcagtcttgttgtcggaatttttcggcgttgccgggcctgcgcctgtgttgtccgcctgcgcggggtgcgcggcgtccacgggctccttggacaggttcgcggtcctgccgtcccgggtgccctccatcagctcgatgaagcggtcgaacaggtaggcggcgtcgtgcgggccggccgcggcctcggggtggtactgcacggagaatgcggggatgtccaggcaggcgagcccttccacgacgtcgtcgttcaggctgacgtggctgacctccacgcggccgtaccgtgcttcgggagcctgcgtggcgccgtcgagcggtgcgtccacggcaaagccgtggttctgggaggtgatctccaccttgccggtgcggcggtccatgacgggctggttgatgccgcggtggccgtagcggagcttgtacgtgccgaagcccagtgcgcggcccaggatctggttgccgaagcagatgccgaagtagggcagcttctcgtccaggacggagcgcagcagcttgacctgggcgtctgccgtggcggggtcgccggggccgttggacataaagaagccatcggggttgacggccttcacgtcctccagggtggcggtggcgggcagcacgtggacgcggacgccgcgctcggcgaaccggacgggagtcattgccttgatgccaaggtcgatcgccgcgatggtgaagcggggctcgccctcccagccgtggtccttcggctccaccacgtaggcctcgtcaacgctgacttcctccgccagccgggagccctccatgggggcgctggccaggacggcgtcgaccagttccttgtccgtggcctgggcagcctccccggagaagatgccggcgcgcatggtcttgtgctcgcgcaggtgccgggtaattgcgcgggtgtccacgccctggattccgacgattccctgctccaccagttcctcatccagtgagcgctcggagcgccagttggagggtcggcgggcggcgtcgcggacaatgtagcccgcaacccagatgcggcgggactcggcgtcctcgcggttcacgccggtgttgccgatgtgcggcgccgtctggaccacgagctggtgtgcgtaggaggggtccgtgatggtttcctggtagccggtcataccggtggcgaagactgcttccccgagggcagttccggtggcgccgtagctgcttccccggaaaatgcggccgtcttcgagcacgagcgcagccggggcggtaactggggcgtttactgctgtgtttgttgtcactgtcttactttccactgttggcgtcagccgccggggctgaagaaatcaattcctgaagtgcttcgaagagccggtccttgtccgccgcacggcgggtgcggaagccggagtccagttcgtggctgccgtgtacccaggccaggaccaggagtccgtccttttccacgaacttacctgccatgccgctgtcctgccggacgccggtgagtgacgcggccgggatgaagagggcgggagcccccgaccggtcgaaaaggacgccgtgcggatacacctcgagggttgaggtggtcctgatgcccaggccgtgcaccgcgatccggtccagccagtcgcccgcggtggtggtggccacgtactgcccttcggcactggccagcggctcgccaggtttggcgggcaccggaggcagctggccgacgtcggactggcggcggagcctgctgcgccagccgatggcgaggaggacaaatacgacggcgatgatcgccagcatcgccagtcccggaaggattttgtccatcaggcgacgcctgcggttgagtcggcgtaggggtatggcgtgttgagttcaccgtcaaggacggtggggtgccccttgaagaacgtggccaccaccttgccgggcagctcccttcccttgaacggcgaattccggcccatggtggccatgcggaacggatcaacagtccagcgggcagccggatccaccaggatgacgttcgcgggctcccccgcctccagcggccggccctggtcagccagccgcccgatcttcgccgcagcggtggaggtgacgcgggcgaagtccgcccacgtcatgaggccggtttcgatcatggtgtgctggaccaccgagagggcggtttccagccccgtcatgcccatggccgcctgcgcccactcgcactccttgtgctcgctggggtgcggggcgtggtccgtacccacgacgtcgatggtgccatccgccagaccggcgcgcagcgcctggacgtccgcatcggtgcgcagcggcgggttgaccttgaagacggggtcgtagctgcggaccaggtcgtcggtcagcagcaggtggtgcggggtaacctccgccgtgacgttgatcccccgttccttggcccagcggatgatttccacggaaccggcggtggagacgtggcagacatgcagccgggaaccgacgtgctgcgccagcaggacgtcgcgggcaatgatgctttcctcggcaacggcgggccagccggcaaggccgagtaccgcggacacctcgccctcgttcatctgggcgccggccgtaaggcgcggctcctgcgcgtgctgggccaccacgccgtcgaacgccttgacgtactccagcgcacggcgcatcagcacgggatcgtggacgcagatgccgtcgtcggagaacatgcggacgcgtgcgcgggaatcggccatggcgcccagttcggccagctgctcgcccgccaggcccacggtgaccgcaccgaccgggcgcacgtccacccagcccgctgtccggccgagggtgtagacctgctccacaacgcccgcagtgtctgccacgggcgtgctgttggccatggcatgcacggcggtgtagccgcccagggccgccgctcgggtacccgtctccacggtttcggcgtcctcgcggccgggctcgcggaggtgcgtgtgcacgtccaccatgccgggcagggcaaccaggccggaggcgtcgatgacggtgacgtcctccgccctgtcttcggcagaaaggcccgttccggtttcggcgatgacgccgtcgcggatcagcaggtccgccggttcgccgcccaggatcgacgcgccgcggatcaggtaggttccggtattggctgccatcagttgctctccttggtggaatgggtgccggcgtacgccagggcgggggtggcggctggttcacgggtgtcccccgaaagcagcaggtacagggcggccatccgcaccgagacgccgttgcggacctgggccagcacggtggatcggggtgagtcggcggcagccgcggaaatctccaggccacggttcatggggccgggatgcatgatgatggtgtccttcatgcccagtgtgtccagggctttcaggcggttgtcatcgaacccccaccgccgggagtactcacgggtgctggggaagaaggatgcgttcatgcgctcgccctggacgcgcagcatcatgacggcgtctacgccctgctcgagcgtttcgtccatgttgtagctgattttgcagggccacttttcgacgccgatgggaagcagcgtgggcggcgccaccaaggtaacttccgctccgagggtgcggagcagccagacgttggagcgggcaaccctggagtgcaggacatcaccggcaatggccacgcgcatgcccttgaggtctgcgccttcggagccggtgccggccaggcgcgcccagtgccggcgcatcgtgaacgcatccaacagtgcctgggtggggtgttcgtgcgtgccgtcgccagcgttgatcacggcagcatcaatccagtccgtggctgcgaggcggtgcggtgcgccggaggcccagtgacggataacgacggcgtccgcccccatggcggacagcgtctgggcggtgtccttgagggactcacccttggacaccgaggagcctctggcagcgaagttgatgacatccgcactgagccgcttggcggcggcctcgaaggagatccgggtgcgggtggagtcctcgaagaagagattcaccacggtgcggccgcggagcgccgggagcttcttgacctcgcggtcgcctaccgctgccatctcctcggcggtgtccaggatgcggattgcattggccaggctgaggttttcggtggagagcaggtgcttcatgaacggccctcgataactacctcgttgaccggcgatccgccaggggcagtgtcggtttcagccagccggacccggaccttttctgccgatgatgttggcaggttcttgcccacgtggtcagcgcggatggggagttcgcggtggccgcggtcgatcagcacagcgagccggacaatacgcggacggccgaggtcgatgagggcgtcaagggcggcgcggatggtgcggccggagtacaggacgtcgtcaatgaggacaaccaccttgttgtcgatgcccgtccggggcagcttggtggggtacggcggccttgtcccctggtgggagaggtcatcgcggaacattgtgacatccagctggccaacgatggcggcggcatcaacagtgctgtccgcggcggcaattttttcggctaggcgcaatgccagcgggtaaccgcggcgcgggatgcccagcaggacgaggtcctgggatcccttgttggcttcaaggatctcatgggcgatacgagtgagggcccggtcaatgtccgcctggctgaggacaaccctggctggaaccggtgcgctggtgacagaagtcaacgctcgtctcccctttccccgcctcacaggacggaattaaaaaaggattatgtgcgtttcaaaattaccacacgggtttccgggagcccgtgccgggaggacgcggtactgatcacactgcagcggccaggcgccgctgtccttggaggcgcagcggcccgcacctaggctgtcgttatgccgacgaatccgcgacaccctgcctccgggccacccgacgatcaccggctgcggggaactgcgccgctcccaggggaagccaaccccagctggatgggacacgtggagccggggaactaccgcccggcgccgggacacgttggcaggccagtggacacggtagtgccgccgcaggtccagggagccgtgatgaaggccgggcgctcccgcagcggcctggtggggttgacggtcggcgggagcacccttgccttcctcagcctgttcctggtggtcccgttcctgctgtccaacaccgggccggccgggttcctggtgggattcctcgcgtccctggtgccgctctctgtggttctcctggccgtgcacatcatcgacaagtgggaacctgaaccgaagcggctcctcttcttcgcttttacttggggcgctgcggtatccattgcagtgaccctgctgatccagccgttctttgtcctggcgttccagttttcagacgaggccgaccttcaggcctacatggccacggtgcaggcgccaatcgtggaggagttcgcaaagtccctggggctgctgatactccttctcatggcaaggaagcactttgacggtccggtggatggtgtggtttttgcgttcaccatcgctgggggtttcgcttttacggagaacattctgtacttcggccgggccgttgcggagtccgcggatcctgccagcgactttgcccaggtcttcttcctccggggcgtcatgtcgccctttgcgcacgccatcttcacaggcaccacgggcctggtgatggggttcgcggcccggcgctggcatgcgggtgcctcggtggcagccttctttgtggggctgctgccggccatgttcctgcacaatcgctggaacagcatggggcagggcttcctggcggagtacctcatggtccaggtgcccatctttttcctcgccgtaggcggcatcatcctgttgcgggtggcggaaaaacgcctgacccgacagcgcctgctggagtattcagcagctggctggttcacgccggcggaggtggagctgatggccacccttggcggccggcgcactgccctgaactgggctgggagctatggcaggaaacggcagatgaaggaattcctgaaggccgccacccggctggccaacacgcgccagcggatcctgagcggccgtgacgtgcagctgcaccaggctgaggagcggcagcagctgcagcgcatcctggccctgcgggccgccatcgcgcactgaacagaccgcagtcccaaccattcggaccttaacgggagaaggaccggcctccacatccgtggcggccggtccttctggtgttgccgtgtgttgctgatactcaggcgagcagcgacggcttcagctgctgcaggcggcccagcaggccgttgatgaactgcggtgattcgtcagtggacagggtcttcgccagcgctacagcttcgctgaccgcgacgccgtccgggacgtcgtcgttgtacagcagctcccacgtgccgatgcgcaggatgatgcggtccacggagggcatccgctccaggctccagccctgggagtacgtctccaggaactcgtcgatggctgcctggtgggagacaacgccctccacgatttcgatggtgtagggattaaccacctggtcagtcttttcgcgccgcgagcggatcacgtcaaaagccgaaaccgagcgctgctcggcttcgaagagaacatccagtgccctgttacgggctttaccgcgggcactcactactcggtgaccctgcccaggtagctgccatcgcgggtgtccaccttgaccttggtgttgttctcgatgaacagcgggacctggatctcgtagcccgtctccagggttgcgggcttggtgccggcggaggagcggtcgccctgcaggcccggctcggtgtaggtgatttcgaggacaacgctcgggggcagttcgatgtacagcggattgccctcgtggatggcgatgttcaccatctggttctcgagcatgaagttggtggcgtcgcccacggtggcgccggagaccgtgatctggtcgtagtcggaggtgtccatgaacacgaagtccgcaccgtcctggtacaggtactggtagtcgcggcggtccacggtggcggtctcgatcttgagcccggcgttgaacgtcttgtccacaaccttgccggacatcacgttgcgcatcttggtgcggacgaacgcaccgcccttgccaggcttgacgtgctggaattcgatgatgttccagagctggccctcaagcttgaggaccgttccgttcttgatgtcgttagtggttgccactgtttcctctggtttctctgtctggtcgcgtggtcagacggtgtatgccgggcagacaggccaaacggactgccagcgcgtgtttgtcaaaaatcgggtggttaaaaattcaagaactattctaccggtaaattccgggcatctttcggccccgccctccagccggactgcaggcagcgtcagcaggcgagctccagcacgtcccgcgcacgctgcagcgccactgtggacgagtagatctgggcagcatctgcggactgggccacccgaaggtccagtgcccgcgcaaaggattcaaccgctgcggacatctgcccggcactgtattgggtcttgcccaggaactgccacacgagggcctcccgcggcgttccctgcacctcggcaaggagctggcggaacagttcgacggcccggtccaggcggttggagacgcggaggacttcagcctcgaaagtacgcagacggaaggattccggatccttgaaacgggcttcggcaagcagctcagcggcctcggacgcatgtccttccaccaggagcacgaagatgtggtcagcgggatccgtagatactgccagcgcctcgcggcaggcgtcctggttcacgatttccggcagcagcgactcagggttgatccggatccccgggaaacccgcatccggccagtctgctgttccgctcatgtcgccctgcatcaggaggcaatttcctggtaggccgcgaataacagcgaggtgtccgggacatcgaggatccccggcttggccacgccgtccaggacgacgaaccgcagcaggtctccgcgcgacttcttgtcccggcgcatcccgtccagcagcccctgccagcggtcccgccgatacgtgaccggaagccccaggctctcgaggatgctccggtgcctgtcggcgtcggcatcgctcaggcgccccacactgcgggcaagttcggcggcgaacatcatgcccaccgagacggccgcaccgtggcgccaggaataccgctcaaccagttcgatggcgtggcccaaggtgtgcccgtagttcaggacttcccgcagccctgattcctttaggtcctcggagaccactttggctttgacggcgatggcacgttcgatcagttcccggaggacgtcggactggggatccgccaccgccgtcgggtccttttccacgaggtcgaggatggcgggatcagcgatgaaaccgcacttgatgacttccgccatgccggagatcatttcgttccgcggcagcgtttccagggtgtccaagtcggccagtaccgcggccggagggtggaaggcgcccacgaggttcttgccctcggcggtgttgattccggtcttcccgcccacggacgcgtccaccatgccgagcaggctggtgggcatgtggatgaccttgacgccgcgcagccacgtggcggcgacgaagccggcgaggtctgtcaccgcgcctcccccgacggcgacaatggcgtcggagcgggtgaagtcgttctgcccaaggacctgccagcagaaggcggccacctggatgtgcttgccttcttcagcgtccgggatttccgcggtcagggaggtgaatccggctgctgccagttcgtcgcggacggtgtcaccggtcagccgcagcgcacgcgggtggatcacgagcacgcggcggacgcgttcccccagcaatccgggcaggtcaccgagcagcccccggccgacgacgacgtcgtagttctcagcggcggaaccgccggtgacgcttatgactgttgattcggtgctcacttttcaacttcctgtttggcagctgcgtaatcgcgcagtgctgcttcgagccggccgcccagctcggaaaccgagccgtggcgcacgtccagggtgatgtctgcaagccgctcgtagaccggcttgcgggtggcgaacatggccgtccagcggcccattgcgtccccggccagcagcgggcgcccggagttgcgggcaatgcggccggcgacagtttgtgcatcgcattcgaggtacacaacggtgcagcggctgaccagctgctgcgtcccggagtccagcaccgcaccgccgcccagggagatgacggtgaccgtatcgtctgccgcttcgacgacggcagcgactgtacgtgcttcgatctcacggaacgcgtgctcgccgcggccggcaaagatgtccgctatggatccgtgccctgcaacgataacagcgtccgtatccacgaagggaactccgagctggagtgccaactgctgccctatggccgatttcccgaccgccatgggcccgatcaggacgatgggccgccctgcggggccggttttgctgcgatggggcacttactggccaatcgagtccagggacgccggaatgttgtccaggtaacccttgatgttccgtgcggtttcggccaccgagtcgccgccgaacttctcggtgactgcctcggccagcaccagggcaaccatggcttcggctacgactccggcagcgggaacagcacacacgtccgaacgctggtggtgcgccttggcgggctcacccgtgctgacgtcgatggtcttcaaggcgcgcgggacggtggcaatgggcttcatggctgcgcggacacgcaggacgtcaccgatgctcatgccgccttcgatgccgccggcgcggttgctggtacggacgatccggccgtcggcgtccctgacgatttcgtcgtgggcagcagagccgcggcgcgacgcggtcaggaagccgtcaccgacctccacgcccttgatggcctggattcccatcagggccgcggcaaggcgggaatcaagccgccggtcccagtgaacgtaactgcccagtcccggcggaagcccgtaggcaaggacctccaccacgccgccaagggtttcgccttccttgtgcgccgcgtcgacttccgccaccatggcgtccgaggtttcccggtcgaagcagcgcagcgggtcggcatcaagcgcaatgacgtcggccggagcgggcagcgggcgtccttccggaaccgtgacgctggcgatgctgacggtgtggctgaccagctcgatgccgaggtgcttcaggaactgtgcagccacggtgcccatggccacccgtgttgctgtttcgcgtgcgctggcgcgctccaggacggggcgggcctcgtcaaagccgtacttctgcatgccggtgaagtccgcgtggccgggacggggacgggtcaacggcgcgttccgggcctggtccgcaagaattgccggatccaccgggtctgcagacatgatctgctcccacttgggccattcggtgttgcccacctggatggccacgggtccgccctgcgtcaggccgtggcggacgccgcccagaatggtcacggcgtcctgctcgaacttcatgcgcgctccgcgtccgtagccaaggcggcggcgggccaacgagtctgcgatatgcccgctggtgatttccacaccggcggggacgccttcaataattcccatcagagccggaccatgggattcaccggcagtcaaccaacgcaacataatttccatcctgccatgtatggcggtcacaacgcccgtcggggaaggccgactgcgtcacacatcacatctatgacagctgcattaacgtcttcgtcccggcgggtgaaaaggcgcacctgctccaccgcctggtacaggagcatttccagtcctggcaccacggttccgcccccggcctgccacacggaggccagcaggctgggccacggatcataggcaacgtccagcaggaccccgggcaggctggtcttgagggaagccagttcagaagccagtccgtccgctgcacgcggcgggagggtggagatgacgacgtcggccgctgcagtgggacgggccgcctccgccagggtgcggatctccaaggagaaggccaggctttcggcggcggcgcggacatcggcggtccgggacgtatcgcggacaaagaccttggcctggctggccccgaggtccttgagggcagcgacggccgaggccgcagttccccctcccccaaggatcacagcggccggggccgcgccggcacccgcgtgctgcagtgcattgacgatgccggcaacatcggtattggagccaatggtgcgccgggtgccgccgtgctcctcaaacgagacggtgttgactacgcccagtgtcctggcaacaccgcggacttcgtccacctgcccgagcatcgccgtcttcaagggcattgtgaccgagaggccgcgccagcccggctgatcgcggatctgccccatcagggacggcagcagctgttccgtgacgtcgattgccgtgtagctgatcccgatccccagccggctgtaggcagccagatgcagcgccggggacttcgagtggcttatcggatggcccaggacggcagcccgaaggctcacgtgcagcgtccgacgtttgccgtgcaccaggcgttgtactgctccacgtagccgttgtgctcttcaagcgtccgggagaacttggtctccttcgtgtccaggttgatggtcacccagtacaggtagtcgttcgtcttgggcttggcggcagcgtcgatcgcggtctttcccggggagccgatgggtcctggcggcagcccgggattcgcatacgtgttgtacgggttggacttgtcctggcgctgttcatcagtgaagttgtagctcttggtgcccaggccataggtcacggcggagtccacctgcaggaaacctccggtctggtcgttgggcttgagccggttgtagatggcacctgccacgtccccatactccgcctgaccgccctcggcctggacaatgctggcgacgatcacggcctcgtactgtttggcagggtccgtgatgccctgcgacacaagttcgtcagtcgtgatcttgaccagggactggaggatgtcctttgcgggagtgccaagggggaagcggtgctcccccggcgccaggtacccctcgaggtttttggcgttggcgggaagaccaaactggcccggctcgttgctgagggcctgcaggtcctggaacgcaattccggacccctgcgatatcgcctgcagggactccccaatgcgcagtccggcgctgagggcgaagtagatgaccttggtttggtccttgcccaggaggacgttcacggcgtcggagtttttcatctccgacttgaacgtgtagtcacccggggaaaggatgccgccggatgcgttgaagctctggaggaacgtgtcggcgttggccaccaccccctcgttttccagcttcgaggcaaccgaaccggtgccttcaccgttttcgacggtgacaaccacttcgcccgaaccaggtcccgggaagtcgccgggcttgtcgctgccaagcagcggcttgaggaactgcgctccgacggcgacggccgtgacgaagacggcaagggtcaggaagagcgccaggagccgccggcgccggcgcaccttcttcgagggcttggccacgacggttgcggctgccgaggcgggaaggagttcgtggtggtgtgcagcgtcgtcgtgcccatcttcatagtgggtcccgtcgtcgtgcccgtccccatagtgcgtcccgccgtagtgcccatcgtgctggtgcacgccgtccgcatagccgtgcccgtcggtgtagccgggttcttcgtagtggggttcgttgttatagcgcacgcccgccgcgtgctggtgccctgcaagggccggctcccaggaatcgtgctgggcaggttcgtgggagtcatcctggatggacggcggggcggcaggagcagccggaatcctgggctcttccacccggtcctgcggtgcctgttcttcacgcaatgcttcatcctgacgccgggggtctgcttctgcgtccgcggggggttccgcgggcagtggtggaatgtcgtggccggtctcgtatgcctgctccggaacggcatcgtggcctccggtgttgagggtcttttcccgtgcgcggagttccttgcgggtcagcggccttcctgcccccgcgtccagagggctggaagagtcgtcaatgttggcagggctcactggtgccttccattatctgaagatcggtccgtatcgccgggtgcggcgggcaccgtttccggcccgctgcctcccatgtccacggaagggggtggcgccgtcacgcgtgagccgacgtccgctcccctggctttctgcatgtcgatggcgtgctgaaggatccctgccgccgcgacctgatcaactactttacggtggttcctgctgctcatgccagcttcgtacaggctgcggtgggcgctgacactgctcagccgttcatccaccaagttcaccggcaccgccaggtcccgggccgcgagctcgccaaccagcaggtgggcgtaatccgtggccatcatggcagaggcccgttcctcacccttcatggtgcgtggcaggcccacaaacacctgcacggcgccaagttcctggaccaggttggcaatgacccggacgtctgagttcttcctggcgttgcggtccagtgtcttgtagggcgtcgccaggatggaatcgcggtcgcagatggcaacccccacccggacggtgccgacgtccacccccagtttaatgccctgggggtagtcgccggcagcagcaggatctgtcatcggaggattagcgccgcgaaatggcgtcgacgacggctgtgagggccgggccaacctggccggcgtccgtgccgccgccctgggcgacgtcgtccttgcctccgccgcctccgccaaggacctttgcggcaaggcgcaccagggctcctgccttcaccccggcttcccgggcggcctcattggtggccaccaggatgacggggcggtcgttggcgacgccggctactgccacagttgccgctgcggagccgaggcggttccggaggtccagggccaggccgcgcagatcgtcagcgccgctgacctggcctgcatcgtgggcgatgacactgacaccggaggcatccttggcactgctgaccagctgggcagcagcggctgccagctgctccttgcggaggcggtccagttccttctctgtcgccttcagctttgcaagcgtggcggcgatccggtcggccagctgtcctgacgggactttgagcatgtccgtcagttcggtcacgagggcgcgttcggccgccaggtggcggaatgcgtccatgcccacgaaggcctccacacgccggttacccgacccaacggactgctcgcccaagagtgaaaggctcccgatcaaggaggtgttcgacacgtgcgtgccgccgcagagctcgcgggaccacgcgccgtcgatctccactacgcggacttcgctgccgtagttctcgccgaacagggccatggcgccgagggccttggcttcggccaggcccatcaccttggtttccacccggaagttgttccggatggccaggttggacacttcctcaatttcggagcgcgtggccgtgctcaggccttcgccccaggcgaagtcaaatcgcaggtagccggccttgttgaaggaaccgcgctgggtggcctcggggccaagaatctggtggagcgcggcgtgcacgatgtgcgtgccggtgtgggcctgttcagcggcgtgccggcgttcacggtcgacggcggcgcggaccagggagtcagccccgatttcgccttcgcggacaatcgccttgtggacgcttaggcctttcagcgggcgctggacgtcgagcacctcaacaacgaacccgtcgccggtgatcaggccggtatcggcggcctggccgcctgcctcggcgtagaagggcgtttcggagagcaccagttcgatttcatcgccgttggatgcctgctggaccgcacgtccgccggtgaggatgccgcggacgcgggactcgccgtcgagctcggtgtacccggtgaagaccgtctcaccctgggccaggatgtcctggaaggcactgaggtccgcgtggccgcccttcttgcccttggcatcggcctgggcgcgctggcgctgttcctgcatgaggctgcggaaggcagcctcatccacattgagcccggcttcctcggccatttccaaggtcaggtcgatggggaaaccgtaggtgtcgtgcagcgcgaaggcatcggccccggacagcggcttgttggcggccttggattccttgacggcgtcctcaaggcgtgcggttccggaggcgatggtccgcaggaaggccttctcttcggcgtacgcaatgcggctgatccgggcgaagtccgtgtccaccacagggtagacgcccttcatggcgtcgcgtgaggcgggaaggagttcgggcaggcaggcctgttcaacaccgaggaggcgcatggaacggacggcacggcggatgagccggcgcaggacatagccgcggccctcgttggagggggtcacgccgtcggagatcagcatcagggctgaccggatgtggtcggcgaccacacgcatccggacatcgtccgtgtggtggggatcctcatcggtctcggcggacgtgtattccttgccggaaagttcggcagccttgtcgatgacggggcggacctggtccgtctcgtacatgttctcgacaccctggaggatcatggccaggcgctccatgcccaggccggtgtcgatgttgcgcttgggcagctcgcccacgacgtcgaagtcttccttcgaacggacattttcgatctggtactgcatgaacacaaggttccagatctcgatgtagcgggtctcgtcagccagcgggccgccctcaacaccgtactgggggccgcggtcgtaatagatctcggagcagggaccggcagggcccggctggccggtgtgccagtagttgtccgactttcccatcttctggatgcgctcggcaggaactccggtgttcttgagccacaggtccttggcttcgtcgtcctcttcgtacaccgtcacccacagccgctcgggagccagcccgtagccgccgtcgtccacgcccgtggtcagcagctcccaggcgaacttgatggcgtcttccttgaagtagtcaccgaaggaaaagttgccgcacatctggaagaacgttccgtggcgggcagtcttgccgacttcctcgatgtcaccggtacggatgcacttctgcacgctgacggcgcgcgagtagggtgcttcctccctggcggtcaggtagggaatgaacggcaccatgccggcaactgtgaacagcagcgaggggtcgctggagaccagcgatgcggagggaaccgcggtgtggcccttgctgacaaaaaagtccacccagcgctttgtgatctcctgcgacttcatgagctgtgtacttacccttcttgctccgcgcactgtaagtcgcggaggttctttcgcttggcggtcccgttgtgaacggtgcccgccggtgtggttctaacgtgtggtgccggtgtggttctgacgtatggtgccggtcagcagggtggtcagcggcggaccaggtctgccgattcgacgccgagggcagaccggaggtcggtttcccgctcgcgcattcctgcacggacggcgtcggcaaagtcgtagacaccgtcggcaaggcggttcacggaacggttgaggccctccgggcccaacgtcgactgcatactggcctgcacttcggtcaccttgcggaaagcgatcactccgatcgccacgccgattcccatccagataaatcgtttcattctcttctcccggaatctagcggctgcggcggccggcggcgggtttcttgcgcccggccagcgcggtacggacaccgtagctgaaagctgccaccttgatcagcggcgaccctacggtggcggccacaagggaggacagggcggaaaggtttgcggacgcgtccgaaacgttggacgagatgccgtccactttcttcaactgctggttggtggtggagacggtggcggtgacttcgtccatgagcggcgtggcgccgtcgctcagggaccgtatggaggtgcgaacctcgtccaggacgcggcccagcttaaggatgggcaccgcgagcagcagcaccaggactgcaaacaccccggcagcgatcaggccggcaatatcgccaccagacatagacgttcatctcctcgaaattctgtggttcggttgcatcccggcgggtgcgcctgaagcgcattccgcagatgtcccccaagtaccttacatacaaagaagcccgcggcgcttgccacgggcttctttggatacgctgctggaatttagcgtgcgtagaattcgacgaccagctgctcctcgcaggtcacggggacctcggagcgcttggggcggcggaccaggcgtgcctgcagggcttccagcttgacgtccaggtatgccgggacggcaggcaggacatcgcggtgggcgccggctgctgcaacctggagcggaaccatggtctcgctgcggctgtggacgtggaccagctggccctcgccgacgcggaacgacgggcggtcaacgcggacgccgtcaaccatgatgtggcggtgcacaaccagctggcgggcctgggcgatggtgcgggcgaagccggcacgcaggaccagggcgtcaaggcgcatttcgagcagctcgatgaggttctcaccggtcaggcccttggtgcggcgggcttcttcgaaggcacgggtcatctgtgcttcgcggatgccgtactgggcgcgcaggcgctgcttttcgcgcagacgtacggcgtagtcggagtcctgcttcttgcgggcacggccatgctcaccggggccgtacgggcggcgctccatgtacttggcggccttgggggtcagagcgatgccgagggaccgcgagaggcgggcctgacggcgagcacgagtgttgttagccacttgtgtccttccaatatctgcggtgtgtcagtgttactggcctccacgatggagagcatcggccaaccgctgccttttgctactgggcgcagggcataaccttctcaacgtgaattggggagattgtgcgtccgtgccttgccagacaaacatctaccttaccacggcagtcacttgccccggacaatcctgcggagccgctccagccgcgtggcaatgtcccgctcggcgccgttggccgtgggctggtagtagtccttccccaccaggtcatccggcgggtattgctgggcagccacgccgtgcggggcgtcgtgggcgtatttgtagccgaggccgtgccccagctgcttggaccccgggtagtgggcgtccctcaggtgcgccggaatgccgttccccatccctgcgcggacatcggcgatggctttgttgatccccatataggcggcgttggacttgggggcggtggcgaggtgcaccacggcctcggccaggatgatccggccctcgggcatgccgatcagctgcaccgcctgcgccgcggccacggccgtgtgcagggctgtgggatccgccattcccacgtcttcggctgctgagatcacgatccgccgggcgatgaagcgcgggtcctcccccgcctcgagcatgcgggccaggtagtgcagggcggcgtcgacgtcggagccgcggatggacttgatgaaggcgctgatgacgtcatagtgctggtcgccggcacggtcgtaccgaacggcggcaacgtccagggcacgctcggtgtgtttaagttcgacggcgacgggcccgtccccggcatcgtcggcatccccgaacgcaacgccggcggctgcctccaatgccgtcagggcacggcgcgcatcgcctccggaaagccgtacaaggtggtcgagtgcttcctcactgaggcctactttcccgttcagcccgcggggatcggcgacggcgcgctggatcagtccttcaatgtcagcgtccgtcagcggacggagcgtcagcagcagcgagcgggacagcagcggtgacaccacggaaaacgacggattctcggtggtggcggcaaccagcaccacccagcggttttcgacccccggcagcagggcgtcctgctgggccttgttgaagcggtggatctcgtccaggaacaggacggtggtggtcttgtagaggtcgcgggccgtcagggcctcgtccatgacgcgccgcacgtccttgacgccggcagtaatggcggagagctccacgaacttcctgccccgtccgcgggcaatcacgtgggcgagggtcgttttgccggttcccggggggccccagaggatgagcgaggtggggcccgcagggcctgttgtgtctgcaccggctccggcggccaactggcgcaggggcgaaccctgtcccaggaggtgctgctggcccaccacctcgtcaagggtgcggggacgcatccggacggcgagcgggccacggggggaagcgttggcccctggccctgcagtccggccgagggctacggagccgtcgtcgtcatcatcattgccgcggccgtgcccgaagagatcttccacatagataggctacttccagttcacttccggatttcgcccgggagtccggccagccagtaaaggaacatcccatgtccgctcgcaccaccggcggaaccaggccggcctccgtgcgcaccgctttcatccccggcagccggttggccggatgggcggaaaggtttggcgcggcgcacggcggataccagctgaaagatgacgacgacggcctccgcctgctggccgcggacggcgccgaagccctcctgcagcctccctggccggccgacggccggccaggccgtggcgcggatcccctcgagcggcttgcctccctggcgtcgcagccgcggcggctgggcctgctgctggccaggcgcggaggctacggcgtggcggtggtcagtgaggggcaggccctcgcgtcgaaggtgggatccacgtatgtgcagtcccggacggccgcgggcggacagtcgcagcagcggttcgcccggcggcggagcaaccaggcggacgccctggtggaggctgttgcggaacaggccgcacgcatcttcagcggtgaaccttttgaatacgtggttcccgggggtgacagggccctggcgggcctggtccttcaacaccctgtcctgaagggctttgccgctatgccccggcttgcctaccttgacgtcccggatcccaaggctgcagtgctgcggaaagccgccgcggattcgtgtgccgtgcggatccaggtcaccgacgcctcctagtcagcagccggtcagcgcccggcggggccgctcctggcggtagagatagcggcccgcttcctcgaaccctgcctgctggtagagctcccgggcgccggcattggcggcagtgaccagcagccagaagctttccacgttccgcgcgttccccgcggacaggagcgcctggagcactgctgctgcgtagccccgcctgcggtgcgcaggcgacgtcgccatgcaatagatacctcccgtggcgccaaccagggcgaggcgcccgacggcggccgggacgccgtcgtcgtccctggcgagggcatacagcgctgggcaccccgtcacgatcaagcgcgctgtctcccgcgcctgaccaccgccccggccgtccacgctccaccaaaggtgcagccactcctcgttgggctcatcaaggatctccaccccagcgaccgccggatgcccgccctggggcccggcaggccgggccatgatcagcgtttcggactgccgggtgaagccctgggcgtccaggaagtggttcagccccgagttggcggccgtgtccgcaacttggaagatcaagggaagacgccgcatccggtaccaccgcgcagcctccaacaaagcctcctgcggcttgagcgcggggtcccgcggccacaccgagttggcccgctgcgtgacgccgtccgcagcccggaggacccactcccccacgtcgaggcgttcgggggcgggccaggcagcatccatgagcgcctcgtaggtgcgggcgggttggctcgaacggttgagggccacgggactcctgatttcggagagacgtgaaggccccccatttccaggagggccttcacgtcaaacggatactgcctacttgccctcttccggcttcttggcctcaggcttgaagtcaacaccggcttccttgcgctgctgcggcgtgatgggagccggggccgcggtcagggggtcgtagccgttgccggtcttggggaaggcgatgacgtcgcggatcgaatccacgccggacagcagcgccacgacgcggtcccagccgaaggcgatgccgccgtgcggaggtgcaccgaatttgaagccttccagcaggaagccgaacttctcctgcgcgtcctggtgggagaggcccattacttcgaagacccgttcctggacgtcgccctggtggatacggatggagccgccgccgatttcgttgccgttgcagacgatgtcgtaggcgtatgccagcgccgattccgggtccgtgtcgaagctgtccatgaactcaggcttgggggacgtgaacgcgtggtgcacggcggtccactggccggcgccgacagccacatcgccggaagccacagctgctgctgcgggctcaaacatcggcgcatccaccacccagcagaaggcccagtcatccgggttgatcaggccggtgcggtggccgatttcaacacgggcagcgcccagcagggcgcgcgcagaggacttgtctccggcggcgaagaagatgcagtcgcccggcttggcccccacggcatccgccaggcctgcacgttccgcctcagtgaggttcttggccacggggccggccagttcgccgtcttccttgaaaaggacgtaggccaatcccttgtgcccgcgctgcttggcgaactcctgccagccatccagggtccggcgcggctgcgaggcgccgcccggcatcaccacggcaccgacgtagggggccttgaacacaccgaagttggtgtccttgaagaattcagtcagctgcgtgagctccacgccgaaacggaggtccggcttgtccgagccgaagcgtgccatggcgtcgtggtacgtgatgcgctggatgggcgtcggaatctcgacgtcgatgagcttccacagtgccttgacgatgttctcgcccagggcgatgatgtcgtcctgctccacgaagctcgcttcgatgtccagctgcgtgaactccggctggcggtccgcgcggaaatcctcgtcgcggtagcagcgggcaatctggtagtacttctcgaagccgcccacctgcaggagctgcttgaacagctggggtgactgcggcagcgcataccaggagcccggcgccaggcgtgccggcacaacgaagtcacgggcgccctcaggcgttgaccgcgtcagcgtgggggtctcaacctccacgaagccgtcctggtgcagcagttcacgggccacgcggttggcttcggagcgcaggcgcaggttgcgggcggggcctggacggcggaggtccaggtagcggtgcttcaggcgtgcttcctcgcccacctcgacgtgctcgtcgatctggaacggaagggggtccgaggtgttgaggatggtgaccttttcggccataacctcgatctcgccggtggccagggcggggttctcattgccctccggccgcttggaaacggtgccgatgatctgcaggacatactcgttgcgcaggccgtggaagacttcttcctcgcggaccaccacctgtgccacaccggaagcatcacgcaggtccacgaaggccacaccaccgtgatcacggcggcggccaacccagccggccagggttacggtttgtccaatgtgctcggaacgaagggatccgaggtcatgtgtgcgcagcacagcacgcctttctgcggggttacggcgggaagtcgatcgggaagttaaataggatcgttacgggaacgatcccgttcgagtttacccgctgcaaagggactgccaccgcatgagcgcacaccagcaacttcaccgcaggctaggcacgtttgacgccacggccatcggactgggctcgatgctgggcgcaggggtatttgttgtcttcgcgccggcggccgcactggcgggccagctgctggccctgtcggtggtcatcgccggggcagttgcctactgcaacgcggtggcttcggctgccctcgccgcaaagtaccccaccagcggcgggacgtacgtttatggccgcgaacagttgggcgagtggcctggattcgttgccggctggggctttgtcaccggtaagactgcgtcctgcgccgccatggcactgaccttcggcagttacgcctggcccggctacgcagtgccggcggccgtggcggccgtggttgtcctcaccggcgtcaacctgctgggcataacgcgtacggccctgctgacgcggatcctgctgtgcatcgttgtggccaccctcgccttcgtggctgtggccgcagccgtgggtccccatcccggccccggtgcgggcgggcccgcgggcgattcttccctgggcggggtactgccggctgctgggctgatgttctttgcctttgccggttacgcgcggatcgccacgctgggtgaggaggtcaaggatcctgcccgggccatcccgcgcgcaatcctcgccgccctggctgctgcgttcgccatctacctgaccctgtcgctgctcctgctgaaccaccttcccggcggccggctcgccgccacgcggacgccgctgctggacgcggtgctgcagtcacggtttgaaagcggcgcaccgttggtgcaggtgggcgccgccgctgcctgcctgggagccctgctggcactgatcacgggtgttgggcggaccaccctggccatggcacgggaacgcgacctgcccgcgcccctggcgaaggtgggtggaaagcacaccgtgccgtatgttgccgaactggcggtggccgccgtcgtcatcctgcttcttctcaccacggacgttatgacggtggtgggcttctccagctttggcgtgctgatttactacgccgtggccaacgcctctgcgtacaccctggcggcacatcccggctacgcacccaagtggctgaacgccgtcggtttcgcagcctgcctgctgctggccttcaccctgccgccggcgtcggtcctgaccatggtggcggtgctggcagccggagtggccgggcggtggctggtcctgcggctgcggcattagcgcggccccaccgcgcggagcgggaccgccgcggggcacattggtcggcccacaagccgtctgcggaagaatcgacggcgggtctgtgccatagtgccccacgacggcggcgctgcgccgagggtgcagtgcagctaaacggctgctgcagccggttctgccgccgtggacacctggactgccaggtcttcggccggcggcgtccaggtctccggggctgcgactacctgctcgccggtccggatgtccttgacctggtgcgtgccgtcgtcgtccgtgaaccagacaaacgggatgccccgccggtcagcgaacttgatctgcttgccgaacttttccgccttcgccgccacttcggtgggaatgccgcggctgcgcaactgggcggccacgtcctgcgcagcgtcccagctgtcatcgtgcgtcagggccacaagcacggcagtgggaaccgaccgtgaggccttggccaggtcctggctcaggatgcgggacaccagccgggtgacgccgatggaaagtccgacgcccgggaacttccggtttcccttcgacgccagcgcgtcataccggccgcctgagcagattgagcccagctgttcgtggccaaccaggacggtctccaccacagttccggtgtaatagtccaggccgcgggcaatgctgaggtcagccaccaccttgcccggggcacgctggacggccgcgtcaatgacctgttcaagctcgctgaggccctcgtcaagcaaatcattgctgacccccagcgcccggacctgggccacgaaggaggtgtcctcggtgcggattccggccagttgcagggctttctgtgcctggtcgtccgtggcgcccagttcggatttcaacagttccgcgactttcgcggggccgatcttctcgagtttgtcgatgctccgcagcacgccggcagtgtcatccaggccgataccgcggtagaagccctcggcgagcttccggttgttgatgcggaggcggaagtccggaatgggaagggcgctgagcgcctcggcgatcaccagtgcgatctcgacgtcgtagcggaacggcagctcgccgtcgcccaccacgtcgatgtccgcctgggtgaattcccgggcacggccttcctgcgggcgttcgccgcgccacaccttctggatctggtagcgccggaaagggaacgccaggtagccggcattttcgacgacgtagcgggcaaagggaacagtcaggtcgaagtgcagggcaagtgcgtgcgggtcggctttgcccttcgcctcaccttcgtcctcctggaggcggctgagcccgtacacctctttatcgatttcccccttgcgcagcaactggccaaccgtttccacggcccgcgtttcaatggaggagaacccgtgcagctcgaacacccggcgcagggtatccaacacatggagctccaccagccgctcctcgggaagccactcggggaatccggacagggaggcggtgcgtgccatggtggagtttctcctcttggtgaacggcggcagggacgtgcgcggcaatcggcccgaaacgggatgacgacggcggcactccagccagtcatgcataaactatgtgcggcagtcagtttatgtcgtcttccaccggcatctctaatgcggcggaccggcagggcccggcggccagacacctgcgcaggcggcccacagccatgccgtgcagcagcccgactatgaggaggacccttggcggccagttcacgcagtgcccgcgaaaccagacggcgcattcagcagatggaagccaagcgggccatgcgccgggaccaggaaagccggcgcaagcgcgacaacctcatcgccgccggtgccggaggggccgcagttgtcctcgccgtcgtcctccagctcactgcctttgccggcaatccctcacaggacgagtacgctgcagcagaggctggactgagcagcccgtccgcgtctgccgagccgtccgcaagcccgtccgcgcaggcaaccaacgggcccaacatccccgccgcggacaccgccgcaggccagaccttcaccggcgagctcatcctgaacgccagcccgctgggcgtggagctgaacgggacggatgctccgcaggcaaccgcggtgttcaaatcgctcagcgacgagggctatttcagcggcaagacctgccaccgcctgaccaccggggagaccttcggcgtccttcagtgcggctcccccaccggcgacggccagggagaccctgactacacctggggtcctttggaaaacacgcccgcggacaatgcctatccggccggcaccatcgcagtggcccgtacgggcaacaacgcatacggaaacggcacccagttcttcattgtctacaaagacacggtcatcccggcggacaccgccggcggctacaccgtggtggggaaggtgacatcggggctggacgtagtgaccaacctggctgccgccggaatcacgccgggcagcagcgacacggacggcgcgcccgttgaaccagtcacgatagactcattttctctgaagtaggagcccggccggcacggccgcggtgcagtacgtgagtatttccctccaagcgaaagacttttagcggtgacagacagtcagaaatccgacgaaacagcaacagacctgaccgaagcggcggcccccgcggcggatggcgcaggaactgaggcatccggtaccacggcggtggaagctcctgaagccggggcagccgcagaacaacctgccgcaagcgaggaagagccttcggctcccgtggaagagactcccgctgatgatgcttccgctgctgcccccgcaccggcaactgcaccgacaccctcaccggcaccttccccccggtcagcagctccgtccccggccgcgttcgcttcccgccccaagcctgcagcaaccgctccggcggcaacggctgttccggcagcacctgccacctctctggccgaggcctcaaagtggggccgggtcgaaggcgacgggcatgtgttcctcaccattgacggcagcgagcacgccgtagggcagtacccgggcgttagcgacgacgaagccctcgcctactttgcgcgcaaatatgacgacgtcgtggcccagattgttctgctcgaacagcgcgtcagctccagggcacccagcacggacatgcagaaaaccgtcacccatctgcgtgagcagctcgcggaacggaacatggtgggcgacctgcgggcagccgaggcgcggctggacaagcttgccgaacagatcggcgagctggagaaggccgaaaaggctgagcacgacgccgtccgtgcgtccgaactggcagcccgcgaggcaattgttgccgaagccgagcagatctccggccaggatccggcacagacgcagtggaagacctccagcgcccgcatgaacgaactcttcgagagctggaaagcagcgcagaagagcggcgtgcgcctgggccgcagcaacgaggacaccctctggaagaggttccgcgcagcgcgcaccgtcttcgaccgccaccgccgcgcctacttctcccagctggacagcaacaactccgcggccaagtccgccaaggaaaagctgatcgccgaggccgaagcactgtcaacctccaccgactggggttttgccgccggtgagtaccgcaggctgatggaccagtggaaggcatcaccgcgcgccagccgcaaggacgacgacgcactctgggcccgtttccgcgcggcacaggatgtgttcttcacgaaccgccaggctgccaacgaagagattgaccaggaatacgctgccaatctcaccgtcaaggaggccctccttctggaggccaacgccatccttccggtcaaagaccttgccgcggccaagaaggcactgcagtccgtccgtgaccgttgggaagaagcaggcaaggtcccgcgcggcgatatgggccggatcgaagccgggctccgcaaggttgaggatgccgtccgcaacgctgaggaagagcagtggcagcgctccaacccggagcggaaggcgcgcaccaacagtgccctgtcccagctggaatcggcgatcgcaagccttcaggacgatcttgccaaggcagagaaaaccggcgaccagcgcaagatcaaggcggcccaggaagcccttgaggctcgccaggcctggctggaccagatccagcgctccgccagcgaactttcctaagccatcctccggctcgtctgcctgcttcgcaggccggcgtccggtgcaggcccggtccggttatccacataaccggaccgggcctgtccccgttaagggcctgcgcggcaggatggacgaatggcgattccttcggctcccccgggcaatgaccatcccgccgcagcagaggcagcaacacaacgtttcccggagctctacgtcccggacatgcccttcgccacgcccgagctgcaggccctcgccgcggacggcctcctggaccggctgcaccaccgcggctatacgctgcccggagtggccgcgtccccgcagctgcgcgcacgggcggcggccggggcggtaccgttgtcggtcaggcaaagggtggttgccggccgcatgacagccgcctggatctacggctgcgcggcagagccggacaggcttgcgctgctggtggacgccaaacgaagggtttcaagcctcaggaacacccggggctgcacccttcacgaggtgaagcttggcccgttcgacgtggtcagcctcggcggcctgatggtctccagcccgctgcggaccgcactggacattgccctgcacgtggacgccggcagggccatccccgcactggagggtttactggcgcgcccccaaaaggacgtgcggctgcgcctgctcgtccttgccatagaggcgacgccccgcgtgccccacaaacgggccgccctggaaaaactcgccgcgctagctccggcgcttgttgccggtggtccggtaaacgtcgaacacgccgtcgatcctgcggacagcgctgaggacgtggctcaggtacttggggtcacccatttcgaaggcaaactttgagatcgccacccggtccgtggaggtgtgcacgctggctgccaggatgttcacatggttctcggacaggacgcgggtgacgtcggacagcagcgacttgcggtccagcgcttccacctggatctcaaccaggaaaacgctggactgcgttggcgcccactccacgtccacgatgcggtcgggctggtccttgaggtccgagatgttggtgcagtccgtcctgtgcacggagactcccgagcccctggtcacgaaaccgaggatggggtccggggggacaggcgtgcaacagcgggccagcttgacccagacgtcgccgacgccccggaccaccacgccagagtcggagaaacgggctttggtgacctgggtggggatgctgacttcggcaatgtcgtcgtcggcgctctcattgcccccgaggctttcgaccagcttttccatgaccgactgggctgacgtatgcccgtcacccactccggcgtagaggcccgaaatgtcaacgtacttgaactcttctgccaccgccgcgagggcctcgtgggtcatcaggcgctgcagcggaaggttctgcttccgcattgcacgggtcagcagttcctttccgcggtcaatcgcctcttcccggcgttccttgctgaaccactggcggatcttgttccgtgcccgcgcactcttgacgaagtgctgccagtcctggctgggcccggcaccttcggccttggaagtgaagatctccacccagtcgccgtggttgagttcgctgttgagcggaacaagctttccgttgacccgggcaccgatggtccggtggccgacctcggtgtggactgcataagcgaagtccacgggagtggaaccggcgggcagcgccatgacttcgcccttgggggtgaagacgaaaacttcccgcgcgttaatttcgaagcggagcgagtccaggaactcacccggatccgaagtttcctgctgccagtccaccagggatcgcagccagcccatgtcgccgtcgcgggggcttccggggccaaccgcggtccggttgggctggtccttgtacttccagtgcgcagccacaccgtactcggcgcggcggtgcatctcatgggtgcggatctggatttcgaccggcttgccgccgggcccgatcaccgtggtgtgcagcgactggtacatgttgaacttgggcatcgcgatgtagtccttgaacctgccgggcagcgggttccagcgcgagtgcatggtgcccagagcggcgtagcagtcacggacggagtccaccaggacacggacccccatgaggtcgttgatgtcgtcgaagtccttatcgcggacgatcatcttctggtagatggagtaataatgcttggggcggccggtaatggtggccttgatcttggcggtacggaggtcgtcggtgatctggtcgcggatgacgctcaggctcttctcccgctcgggggtcctgtcccccaccatccggacgatctcttcataaaccttcgggtagagcgcggcgaaggagagatcctccagctcccacttgatggtgttcatgcccagcctgtgcgccaggggggcgaatatctccagcgtctcccgtgccttccgggcggacgattcagcggaaacgaaccgccaggtcctcgcgttatgcagccggtccgccagtttgatcatcaggacacggatgtccttggccatggccacaaccattttgcggacggtctcggactgggcagcctcaccgaagctgaccttgtccagcttggtcacgccgtcaacgagcatggccacttctgggccaaagtcccgtttcaggtcggccagggtgtacggcgtgtcctccaccgtgtcatgcagcaaagcagcggccagggtggttccgctcagcccgagttcggcgaggatggtggccacggccacgggatgcgtgatgtacggatcgccgctcttgcgcttctgcccgcggtggctttgttccgcgacgtcgaaggcccgctggatgaggtcgaagtcctctttggggttgttggcccggacggtcctcagcaggggctcaaggatgggtgagtacgtcgccgtgctgcgccccgtcagccgggcgagcctggaacgtgtgcgctccctgcggccgggaaaggtggcgcgggagccggagttgtcgacgggaaccagcgggccagggcgcgcggacgaggccaccccggcctgcgtaccgttggcagcactcttgtccccttgtgccgctggcgctgacgccgaacgctcttccaatgaagtacccctcaccaccgttttaattacttcagtctattccccgcggcggtgagatttataaccggcgccttaaacacggacgggccggccggcgtcaggcatctgacgctggccggcccgcgggcgcccggattatgccggggctgtttccacggctgaggagccggacccggtgccggcacgccggtgctcaacccgcttcgcctgcctggcgaggtcgggctcgttctggcgcagccaggcatacagcggggctgccacaaagatagtagccgccgtgccgatcaggatcccgacaaacagtgccagtgaaaggtcgcgcagcgtacctgcccccagcaggccggcaccgatgaacagaatcgctcccacggggaggatcgccaccatcatggtgttgatcgacctgacgagggtctggttcacggcgaggttgacttcctcggcgaacgtgcgccgggttgacgcgtccaggtcggcagtgttctcccggatcttgtcgaaaaccaccaccgtgtcatagagggagtagctgagcacggtcaggaacccgatgatggcggacggagtgacctcaaagtcgctgagggcgtagacgcctgcggtgatgaacatcgtcaccgccatacccgcgatggccgagagggacatcttccacgtgcggaagtacagtgccatcagcactgccgcgaggaggacgaacaccaccaggccgatcagggcctgcttggtgacgtcggctccccatgtcggtccgacgaacgtcgaggtcacctcattgtcggtgacgccgtacgcgcttgtgagtccctccttgatgcggagcgtctcatcatcggtcagtttgtccgtctggatccgcatggtggtgccggcgacgttcgccacgcgcggcacactgccctgaaccacgtcagtaacggccttttcccccagcgccgcatcggtggtctgcacgttggagaccgtgaattcggacccgccgcggaactcgatgccgaggttgaagccgcccttggccaccggaatgatgatggagaggataaccgccaccgccgcgatgatgaaccagagtttcttggcacccacaaagttgtaggagcgctttccggtgtagagctcgttgccgaagttggcgaagcctgacattacttgttctccttcgctgaggacttcgaggagcccgtgagctgctcctgcttctccgccaggcggcgttcggcgatggtcatcctgcgttccgcttcggcggcggcaccggcgttcttggtccggaccccggcaggcttgtctgccggggtacggacgcggccggcaccgcggtacagcggcacggctccgagccgtttcggatcaaggccggacagccggtggccctcgccgaagaaccgggtgcgcgccagcatctgcagcgtcgggtgcgtgaacatgaacaccacaatgaggtcggcgatagcggtcaagcccagcgtgaacgcgaatccgcggacgttgcctacagccacgaagtagaggaccagcgcggccagcaggttgacggccttggacgccagcacggtccgcttggcccgcttccagccgttttcgacggcggagaccaggccgcgcccttcacggagctcgtcccggatccgctcgaagtagacgatgaaggagtcggctgtctgtccgattgccacgatgaggcccgccacgccggccagggacagccggtagttctcggtccagcccaggatggcgatggcgagatacgtcaggatgccggcgaccaccagtgacgcgatggtcacgaagccgagtgcccggtactgaaacagggagtagaccaccacaagcaggaggccgataatgcccgccaggaggcccatgcggagctgctcaccgccaagggtggccgaaatctgctgctcgctctggatctcgaagctgatgggcagggcaccgaagcggagctggtcggacagggccttggcgctttgctcggtgaacccgccggtgatctgcgggcggccgtcggtgatgactgcgagggaccggggcgcggagatgacctggtcatccagaacaatggcgaactgggccttggggtcgttacccgcgtcgccgccggcggcaacgtagaactggttcaggcgttcggtgacctctttgaaccttgccgtgccttcgtcgtcgaactggatgttgactgcccagtcgttggtgacggcaccctgtgcaccctgctggagctggaaggacgaggtgacgatgttgctgcccttgacctcaacgggacccaggatgtacttgatcgcaggattcgtgtcggaagcaggctcgcaggtcaccaacggcttggccggatctgaccgctcccgctcgtcctgggccgggttgtcgcagtccagggtttcaaactcgcggtagatctccggagtgatccagttgatgtcgctgctgttggcgggttcagccgtcggcttgggcaactggtcctcaggcgcccgctgctcctccgggacgggtgcgccggcgccggcgagcagcacgggccggaagttcatgtcggcggaggcctggatcaggtcgcgcgtctggctggagggggtgccgggaaggctgaccaccacattgcgcccggactgggtgctgatctctgcttcggcgacacctgaaccgtcaacgcgctggcggatgatcgccacggcctggttgagctgttcctcgttgatgtccgaaccgccctcgaccttcggcgccaggatcatctgggtgccgccttcgaggtcgagcgccagcttgggcgcccagcttgcctgcccggcaagggtgccgccggccaggacggcagtgagtgtggcgaggagtacaccgagccagaccaggaccctgaggcctggttttttggggccagttcgtgccattgtcgatctttctcttattcacggaggaaccgccggtgcctgctgatgcttgcaccggcggtggtccgcagcggtagaggtgttgtggaagcagcggggactagttgtccttcttgccctcgtcattgaggcgcttgagggtttcgtccggtgtttcgagcggcgttgcggagctgccggtctcctgcgcggtcagcgacgacgcatcgtccgggacagccggggcgtcagccgccggaaccgctgcgggctccacgatcttggtcacggcctggcggtggacagtggcgaggttgcccggggacagctccagcgtgaccttgttttcctcgtcgtcgatgtcaacgatgcggccgaaaaggccgaagctggtcatgacgtctacgcccgggccgaacttcgactggagctccgcctgctgctgctgcgtcttcttgttgcggcggaacatcatgaagatgaacacaccgagcatgacgaacaggagaattgacattggatccaaggggaattccgtcctttatttgcatagctgattttccagcaacatcggcttcgctccggccggggcaggacggtcaggcaggcataagcctgtcgggttccttccccagccacgcatgaggccagtgccacccgcggaacaaagacccgaacgtgccgagcgtcataccagtctaaagggaaaagctgaacggagcctgctattggctttcggggccagtcagcgcgggcttaggcgtcgtcttcagccgactcgaacaggtccagctgctcctgggcaaagacgcccgacggaatggcatagccaaggtgggtccaggccggagccatggcaatacggccacgcggggtgcggcccaggaggccctcccggaccaggaaaggctccgccacagtttccacggtttcggtctcttcaccgacggcgatggccagcgtggagagtcccaccggcccgccgccgaacttggtgatcagggcttcgaggactgcgcggtcaagccggtccaggcccttcttgtccacctcatacatgtctagcgcagcggacgccgccctggcatcgatctggtcgattccgtgaaccagggcccagtcccggacacgccgcagcagccggttggcaatgcgcggggtgccgcgggagcgcccggcgatttcggagaatccggccgagttgaccttgaggtccagcaggccggcggagcgccggagcacgagttccagctcgggcacggagtagaactcgaggtggccggtgaagccgaaccggtcccggaggggtcccggcagcaggcccgcgcgggtggtggcgcccaccagggtgaagggcggcagttcgagcggaattgccgtggcaccggcgcccttgcccaccacgatgtctacccggaaatcctccatggccatatacagcatctcttcggccggcctggacatccggtggatttcatccaggaacaggacttcgccctcggaaagggaggaaaggatggcagcgaggtcccccgcgtgctggatggcagggccgctgctgatccgcaggggcgcgctcatttcggacgcaacgatcatggcgagggttgtcttgcccagccccggcgggccggagaagagcacgtggtcagcgctgcgcccgcgcatccgggaggcctggagcaccagcgacagctgtttccgcacccggtgctggcccacgaagtcatccaggttcttgggccggagcgccgcctcgatggcccgctcctcaggctcctcccccgcggccaccagtgacggttcagccacggctgcctacgcggttgccggcccgtgcaccgtcctgccccagccaccggagcgtggtccgcaggatctccggcacgttgccgcggaacgagacctcgggctcgtccgccagtgctttctcgatgctggaggaggcgtccttttcggaccagcccaggctcgtcatggcagccaccacctgcggtttccaggcggcctcggccggagtggacgccgcggccgtacctgccgtgccgtgcggaaccagctttcccgccagctccagcacaatccgccctgcgactttgggaccgatgccgggaaccttcgtgaacgtcttgctgtccccggtgtgcgccgccacccggatcgcctccggttcgtggaccgccaggacggccagggccaggcgcggccccaccccgctcacactgaggaggacatcgaaaacttcccgctcgtcgtcggacgcgaaaccaaagagcgtgagcgaatcctcccggacgatcagggaggtgaaaagctggccttcctcgccggtgcgcagcctgctgagggtctggggtgtggcgttgacgctcatgcccgccccgttgaggtcaatcacggcagtggaaagacccacatgcgctaccgttccgcgaaggaaactgatcaaggcctggctcctggtgtcttgccgggctccagggagcaggaccggctatccgaacatatctacgaataccctagcaagcggccagggcattcagcgggcgcggcgcgcctttgcctcggcctccgcccaggcccgctgggccggggtcagggacgaactgcccgggccggtagtcgtgggaggcaagggcacaca

SEQ ID NO: 34 - DNA, 41701 bp, Arthrobacter sp. OY3WO11
gtggtagcaacggcggcgccgctgcccgcccgccaggcgtgggtgatggccagcgccagggcgtcggcggcgtccgcaggccgcggcggtgcgtcaaggcgcgaggatcttggtgacgagcttggtcaccgcatccttgttcgaggtaccgctgccggtgacggcagctttgacttccgacggcgtatgcagcgccaccgggatcccccgccgggccgctgcggcgatcaccaccccggatgcctgggccacgcccatcaccgtactgacgttgagctgggaaaagacccgctcgaccgcgaggacgtggggctcgtgtcggtcaagccactcatcgatggcgagggcgatcaccagcagcctctggtccagggtgtcctcaggcgacgttcccaccacgccataggcaaccatggtggcctgcctgttccgctcgacgtccacaacgccgatcccgcaacgggtcaggccgggatccactcccaggacgcgcagcgtcacaggtgcagacgcccggcaggcaggcggagcgtcactcagagtccagggcggcctggacgtcgtcgctgaggtcggcgttgctgtagacgttctggacgtcgtcgagttcctccagggcgtcaacgagcttcatgaacttctttgcggcttccaggtccagcggcacttccatggacggaacgaattccgcctcgtcagtgtcgtactcgatgcccgcgtccttcagggcgtcgcggacggcctggaggtccttggggtccgagtggatctcaaaggtgtcgccgttgtccttgacttcctcggcaccggcgtccaggacagccatcaggacgtcgtcctcggtcaggtccttcttgggcagggtcacaacgcccttgcggctgaacaggtagctcaccgacccgggatcggcgatggtgccgccgttgcgggagatggcaaggcgcacctccgaggcagcacggttcttgttgtccgtgaggcactcgatcagcagcgcggaaccctgcgggccgcggcattcgtacatgatctcggtgtagtcgaccacttcaccggtgagcccggcgccgcgcttgatggcacggtcgatgttgtctgccgggacggaggtcttcttggccttggtgacggcgagttccaggcccgggttgccctgcaggtccgggccgcccatgcgcgccgcaacttcaatgttcttgatcagcttggcaaacgacttggcgcggcggctgtcgaggatggccttcttgtgcttggtcgttgcccatttggagtggcctgacatgctttacgcttctcctctgatcatgcggataaaaagttcgtgtacgcgtttctccccagtcacttccgggtggaaggaggtggccagcaggtggccggaacgcactgcaacaattctagccgtccccggcagcggtacggcgtgggacgcgtgctccgggtcggcgggctcaacctgggcgaggatttcgacgccgggaccaacccgttccacccacggcccgcggatgaagacggcgtggacaggcgcaacaccggacgcggtggcgctgaaatccaggcccttgaagtcaaggtcggtttcaaaggactcacgctgccggccgaaggcgttacggcggaccgtgatgtccagtcccccgaaggtttgctgcggagccccggacaggtccgtcgcgggatcggcaatgtcgttggcaagcaggatcatccctgcacatgagccatagaccggcaggccttcggcgatgcgctcccgcagcggttcggccagttcaaaggcacgggcaagtttgtcaatcgcggtggattcgccgccgggaatgaccagcccgtccaggccgtcaagttccttgggccggcggatgcccacggccacggcaccggcggcttcgatggcccgcaggtgctcgcggaaatcgccctggagcgccagcacgccaatccgaaggcctgaacccgggcgcgcagaagcagccgaaagggaatttgtcatccatccagcatacgggttcgccctccgcggagaccggccggggtggcgccgacggcggttgcatgccgttgctgggatatattcaaaacatgctctacttcagtgttccgctcggcaaactggtccgccgggtgtcccggcttcggggcggcgggtccgccctgcccgggctggtggttgaaaaaatcgacccgggcttcatgcggcggacactcagcaccctcccccacggtgtggcggtggtcagcggcaccaacggcaaaaccaccaccactaaaatggtggtggaactgctggaaagccaaggcctgaaggtctttaccaaccgcactggcagcaacttcacccgcggcgtggctgccgccctgctcggcgaagtggactggcgcggccggctggatgcggacgttgccgtgctggaactggacgaagcccacgccgtgcacttcgtcaacagcgtcccgccgcgctactgcctcctgctgaacgtcctccgtgaccagctggaccggttcggcgaaatcgacaagacagcccagctcctccagcacatcgcagcgaagaccaccggaacggtggtgctgaaccgcgaagaccccagggttgcccggattgccgaaaccctcaccggacaggacgtcaaatacttcggcctggacgattcgctcctgagcaccttccccaacgacgacgacatgcggaccgctccaggaagtcccgctccggcgggcctgccggagaagcctgccgccgacgtcgtactccgcaaggtcggcgcggacaccgctgagtttgagtacgacggcggcacggtcaccacgggcatgaagctccggggtgtctacaacatcttcaacgcggccgcggcgctgacgctggcgcgcagcatctgcggcagcggcgccgccacggccaaccatgacaccctcctcgaggcgctgtcccgcgttgccccggccttcggacgaggggaaagcctcaccgttgacggcaagcccctggacctggtcctggtcaagaatcccagtggcttccggctggggctgaagtcgttccccgccggcggctatgccaccatgatcgccatcaacgacaactacgcggacggccgggacatgtcctggctgtgggacgtggaattcgagtccctgcgcgaaggcggggtggaccagctcaccggctcacgggcctacgacatggcactgcggctgcaatatgacgacgtccgcatcggcaacgtggagccggacatcacaccggcgcttgcggccttcatcagggaagcccagggaaagcccaagcgcatcttctgcacatacacggccatgctggcgatccgccgcgagctgtcaaaaatcaccaccgtggaggttgtctcttgagccaggcaggcgctgatcccgcaatggaaaaccctgcgggcaaaggcaccctccgagtggtacagctgtacccccgcgacatgaacatctacggcgactggggcaacgccctggtcctccagcagcgcatcagctggcacggctacaccccggagctgctcgagtacaacgtgggtgatccgttcccggaggacgtgcacatcattgtgggcggcggcggccaggacagcggccaactggtcatccaggacgacctgcaggcccgggccggggtgctgaagaacctggcggaggacggtgcaccgatgctcgtcatctgcgggctgtaccagctcttcggtcacttcttcaagacccgcaccggcgccgtgatcccgggcatcggcatcctcgacgtcgagacacacggcaccgaggagaggctgattggcaacgtcaaggttgccacaccggagttcggggaagtgctcggctatgagaaccacagcggccagacaaccctgggcagcggcgtgcggcctttgggctccaccccgaagggcatgggcaacaacagcagtgacggccacgagggtgcccgctaccgcaatatcgtggccagctacctgcacggctccctgctgcccaagaatccggccatcgcggacttcctgatccgcacggcagcggagcgcaagtacggcagctttgttccgggccaccccgatgacaagtacgcggaactggcacgggaacacgccgcacgccgtccgcgctgaccgctggggagagaccgcagaaagggtaggttccggaaagcatccggtggcgtggctcacattgagatgcgtgccctgctgtgaaaggttttacttcatgaccaacccccttatggcacccagtcccctgccctacggacttccgcccttcgcagagatcaccaccgccgattatgaagacgccgtccgggctggtctcgcagagcacctggctgagatccaggccatcgttgaggacgccgcccctgccactttcgataacacggcagtggcgatggaacgctccggcaggcttttggaccgcgccgctgcatccttcttcacgctcgtttccgccgatgcatcccaggagatccgggacctggaaacggcgctgtcaccgctgctctccgcgcaccaggaccacgtctacctcaaccgggcattgttcgagcgcttcgccgccatcgacacctctggctgcgatgccgagtccgcgcggcttgttgaggagtacctgaaggaattccggcagtccggcatccagctggaaggaccggaacgggaaagactcaaggaggttaacgccgagctctcccgcctgggcaccgagtttggacagcgcgtgaaggaaggaatgaaatctgccgcgctgctgctggaccacgcgcacgagctggcgggactgcctgccgatgacatcgccgccgccgcggaggctgcccgcaccgccggacatgacggcaaattcctgctgactctgatccagccgactaaccagccggccctggccgccctcgaaaaccgcgaagtccgacgccagctgtttgaagcgtcggtggcccggggcagcgggggcggtagcctcgacgtgctggatttggccacgtcgatggcgcggcttcgcgccgaaaaagcagtgctcctgggcttcgcgaattatgccgaactggtggtggaccggcagactgccccagatttcggaggggtccagtccatgctgaaccgcatggcaccggcagcggtgcggaacgccgacgccgaagccgcggcattggccgaggccgcgggccatccgctggaggcctgggactgggccttttactccgccaaggtccggcgggaacgctacgacattgatgaacaggcactccgtccctatttcgagctggaccgagtgctgacggacggcgttttctttgccgcaacgtcccttttcggcatcaccttccacgagcggaaggaccttgccggctaccaccccgatgtccgcgtctgggaagtccgcgacgaggacggcatggggctcgggctgttcctgggagactactacacccgtgaatccaagcggggtggagcctggatgaactccctggtggaacagtcggcgctgctgggaactaagccggtggtcatcaacaacctgaacatctccaagccgcctgcgggtgaaccgacgctcctgacgctggacgagctgcggaccaccttccatgagttcggccacgccctgcacgggctgttgtccaacgtgacctatccccggttttccgggacttccgtcccccgcgacttcgtggaatacccgtcccaggtcaacgagatgtggattatgtggcccgacgtgctgcagaattatgcgcgccaccatgtgacgggcgagccgcttccgcaggaggtggtatcgaaactggacgcttcacggctgtggggtgaaggctttgccaccaccgagtatcttggggcagcactgctggacctggcctggcacgtcctggacggcagcgaggttcccgaagacgcggttgcgtttgaagacaaggccctggccgccgccggcatcgcccacgccttgattccgccgcgctaccggaccggctatttccagcatgtctttgccggtgcggggtacgcggccggctattactcctacatctggagcgaggtcctggatgcggagacggtggactggttcaccgagaacggcgggcttacccgggcgaacggcgaccgtttccgccaggagctcctctcccggggtaacagccgcgacccgctggaatctttccgcatcctccgcggccgcgaagccgccctggagcccctgctgaaacgccgcggcctggaatagccgagctccctaccccaccccacttaaagaagtacgacgccggtcccccaccaagagaaggtgaggaaccggcgtcgtacttctttagccaacgcaccctggcgagggacggtgttatccggcagcgcgcgtaaaagggcccccgcgccggaaccagctactcagctgccaactacgcgcggggaatagcgcgccgaggatgacgccgtccggcgcccccaaagcgaccaaaggcagaggactaccagccgcgttcggcgaggcggtgcggctgggggatctcgtcgacgttgatgcccaccatggcttcgccgaggccgcgggaggccttggcgatgacatcggggtcgtcgtagaaggtggtggccttgacgacggcggcggcgcgctgggcggggttgccggacttgaagataccggaaccaacgaacacgccgtcagcgccgagctgcatcatcatggcggcgtcggccggggtggcgatgccgccggcggtgaacagcaccaccggaagcttgccggcagcggcaacttccttgaccagttcgtacggggcctgcagttccttggcagcaacatacagctcgtcctcgggcagggctgccagcttggcgatctcggagcggatctggcgcatgtgaccggtcgcattggagacatcgccggtgccggcctcgcccttggagcggatcatcgccgcgccctcgttgatgcggcgcagcgcctcacccaggttggtggcaccgcagacgaagggaaccttgaagttccacttgtcgatgtggttgacgtagtcggccggggtcaggacctcggactcgtcaatgtagtccacgccgagggactgcaggacctgcgcctcgacgaagtgtccgatccgggccttggccataaccggcacggagacggcgtcgatgatcttgtcgatcatgtcgggatcggacatgcgggacacgccgccctgggcgcggatatcggccggaacgcgttccagcgccatcacagcaacggcaccggcgtcttcggcgatgcgggcctgctcgacgttgacgacgtccatgatgacgccgcccttgagcatctcagccatgccccgctttacgcggttgctgcccgtgacgctgttcgcggacgtaccggcctcgctgcttacatcaggtgtagacacaaaaacccctatgggtagatagatgaccttcgccggtcgtgcagggcggcacggagatgccacgtgtacacacaccgggttgccggatccattgaccgggcagtcctaatactagtctcaccgcggccggccggcttaattcgcgttaatcggccggtgacggttccgcaagggcctggcggcgtacggagaccacgcgctggaccaccgtgatgaagctggccacggcaaggagcaggagcgtcaccagcaggaccacctcagggagcccaaggccggtgaatccggtgacaaccagtactgagacgaggcgctccgcccgttcagcgatgccggtattggcagtgaatcccaacgactccgccttggcgcgggcataggaaaccaccatgcccaggacaaggcacaccatggctgccacagcgatggggacgttggccccgccggtaaagaaccagacagccaggcctgcgaagagggcgccgtcggcaatccggtcgagggtggagtcaaggaagttcccccagcggctgcccacctcccgcatcctggccatgattccgtccaggacgtcggagaagatgaacgccgtgatgaacagggttccccaccacaactggccgaacgggtagaacaccagcgcgcccaccaccacaccggcggtgccgatgaccgttactgcatccggcgaaattccgattttgaggagccagcgggcaagcggggtgaacagcgcggtgaagaatccgcgtgcgtgcctattcagcatccgtctccccgggccaggcgtcggccacctgctggcgtacctcgtcgagggtctgcgtgatggccttggtctgggcgatgatggggaagaagttcccgtcgccgccccaccggggaacaatgtgctggtggaggtgcgcggcgatgccggccccgccaacaaccccttggttcatgcccaggttgaagccgcccggattggccactttccgcagcacccgcatggccgtctgggtaaggtccgcaaactccgccgtctcatcgagtgtcaggtcggtgtagtccgggatgtgccggtaagggcacaccaggagatgcccggggttgtagggaaacaggtttagcaccacgtagcaggtctttccgcggtagacgatgagtgcttcctcgtcagtccgtccggggccgatgcagaaggggcagtcattttcgttcttgaactggtgctgcccgcccttgatgtacgccatgcggtgcggagtccacaggcgctggaaggcgtccgggacaccggcgaggtcaaagtcgtcggtaacgccggcatctcctggataccctgcgcctgtgttctcctgcacggtgctgttccgtttccgctagctggtccggttacggacggcttccgtgatccgcttgactgcctctgccaccggcacgccgttgtcctggcttccatcgcggaagcggaacgaaacggcgcctgcttcggcatcgtcaccgccggcaatcagaacgaacggaatcttgtccttgctggccgtgcggatcttcttggggaaccggtccgaggaggtgtccacttccgcgcggatgcctgcggcctttaactggtcgacgacgtcgaacatgtactcgttgaaggtctcggcaaccggaatgcccaccacctggaccggtgcaagccacgcggggaaggcgccggcgtagtgctcggtgaggacgcccatgaagcgctcgatcgatccgaacagggcacggtggatcatcacgggacgctggcggctgccgtcagcggcctggaactcgagctcgaaccgctcgggcaggttgaagtccagctggatggtggacatctgccaggtgcggccaagggcgtccttcgcctgcacggagatcttggggccgtagaaggcagcgccacccggatccgcgaccagttccaggccggactcttcggccacttcggcgagggtgcgcgtggcttcttcccaggccgcgtcctcgccgacgaacttctccgggtccttggtggagagctccaggtagaagtcgttcaggccgtagtccttcaggaggtccagcacgaacgtcagggtcttggtgagttcgtccttcatctgctcgcgggtgcagtagatgtgggcgtcgtcctgtgtcatgccgcggacgcgggtcaagccgtgcaccacaccggacttttcgtagcggtatacagcgccgaattcgaagagccgcagcggcagttcacggtaggaccgtccccgcgaacggaagatcaggttgtgcatggggcagttcatcggcttcaggtagtagtcctgggcaggcttccggacagtaccgtctgcgttgagttcctcatccacgcgcatggccgggaacatgccgtccttgtaccagtccaggtgccctgagacctcgtacagatgacccttggtgatgtgcggggtgtagacgaactcgtagccggcctcgacgtggcgctggcgcgagtagtcctccatctccttgcggatgatgccgcccttggggtggaagacggggaggcctgagccgagttcatccgggaaggagaagaggtccagttccgagccgagcttgcggtggtcgcggcgttcggcctctgcgatgcgttcctggtaggccttgagggcgtccttggtgggccaggccgtgccgtagatgcgctgcagctgctggttcttctggtcgcccagccagtacgcggaggacgagcgggtgagggcaaaggcattggagatgagcttggtgttgggcaggtgcgggccgcggcagagatcgcaccagacggtggtcccttccttgcgctcaacgttgtcgtagatggtgatgtcgccggcgccgacttccacgttcacgccttcgcctgcctcggcggcctcattcttcttgcccagcagttcgagcttgtatggctcgttcttcatggcttcacgggcttcgtcctcgcgcaccacgcggcggacgaacttctggttctggttgatgattttctgcatcatcttttcgagggtcttgaggtcctcgggggtgaacggttcggcgacatcgaagtcgaagtagaaaccgtcagtgatgtacgggccgatgcccagcttggcgtcggggcgcagctgctggacagcctgggccatgacgtgggcggtggagtggcggaggacgttaaggccgtcgggcgagtcaatggtgacgccttcgacgtcggcgccttccgggagttcctggtccaggtccttcagctcgccgttgacgcgggctacaacaacatcacggcgctcaaagaagagttccgcaccggttgtcccggtagtcaccttggtctcttcgccatcgacgagaagggtgatctgctgggcatctgacacgggtgtctcctattcaaagttaaggcttcatagcttgtggcatacggggaccacagccagccatcgtcaatgctatcggttccgctcaggcccgaccaacgcggcgcacggaagggtcagccgctgaatcccgtgatggcgaggctcctggtgattccatccagcggatgcggggcgtccggttcctgcagacgggagtccgggaagggcagggtatccgtcctgccaaggtcccaggccatgctggcgctcaggctgatcccccgcggcccggtacgcctggtggtcccgcggatcagcatcagcctggtgccgaacaggagcattcctgctttttcctgggcttcatggaagaagaccgaatctatgcagccggtgccgtcgtcgatactgatgaagaccaccctcctcccgcccctcatgggcggtgtctgggttgccacccgcaccccggccaccaggacttccgtcccgttgcgcaggccaaggagtttgtccgccgtgatgacacccagcctgtccagcattggccgatggctgtccatcaggtggctgctgacgtcaactgccatcaggtccagttcggctcggacgttttccaccagtgttggcgacgggagccctggtttaacattgcgcagttcaacatcacccaggggaagggacagctggccctcaaggacttccacgcctttccgcccgctgctggaaccctggatctgctgcaggtggtggacaaggtctgcccggttagccgtgccgcccgcctcacgatgaagggaatcaaatgcccccagctgggccaatcgcttgatgttgggtttgctgacccttgaccgtgccctcaggtctgccagggagtcatagggctggccggcgacgatccgcttgagttctgttgcggaaagcccgtagatgccgttgaggctcagcctgatacccagttttcctgcatcattgccggtttcaatcctttccacccggtactcgcccttgctgcggttaatgtccaggggaaggatggggatgccaagccgccgggcttcagccactagaagcctcttcgggtacatgcctggatcgtgttcccacagcccggcaaggaacgcttccggatgatgggcttttagccaggccgactggtaggtgggcacggcaaaggcggcaccgtgtgctttgcagaagccaaaacttccgaaggccttcagcgtgccccagacgttgtccacaacttctggcggatagcccttgatgcgggcagctttacggaagaattcctccacccccagttcgagtgcctcatttcccagggcgcggcggaattcgtccgcccgggccaggccgcagccagtcatgacatcaaaggtccgcagtatctgttcgtggaacacagtgacgccgtgggtttccgccagcacgggtttcaggtccggatgcggatagacctcgggcgcgaagccgtgacggtgttccaggaagggccggaccatgtccgacttcatggggcctggacggaacagcgagatatcgatgatgaggtcattgaattcccggggcgccatcttgccaatcagttcacgctggccgggtgattcaatctggaaacagcccagggtgtgggtgcttctgatgagttcaaaggtcgcctcgtcatcaaggggaacggcattcaggtcgatatggccattctccgcaatgtagtcaggacccgtaccgcccggaccggaagaatgccggccggcagccaccacctcactcttggacgggtggatgcggatgacttcacggacggcaaaagccatggcactctgcatgcggactcccaggacgtccagcttgagcatgcccatgggatccatgtcgtgcttatcgaactggctcatgggcaggcccagcccgctgggctgtaccggggtgcggtccaggaggctagcgtcaccaaggatgacgccacacggatgcatggaaatatggcggggcagccggtcaagccgttcggtcaggtcaaccagcaggtcaagctgctggttgccgtccatttcccgttgttccacccggccggcgaattcccggagttcaggtttttcctgaagcgcctcacggaatttccgggcagaaaaacgccacaactgcttggcgatttcccccacctcgtcgccgtccatgcccagcgccataccggcatcccggacggcgcccctggcccggtacccgttttgcatgctcatcaaagtgacccgctcggaaccgaaacgcttgaagatgcggtggtagacgttgtgccgctcagcgctttcaacgtcaatatcgatgtccggaagggtggcgcggtccctcgaaaggaaccgttcaaagatgaggtcgtgctgcaaggggttcacctggctgacatcaatcaggtaattgaccaggctggaggcgcctgatcccctggctgccgcacgcacccccatctcctggatcatgcgtgacacctcggcgactgtcaggaagtaggaggaaaaacccaggttgcggatgatgcccagttcatggttgaggcgggagagcatcctctctccggcagccccggtgattcccggaaagcggcggctgataccggcctggcaccgctgcaccagttcgatgtgtggatcctggctgatccctatgactgaggcttcgggcactaccggctgcttccagcccatatccgtttccggatctatccggcagcggtccgcgagcgcctcggtctgcgccatcagctgtttcaggtccgcggcaccataccctgccgctgaaatgatctctttgcccagccggagcatttcctgggaagacttgagccatccctggccggttggctgcagcagcggttcatccgcgagctcagggagggatttcaaggtgcgggccgagtcgagaacatcggcggtgggggcgccgtctgcggcgcagtacctcacggcgttggtcaggacagccggaacctgatgctcttcggcaagcttgagcatccggacggcgtgggcggtactcaaaggctttcccggggcgctgagctgggacacgatctcggccaccagcgtgcctgcgggcattgcatccagccattgcttgaaaagggtgcgggggcggaggtagcggcgccctcccatggcccgtccgacgtcggaatcaggcccgagcaggacagtcaagaccggtttgagggtttgaggatcaagggtgcgggaagccagctcggcccgggtgaccgctaccgggaccgctcccccggcttttcccgtggtgcgggcgtgggcatcggagatcagcctgcagagggcgcggtagcctgccccgttgttgtggccccgggccagtaccaccaccctgcccgccagctgcgtgcggtggtcgccgtcgtcgtcaaataccgcaaggtcaaccccaacaatgggatcgatgcctgctgccatgcatgccttgaggtgcttgatggttccgtacagcccgtccctgtctgtacaggcgagcgcggttgcgccgtcagcggcggcggcctgcgccagttcctcgggccaggaaacaccgtagtgggcgctgaatgcggtggaaacgtgaagatgggtgaaactcatgctgtcctgggccggagtgcgtcatggatgcgcaggagccgccaccggccgctgcggatatgccgggtgaggtccagggtcagcggctcctccgcggtttcagtacctcgcactggagtggaaggaagcacctggacgcgccagatctcatggtccaccactccgggtccgctgcccagcggtgcacgggtctcttcagcccaccattgccggcgttcgtaccagcgcaccggttcagtgcagacagtataggactgccctgcccacagcaggccgcggggttcgccgtcagcagtgcagtcgacatccacggattcgctgaacatacccatggcgcctcccggagtggacgtagctgaaagtattcgaacacatattcgaatacagccagtctacccctgctctgaacgggagcatagatgggctgcgggagggacaagagattggacaggaagggtggacggaccgatcgccagggagcaggattgtgccatgaaaacccaagacgcacttctgaagcaggcaagcatcacaacccaggattccaccgtggtggccacgttcgatattgacggcaccatcccggtttccggtgcgtatgtggtggggctgatgggggccacccccgactattcctcgcagcggaggctgtgtattgagttcatgaacgggaaggccattgccttctattccttcaaccgcgaacagggagtcgaggaagactacgacctgtccggggtaacccattcagagaacaccatcaccggcagctttcccctcgccgccctgaacgggctgggcaaggggcacctcatgtcagccttcagcgaggcggagggcagggagtaccagcacggcgtccccgtagaggaaaacctgtaagtatggcctaacagcggcagatcagctgttctctttgtggaccttcagttccagttcgataaaaccggaaatcatggcccggtacgttgactcgacgatgtccgggtcaatgtccttcttttccgcggctgagcggacgtgctcaatgatccgctccacccggccgggcgcacggacctcggcgtcgtcgcccttgagcgtcccggcaatacggatcagccgttcgcggcgggcgatgagggtgacgatctgttcatccacttcgtcaacagcaacccggacggcagcgagctgttccttgtcggccaaagcatctctatcgtttccttgaattgtcgccatcgtctgacagtatcgaagcatgcagccaagagtcgacttcatttcgctgggcgtccgcagtgttgccgcgtcccgggccttctacgttgacgggcttggttggcccgtgcaccgtgaacttcccggtgacgtggtgttcatccaggtgaaccacgggctggtgctgtccctgtgggatgtgcgccagatgcaggcagacgccggtgtcaccgcaaccggaggtgtcccctgcatcacgctgagccacaaccttcccggcactgaggacgtggaccgcgtcatggaggaggctgccgccgcgggggcggagatcatcgccgagcccatcacccagccatggggcggctacagcggctacttcgcggacccggacggtttccgctgggaagtggcatacaaccccacctgggcagtggacgacgacggcgcggtcaccgtttagcccttccgcgggtttggtccgggctgctaaaggcaggctgctagaagagtgcttccacgggccggatcagttcgggcccgttgttcctgacgttgccgacgtctttccctacggattccacatgccagtcagcggccacgtccttgacccctgcccgtaccaggtccaccagtccggccggatcgtcggcctggggatccagccaggcctgcatcgtggctttgtccatgggaagggggacccggtcatggagtgccgtgagttttccaaacaccgtggactcgctgcccggcgggggcgtgtcagcggtcaggatggacgttgagagcagccacccacccggctcccctgctggccaggagggatccttccaccactcatagagccccgcgaacaccaggccatggccaacgcccgggtgcacgtagtagggctgcttggacttacccggcccctgcttccactcgtagtagccgtctgccgggacagcgcagcggcgtgactggatggctttccggaacgccggcttctcaaggacggactcgctgcgggcgttgatcatccgggatccgatgcccgggtccttggcccatgacgggaccagtccccagcgggccacatggagctggcggacatgcttgttcccggactcgccgtccaccaggcgttccaggacaatggggacgtcgtccgtcggcgccacattccacgacgccgggatgctgacctcgtcctcaagttcggcgtcgaactcggcaaggaggtcccccacggcgcgtgccattacgtaacgtccacacatggctccagcatgccatcggcggcaggagctgtcatccacgggggtccggcagggctcggaagtggggaataccgggccgcacgctaccgttacaggaacgaaaccgttatcaagcacagaggagagctccgtggacttcactcccgaatccggcactatcaccatgttttccaccacctggtgcggctactgcaaccggctgaagaagcagcttgatgcccagggcattggctacaccgagatcaacatcgaggaagtggaaggcaccgccgaactcgtggagcagctgaacggtggaaaccagaccgtacccaccgtcctcttcccggacggcaccgctgcaaccaacccttccgccgccgaggtcaagcagcgcctcgcagcctagccatttcacaacgggaccaacatttcaatatgttggtcccgtttgcttgcctggcaaaaaaggggcggatcatacccccaggctgctgatcgaagcgctttccagggtggcacggccggcatacacggaaagcagagcttcctccaccgctgcgacgtccacgccaggtacaaggtcgtccaccgcccctgccgtggcagggtcccagtccagccccagggcggcgtagctgtcggtcagcactttgcggatcggcgccgagttttccaccacgatcaccgaactgaacagccagccgcctgccaccacgcgctgggcggtgcccaccagtttcacccggtgcgcgccgtcggccgggtccgtgccgtgcacgctgaactcgccggggcagtattccccgggaatctcgccgacggccgcctgcactccgacccggcgcagggcgtccgcaaacagctccccgaagtacccgaacctggtcttggaaccggcgatggcatccggatcgggttcaatgtggtccaccaccagggttccctcgtggtaggcggccgcccggcctcctgcccggcggaccaagggttcgaagccgttggcacggcacgcccgcgcggcggcgtcgaatcccggcaggcgggtgtcacgctggccgaacgcgaccgtgggggcgggccggtacagccgcagcgtgggaccgatgtccccgcttttggccctggccagcagttccaggccgaactccaggtcccggccggcgcccagcgtctgttcctgccgcaccaccgtcagcgcacggggccccggaccgccgtcgttcatattgctaagctcccttatggtcattctgcaattcctcgttgtcgccgccgctttcgcagcgatcgacgccgtctggctcaagctgatgaaccccttttaccgcagccacatcggcgagctgctggcggacaaaccacacctagggtacgccgtggcgttctacgtcatttacatcgccggaattgtgttctttgcgctgcggcccgcgctcgacggcggcagctggctcacagccctgggttacggtgcggccctgggcgccttcgcctacgccacctacgacctcaccaacgcagccacccttaaggtgtggccgctgcagctgatcgtcgtggacatgctgtggggcgccgtgctgacaggcctgtcaaccctcgcaggctggctggttttccacgcccggagctgacgctcgccgtaaacggctgcagcctgaccgcttcccggtcagaggccgcgccggcctgcccacatcccgtgcaacagcgggagcaccgaaccggccataaggacgccgcccaggacggcgtcgtcagcccgtacgatggcgccggcgatgagcagggcggcaaacaccagggcagaagccgagcgccgggtggagcggtccagccgggcgatctgccgttcaagacggggattggcgacggccagcgagccttcctcgagccgtccggccagcgcgtccaggcgtttcggcagtcgcagcgcggtcgctgcggcgtccaaggcctgctgggccacgtcctcgacgatgttgccgcgctcgtcgcgcaggagccgggctgcgtacggttccacggaatcccagaggttgaagcgctcatcgagcgagctgcacaccccggaggtcagcgacatcgcccggatgatgagcaggaaattttccgggagctggaacggcagcgagcggacgacgtcgccgaactccaccgcgaagtcgcggaactccctcggatcaacttcccggagctcggcgaaccccatcccgccgaagcgggcgaagaggtgcgtcatggcacgctccatctccaccgtgtcggctgacggcgccagcacgccgacgtcgttgatcgccgccaccagccccctgccgtcacgcgcggcggcagcaatcagcagcttccggagtccgctgcgggtggaggaggtaatttcgcccatcatgccgaaatcgatgaacgtcagtttccacgggcggtcgccggccgccgcggcgacgggagtgacgaagatgttccccgggtgcgggtcggcgtggaagaagccgttggtgaacatctggtcgaacatgacggaggcgaacaccggagccacctcggccggatcgatgccagccgcccggagtgccccggcctccgtgatcttgatggcggtgacgtcttcaagggtaagtacgcggcgggtgctccgctcccaggcaatgccaggcacgcagaccctgccgtcgtcggaaaaatccacggcgaagcgttcggagtttgccgcctcgtgcaggtagtcgatctcctcgaagcttgtctgcgcaaattcctccaccagggccggcatattggcgcggctggacaccaggcgaatgcggctgagccaactgcctaccttccgcagcgctgcaaggtcgacgtcgacaatcgcgtcaatgcccggacgctgcaccttgagcaccacgtcggtgaacccggtgtcggccgcatccgttgcacgaaggcgtgcccggtgcgcctgtcccagggacgcggcagcgattggcgcctcctccacgaaagcgaacaccaggtccagcggagcgcccaactcctcctcggccaaagcgcggatcgcaggaaacggaaccgggggcacctcgtcctggagcccctcaagctccctggtgatttcgggcggcagaatatcgagcctggaagaaagaaactgtcctaccttgatcatcaagccgcccagctccacggccagtccgtggaagcgccgggcgaaacgctgcatccttcgcggccgcgtacgctccgcgacccgggcaagtccgatccgcgggaggaacagttcaaaccaccacgtcaccgccaggttccaggcggcaaagcgcaggatgcggcggtagcgggcacgggtgtctccggcgccggtggccgaagcggcccgatgcaggcggacagacgccacccgcgtcaatcctgggcgaggatcgcgtagagccggcgccgtgcgtcgtcgagcactgccacagcctgctgcacctggtccggcgagccagtacggcccacctgggctgcagcctgagcgagctccacccccgctttgggcagggatgcaaacccgccggcatgggaaccaggagagtcccagggcgttgctccgtggtcctgcgcaacttcctcgcggccggcctcggtcagcgaatagatcttgcggccgttggactcctcagcactgatggttccctcgtccgcgagcagctgcaaagtcgggtagacggagccagcgctaggcttccagctgccgccgctgcgctcttcgatctcgcggatgatctggtagccgtgcatcggccgctcagcgaggagcgccagcaccgcggaccgcacctcacccttgccggcgcgggttccagcgcgcttttcgaaccgtgagcgcagctcctcgacggcctgccacatgccgtcgatgttgctcccgccgaatccggctgccgggtatgaaccacgcatgatgatctcctttgaaaaccgccaacgatatacaacgatactcaacgatacatcccactgacccggcggtgttgccgctgttcggctgcgttcagtcaccgctaggtggtgcttcgagtcaagggacggaatccgtgcgcgtgcgtccgcctcgtatccctggcgattagggacgcggaagttagtggacgcaggtagtacatggctccggagactctgcaggattcggtatgtctggctgtttgggtgaccggaaagtacgtgcattggtttaggctgcgcggcgggcggaagagcggctgaagccttgtcctgattgcaccaggttcctggcgctgcggagtcttgcgttctcgtagtcgagcagtgctgtggtggtggtgccggagaccgtcctggcgagcgtcagagcagtcatgagccctgcgagggacgccccgatgatgagagccgcgccggactcctcaccgaccacggcgtcggcagcatcccctacagcccgcttgccaaaggacgactcgcccgcccctggggcgggaacaccgcacggtccgccaacgaccccgtagccgagcgcagcttcagcgacgccgataaaccgattgccgatgcagttcaagagatcgcagaagaacgcggaatccccatggcgcacgtcgccctcgcctgggtactgaacaaccccgtgtaaccgcaccgatcgtcggtgccaccaaggaacaccacctccccgatgccgtcgcagcccttgacatccacctgacagacgaggagatcaaaaccatggaagagccctacaccctcaggatgcccgtcagctattaacaccatgggcctcgggcctgaccacgcggccatctgactcctggagtctcaaaaccctagggtttcgaagcgctgaggttatgagctgcggagccgctccgcggcgtcgtaacttgagagacggccttggctggcttgcttagcgacggatgatgacggtgcctcggtcaacgccgcttgtcttagtgctctgagcctgtttatgaccatggtgtggagggcttccacgggaaccgtggattggtgccgccagcccagtagccgggggtttgatgagcccgtttagtagattcctgaatcatctccccgccctttccgcggcacctgacaccgccagccggtggtgttgttagaccggatacgaggagtacagggtggatatcgtgcacgagcgtgccgcgggaatggatatctccaaacgtgatgcgaaggtctgcatccggatacctggaacgcgggcaagaacgtccagtaggacagtggccacgtatggggcgacgacaaatgagatcatgcgtctgcgccgcgaccttgaggcagccgcggtgacggtggtcgtaatggaggccaccggcgactactggaaaccgttctacttcctgctcgcggagtcgctgaacgtgcaactggttaatgctaaagcggcgcggaatatccccgggcggaagagcgatgtttcagacgcgacgtggctggcggagcttgccgcccataatttgccgggggccagtttcgtgccgcccgagccgaaccgtcagttgcgggatttgacccgcagtcgatcaaatctgacccatgagcgcacccgcgaattctcacggctggaaaaagcgctgaaggactcaagcatcaaattgtcctcagtcgtcagcacgctgggcacccaaccggcccacaatatcctcgacgctctcgtatccggagaacgtgacccgcaggccttagcttcgctggcgcacgcctcgatgcgccgaaaatctgcggcgctggtcgaagccctcactggccgcttcaccgaccaccacgcgttcatgctgcagctacatttggaccgcatctatcagatcgaggcgaccctcgcggccctcaacacccgcatcgacagggtgacggaaccctttccttgcctcgggagctgctgatgaccgtccctgggatttcgatgaatgtcgctaacgtcatcatcgctgaagccggcgtggacatgagcgtctttgacactgcgggccatctgaagtccactcaaacccgacccggcgaccactatcttaaaccggcacagggaatcgcagcgctggccgtgtccagatcaaaaaccacggatctcgccgtgaaataccgtcgcagtcagtcccatgccggcgtcctgcgtgccgtagtcgcactccaacacacgctgctacaccgaacgcgccaagaaacgcctccaacgcaaaatggtctcgctcggattcgagcccaacctcatcccactttccgcagggagcccaccgtcgttttcttagtagacacaggaattcagctgtcccgtaaggggatcctcttccgggcggcctacctaaaactggaagaacgcgtgtatccttgctcctcgctcctgcatacttgccgggcgatatgagccggaggtcttaaagcttcagcaccgctttgcctggtaccggacagctgttgggcttggtgggcggatcccacgggaccggatcaaaggccttctcaagaattgcggactccccgcccttctcatacacaaccatgtggacgttgctgatcccaggccacacctcgactgcattttgggtggcagcgtcgaatcgagcccccgccgacttctcaaagcactcgctcttacccggacagtcaatttcgaattccaggtcatcagcgggtcgcccaatcgccgagaaatcaagcgtgaggatgttcggttccagcgacgcggaacacgacggcgtgtagcaggccgtcagagaagaagtggccatgagtagaagcggcagcaaaggcgcgcgcaggagacggggcacctattcacggtaaccctagaaacaagtattgctatcgaattgatttaaagttttgctgcccggtgactgaggaccgcctgcggacaaaagtgcctactgaacgatccttgagcgcacaccaagaattcaaagcatgtggcccgggcgaagggcaggctcggttcgaaggggcgagctatagcattgggcggatgaaggttcctaaggtccaaggacgctcagagcggaaactgcaatgatcggcgaccgggatcgggatgcttcaaggcgcccgcggcaggcccggccacgtgacgctcttggacggccgctgccgtacggaagcgccggcgtggagccggtctccgaggagccgctgccaccggtggagacgttggtctcggccaggagcctggtcgaagcgggcaggcccttcgccgcacatgaggtacttgaggcccgatggaaagctgggccttcccaagaacgcaacctttggcagggtctcgcccagatctgcgtcgcgctcacccacgccgcccgggggaacagggttggcgcgctccggctcttcgagcgcggtgcggcccgactcgaggagtacggtacaggcgaagggccgacctacgggctcgatttgtccgcccttgtaagttgcgcgcgtgatcggctgggcagcggcccctgagctggcggcccaacaacctccggcaggcggcgcaggcactatctccgggagactgctgacagtttgcttgacagtaacttgtccttgaggggaaccctcaacgcgacagtttgtggaccgttgccgaaccacgggatagctctttgacccttgagcatgagcatcaaccttgatctgtggcgctggagtcctcttagtatcgcccgcttggcccttttactttccggttacaactccagcaagcgcaccagcgacgccgccagcaaaagtgcttatggtcgcaacttgaatggcaaatttccttgccttctgttctccaagccgctcctggctgatgacggggcccttcttcatgaccattgccaatcggctgaagggtaccatcgcttcttctacgtagcgttctatctcccgagtgttgtcacgaacagccctcccattgctgccagcaaaatgaacgaccatgtaaccctttcgctggcctgtcttcctgtctctggctggcccctgaacgtgaatagtaaaaacccctgagacgacttggatgtgctgacgctgaaaatcgggcagctgcgcgatctccgggaccgtcattgtctgaccttgcacgagaaaagatgaggctacgccactcacttgttgcgcggttcgtcccagtccctctagtgattcgaggtttggaaaacgtgccggccaagttctgattcgggttgaggggatagctcccaggggctcttccttgtcctgccatgctttcttgcccgaggggccgagaatccaaggagtcttatgcatactgccaactctctatagtgccgagtattagatcatttggagcctaccgcgcaggtcagcgacactcgtgtcgatacgtatcctgcctagctgggtttcaatcacagaattaatttttgcctgccgacggcgcattcgcgttggcagtcgcgaattctgccgtcgcgtctgcctcattggtggcacagggaatggactcgggaccatcgtctggctggggctcctgggcggtgtagcggtgagggtggtgtctggggaacggatgatgagcatccagtaggcagcagggcagcgatagccgtggcgggggaaatagtcgtgttcagggttgtccagtgtctatgaaggaacgctctacgagacagttttttgtgtggacgggcagaccacaaggggatccttgagcggacacgctcagcttttgaggatcatccgcggaggaatcagaaaagtgcttccccacggagaacgcgctctaaatcggcgctgttgaggccacttgcctcgagtatccagcccacgccgtagccggcctgacttgaagacctgatctcttcgccaagttctagggcagcagctctgcttgcttcggtagtttcccgcagcttagcgaccgctgcttccagaggtaggcggatctccgcgggaggaacggagtacctagcgctttcgtcatcaatgcggaacgtccagtcgggctccatgtggtcctccaaagtgatgtttgcctatcggtcagcttaaagaatcaaagacgagacgtaatccgtttcgaagcatttcgaagccgtagtcgtataaagacggggcccagtagaggatcccgcagcggacagggagcagcgccagctccatcgagaggccctcgccttagcgatcgtaagcgtctgggtttgatgaactccggtacttgacgacggccagcccaatgacattggcggcggcgaacccaagggccaacacgattacaacgaggttgaacgtgatccagaacggtgaagatacttggttgaacagtgccacaactccagggacaagtccgccgatgacgcctgccactgatggaaaccagggcttctttccctggccggtcttcatatcgtcgttcatggtctgccgaacctctttcgccatcgcgatgagccagccgtggagttgatcttacgcctccataaatttctggacccgactttgcctctccgcccgtaagccggtggctggccgcgacgcttctacgcaccttacgaccgcaatgcttctccgccgcgtttgaggaaccctcttcgggacacaaggcattgagtacatggcactgaccattccccccttgaaagaccgcaggctagacgagagctccgtcattgagttgccggcgctgcgagcggcgggggagcctccaggcccaatatgtgatgaagagacctgccgtcgtggccccgcccgcatacgtccatggcgaggaccatgacccttcgggggtgggaatggcaaaggcaatcacgacggcggccacggccaggaggacttccatggccgcctgcagcggcttggctcggtactcggggtaggccagagggccagggggatgatcgggagcagaaacaggccgagggtgaagaccacccagatgatgttgatcgtgaagacggccaggcccagcagtagaagcccaaggaatttcagtacgtccaccgcccggagcggattcgccggcgtccacatgttcatgagcagcgcccacgctgggagaccgagcagccagccacctgcccagaagcctacgttcagcagtgctaacggcacgagcagggcgccgggaagcaggaacgccacggcctgccgcagtgatgggagtttgccgggggccgaagatgcacaacccgaccagcacgtacgtcgtcgcgtaccaaggcagcagctgaatcagaggatctctcaggctgaacaccagaagggtgagtgcggggaccatgatgcacaccgcggcgaacggccacggacggcgggtgctcagttggttcatgacggcagcgacgccaaaatgtcgtgtggccactccctcgtgagcacgtcgttcagctcctggttcgagctggagacacaatatggagtctggtttacgtttaggacagccagatttactggcacggcaaagaggtcccaaggctggatcctattggctaagtacccagtgagttttaggtcggcgtactcgggcgcgttccagaccctgcaggcgcgctggaggtcatcggggtggatagcgatccagaccccaaaccggaactcgtgcccgcctaacaacttgatcggaagcagggcacggacgaaaggactgatattcgggatctgcatgagcgtggccctgttggggtccgggtcgctgagccagctgtcctcgacccggtgctgttcagggctctccagcactggatccgggagacggaaccggacatctctatcgtggaccgccagagtttccccgcacatcccgcacgcgcgcttcttgccgaacatcacatcccccaatttgtagtttctcaggtgagtctatgtctcggccaaccgaacgcacggaagatttagctgctcgccttacgttgaatcgtgaggaccgatgacccattagccgaaccctctacgggacagttttgtggaggggcagcccttaccggacatctcactcgttctcttcagcctccgcatgacgctgcaatgagggtttcggcccgcccgcctgctccggcatgccgcttcgggcttgaccgtcctgaacgaaagtgattctaatttggctccccggctcaaggaacgatcctgcggtcgggtcttgggaggtcacccagaacagccccggccaggtacgcgaacggagccccggcccgtcggggtccccggctgcgagaccgaacccaacgtccgccgccatctcctgtgcaatatgcacaggctgtcccacaagatcgggaacagtcagcatctggcgttcaaccatctcggcatctcctttgagctgaacagcaagaaccgtgaaaccgtagcttcagcccccagaatacttctggtgaccgggtgcggcgcccggtagaggaaccttcagcgggacgtcgaagatcatctggactccgctgacctcttggactttcgccacatcatgtaagaagcaatggcaagaaggaggaaggaaactgccaggacgaccttcatcagatagtccggggtcccactcgaaatgtcacggacaacttgaatggtccaaacgactgtagagagcgaccacaacacggtgaaaaacaagagaacacgtgggctttgactcggcggtttcttacctggctcggtcaggcccatattgtccgtcattcgcagccaagcgctgcgtggcctgccgggttccatggctagagcgtagccgcactctaggggcgggggaaagagctgcgggtatccctagcccgcagcggtgggtgaccaaattcttaagagagggtgcagctggatcgcgacgtttctacgcctcgtttggggaaccctttacgggacaccgtgtcagggtgatcatgcagacaccctgcaagcccgcttcagacgtgtgtgggcagcgtgcgtatggtgtttgcatggcaaagactcctggcgtccttctcgttccgagtgcggaatctgtggtggcctttattgatcgcgttgtcactttagattggcccactggcgtcgaggatctaggcaactactttcccaggctgggcctccacccagccgcgggacattcacggaatttcgattctccagaagtcctaagaggggatttacgtagtcctgacctggctgcgtctgccgcttcttggatgtcctacaaagccgaactcttcagcatcaaccttttcctttacgaagattcttcccccagcggagccgcagccgtgacggcgtacccttcgatttatgagcggcttcaagcacgatatggtccgccggccgatgcaaccgccctcccgtcggggctggcgtcctctctctggaaagtgagcgacaccggcatagagatgtactgccacatcgaccccgcacccacactgcagctagggctcagccacattgcccgaaacgcggcttacgaagcacgcctaacatcatgaacgaatccgccccgtagagggaaccttcaacgggacgttcttttcccagcgtgattaatcctctagtggaatctgtctagccgtgctttcgttgagctatagagctgcatttggggagacacatggaacgccgtccggatccgaagaacgtccgccaggtcattgctgtctcgctcacggtagctgcgtccttggtccttttaatagttcccatgtacaccaaggtcgaactaacggaaggcgcgccagggcaggtaagccattccactctgcttgagacagtaggaccatctattttcgtgccgttgctcatccccatagtcctgaccgctatacctctcctgctccgaggacgtgcacggatacaagtctctgtcgcgacaactgttgctctcgccgtctttgtagttatcggctccgcaagcatcggctggttctacgtaccagccctgaccgccgcagtagccgccgttgttgctccgatggagagccgcggaaaacttctacctggccattcataacgggacttaatcaaatcgctctgctgtctaaacccaggaccttcggcacgcctgtggagatcggcatccgacggcgaagccgcgagcaacgttagaccagctgtggtgtcccgttcgagaaccctctacgggacagttttgttagagctgagtagttggtgactttcagcgataaatggtgcgttttcacagcactattggtggaatgagcagaccgcaaagggatccctcatccgacgctacgggcggggaccccttcattgctaaaagaactggtcaaggagccggtaaaaggtgacgcggttggtgtcggcctgttctatgccgtaacgggtgaggtaccgctcggcgtggtgtacgccgtactgggggttctgggcgctggtgatgctccgggtggccagggcgaggtcggaatactggtcggccatccctaggcgaccgacgtcgacgagccctgtaaccgtgaacgtgtcggggtcgagcagtacgttcggcaggcagagatcaccgtggcagacaactaagtcttcggaggtgggaacggtggcaaaaagctcatcgaggagttgttgcggtgtccaacccacatatgcggggtccagccggtccagatcaaccaaatgctgccgaactgcatgttcggcggcgggcatgatgacagcgaggttccgttcgtagggacaatcctcgatcggaaggtcatgcagcgtgcgggtgaagtcggctagtgcgtcgatcacgttaatgcgctggtcggccggccagtgttcggcgccggagcggccgggcactgccgtggtgactaaccaggcgcagtcgtcagagacgtcgtactcgacgacctccggcgtaggaatcccaaccttcgcaagccaacgcagacgctcagcctcggcgcctaggtcgtacccggcgtcgtgtctatttgtcaggccgccaagctttacaaacaggtcggtggctccgtccagcctataaaccagtgcgccagagcagccgatgctgattggagtccagtcatggcccgaataccgtcgtcgaagcgttttgacctgttcttctgtcactcttcgatggtaggtcctacttggctgcaccgaccgcccgtaagccggtggctggccgcgacgcttctacgcctcgtttggggaaccctctacgggacgatgccttggtcgtcagcgtggccccgcagggtgacgtagtgttcgcatgcgaccactacgggagcctacggttttgccctcagttgccggttcctcgacttgagcattatccagatggccgtagcgaagaccaagaaaagtatggcaatcggcaggagcaaaaagcccgtgctggtgtcgcctgccgctactgtaacgccggcgatacagcctagaacgatccctacgactgccggcaacacggcaatccttgcccaggttttggcatcacgatcgctgaggtcggccgccctaaaatgaacgctctcctccggctcataaagctgggcaacgaacaaacctaggatggcgggaaacaacccgagagctaggttgccgccggggcgctctgggctgacagaagtgagcgcgacagtaacgatgatgagggctacggcgacccccatgagcgcgaagtatttccaccgtcggcgggtcctcaccaacctcccggctcgggttttcccgatcaaaatcactccgcccaaaacaaccagcaaagcaggcatgaggctttgaagaaccccggccagcgcctccggcgccgttcgccaaatcgctaggaaggaaactacggcgagagctatgactaccagagcgtccgcgatccggagcttcccctcagtctcttgagatgccatgcctaagtgcagccgccagcagcccagttgtcaataagtcaactagccggataaattccgcagctcgccaaaccaagccgatgccggtgaatcacgggtagtgactagggctggtaactgtccccttagagtggccgaccggcgaagcttctgcgcgttagaggaactttcagtgggacgacggggccggccagctggcctgctgggtgtcagctttcgtggctctgtccgcgctgctttgagagggctctttgctcctcatgcttgtgtaacgggagtgaccatgacactgccaatcgagcggttcactccccacaggaggacagaaccgtcatctttcctgacggctatggtttgtttgactgccaagatgtcgatgttctcggggtacgcgtgccccgtcttggtgctgaattcttctccaaatctgcggttgataagaggccgaagcagtttctgcttacgggatgcatagaacgcgaacccagcggtgagaacgagggctacccccatgatggcgaagctgatctctcggggaacctcgatgtttccgaatgataaaacgagcgacaggatccagaagactagaaagagtaatcgccacgaaacgtccagcgttttgtattttcgcatctcgggcaagtcgatcgtgaaagtgttcgagtcattacccatggatctcccccgattcggtgatgggcaaatcctattaccccgtcgcttaggcgagaaggctagtcgggatcctaatgccaggccaagggcccgtaaggggcccgtcccgcaaactgtcccgttagcggtggccgaccgcgacgcttcaacgcgtttgaggaaccctcggcgagacgaaagaggtagggtcagggcatcagatgcgccagaatcttcagggctgctaactgagggtagtcatcctgcggcattttcgtttgatagtcgtccagccagtagctcatcgccctttgctcggtgaggctgaagaattcggggtttccattcacgaactgtttataagcctgctggagacccggcctttccggcagttcgcgtttcaggaaggcatacacttcttctccaacctcgatgacgtactctccacagagttgaactacgaaggggatgggccaagagtcttctgaagcgaggatcagggacagagcttcttgccgtacccgcccatcgtggtgccttgtcatccaacaagcaaggactagctgctcatcaggtgtgagttgcgacctcacctcctgttcgggccaggagtagtggatgcggtacggaatctgcaccagctcgcccgcgacataaatttccgggctatcggccacgtgccagttcgtgtcctgaattaggcggggagaggtaccaatttcgggtggatccaagactttcattgtccgctgagcggaaggccgggcacttagagggatcgaacgcagcagtaggggatctttgaaccaaggttccttcatccgctcattgaatcattccctgaggattcggcggcaagtagcagcggtcagccgagacatcctctgagcaaggtcgcacatcagaatgcatcggcgttcgggggacggattcaaaaccgtggctgtcgcgtaaggggtctgtcccgcaagtgtcccgttagacggtcccttatcgggcacctttcgcccgacaggcaaccggcttacgggacgattcgattgcttatacgaaacatggagggtgggcggtgctctggtagcgtcggtcaacgaacatttgggggaaatattgaacgtcgattttgctggggtaaccccttatcggccacgcctagccgtggtcttggctacgatcttctgctcggtggcagttctgccggcgattccagccactcttattgccggggcaacaatcatgtccctgctcaccggagccggggctacgttgaaccaggcgctgcaagtcagcgtcgttttggcagtcttcatagctgccttagtggcgttcgtgatgatgcgacgaagtatcaccgcgcgtaggacctgggtatgggcaggcttgtccatcatcctcgttgcagcagcatccgccccggttgtttgggttgcttcacagaactttattgaagagtggtgcgaatatcagcctggcggcaggggcaatgccgacactggctcgcttgatgaaattccggccgtgtgtcgttaagccacaaagggttcctacctcgcttgaatccggaaagacgtgccgaggtatagatgatggcatcagccgtccggagagtgatccccttgtgcagtggctccatgcgccaaatagcgccgcgaaaacaccgccacttattgccgaaagtcacagcgtcatccgggcactcgatgattcccataagacccgcccgcaaaactgcccggtgaaggtgccctaaacgctacacaccgaattgcctcgaattccttggcttatgatgcgtctcacgcccgccgaacaacgccaggccggcaaggtcttgattcgcgtgatctaccgcgacttccaccgcggccggcgattctcattactatgtcgcagaccccgctggctgaatcggggcgaattccagtggtgcctgcaacaccggatttagttgactgggttcgagattagctcggcgaggacttctgcgggcgttcggtagccgtgtcgtttgcgtggccggcggttgagttccgcggcgacgttctcgaggattccaggcccatggaaagacaggtcggtgcttttcgggaagtactgacgaaggaggccgttggtgttttcgttgctgccgcgctgccagggtgaatgtggctcacagaaatagatcggcatgccggtagccatagtgatctcctgatgccgcgacatctccgctccttgatcccaggtcgtcgaacggcgcagctgctcggggagggtattcatcgcggtgatcatggcggcggcgacggtgcgggcggtgtggtcctcagccagatgcagcaacatcacgtatccgctagtgcgttcaacgagggtcccgatcgcggatttcgatgccgttgaaccgatgattaagtccccttcccaatggccgggaacggcgcggtcctcgacctcggctggccggtcagagatcatcaccatttcctggaaccgttgcgggcgaggaccttccggcctttgcggccgccgacgcacccgtccggaccggagcgccgtcgcaacttccaggcacaaggatccgcggccctggacgtagagggcctgatagatcgtttcgtgtgacacctgcatctccggattctccggatgctccaccttcagtcggccagcgacctgttccgggctgaaccggtcggtgagcatcgtcgtgacctggtcccgtaaggctaacccgtccagcttccgcggcttcggcctgcgggcacgagcccacgtttgctcctgtacgagcgatggcgaataccggtcactgacgcggttcctcgcgatctcccggctgattgtggacggagcccggcccagaatggcggcgatatgacggactccatggccctgggcgagctggaagccgatctcttcccgttcacgcaacgacaaaagccctgcacggggcacactgaaattcggaacgggcgatggcaacaccttctgatggtcgctcaaccaccggtatgcggtcggacgcgacacccccgcggcctgcgccgccacggctaccgacagcccggcatccagcccttcccagaacgctagtcgaacacttaacggcgaccacggcctacccatcgacgacaccccacagaattcagggtgttgcactcaccacctgaactcgcccggcatatcactcattagttgtgagactgcagtatctcgacccggcagcggtccactaatcgagagcaggtggatcttctgacgttcggcgtccgccacgatgaccaccacattgttcacggtacgtcttgagtgggagcttcacgaccccacatcagcaggcactcgaggcgctgatcgatgggacaccctggtcatcacaacgctggacagactcgggcgactgacccagaacagtcctgtcttcgacgacgaacccggcaacgcagactgcgatcccgaagcgcaaggcgccctcgagcccgggatgtatcgggcagccttctgcaggcggtcacgagcattcatgaacacgcagggctccgcacccggcggtcccgtcaggtctttcggagcgtgaggatctgctccgcgcgcccgaacggcccctggaggtcgtgcagaacggtggaggtcagccctattccgtccccgccgaacgagacagcgttgtccaggcccagccactccccttcgggccggcggtacatgtggatctgcaggtcaaggttgggaaaggagtagctgtccttcccgggcggaacccgggccgcgatgccgttggccgtgtccaccatgcccatgagcctggccagggcaccgctgtccgcgcggtccgtcagggggtgttccgtacgaagccagacctttccggccccgggccggtgcccttccgcaacgcgcatttccagagagcggatgtagccgccgggccacacggacgcgccgtcgtacggcttgcagtcttccggaccgggaatgggggtgtcctcgatggcggctaccggtgttgtatcactggtagccagccgccaggcggtggcacggatggcggtccgcccgcccgccaccagctcggcctgcaggagttcgatggtctttccgggccggagggtggcggccgcgatctggaattcgccgcccgggatgaggccgaggatctcgtagctgatccgcgccatccgcatgtccggccgcgggtcatggcgttccaggctgtccgccagcaggcccgacgccggcgccatgtgctgctcgtggacgttccaggcaccctgggcatggatggtggaacggaaacgacctccgcccaggttcaggtagtagaagtttccttcagccagttcaggcagctctgcgctcaacgttgaacccctttgcagttccagtgaatcggccttaactctatctgcgccggcgccgccgctccgccggacacgggccaaggcattccaccggaagggacgcggcgaaatgttggccactagcagtatccatccgactagactcaggaactggtcctgtcagcaaccctcggaagaggtgttccatgcgcgtcatcagctacaacctccgcaagcacaaagcgagtggcgaactcctcgccctggcgcggaaccatgacattgatgcgctctgcctccaggaggtggattccagcgatcttcccgaaaccctggggccgctgcatctggccgatgccaccaaaggcaaccggctggggctggccatctactaccgcaccagccgcttcaccgccctggacacccagtccttcgccctgaagaagtcgatgcatgaccgcgtccttgccccggcccatgagcggctgatcggtacccgggtcatggacaacgaaacgcagcatgaactggtgatcggctcgttccacgcagccccgctcaccgcgtccaactcgctgcggcgcaagcagatccacgcggcccacgctgagctgctgagcatgggcaagggcctgatgaccctgatggtgggcgatttcaactacccgttcttcaccaagaaccttgacctgcacatgaaaaactcgggctatgcactctccctgagcaaccggcgcacctacacccggtacaaggtgttcaagggccacttcgatttcgcgacgtcactgggcctggatatcgaaagcgtggagaccctgccgcggggcaattcagaccacctccccatcctggtcacagcggagtacggcccggactactaggactcaagccttgcacggaggtccggccaggacgcttcgaacccggggtgcagttccagtccggccacctcgggcagcgggacccaccggagctccaggctttcgggatcgctgatcacggggtcaaaaggctccctcaccagcaccacaaccgtggtgtaggtccagtaccccacgtccagcagggacgtaaagagcacctccacattgtccgcgggcacggcggcttcctcataggcttcccggagcgcgcccttgacgggctcttcgccctcatggagtgcgccgccgggcaggccccatgttccgccgttgtggctccatacggcacggtgctgcagcagcacccccttgccgggatcgtaggccagcactccggccgccccgaagcgcccccagaagcgcccgcggcttccctcgacccaggcgtcgccggggtccctgggaccggtacggacgggaggggcagaggacgcggtggacgccggaaagtgatccatcgctccagtctgacaggtgcagcgggtgggctgcaccccccgatccgctgccccggtcaggcctggttcgctgtaccgcgctcgacggcgaaatcaccgccggggtacatgatggtctcgtgtccgtcatcaaagcggacgcggtagggcggcgttccgccctggccgcgcacctcaagtatcactccatgccggtccgccgcccccacagtcctgccgtgcacgatgatgcggtcgccctgcgttgcctccatggcaatcacctccgagcccagagtacgactggctgcccgcagggaaaagggcgaatgggaacaccggccggaaaggcgcgctggagaaggtcataggcgggtccgcgggaaccaggcgggcatggcaggatttttcccatgccactaaatctcgtcctggtcgccgatacccatgtccccaagcgcgcccgcgatcttcctgcacaggtgtggtccgccgtcgaaagcgccgacgtggtctttcacgctggcgactgggtgtcgggctcccacctggaggaattccataggcggagccgcctgctggtgggcgtctacggtaacaatgacggaccggagctgcgccggagccttccggaaacggcggagatcacgctggaaggcgtccgctttgccatggttcacgagaccgggcaggccaaagggcgcgaggcccggtgcgaggcgctgtacccggaggcggacgtcctggttttcggccacagccacatcccatgggacaccaccacgccgcgtgggctgcggctgcttaatccggggtcgccaactgaccgccgacggcagccggcctgcacgttcatgacggccacggtggattccggaacgctgggggacgtccggcttcacgaggtccgccgggattgacccgggttggcaagggagacatttgatgcctaggctggaacggtaagcatacttagctttttcacgttcatccgagcatcaggaggacagccatgacagaccagtacaccttccgcaatccggtcaccgcgtacgaaaagatttcgccgccgaagcagcaccagcccgagccgggactggacgcggagctggcacccaaggccgacctgggcgaggagacctaccgcggtaccggccggctggaagggcgcaaggcgatcgtcaccggcgcggactccggcattggtgcggcaacggcgatcgccttcgcacgagagggggccgacgtcgtcctgtcctaccttccggaagaggaggaggacgccgcgcgcattgcgggcctcatcgaggctgccgggcgcaaggccgtcaaggtcccgggcgacctcaaggacgcgtccgtgtgccgcgacgtggtggacacagccgtggcggtgctgggcagcatcgacatcctggtcaacaacgccgggaagcaggtggcgcaggaggacctcgccgacatcaccgatgagcagttcgaccacaccgtgaagaccaatgtgtacgcgatgttctggctgatcaaggcagcgctcccccatatgccggccggatccaccatcatcaacaccacgtccatccaggcttacaatccgtctccgacgctggtggattacgccaccaccaaggccagtatcaacaacttcacgaagggcctggcccagcagctcgcacctaagggcatccgcgtcaatgcggtggcgccgggtcccatctggaccccgctgcaggtcagcagcggccagccgaaggaggagctgccggagttcgggcagtcgacgccgctgggccgggccggccagccggcggagctcgcccccgcctacgtcttcctcgcctcgccggagtccagctatgttgtgggcgaaacactgaacgtcaacggcggcagccccacgccgtagcccaaggctccaaagacaaacggccgacggcggtgcctggcgcatggtgcgcaaggcaccgccgtcggctgttaaagttcggcgcctattctttgtccgtctcagccaacagctcgtcagtggcggcgtcgggctgtccatcgaagaactgggccaggaccgttttgaacaccgtctcccccggggctgcccggaggaacagcgtcacggaggagtgcagcttccgggcgtcgatccccccgaagatgtcctccgccgggacgcctgagtgattggtgacggcaagggcggactcgagcagccttggtcccagcaccgggtgggccaggtattcccgtgcttcagccagggagctgatggcgtaccggcgggacatctcactgtgccccaggcctgcgatctgcggaaagatgaaccacatccagtggccggacttcctgcccagctgcagttctgacagggcctgatcgtaagcgccgccgctctcctgcgcagcaacgaaccggtcaaggttatagggatcgttcatgggtgtctccttgtggtggggcttcgggggcggcttgctggtggatgaatgcggcggcggcgcgcagctggctgtcggagtccgtccgccatcgggccaggacaacatctgcgcgctgccggtcccgtccgccgagccgcgccaggaacggcgccacgacatcggccagcagcggttcggtcagttcccgggtcccggcagaccgcaggaagccctcaatgcgggtcaggtccgagtggcgcaggagtgccctgttggattgcagcagcacaacagcggcgagccggcgctcaaaaacggccctggaacctggccggggctggccccacagggcggatgccagctgcacaacggcgtcgtgatcgaggtcgttgtacttccgcagggcgtcgcggacggttccgcggaccgcgcccaccgacgagccgtaagaggagagcttgccgcccagcctgccctcgacgtcgtccgcccggtaccaggcgccctcattctgcagcgtgcggtcaatgaatcctgcagcagcggccacctggtccaaggggctgctcaccggctgcggcctgccgacgcgtggcggatgcagaacggggtccaggggcgcgcctccagcctgccttcggcgatggcttccccgcacacagcgcaggtcccgtacgtgccggcggcaatcctggccagcgcggcgtcaacctggtccagccccgcactgctttgcttcagcagggccgacgcctgggacagctcgaatgcgatagtggagccttccgggtcgtgttcgtcgtccacgttcgagtcctggcgcgccgagttggcggaggcgatatccgcgcggagggccggaagcagggccaccttccgttcccgctcctcctcaagcagcatccggaagcgttcatagtcgggcatgggaaaagcctacgcggggtcagtaccagttctttgccatggaatggttccaggcggcgcagggcgagccgtaacgctccctgatgtagccgagcccccagtcgatctgcgtccggtagctggtaagccagtcggcgccggcacttgagtacttgccgggcggcagggcctgcgcgattccgtaggcgccggaataggggttggtggcggtggtcagccagttcgattccttggtccacagctgggccaggcagaggaactggtcctggccccagccgtgggcgcccaacctggtggaggcatagcttttggctcctgccgggtcattgaccgcgccgccggggagggaaggcacgacgacgggcggcgggtttggcggtgcgggggccggcgcgggagatgggttggccggg

SEQ ID NO: 35 - DNA, 532029 bp, Arthrobacter sp. OY3WO11
cagcagcacgcttggccgcctgggatgcctcgtaggcggccagcgccgcctggccttgccggtaggcgttctccacctccgccgtcgtgcctttgagcgacgccaactgcgctgttaactgcccgctgcgttgcttttcctccgccgcctggcgggccacggcgtcgtgggccgagcgggccgctccgagccgggcttccgcttcgagggccagccgtccgcgctcatccttggcagcctgttcctgggcagtcaatgcagctgcgatcttccctgccgccgacgccttgtgcacgagggcggcggtcttgtcccccacgatctgcaccacattgagcccgtgcacggtgttgccctggacagcgtcaagggcaacaaagaaccccatgttcgtaccaccggttttgtatgactgggccgccagcgcaccgagctctttcctgtgccggaccagctcagagtcagcctgagaggcctgggccgtcagggcttccacccttgcagtggcagcctgcaaagccgcatccgtcaccgcatactccgccgctgcctccaccgcggcggagccggcggcctcagactggtccttgaggctggacagcaaaccatcgatcctggcaatttccgcggctttcccggcctcgctctcctttgcgtcctgcacctcctcccaggaggggtaaccgccaggcggatcctccgcagcgcccgccggtgccagccagaaagttcctgccagagcgcacgaaagaagcgccgcgggcagcagcgccctgggtttggtaacgaaccgggacatagtcgggaagcttaccgccttcaccctcaggttgaaggaggacgtttctacatcgttatggaccggagacagttgcttttacggaaaggtccggaacactcgtcttttgcaggtgctggtcccttacagatgctggacgaaccaggcgagggtgtcgttccacgcggccgtagcctgggcttcgttgtagcggtcgccggtgtcgttgtggaaggcatggtccacgccggggtagaccgtgagctggtggaccgcaccggaggctgccagcgcatccttgagcgcaggcatggggccggtgatacgttgatcgagttcagcgtagaccccgaatacggccgccttgatgtccggtactttggcgaggtcaggggcgggcccgtaaaacgccgcggttgctttcaagccgtccagttcggcggccgcctgccaggttatgccgccgccgaagcagtagccggtcatggcgatgcggccgccgtccacgaagtcctggtcctggagatactccagggctgctgcgaagtcggccacgtgccgcggggcgccggcctgggtgagggcaccgggtacggcgtcgcggtccattccggccgtcccgccttcacggctgagcaggtcaagcgcgagggcggcgtacccctccttcgcgaagcggcgggccacgtcttcgatgtggggcgtcagtccgcggttctcatggcagatcagcacggcaggactgcgcccgtcctgctccggcctggccaggtaggcactgacggaggcgccgccggagggaaactggacggacgccgtcgtcaatcctggcgccccctccggaacagagagcgggctcttggccccggggaccgctcccgaccccgcagtcccggcagcggacgtcggggacggttccggggtgggcatggggtcggtgctccgtggcacctcgctgggggtgcagcccaccagcagcatcgccgctgacgctgctgccatgctgccggtaatgaaggcaacccgccgggtgaaggtccgctggctcagtgcgccggaccggtagtcgtcaaagaattcctcaatcaggtacttctcatacttgccaagctgcgtcacagtgcctcctcggggtgccgaacatactcctcccccgcccacctccggacaaggccccccggcgatctttgcttgtccttaatcgctttgtgataaacaacatgccctgctaaatcggcgcgcctgtccttcgcctttgttgcgctgtggcacacgaaatccagtcgatagcgaaaccgagagaatcgcctcgcatgttatccaagtgtgacaatgggtgctaagtcgggttatggtcttcaggtgtccctcccagacgggacattccccgtcagaatgccgagccctgccactgacccgggaaccaacgctttccagctggcagggacgggggaaccaagtttccgcggcctttgaaggccttggggttaagtcgatagcgcgtccgttccattcggacgtgttaccggccgggtatctccaacccgaacccgacagctcaccccgcaggcatgggagaggcgatcaactgtgtcaaaaaattccaccactgcccgtcaccgcgcaaccccggcccgctccatcgcgatcgaagggctggctgtttcggccaagtccctgggccgtccggctctcgccgtagcagcagcctccggcattgccttcggcgtaggcgccccggctcacgccggtgtgaacggtccggacaccaccgagaccgctagcgtccaggcttccgccgcccctgctgcagcagtcgcagcccccgccgcagcagccggcaacgtccacacggttgtatcgggcgacacccttggtgccattgcgtcgctccacggcgtcagcctgaatgacgtcctgtcggccaacgggctttcggtctccacgatcatcttccccggtgaccagatccagattcctgccgccggttccgcagccgctgccccggccgcagcctacgttgccccggctgcagcaccggcaccggctccggtccagaccgctgctgttaccaccccggcgaacaccggaatgaacatgtcctacgcgtcagctccggttgcagccacgggcagcggtgcaggagcggccatcttggccaacgcctacggccagctgggccagatccaggactgcaccgccatggtggagaaggcactgcgcactgtcggcaagtcggttggcgacctcgcccccggccagttctaccagtacggcacccccgtgggcagccccgctcccggcgacctggtgatcaccgccggccacgtgggcgtatacgccggcgacggccaggttgtcagcggcggcgtgaacggcaaccagaccgaggttcactccatcagctggctcagcggcgcttccttcgtccgcgtggcatagtcaccacggacacaggtgcagctggcccgtaagggccaggccactccagacaagggcggcagtcgggttctcccggctgccgcccttgtctggtttcctaagtttttcttcctgacccgtccggagcccagcgccgccccgggtcaggtaccgcagaaagtccggtaggtgccgaagtcttccggcggcccctcggtgtagcgctccagcccctggcgttcccggaacggggacctcaccacctccaggaggcggttgaatgggcccatgtccccctccgtggccgccgccagggcttcctccaccaggtggttccggggaatgtacaccgggttgacgctgtccatcagaccggcatcgggcttcaggcgagcccagcgctcagcccaagcatcaaacgcggcgagatccagaaccatgccccgcgccggcctggtatttccgctggccgcctgggcgaggctccggaagaactgtgtgtaatcgacaggtccgtccttcagcaggccgatcaccccgtccaccagctccgatgcttcgtccccctccttgcttccggccggcccacctgcgatgccaagctttgccttcatgccgttgaaccaggcgtcgctgtactggctgcggaacttccccagcgcctccacggcgggggcgactgcctgttcctggtcctcgtggaagagcggcagcatggcctccgccagccgcgccaggttccactcggccaccaccggctggtttgcgtaggcgtagcggccgccgacgtcaatggagctgtatacggccccggggttgaaggcgtccataaaggcgcaggggccgtagtcaatggtttcgccggaaatggtcatgttgtccgtgttcatgacgccgtgcacaaaccccaccagcatccaccgggccaccagcccggcctgggcggccaccaccgaggcgaacagttcaaggtagggattttcagcctgcgctgcggccgggtagtgcctgctgatggcgtgatccgccagccggcgcaggagctccatgttgtccgtggcccgggcatattggaaactgcccacccggagatggctgctggccacccgcgcgaggacggcacccgggagcatcgtgtcccgtcgcaccgggcgtcctgtggccacaacggccaaggcccgcgtggtgggaatgttcaaggcgtgcattgcctcgctcaccaggtattcgcgcagcataggcccgacgacggcgcggccgtcgcctgcccgggcgaagggtgtgcggccggagcctttgaggtgcacgtcccgcaggcgcccgccggcgtccaggagttcgccgagcaggagcgcccggccgtcgccgagcagcggcgagtaaccgccgaactgatgcccggcgtacgcctgggcaaccggggtggcaccggccggaacgtggttccccaggaggagccgcacgccttcgggggtccggaggtattcgggggcaagtcccagttcgccggccaggacatcgttgagaacaagaaggccgggttccggcgcttcctcggcctgccagggaacggcgagttccgggagttcactggcgaaaaggccttcgaaggtgacagttgattctgctgctgcagtcatgaatcaaccctatcgccgtcgttggttctgcggtttatcagccaggtgatgagccacaggattaccccaatggccatcagtccgccggcgatctggtactggatgatgttcctgcccacccaggggccggcgaggaaagcgcacagggcggcggcaacgagcggaagctggccgggggacgtgaagaacacctttcggtggggatcccgcttgcggcgcagcaccacgcaggccacgttgaccaccgtgaagacacacagcagcaggaaggcggtggtgccggacaagttggccacaatgttgctttcgggatcactggtgacatacaggatgagccccagagccaggacagtggagaaggcgattcctgcccacggggtccgccggaccggaaggactttccccaaagcgccgggcaggacgtgctggcgggccatgccgtaaatcagccggctggccatcagcatgttgatcagtgcggtgttggcgactgcaaagaccgccaggaaggggaagaccctgtcgatcgggaagtccggtgagcccttgtgaaccacttccagcagggcggcgccttcagcttcccggatgccctcaagttcggtgggcgagaggacgctcaccacggacaccgccaccagcatgtacagcagtactgctatgcccaggccggtgagcatggtgcggggaaagatcttctcgggattctgggtctcttccaccatgttcaccgagtcctcgaatcccaccatggcaaaaaatgcgatggaggtggctgcggtgacggccaggaacaatcccttgtcctgggagtcgttgaagacaaagatctcgcccgggtttcccgtcccctgggccatgacaaagaacccgacgccgatcacgatgcacagtgctgccatctccaccaccgtgagcacaacattgaacttgacgctctcccccacgccacgcaggttgatggcagccaggaggagcatgaatccgagggcgaccgcggtaatcacgccctgcccgggtttgcccatccagccgttgatctcaaggccgccaaaaaagttctgggccaggacgttcgcagacgtggacgcgctggtgattcctgagcagacgaccgcaaaggccaccaggaaggtgacgaagtggatcccgaacgccttatgcgtgtacagcgcggcacccgccgcctgtggatactgcgtaaccagttcgaggtaggagaaggcggtaagcgtggccaccacgaaggccagcaggaacggcagccagacgattccccccacggtgcctgccatggttccggtcaccgcgtagacgccggcgccgaggatgtcccccacgatgaacagcaggaggagcttgggtcccagcactctcttgagcgtgggctccttgccatgcgcggtaacgtctgacacttcttctgaagctgcactcacgagtggcctccatggctgacttggctgaatgaggggtttggcattgatgcatcgaatggcccacgccgatctgcggcaccttggggccagcgccgccgccgggggaaggggatgcgctgcaggtcctcagccgcgatgaccgcagcagtccccgcacgggcgcgggcctgggccgagagcagtgtggcgtcgtcgccgtaccgtgcggagaagtgcgtgagcaccagggtgcgcgcgccggaatgtgccgccagctttcccgcctgccccgctgtgaggtggcgatactggccggccagccccgcgtcgtcgtcggcgaaggtcgactctgcgacgaggaggtcgacgccgtcggccagttcctctgcgcccggacagggcgccgtgtccatcacgaaggcgaaacgctggcccggccgggcgacgctgacgtcattaagccgcacgccgcccaggctcccttggcgctgcaggcgccctgcgtccggtccggatatccccgctgcctgcaggcgttccggcagcagggtccggccgtccggttcgaccagccggtagccgtaggtttctatgcggtgcttgaggggccggaccgccaggccctcggctacggttccaccttctccgtgcgggtgcagcctgaggtcgatacccggtgtgctgacggatacaagggcccgcaccacgtcctcgccggaggatgggaagtggagatggaccgggtggggcacggcatcgagggccatgcgcgagagcacccccggcagacccaagcagtggtctccgtggacgtgtgtgaggcagatgcgggtgatcatgttcgctgacaccccggcgtggatcatttggcgttgcgttccctcgcccgggtcgaaaagcaggccctcgccgtcccagcgcaggaggtagccattgtggttccgggtccgggtgggaacctgggacgcggtgccgaggacgacgagctcgcgcattgtagttaagggccaaaaagcaggtgccggaagatccggtacctgctttgttggttgcggcggcggcttagcgccgccggaggattcccatgatcctgccggctacgccgcccggcctggcacctgcggcacccgtggtgccgggcgtccggccggtggcattcagaccggtcccgcgggcagtcccgccggtccccgtcctgcctgcgaatcgtccagcggcatttttgatcatgcttcccaagttcatgtgaaactccttcagtagtgatcctgccaaccgatattcatcagcctgcttatgattttagcgtagtttggccgcaggtcgaggggattagccaaacatccgcgccgtcatgtgaagtccgaagctcggcctgggagcccgggaataggggcggttgcccctatcggcgggctggtacggctgctaaattggcacgccataggccacctcccgccgcccgggaacccgttatccggaaggtaaccatcatgctttcagacacctccctccccgtgatcaaggcaacgctgcctgtggtcggggaaaacatccaagagatcgccaagcggttctaccagcacatgttcgaggcacggccggacctgctggacggcctgttcaaccggggcaaccaggctgacggccggcagcagcaggcgctggcgggatccatcgcagcgtttgcccggtacctcgtggagaaaccggaccagttgcctgaccacctgctgtccagggttgcccacaagcatgtctcgctgggattgagccctgaccagtaccagatcgtccacgagcacttgttctgggccatcgttgacgtgctcggcgaggctgtaacgccggaagtagccgccgcatgggacgaggtctactggctgatgggcaacatgctgatcaaccaggaacgggggctgtacaacgctgtgcacttgtcctcggagaccatctggcgcacctggcgggtggctgagcgcatccaggagacggacgacgtcgtcactttcgttgtggagcgcgtcgacgagagggaggtgaagccttccctgccgggacagtacgtgaccatcaagatgcggatgaaggacggcgtccaccagccgcggcagtacagccttacccgcgccgacgacggcaagcaccgccacttcgccgtcaagcgggtgcacgggcagggaactcccgacggcgaaatgtccaacctcctgcaccacgacgtcaaagtaggcgacgaggtggtgctctcagcccccttcggggatgtagtgctggagtacacggacaggccggtggtcatggccagtgcggggatcggggtgacgccgatggccggcatgctctcgcacctggtgaaagccggcagccagcgacaggtaatgctcctgcacgcggatgacagcccgggatcgtttcccctgcgccggcaggtcacccaggacctggaactgctgtccgacggcaccatgcacacctggttcctcaaccaggaccaggactccgacccttccagctttaccggattcatggacgtgaacgccgtcgaactcccgctcgacgccgagtactatctctgcgggccgctgcccttcctccagtccgtgcggagcagcctcatctccaagggcgttcagccgaaggacatccagtacgaagtgttcggcccggacctctggcaggccgacttccagtgaaggaaaccgccttgggcgggaaggcttagcggcgaagccggcggacgaagggtgccttgcccagtggtgtccgttcaagttggtccaccacgcccacttccacgggtgtcccgacgacgcctgccgcgtggagcgcgccggctaccgcagcctggaccccctggactgtatttcccgctgcaaggcccacaagcaggacacgcagccctgccggttcctggaccacctgccatccaccggcagcagcctggtccagcacgtggtggaacacgatggggtggatcctgaccggacccgcagtccccggcaggtccaggacatcctcgatccgcccttcgatgtcctccagcaaggtgaaggagcgtccacacggacagccccggccgcccagcctcacggtgtccgacatttcataccggatgagtggaagagtccgcgagaacaggaccgtgaccagcaccttagcccccgttgtcccccgcggcaccgggttcccgccctggtccacgggttcgacgatcagcaggtcctcgtagaggtggcggttccggtagccacacggcgaggcgatgccggccgtttccgtggcagcgtacacatcgaccggtgcactcccccaggcgttcgccagttcctgggcggcgaggggcgtgagcacctcagaggctgacatcacagcctgcggcgagattttcaggcgaccggccaactgctccacagccagggggcccagggctgaggcgtaaccaaccagtgcccggggctggaacctgttcagcgcgtcaacagtcacgccgattggtgctgccgcatccaggcggagcgtggggaccagcccggagcgcagtgacgctgcgacgacggcggactggtgcgtggggacgcgggacgagaccagcgccactttcagtggacggcccagtccggcctggatccctgcccagtcgtttgcccgggcgtaggaggccaggacggttgcccactcagaacggttccagacgaaggtgccccgcgggcccgcgctcccggccgtcgctgcggcccaccagcgtcccctccagggcacgccggggtcaccgtcttccgcggccagcgaccggagatgctgctccacttccgccagcttcaggtccggtgtggtgacggcctcgtcgaagtggctcatgaggtctgctttggtgacgggaggcaactggtcaaagggtgcctcctgcagcccggcatgatgccgccggtagaatgctgaacccgcataggctgcgcggcgcagttccttcagcgcgtggtcctggtgagcggcgattttcgtggcgtcccagtggtcccgccttcgccaggcagcccggaggaacagcacccgggacacgatccgaaggtccatggccgacgtccagagagtgggagcccgatgcctaggctccgcgcgcgcggcgtagcgccgccacccgtgctgtgtactctgtctcgtctatgtcgccgcgggcgaagcgttcggcaagcaggtcctccgcaacgcttccgccgggcccgttgctcgcccgcccgcggtggcccggggacatggagcgggcaaaaagcacaatggcagcgatgattgcgccccagaacaggatgaagctcaccaccatcaggacgaatccccaggcgcccatgttcccgtcccagtacatcatcgctgctcctctcgcccactgccggcccttactcaactatccccgcagaaggccgccccgagccagagtcttacgtcccccggattaacctgcccggcttacatactttcgtgttcctcaacgctccaagtcgtcgggttcgaattcactgagcggtgacccgccgaaagtttcctcagcatcactcgcagcggcttcgccaaactcggcgtcggcaaccgactcatcctggatcaacggatcctcctgccagcggtccggattgttctctgccgcgcccgggtagctgtccggctcgccatgcacagggtcgagttcaagggaggaagccgcaccgggagtctcatcaaggagcacgtcgtcatcctggacaacttcaagcccctcgtcgggaaggttctgttccgtcatggtgatgcctttctcgtggaccgctggagtaacaatagtaagcctactgaccacatggtggcgttggctaacgtctccgcaactggtccaccaggagcctgctccgggtcctcggcgtgctcctccgttgtcagcgtttccacaaccgtatttgccgtgacctttggccctatgtctgccgtgggcgcggggccagtcttgtaagtgaccacgcccgcgcgaaccaggagatcaggccatgacaacgcgtaaaccaatcgccgtcgccaccaacgagtcaccgcagagccaggcggcggtgctgtgggctgcacggcgggcggagcgggcaggtttgcccctggtggtcctccacgttgtggatgacaggtgggtggcagagccgtacccctggatcggcgtcatggaagaggccggtgaccggctcctgcagacggcggccggacgcgtccgggacgcgttccccatcgccattaccacccggctcctcaccggaggcataggacgttcgcttgcgaagtactcggccaaggcgtccatgctggtcatcggctcaggcaccggccacctgggcggttcgctggccgaccgggccctccaggttgcagcctcttcgaaggttccggtggctgtggtgggaacgcaggacctggagggccgctccggcgtggtggtgggtgttgacggttcaaaggaagccacgcaggccgtggctttcgccgcagcagaggcggaccgggaaggtgatgaactgaccgtggtgtatgccatcatcgccccggaccgcgtggtggatgccggcctgacatccaccagcctcgcggagctcattgccgacgaggagcgccttgtcctggcggagacggtggccgggctcaaggaggactatccgggcctgcaggttcaccaggtgctggaaaccgaaaggggtccggttgaagcccttgtggatgccgccatgaacgccaggatgcttgtggtgggcaaccgcggcaggggcgccatccagcggctcctcctgggatccacggcccatggcgtactcaggcacctgccctgccctaccgtcatcacccggatccaggccagcaagaacaaaaactaggccataccgggcctcccgcttctcctgctcattagctgttccctcctcctaggattccgggttggcaccatgaagaagactgcttcagtaataatgctcatcctcgggatcctcatctcgatggttggcctcgccacgctggccggaggggcggtggcctcggtggtgggatccgcacagggagacggatacctcacgtcaggcaccgcccgcctggccgttgggtcccacgccctgacctcgccccggcttgatgccgtaggcgagggcatcccgccgcgcctgcccttcgacgtcgggacgctgaggctgcgggccacgtccgcggacccaggcaaggaaatcttcataggggttgccccgcaggacgacgtagagcggtacctttcgggcgtgcatcattcggaactgcttgaagtggacagcaggcccttccgggccgaataccgtgacattccaggcaccggcacgcccgcacctcctgctgagcaaacgttctggagcgcttccgcctccggccccggcgaacaggagcttacgtgggacctggccgccggcagctgggcaatagtcatcatgaacgccgacggcagccttggcgtggatgccgaagtgcaggcgggcttccgctcggacctgatcatgccggcggccacagggctgctggtgggaggggccgttgcgctggcactggggatccccctgctggtcctgggcgccatagggctcggccggcacgcgcggcagcatccacgggggcctgccgcgccgccacccgggtacggaccgccaccgggttacgcgccgggatatggcacacagcccggctatgcggcggggtacgccccactccccggacatgaaccgccacccgggtatgcaggaggagttcccggaacatcagcccccggtgcccaagcagcgccgggcatgccgggagccgcagttccaggggtcccgccgtcgtcccagcccggcgccgcagaccggtcagaccgcgcgccctaccctgcccggctcttcggtgagcttgacccggcgctgtcccgcgcgatgtggctggtcaaatggttcctggccatcccccacttcatcgtcctggtcttcctgtggtttgcgttcctcgtgaccacgatcgtggcaggcttcgccatcctgtttaccggccgctacccgcggcccctgttcgacttcaacgtgggagttctgcgctggaactggcgggtggcgttttacgcctacgccgccgcgggcacggaccgctacccgcccttcaccctggcacgcaccgattatccggcggacttcgaagtggactacccggagcggctctcccgcgggcttgtcctggtgaagtggtggctcctgtcccttccgcatttgctgattgtcgccgccctgtccggagccacctggacctgggaggcagaagccgatgacctgggcaccacctatgagcgtgcaacgggcccgtccctgctgggcctgctcgtcctggtggccgtggtggctcttctgttcaccgggcggtacctgcggccgctgttcgatttcatcctcggcatcaaccgctggatctaccgcgtcatgacctacaccgccctgatgcgcgatgaatacccgccgttccggcttgaccagggacccgctgaagcgccgccggcggtgatggaaccaccgcagcaggaactaacgcgccaggaaccaacgcgccgtgaaccacctgtacaggagccaccatcgaatctcccataacctgccggtggctcctgcaacctgccggcggcccctgcagtgactttcggccctacctcccggtgtcccgccgggacaccatggacgaaggaccgcacgggtcacctgaggagctgagatgagtactgctggagcaccatttgcccggatccttgtgggtgtcgacggctcggagccatccatcgaggccttgcggcaggcccagcgcctggcaactccgctgggcgcgaaggtgctggccaacgcctactgggattacccgcaggtctacgcgggctacgtaatgatgggcatcgaaggcttcgaggagcgcgccggggagatcctcgacgaggcgctcacaacagcgttcggtgacgaaacgccgtcgaacgttcttcccagcctgatccgcggccacccacgggattcgctcatcgacgccagccgcgatgcggacatggtggtggtgggacgccgcgggcacggtggttttggcgggctgctgctgggctcggtcagctcagccttggtagcccacgcccactgtcccgtgctggtggtccacaccccggaagcacgcccggagacatcctgaaggaggtccacgtggccgggaccacggcgggcccagtccgttgacggagccgctgcgaggtgacgcacgacgacggatggcggctaccgccgtcgtgctcgccctgattgtgctggccatcgttcttgccgtgctgctgcgggaaccggcggcaagtcctcctcagccgcccgcgccctccccctctgcggccgcgtccaccagccccagccccgacccggcggcctccagcgccccgccctccccatcccagcctgtggaggcatcgacggacacaccggaggcagggcagaaccctgtccagccacccgccattgtgcctcccgtcccgctcccgttgccgcccgcgcccgacccaggacccggccctgcgccggatcctgtgccgccggcgtcgccgttcccttccgcgctcctgaaccaggacctcacggtcattccgaacgcgggtagcgtggtggctctgacttttgacgccggcgccaacgcggcgggactgccgaagatcctgtccaccctgtcagccaagggggtcacgggcacgttcttcctcaccggcaactgggtggaggccaatcccggcggggtggggcagatcgcctcagcggggcaccgggtggctaaccactccatgacccatcctggtttcaacggactggacggcactcagattgcccagcaggtccggggagcggaacacaccatcctggcagccggggccgatccgcgcccgctgttccgcttcccgttcggtgaaagggatgcccgcaccatcgccgctgtcaacggcctcggctacgttgcggtccggtggaccgtagacaccctggggtggaaaggcaccagtggcggcgtcaccgcccaaaccgtggcggaccgcacgctggccgccctgcagccaggcgaaattgtcctcatgcacatcggttcgaatcccgacgacggttccacgcttgacgccgacgccctgccagccatcatcgaccgcatcagcgccgccgggtacggcttcgccacccttgacgcgctgctggccccttaggaccggaagggccagtaatggagaagacaaggcaggcaagaaccaccggcagacgtccggctccggccgccaacgcaacggctgaacccgcacaccacgggctccccctgcatgaggtggtcctgctgctggggacggaccacgtgcagggcctcgcgtccgcggaggtggcccgccgccaggtccagttcggcgccaacgtccttccgcgctcacgcggcgggggtgtgttcaggaaactcgcgcggcagttcaacaacccgctggtatacgtgctgctggccgcggcagccgtcacgttgttccttggtgagtacctggattcgggggtcatcctggccgtcgtcctggtgaacacggtgattggctttgtccaggaagtccgggcagaggccgccctcgatgcgctccactccctggtccgcacgcgtgcagtggtggtcagggacgggcaaaggctggaggttccctcagaggacctcgtccccggagaccttgtcctgctcgaggccggcgacaaggtcccggcggaccttcggctggtccggctgtccggcctgcgggcggacgaatccgcactgacaggcgagtccgaagcagtggcaaaggacgaggtggtccttccctcgacgacaccggtggcggaccgccggaacatggtctacagcggcaccctggtgacggccggcaccggtgccggggtcgtcgtcgctatcggcggcgagacggagctcggtgaaatccaccggctgatgggctcggtgcagcaaattgccaccccgctgacccaaaagctggcgcacttcagcatgacgctgacggtggccatccttgccctggccgccgttgcattccttgccggcgtgtcacgcggccagcagcccgcccagatgttcactgccgccgtcgcgctggcggtgggggcgatcccggaaggccttcccgcggcagtcaccgtaacgctcgccatcggcgtccgccggatggcccggcggcgcgcggtggtgcgccggctgccggttgttgagacgttaggcagcaccacggtgatctgctccgacaagaccggcacgttcaccgaaaaccagatgacggtgcggggcctctggactccggctggctcctacgacgtgacaggctcgggctacggtccggagggccgcgtccttcccgcaggtgcgggtgtccgcggcgccgcggaagccaagggtggagcggcgacgacggcggcgcaggacgttgcgctgcactggtccctgctggcgggcggcgcctgcaatgacgcgaaggtgatcagggaaggggacgcctggcaggtccagggggatcccacggaggcagcgatgctggtggccgccggcaagggcggcgtggacacggcgcagttcctcgccgccactccgcgccatggcgcacttccgttcacatcggagcgccaatacatggccaccttccactccccccggctcccggacggcggcggcaccgggcaggacaccgtgttggtgaagggcgccgtggaacgggtgctggagctgtgcgcctggcagatggacagccacggcgtcaacggacacctcaacaagcacgttgtcctggaggttgcgcaccggtttgccggcaccggcttgagggtcctggcgactgccatgatgcacctgcctgccggcggcgttctctctgaagcaaacctgcacgggcagatgacgctgacggggctccaggcgatgttcgatccgccgcgggaggcagcagcggcggcagtacgtgcctgccaccaggcgggggtggccgtcaagatgatcaccggggaccacgtgggaacggccgccaccatcgccggggccgtgggcatcaccgcggaccgggcggacgggacggcgctgaccggagcggaggtggacgcgattcccgccgcccagctgccggatgcggtggagcgggcaaccgtcttcgcgcgggtgtcgccggagcagaagctccgacttatcggggccctgcagtcccgcggccacgtggtggccatgacgggggacggcgtcaacgatgcgccggcactgcgccaggcgaacgtaggtatcgccatgggacggtcggggacggaagtggcgaaggaggcctcggatatcgtcctgaccgacgacgacttcgccacgattgaggcggctgttgaggaaggccggaacgtctttgacaacctgactaagttcatcgtctggaccctgcccaccaatatgggggaaggcctggtgatcctcgtagcgatcctggccggagcaacactgcctgtcctgcccacacagattctctggatcaatatgaccaccgctgtgtgcctgggcctgatgctggccttcgaaccgaaggagccgggcctcatgtcccgccctccccgggcccccggccggccgctcctgacctggaccctcaccctccggatcctgctggtatccaccctgctcgtggcaggcacctggtggattttcgaactcgaactggccggtggcgcgtcccttgccgaggcccggacagccgcggtgaacgtctttgtggcggtggaactgttctacctcttcagctgccgttccctcacgcggtctgtctggcggatcggcttcttcagcaaccgctgggtgatcctgggcgtcctggtgcaggcggccggccagctggccatcacctactcccccgtaatgaacgaactcttccacacggcccccatcggcgcggagacctggctgcggatcctgggcatcgccgtgctggcttcactcgttgtggcagtggacaagcgcttccggcgccactcgttctaggcaggtccggcgttccaggaccttgccgcaacagggccatgccgaaactggacagcgtcctcacggctttggcaggagccggagcagcaccaggccggtcactgcggccatggcctctgccatcaggaccgccgatcctatcccaatggcggctgtgagccacaggtcctggccaggctgccagagcggagtcgcaactgccatgaagatgcccagtcccagggcccaggcggcggcgcttccggcgatccaccgccaggcccgcgggacgtggcggcgcagttcgacccattgcgccactccgatcgagaccaggagcaccgttgcggccccggttcccgtaactagttgggctgctgccggccacccctgccaggactcgttgctgaaggacaacaggcccaccgtccaggcaacagcagctgcggctgcggtcagcaggacccagcgccggacggaaacggcggggagcctggtcctgagaacccgcacctggaaccaccccaggacggcaccctcaacaaagcccgcaagcaccaggagcggcaccgccgctgttggccacacagtagcggaaacaaactgggcggttgcaggtgcaaggaatcccagggtctcgccaaagcccacccaccccacccaacgggcaaggaacgtgtttctgcgcgtcgcaacagatccctcagcagccaccttcccagcgtaggggaccaatggctctgccacccgcccggtcccgctgcccatacttaacgcaacgaccaggcgggacgctgccgggcactctgcacgcaccggcctgcgaaaccctcggaaaggaaaaggactatgaaccaggccaaggacgctgccgccgaggcagaagcacttcaatcggttgaaagacatcatgcgcacatgctcaaacatctgaacgggcttgtggcactcctgatggaagccgtggaggcacgtgatgctgctgccgaggaaacagtgcaggcctcgcttctggactggtgcgacacccgccttatcccccacgccctggccgaagagggccccctgtacggtggaccgcacgccacacccgagggaaggctcctggtggaggggatgcttgccgaacaccgtgtgattgtcgatctcgtggaagaactgcgcacctccagcggacttgccgccgccgtggccggctctgccatccagcggttgtttgccctgcacctggacaaggaaaaccgactcctgatgcctttcattgtccagtccccggacatgtcccttgccgagtcagtgcaggggctgcacgaactgaccggagagggcgcggaccaccacggcggaacgcacgacgacggcacgcaccatcactgactacccggacttactgcccgtcgtcgcttttacgtgcgtggcttcgtccggggcgtggaccaccaggaccgggcagtgggcgtggctgacgcacgccgaactcaccgaacccagcaccaggctgccgtgcccgcgccgacccacgatgaggagggatgcgttccggctcccctcgatcaattgctcgctggctttcccccgcaccagccgcggatggacaaatgccggcagttccttaccgaaagcgtccgcaagggcctgctccagtgactgcttggcggcgtattcgaagccttctatgccaaccacgaggtaaagcccatagccgggaggcacgtcccagcatgcccaggcttccaccgttgctcccagggggccggccaaagcccccgctgtacgaagggccgcgatcgaggcgtcggaaccgtccacgcctacaacaatcctggggtgctgcccgggggcgtccatgaggctccgttctcttcggtctgctcccagactgtacagagtccgggcagtgggatagggccgaaagtcaccggacggccgcggccctgcccggcagaggacagccgccggtgacgggcggcggttatatgatcaggactccagactttggtcccttccggcgggcccgcgcggaaggaaagatgggactaggcccctggcacgggctgccggcacagcagtgcaggcatagtcctcaagacaattgggagcatagggtgcaaacgcatgagtcaggcccggaaggggctgcaaatccccaggagccgcttcgcgtgttcattctcgatgaccacgagcttgtcaggcagggcctgaaggacctgcttgagggcgaagggttcgaagtggtcggggaaagcggatccgcggcggaagctacgcgccgcattccggcgctgcagcctgatatcgcgatcctggacggacggctcccggacggcaccggcatcgaggtatgccgggacgtgcgctcgctggacccccgcctacattgcctgatcctgacaagctacgacgacgagcaggccatccgcggcgccgtcctggcaggagcatccgggtacatcctcaagcagatcaggagcgacgacctcctcgccggaatccgcaaggctgccgccggcgagtccctgtttgagcccggagtcagggagcggatcatcgccgggctttcaaaggctccaacggacccgcggctggatgccctcagtgcccaggagaagaaggtcctgacgctgatcgggcagggcatgacgaaccgccagatcggagaggaactcttcctggccgagaaaaccgtaaagaactacgtgtcatccatcctggcgaagctgggcttcgagcggaggacacaggccgccgtgtacgtcacgcggaacacccaggacgggcagtagcctgtcccatggacccgcaactgccggccgacgccagggccaggcgcccgggcgggcagttgtccggttccgttacaaacgctgggcggtccatgtaatccgggtgccttcccttggcgcgctccggatggtgcagctgccgcccagcatttctgcccggtgccgcatattgcccaggccactcacccgggcgggttcctcaaaaccgcatccgttgtcctggatcaccagttcaacctgcttttgggtgacggacacggcaacacgtatctcctccgcgccggagtgccgcgcggcgttgctcagtccctcggaaagaacggacagcagatggctggcaacgttctcccggactgcgtccacgggaccggtaaaggccactttgggttccacgggatagctgcgcgagttgtcctggaccacgcccaggatgcggctggttagcggttcacggttttcctctccggtccgcagggaatagatggtgtcccgcagcttacggatggtgtcgtccagttcggacgtgaccgtggcgatgcgttcgtgcgctatggggtccagtgtgtagcggcgaaggctctggatactcaatccggaggcgaagagccgctggatcaccagatcgtgcagatcgcgggcaatccgctcccggtccgtgaacaggaggttttgttcacgaagggcgtggacacgggcaaggtcgagtgccagcccgatcctgctcccgaaaatcgaactggactccgcttcggcctgactgtaggcagttgagccctgcggacgcgccaggagcaacacgccgttgtcactgttgctgtggccgatggggcacaccagcaccgaacccagcttttccgccacctcgtcaccgaacacctgctggggatcccgtaccacgcgtgattcgcccgtctcgatgactccggagacggcgtcagaggcacctatttcctgcccggcatgcaggccctggacccccagggaggacctgcaccgcaggacaccgtcaccagccggaacggcaatcacggcaagcgcggaatccgacaccctcaaagccgtctcggccaccaggtcaaggttgtccgagtcccttggatgcggcgccatgataagccggctgctgagttccatccctgcctccagccatttctggcgctgcttgctttcttcgaagaggcgggcattctgaatcgctacaccggcggcagcggccagggccacggcaaggtcctcatcctccggggtgaagtcctgtccgccgtccttttccgtcaggtagaggttcccatacacttcgtcccggacacggaccggcacccccagaaaggtgttcatcggtggatggttggggggaaaccctgaggccatgggatgccggccgagatcgtgcagcctgagcggccgcggctcccggatcaggtgtcccaggacgccgtgccctgtaggcagatccccgatggacctgatgtcctcgtcatcgactcccacagtgatgaagtggctcaggctgcggtcctccgcaatcacacccatcgcgccgtacttcgcgcccacaaggtcacaggctgaccgcaccaggcggtccagcacggcttcgaggctcaaatcctgggccagggcgacgacggcggcaagcaggccgttcattcgttcctgggtttgcagcagctcatctgcgcgggcaacaaagtcccgcaggaggtcttcggcccgttctttcatcggagagctccacggctcagtgctcatgtccgacctcctgtggagagtgcctgcgtcgttgcgggccctcagcggtgttgcacgcgtccgggaagtggttcccccggcaacgccgcttccgcctgagtacgaagcgacgtcccggcaccagtctaggagagtaagtcaaggtctgaaatgcccctcttatggaacgccggatatcagctgccaccaggatggcatgcgtcaggaccttcttccctagccccgccccgctccgcggcctaggctacggccatggacagagctgcaacagaaccggaacccgaaaaccttggcgtgcatgactgctggagatacctgcggtcaacgtcggtgtgcaggatggcctttacccgcggcgacacggtggagatcttcccggtcaacttcgtgcccagcaacggcaccctgctgattcggaccgggccgggaacgaagatggacgcagtggcgggccgcaaggcagtgtccctggaggccgacgggctgaaccagtacgggaccattgcatggagcgtggtggtaaaggggcacgctgccgtagtggacgataccgaagatttacaggatgcctcagacgcaggtttgtctccctggcaggccggccccaaggacagccttgtccgggtgacgcccgaggaaatcaccgggaggagattcgtcattaccccgccaacccggtggtgggccccgcaggaaccgccggacagggcctgaggccctgtccggcactaaagactgtcagctacagcagcaccacggaaggtcaccaatggacgcacacaagcccgtcgccgtcggcatcgccgactccgccccttccaaggcagccctgctgtgggcagcggcccgtgcccgaaggcaaaaggtgccgttggcggtcctgcatgtcctcgacgaccgctggatggcgggcgaaaggattgaagcgctcccctatatcgacgtcctgcgccagtctgcgatggacgcgctgaaagaagccggagaaacggtgcacagcgctgaaccggaccttcaggtttctctcgagctgctggaaggaagcgttggggcatcccttggcaagtactcggagaacgcttcgatgctggtcctgggcagcagcggccactcccgcggtgcgctgaccgaccgcgccctccaggcagctgccgcggccgaatccccggtagccgtgatcgggacgggccagagcagcgggcagggtgtggtggtgggcgtggacgggtcgagggagtccacgcaggccgtggccttcgccgcggccgaggctgatgcactgggcgaggaactcaccgtcctgtacgcgttcactggccccaaccggtggatcaaagcgggcctcccgtccagcagcttcgccggacatgtggtggaagaggaacaggttgtcctgtccgaaactgtggcggggctccgccaggactaccccggacttatggtccacggagtcctggaaaccgtcatggaacctgcggacgccctggtccgggcagccgcgaacgccaggatgctggtcctgggcagccggggcaggggaagcttcggccggcttctgctcggatcgaccgctcacggcgtcctgacccagccgccctgccccacggtcatcacccggctcaagaagtcccggcatgacacatgacgggcgggctgcgcgctccacgtgatgtttgaagcaggggaaagtaccggacattacgtggcttccggcgcccccgcgggacagccggggctggacggactcagctccgccgaggtcctggcacggaccaacgcgggacagatcaacagcatccctggagcaacaagccgcagtgtgtgggacattgtccgggcgaacgtcctgaccctcttcaacgccatcgtggcgggctgctttgtcctgctgctggtgctggaccagtggcgggacgcgctcttcggcttctcggcgctggggaattccctgatcggaatcgtccaggaataccgcgccaagcagtccctggacaggctggccatactccacgcggcacagagcagggtcatccgggacggcagcacccggctggtcccggcggaggccctggttccggatgacatcgtcctgctcagcgccggtgagcaggtcgccgctgacgtgcggctcctggacggcgggtacgtggaggcagatgaatcctttttgaccggtgagtcggcgcctgtgtccaagcaaccgggagcggagctcctgtccggatcactggtcatggcaggaagcgggcgggcggtggtggtccgggtgggaccggatacgttcgccttcaagctgaccgctgaggccaggcggttttccctggtcacgtccgagatacgcgccggcctggaccgggtccttcgcgtcatcacctggctgctcctgcccactgcagtgctggtgacccatgcccaggtccaagacgccggcggctgggcggtggccttcagttccgaccggtggatacctgctgcagtgggcgtggtggccagcatcatgtcgatgattcccctcggcctggtcctgctcaccagcgtggcttttgccgttggcgggatccggctggccggccacatggtcctggtccaggagcttgctgccgttgaggtactggcaagggtggatgtcctgtgcctcgacaagaccggcaccctgtcttccggcgccatgacattcgacgccgtgcacgacgccggtgtcccaccggccgaggggtggcggaaggcccttgaatggttcggcgccaaggaggaggccagtaccaccgccaaggccatcggcgacgcttttcccgcggccgacgttttgccggaagcgtcatccgtgccgtttacctccgccctgaagtggagctcagtgacgttcccgccgggctcgccggctgccggcacctgggtccttggggcccccgatttcgtgctgccggactcgtccgccggtgcctccgcacgccggagcgccgcggcgctggcctccaccggcctgcggacgctggcattcgcgcacatgcccgggcccctgccggcgtctgcgaaagacggcgcactgcccgctgacctcgttccggtggtgctgctgaccttccgcgaggatatccggaaggaagcaccacgtaccctcgcctacttccggcagcagggggttgcgctgaagatcatctccggtgacgacccccgcacggtggcggtgctcgcgcgggcggtgggcgtcggaacgggcggggcctacgacgccaggaaactgcccacggacccggtgctgctggaggagacggtggagaaccatcacgtttttggaagcgtgacgccttcccagaagagggacatggtccaggcgctgaagcggcgcgggcacacggtggccatgaccggcgacggggtgaacgatgtccttgcactcaaggaagccgatctgggcattgccatggacacagcgtcgccggcaaccaaggcagtagcccggctggtcctgctggacgggcgcttcgacaggttgccggccgttgttgccgagggccgcagggccatcagcaacatcgagcgggtttccatggtgttcctcagcaagaccgtctacatcacggtcatctcgttgacttttgccctgctcctgtggtcctttccgttcctcccgcgccagatgtccgtccttgacggactgaccatcggcctgccggcattcttcctggcgctgcagcccagtgcgcaacgttatgagcccggattcctgaagcgctccctggccttctcggtaccggcaggattgtgcggcgccctgtgtgtgctggctgtcagcatgtacgcgcgcttcgccgcaccgggcagtgccgaggccacgcagtctgccgccgtcatcaccttggccctggtggcctcctggatcctcgtgaccgcatcccggccgctcaactggatgaagaccctcattctggcgggcatgtacgcaggcctggcgctcctgttcaccgtgcccccggcaaaagaattcttccggctggactggccgcccacggacctcctggccgcttcggtcacggtggccgtggctggcagcctcatcatcgaagcaatccggtacttccagcggcggctcgccggccgctcggcggactgaagatcacggtgaccttcggctctgggcgggacagcccaacccggccaatgttgaaagagccggcagaaggaggaaaagatgctcgcatggtgggtgggccagcccggccccgtgtccggccggcccctggtcaagggcatccgcgaagaccccaggcccgcggcaaatgaactcctggtggacgtgagtgtctgcggaatctgccggaccgacctgcatctggccgaaggggacctgcaaccacgccgtcctggagttgtcccgggccacgaggcggtgggcgtggtggtggaaacgggcccgggtgcctcccggttcgcgccgggcgacagggtaggcgtagcgtggctgggcggcgtctgcggcacgtgcccatattgccgccggggggacgaaaacctgtgctcggcacccgtcttcaccggatgggacaaggacggcggctacgccgaaaaactcaccgtctcccaggactttgcctacctcattccggaggtcttcaccgatgaacaggcggcgccgctgctgtgctcgggcattatcggctaccgtgcgctgaagcgcgccaacctgccggctggggggcgcctaggtatctacggtttcggcagttccgcccacctgaccgcgcagatggcgatgtaccagggggcatccgtttttgtcatgacccggtctgaggaggcccgtgcccttgcccgggacctgggggctgagtatgccgggggcgcatatgacaatccaccggtgccgcttgattccgcgattcttttcgcccctgtggggaacctggtgccggccgcgctcgccgcccttgaccgcggcggaacactcgcgatcgccggcatccacctcaccgacataccagccctgaactacgacgcccacctgttctacgagcgccaggtgcgcagcgtcacagccaacacgcgcgctgacgggcatgagttccttgcgctcgcggcccggattccgctggcaccaaccacaaccgcgtacccgttcgaagacgcggacacggccctcggcgatctcgctgcggacagggttaccggttccgccgtcctgcgggtccgccctgaaaaagcgtgaagccagggtgggaccttggactctggaacagcacctgcagggggcggatggtgttaatgccgggtgatgcgtcagcccggctcacaatgagcaggaggcaacaatgactgacctgatgaagtggtttgattcacgccgctcccccatggatgtgatcgaacggctcttcgaaggagagatgggatcgtccgccatccgggtggaggaaatggtggacggcaacaccctggtggtgcgggcggagctgcccggaatcgacccggaaaaagatgtggacgtgaccgtgaccgacggcgtcctgtccatcagggccgagcggcaggagaaaacggaacacaaggacaaggacagctaccggtccgaattccgctacggttccttcgtccggcggctcccccttcccagcggagtgcagcagggtgacgtcaccgcttcctacaaggacggcgtcctggaagtccgcgctcccctcccggaccagcaagaggtggcctcggcgtcgaagatcccgatcagcaggggctgacggtttgtgcctggtcctccggggccaggcacggtcatgccacccaggtgtcctgtcagccggatgtggcctgccagcagggtctggtcagcaccagtgccttcagccgaacaggactgctgcctctttgtaccgggcctcgggaaccaccttcaggcttccgagcgcaagctccaggcccacggtgacgatgtccgttccgcggagggacaccatagtcccccacgcgccgctggccgccgcttcgatggccgccagccccagccgcgtggcaaggacgcggtcataggcggtgggctccccgccgcgctggatatggcccaggacggtggcccgcgtctctatcccggtggtttgctgcagctgctgctccagaagccggccaatgcctccaagacggggccggccaaaggtatcgagcccacggggcgcatagggtgtctcctgcccctccggtgcaaaagcttcggccaccaccaccaggggcgcccgaccgcggtcccgtgctgacagcacccacgtggagatctggtccagggacaccgggtgctccgggatgaggatggcgtgggcgcccgaggccatccccgagtgcagggcgatccagccggcattccggcccatgacctccgcgatcatgcaccggtggtgcgactcccctgtggtcctcagcctgtcaatggcttcagtggctgtctggacggcggaatcaaacccaaatgtatagtccgtcgccccaagatcgttatcgatcgtcttgggaacacccaccacgttgacgccctggtcgcacagcgctttcgccgcggcgagcgtcccctccccgccaatggcgatcaggcccgccaggccattgcgccgcatgctttcccgcaccgcgtcggttccgccgcccgccagcggattggtgcgggatgttcccaggatggtcccgccgagccgggatatgccgcggacgctccgccggggcaaaggaaccacatcctgttccaggactccccgccagccgtcgcggaaccccatgaacccgtatccatggacaacctcaccacccagcacggctccgcggatgactgcgttgacaccggggcagtccccaccgcttgtcaggattccgagtttcttcatgatgcggctgatccctccaccggcatgggcagccggaatgtcctgacctggccggccgcgagtccagccttcctgccattgacgcgcacgctgatgggttcagcgtccccagccgccgaggcaatcctcatgcgcccgtccttgagttcgacgttcaggtaatgtccgcggtaccggaccctgaaggcgacggaccggaggccggtgggcaggttgggagcgaagacgagtgcgtcgccgctgagcctcagtccggcaaaactgcgttgaatgacgtcgatgcttccagccatggcccccaggtggatgcccgtgtgtgtggtgccgtgctgggtatcgtcgaggtcggcgtcgagcgcttcccggaagctgtcccaggcgcggtcggcgtccagcgcggccagcacggaagcgtgggcaacccggctcaaggtggacccatgggcggtccgtgcgaggtaatactcgatggtccggttcaactggtctcccgtaaacgcgtatcccagttcctggagcagggcgatcacaccttcatggcccagcaggtaaggcagcatcaggacgtcggcctgcttggcaagcttgtaccggttggtttcgtccccctctgcttccaggatcaggtcgagccgctcgatgctgtcataggtttcccggtaccgttcccagtcgagttcgtcgagctcctcgtaaccggcaaactggctgatgacgccgtccgtgtggaacgggatgaacatggccctgcccacctgctcccagccggctgcctcctcaccggtgatgccgagcctctccatcaggccggcgagttcgttcccgtggaagatgccgatgatctccgcagcccgaaggcagacccaggcagccaaggcgttggtgtaggcgttgtcgtccaggccgggatccgttctgcccggatatcccgtgtgatattcatctggcccgacgacaccgcggatgtggtaccgcccggtgtcctggctgtgcccggcccgcgatgcgaagaaccgggcaacgtccaccaccagttcggcgcccttgcggaggagccaggctttgtcgctggtggcctggaaatactgccagacgttgaaggccacagccagcccggagtgcagctgcatgtgcgagtggtccttcacccacctgccggatctgtcgttgtaaagccacttgggggtttcttcagtaccgtcgctaccgctttgccagggaaactgcgccccggacagtccctggaccgctgccgcgtggcgcgctgccggaagcctccgccaccggtattcgatgagggagcgggcaacatccggcgtccgtgtggtcaggagcggcaggacaaacaattcgtcccaaaagacatggccgcggtacccctcgccgtggagcccccgggcggtgaccccggcgtcgagttccgccgtgtggcgggtgagggtctgcagaagatggaagatgtggaggttaaggaccaggcgcacctgcaccggagcctcgatgtccaccaggaacggatggagttcgttccgccatgcatcctggtgtgcggtcaggagggcgtcgatgtccccgccggcgcgggccagcacggccacggcggctgaggccggggaggctatcgcccggtcacgggatgtcaccaccgcaacggtcttgctgattcgtgctgcagctccgtcagccagggccacctggaatgtccggaagtggaaggggccgatgctgccgggcttccctgcacccgttccgccgctgcctggtccccccacgctggtgcggaacgccacggctatccggatcaggctctgggttgtctcggcctcgatgacggaaacgtcgtccggggccggctgcctgaagccgccgtccatggtccggtcaacaaggtgaacccccgggctggaggccggttcggggacattcgagttggtgacgcccgtggtgacgccgctgcgcatctccacggcaccgctccagcccaagggcgtgatcttcgtttcaaggcacagcaggtggggctcggccatggacacgaacctggcttggacgatttccatccgccgcttgtccccggcttccagcaggagccgccgttccagaaccgcacgctggagatccagggtgcggcgctcgcggacaaccgccaggcctccttccgaccaccaccgcccgtccggcatccgcaggtccagggaaaggcagtcaggcgcgttgaccatgtgttcttccacgagcacctcaccggcaacttcggcggccaagcggttgaagactccagccaggtacatgccggcataccggatgcttccgccgccctccggggacgcaccccggacggccaggtagccattgccaagggtggtcagcgcttcccggtgtccctcgtgtccggcgtcgaagccctcatagacgagctgccagggatcagcaaggacgagtcccaggtccagttcacggacgtcgttgaggactgtgccggcaccggcggcttcgagctcccgccgggttccgctgcggtcgatgcccaccaccaggccgaacccgcccctgtgggctgcaaggacccctgccactgaatcctcgatgaccacggagtgggacggcgataccccgagccggaacgcggccgccaggaagacgtcaggggcgggcttcccccggaggccaaggttggctgcagcagtcccgtccaggatgacgccgaaaagatccggaattccggcggcgtccaggacggaggacgcattgcggctggacgtgaccactccggtggggaccccggcgtcggaaagcctttgcagcagctgaaccgttcccggatagctctggacaccgtcccgcttgagccgctcctggaagagccggttcttcagggcaccaaggccgaacgctgtccaggtgccgggctcatcaccgtccaaccccttgtccactttcactcctcttgacgcaaggaacttcagcacaccctcctccctgggaaggccgtcgatgtaggtgcggtagtcggctttggacaggggtgaacggtcggcggtgtccggcaccctggggtcctgcaggatgtgttcgaaggcctcccgccaagccgcctgatggaccagcgccgtgttggtcaccaccccgtccagatcgaaaatgacggcgtcaaagggcggcttggcggctgcggcagtgggtgaggacgcggtcatatgtcagggataccagcaggccgcccgcggttgacagtgccgttaggcctgtctggccagccgctgctcggccgctgcaatgacgggaagggtcttcacgtaggtgtccgggttcagcgagattgagtctatgccgcggccgatcaggaattcggcaagatcggggtggttgctgggcccctgcccgcagatgccgatcttgatgcccgcggcgtgcgccttgtcgatggcctgggcaatcatggcgctgacggcagggtccctttcatcgaacagcccggcaagctgttcggaatcgcggtccacccccaggaccagctgggtcaggtcattggagcctatggagaacccgtcgaagcgctcggcgaactgctccgccagcaccacgttcgagggtatttcgcacatcatgtagagctgcagcccggcactgccgcgcaccagtccctggccggccatcgcttcgatgaccaggtccgcttcccggacggtccggcagaacgggaccataacgatgatgttggagaagcccacttcttcgcgtacccgtttgagggctttgcattcgagggcgaagccttcccggtagtgatcgctgtagtagcgcgaggctccgcggaagcccagcatggggttctcttccggacgttcaaagaacccgccgccgatcaggtggctgtactcgttgctcttgaaatcgctgagccggacgatcaccggtttggggtggaagggcgccgctattttggcgatcccggtggccagcacgtcaacgaagtactccgtggggtcgctgtagccgctggtgagcttccggatgagcgcggcttcctccgggtctgtcactttttcagggtggaccagggccatgggatggatgcggatgaggttgttgatgatgaattccatcctcgcgaggcccacgcccgctgccggcagccgccaccatttgaaggctgcggcaggactgccgatgttcaccatcacgtcagtgcgggtggcgggaagggcctcgaggtccacttcttccacgctaaactccagcaacccctcgtagacgcggccttcctcgccttcggcgcaggacagggtgatgggggcgccatcgggcacggcttccgtcgcgttccgggttccgacgacggcgggcacgccgagttcccggctgacgatcgctgcgtggctggtagggccgccgtggtcagtgacgatgccggctgcccgcttcatgaccgggacccagtccgggtccgtcatcctggtcaccagcacggaaccgtccacgaacgattcgatgtccttggcgtcccggatgacgcaggcctgcccgccggcgatggcatccccgatggcggcccccgccgtcagcagcctgccctgctgccggagatggtacgtccggaaggaggtgctgctgcgctgggcctgcaccgtttccggcctcgcctgaaccatgaacagttcccccgtcacgccgtctttggcccactccatgtccatgggccgcccgtagtggtcttccacggctttcgcccagcgtgccagcagaagcacttcgtcgtcggacagcaccagggaaccctgctcccgttcggtggtctccaccatccgggtccgcgcgttgcccccgtggctgtaaaccattttgcgttccttggcgccccgttccctctcgatcacggggctgaagcgctcgtcggagagcagcggcttgaacacctggtatttgtccggattgatggtcccctggacaacggtctcaccgaggccccacgccgcgctgatgagcacagcctccgggaagccggactcggtgtcgatggagaacatgacaccggaggcgccgaggtccgagcggaccatgcgctggacgcccacggacagggccacgtcgaggtggtcgtagcccttcatttcgcggtagctgatggcgcggtcagtgaacagcgaggcatagcagttccggcacgcttcgaggacggcccgctcccccgccacattgaggaatgtctcctgctggcccgcaaagctggcgtccggcaggtcctcggctgtggcgctgctgcggactgcaacggacacctcgtgctggcccgcgcggcgggacaggagcagatagcgctcctggatcgcctcgccgatgctgtccgggaacgttgctgacaagaacagctcccggattgccgctcccgcctggcgcagcgttgcgcgtccggcccggtactcctcgatgtacgtcctaatgcgcggctccagggcgttggaagccaggaaggcgcggtacgcgctggcggtagtggcaaacccgtcgggaacccttacgccggcggactgcagggagcggctcaactcgcccagtgacgcgttctttcctcccacggacgcgatgtccccgatcccggtgtcctcgaaccacttgacgtggacatcggccggggacgtagcgggagcagtcatgcctcgattctgggccgtgcctgaaaggccgggcagagtctttggtcccgagcacccgcaggccccaggacagggccaccggccaccggccaaaaccacaggtacaggaccaccggccaaagtcactcggttctgcttaccgggcgctgcggcccctgaaagccttgtaggcccagtccgccgccaggaccgccggtattgccatggcggccacgagaaaaccggacgccggcggcggggcctggcccagcagggcggcgagctgcggcacgtacaaacacgctgcgagcacggccagttcggccaggacggcccacgccaggagcttgttggagccccaccccagcctccacggcggcgtggtggcactccggcaggcgtaggcgttggccagctggcccaagaccaccgctgtgaaagcagcccctgacgccgccatgacaagtccgggatccggcggctcaccccgggtccagccgccgccgaagagcacaagggaaaacgcggtcatctcaacaagggcctctaccgggcccaggacgcagaagacccgcaccatcagctgccggtccatcaggtgccgccgctccggcggccgggacagcacatgcttgccgggcggctcggcaccgagggccagggcaggcaacaggtcagtaccgatgtccagggcaaggatctgcaggacgcccagggcaagcgggaactggccgcccgagagggcccagaccacgaagggggtcagctccgccacgttgtcggtgaggtggtaggtcaggaaccggtggatgttcgagtaggtggccctgccctgctctatagctgccacgatcgtcgcgaagtggtcgtcaaggagcaccaggtcggccgcttcgcgcgcaacgtcggtgccgctcaatcccatggccaccccaatgtcggcctcacggagggccggaccgtcgttgacgccgtcgcccgtcatggccaccacatggccgcgggactgcagggccttggcaacccggagtttctgctccggggataccctgctcaccactaccccgtcccggtccaggagcgcccccagcagctgttcatcctcggggaggtccgagccctccaggacgaattccggcgcccccatcagcccgatctcacgggcaattgccgctgcggtcgcaggatggtcgccggtgatcatggcgagtttgagccctgccgtgcgggcagtccggatgacatcgcccacgtccggccgcggcgggtcatggagcccgatcagtcccagcagctccatgccgcgttcgatgtccccggaagggcgggactcccaggcgccgggcggcccatcgagccgcctccgggccaccgcgataacacggagtccacgggaagccatcagctggacctggtccgccacctggccgtcggcgccgctgcacagcggaaggactgcctcaggggcgcccttgcagaaaaggtcctgccctacgatcgccgattcccgccgtcgtgaaggatcaaaggctaaacggcgcgaaggcgccatgcgggaatccgcctccccgcccatgcgccgcgccagcacgtcgatggcggcttccatggggtcgcccaatgcccgccattgcccgtcatgcagttcggcccggccctgcgaggcggcgagcgccgcgagcgcagtttcagcggccttctcctgcccgtccccctggacggtgccctccgggttgtacccctcgcccgctatgtggaccgagccgccggacgtgaaaacttcgacggcgttcatccggttctgcgtgagggttccggtcttgtcggtgcagatgaaggtggtggaaccgagggtttccaccgcctcgaggttgcggaccagcgcgttgcgggaggccatccgctgcgcgcccatcgccagggacagcgtcactgtgggcagcaggccctcggggacaagcgcgacggcgacaccaatggcgaacaggaaggaatcgcgccattcgattcccaccagcagggacaccaggaagaacagggccgcgatccccagggcaacggatgccaccacccggacaatccggcgcagctccagggacagtggggtgggcggcggaaccgcgccgctggtgagggcggagatcccggccagtcgtgtccggccaccggtggccgtgacagtggcctcggcgtcgccgttgaccaggaatgtcccggcccaggcggagtcgccggcagttttaggcaccggatcgctttcgccggtcagcatcgattcgtccacggcgcaggcttgtgccgtggccaggaggacgtctgcggggatgcggtcgccggccgtcaggagcacggcgtcggagaccaccagttcgctggcgtggaccttgcggacgcgtccgtcccgccgcaccatgacgtctgccggcagcagcccgcgcaacctttccgcggcgtgctgggcccgttcctgctggatgtgggcaaagatcccgttgacaagaacgacgacgatgatcgccacgccgagctgcggcaggtcagcgaggaaggccagggctgccgcgcaccacagcatgagggcaaagaagtgcgtcagctccccccagagtttccgccactgcggtacgggcttttcggcagggagaatgttcggccctgcctgcttcaggagttccgcagcctggcccgaggtcaggcccgccgctgtcatggcacgtcgtccgcctcctggcccaccaggagcaccgggcacacggaatgagctgcgcaggccttgctcaccgagcccatggacgtgccgaggaatcctccttcaccgtgccggccgacaaccagcagctgcgcccgccggctctcttccacgaggactttgccgggcggcccgaacttgacggtgacgtcgatgttctgcggccggtcaccggtgaaggcccgtcccagggcgtcctccaccaggcgggcggcggtctcctccagccgtgcggtcaatgggtgctcaccgctttcgaggtgggccaccaccaggtaatcgggcatgccgatgcaggtaatgacctccagccgcgcacccaggcgtgcggcgagggttccggcgtaccgcagggcggcggaggaatattcggaaccgtcgacgcccacgatcacaggcttggacactgtttctgcgttcatacccaccacattcgccactgcgggcggacggcggaagggccgaaggtcacgccggtggcttccggttcagccccggcccgtgggtttccgcggcctggccccgtgcagcgccctcagcccgttcaggatcgtggcaaggtccacgagttcctgcaggagggcaccggcgaccgctggaatgtagcctgtcatggccacggccatcaggccgatgctcaggcctattcctgtccagatgctcaccagggccaccgctaccgtgcgcttcccgatttcgaccgccacggccactttggacaggtcgtcgagcatgatcacgacgtccgccgactcactcgcggcggtggcgcctttggcccccatcgcaatgcccacatccgcggcggccaggacgggggcgtcattgacgccgtcgcccaccatgatgacgggccgctcccgcacggctgccaccgcgttgaccttgtcctccggcaggcagtcagcctgcacatgccggatgccggcctcctcggcgatgtgggccgcggtcccgtgggcgtcgccggtcaggagcatggtgtgccggacccccagcgagtgcagccgggcgagggtttcgccggcgtcggcgcgcagcgggtctttcatgatcagggctccggcatagttgccgttcacggccacatagatggccagttggccgctgtggagggcggcttcccggaagcccgcggatgagttccggaccagacccgccttgcccaccaccacagtgtccccgccgcatacggtttccacgccctgcgtggcatgttctgtggcccgggtgacgggaaggagttcaaggttgcgctgcgcggcggcttcgatgacagaggccgccaggacatgcgaggagtactgctcggctgaggcggcgagctgcaggatccgcccggcccccatcagagcacctgggcctgttcccgggtcctgtgcaacctggaccgtgtccaggacgggccgtccggaggtcagcgttccggtcttgtcgaagaccgcggacctggctttggccagctgctcaagggtcccggagttcttgatgatgatgcccctgtgggctgcctggctggtgccggcgaggaacgccacgggcgcggcgatcaggagcgggcagggtgttgccaccaccaggacctgggcgatgcgcacgggatcccccgacagggcccaggcagttccggccatgaggatcgccagcgcggtaaagggaactgcgtaccggtcggccaggcggaccaccggggcccggctggacgctgcctcctccaccagggcgatgatgcggctgtactgtgaatccttggctgtggcggccgcccgcatcctgatggccgtctcgccgttgacggagccgctgagcaggagatccccccggacccgctccacgggcaggctctcccccgtcagcgacgattcatccatgctcgcggcgtctgacaggagctccccgtccaccgggaccagctcggaggggcgcaccaccagcacgtcgccgggaaccacctcgcccacgggtgtttcttccaggactgatccggcagcctcccggtgggcgaagcggggagccctgtccagcagggacttcagttcacgtgctgcccgtccctgggcgaaggtttcgagcgcttccccgccggagagcatgaggatcaccacgagggcggcaaggtactcccccacccacacggtgctggcaatcgccatcagcgccaggacgtcgatcccccagcggccctcgcggagcgagcggaacatcgccaccgcacggatgacggcgacgacggcggcgtacacggacgcgccgagccgggcgggctgttccagtccggactgcagcatgatcccggtgacggcgagcatcaggcacgtcagtgccaccagggggtactgacggatcagcgcggaggcgcggcccgggagcgacgtgccgggttcctcggggccggccgccggctgcggcggtacgggggtgccgggcggggctgccggctttccctcaggcaaggcccgcccgcgtaggatcatccagatggctccaccaggtcagcggggaggttacggtgaagcgccggccgcttaccgccgtcgggacaatccgcacgaactggtccttgtggcctgcctgccaggggaacagggtgaggccggcaccggtcatcagctccggtgagggctcaaggacctcggcgtggcccttcaccaggacgctccaggcggttcgtttgtcctggtcagtgccgtccgcttcaagggcgacggcggtgggctgggccgcggcgtgaagctttgttccttctccagtgcggaagaccaccgatccatgatccaccttgtagttcacggggaaaatctccggatggccgtccaccaggacggccaggtggcccaccgaaaccccgcgcaggagatcccagcagtcgttggggcccaggacttccactgcggatggggcgtcccgttccggtgagttattgcgcatacagctgaaaatactgccgccccgccgggaccgctagggcatttaggcccgggcccgcccccggaaacggccaggggcggcggccaggtcaaaggtctttgggccctgtcagggatgcggcccgcgccttaggatctgggcatgaccgacaagaaaatcgctcctgaagcagaaatcctcgactccgacgagtgctggagactgctggaacaaacgagtattggacggcttggcgtcgtcgtcgacggacagcccgacgtgttcccggtgagtttcaagcgtgacggcgagggcctggtcttccggacgggcagcggaacaaagctgcaggccattgaggcgaactcgatggtcgcgctggaagcggacagtgtcagtgccgagtttggcctggcctggagtgttgtggtcaaaggcgaggctgtccaggacgacgccgcgtcccccgccctgaacgagacacgccgggggctctttccctggcagggcgttgggcaggaccacctcatcaggatcattccgcagtcggtgacgggccggaggttcaccctgtcagccaccggcacctggcagacaccgttgaacgaagccacccgcgcagggctcgagtagccacagccgttccggtggagggcggcgaaccctggactgttgaccgcttctttgagggttccggcactgcccgcggcatctacgatgcggcagaacgcatggcgtccggcataggccccatgacggtccgcgtgtccagaagccaggtctcgttccgccgccggcggggctttgcgtatctttggcgtcccggcatgtacgtcaggtccgatgttcctgttgtgctgtcgctggcgcttccgtttgagatcgcctcgccccggttcaaggagacagcgcaccctgcccgcgggacctggatgcatcaccttgaacttttggacatcagccaactcgacggcgatgtggagcagtggatgcgccaggcatatgaggctgccggctgagtgcgcgggcctgaccgctgcgcgggtgggacggtttagagtccttaggccctgtcaggcccggtgccggcggcgcaggctggagctatgaatgactctggcgcgtaccctaggaaagtacacctccctgagcagccggtcgccgtcgtccgtgaacgcgttcggatggacgcactgacggatttcttcggcagggccttcgggacggtcatggcagcagcccagaagcagggtgcggcccccgccggccctcctttcgcgctttaccggggaaagccgggcgagaccattgacgtggaagccggctttcccatggccgggaacttcagggacgccgatggagtggccggcgggacgctgccggaaactgaagcccttgaggccatgcataccgggccctatgacaccctggaaaacacctacaacgcggttctgggccagatgcaggcggaaggcctcaccccgggggacatcatgtgggagtactacctgagcgaccccgaaacggaacccgaccccgcaaagtggcagacacgggtcatctggcccttcgcatgactgcccggccccaggaggtcctgtgagaatcctcgttgcctatgcaacccgccacggcgcgacagccggcatcgccgaacgcatgatccggctcgctcccgcatcaaaggaagccttgccgcccggtgatttccgcgattgggacgccatcgacaccggggcgaatgaaatcgctgcggaactgaagtccggcggggaaccggtacccgacgcagggcaggcggcctagcttcctccgccgctgcgcctgaaagtcagctcccagggtctttggccacggctggcctccgaccacccatcccttgctatctgctggcggagctcagcgagactcccttccatccccggggcccactgttcttccggcggggtggcccccagtggagggccggagaacgtgtcgctgacatagagcctgcggttgtcgtccgtcttccccacaaacctcagctgggtccgcccgtactgtgaccccagggtgtacaggatgcgggcccaccaggaactggacgcggcatcctccaactcgatctgcagcttttgttccatgcaaaccagcctaggagcggccacctggccccactagagacttaggtcatgccgtcatacggaaacgggtccagaggcactaccgctcacggcggtaccggcaggacgttcacttattcctgcactcccgtccgccatccaacgaattgccgttacgggactttggcccctaatgcacagctgcgctctctggcagagtgggtgacagcccgaaacatgcactatggctggggatcgtgtctgggctgctgcaccggatgtcagcgggcagatgcgctccacacacagttggaggcaagatgcttaagggagcgcaaaattatggcgggaacgttcgagctgtttgccgatgaggattcgcggatcaggttcaggcttgttgcgccggatggaactgtgctggcagtctccgggcagtaccgggacaagtaccaggctgccgccgctatcgaggatgtccgtgagtgtgccggtacgggtttgatcagtgacctcgctcctgcgcccggactggcaaaggccaggactcccaggcgcccgcaccgggtccgcccgtacatgccgaacaaggaaaagtcgctcggtgcagcgtagaaatgcgttgcgcccgtgacggctgacgtccagacgcaccgggcccaggttctgggcgtcaaaggcctggtcaagcactatggtgcccacaccgtcgtcgacgatgtctcctttcatatcggcgccggtgaaacgtacgggctgctgggccctaacggcgcaggcaagaccaccatcatttccatggtgtccgggctgattcccgcagacgcgggatccatcgagctggccggttcggcaatgactccggcgagcacgcgggtgaaaggccacattggcctggtcccgcaggaactcgccatctaccctgacctgacggcgaaggaaaacctcctgttcttcggccggctccagggccttcacggcaaggaactgaaacatcgcaccggggacgtcctggagctcattggccttgcggaccgggcgggcgagcaaaccaagaagttttcaggcgggatgaaacgccggctcaatatcggcatcggactgttgcaccggccaaccctgctgatcctggacgaaccaacggtaggagtggacccccagtcccggaactcgatattggaatcggtggaagggcttgccacggagggcatggctgttctctacaccacccattacatggaagaagcggaacgcctgtgcgaccggatagccatcatcgacgaagggcggatccaggcggagggcaccaggggtgaactggtggagctgaccggaggggtggaccgcatcgacctgcacgggagcggaaacaccggtgccgctgccacggcgctgcggcggcttccgggcgtacagcatgtcgacggcgacgcatcgggcctgacgctcacggtgcacaacggcccgggcctcctcgcccccattgtggccgaagcgggcggagcggggatggcgttgagctccgtggagatcgtccggcccgatcttgaatccgtcttcctgcacctgaccggcaaagccctgcgggactgacgtgcgcggactgtggacgatggtcgccaacgacctccggcagcggatccgcgacaaatccgttgtgatcttctccctccttgtccccctggcactcatggcagtcctgaatctgtccttcggcggcttcgacagcgggagcgccaccctgaagcccgccgtcgtcattgccagctcggaagacagcgggcagcttggcgacgcactcctggaagcggtggagtcactgcccatcatggacgtgaccgtccggaaggtcgctgccggcgatgtcagccgggaaactaaagccaccggagccgaccttggcattatcctgccggcggaattcacggccgcagtgacgtccggacaggcgctttcagtccaggtcgttgaaggggattcggccggccttgaaaccgacgtcctgatttccgtggtggacggtctcctggagcagttctcggcgggcacggtgacggcagaggcagggaatatcgccggtctcccccacgacgtcctcggcggacttgcccagcaggccgctgcaggcacgcctgccctgacattatctgaaggccaggcgtcggccgggcagctctcactgaagggaacgctggtggcgggccaggccgggctcttcctgctcttcaccgtcggcttcggggtcctgggactcctggcggagagggaggagggcacgctctccaggctgcaggcagccccggtgactcccgggacgatcatttctgcgaaagcccttgtgggattcatccttggcgtggttgcaacaacagtcctactcactgccggcagcgtgctgtttggtgtctccttcggctcaccggctgtggtggcactccttgtcctggctgtggccgcggccgccacgagcctgacgttcatcgttgcccgcctggtccgcagcgcggaacaggccaacatcgcccagtccatcgtagccatgctgctgggcattgccggcggagcgttcttccccatcgaagcctcggggttcctggccacgttgatggacctaaaccccattgccgccttcatccgcggcttgggcatcaccgccggcggaggcggaatcgctgacgtcgccacccccctcgccatcatgctgggcttcgccgccgtgtccaccctggcgtcccgcctgctcccggacaggggtgtccgggcatgagaagcatctttggaatcgccatcgtcgaggtaaggctcttcctgcgggacaggtccaacatcttcttcgtcttcatctttcccctcctgctgatcctgctgctgggctcccagttcggagccaacagcggccaggcacgcgttgccctgtccggtggttcaggcaccgggttggcgaaggccctttcggagcaattgaaggaagacggtgtccaggtgtcctccgccggagccgcggcggtgcgcgaccagctcagccggggaagagccgacgtcgggatcttcatcagcgacgacgactccgcggctttcgcagccggccagccggctgaccttgaggtgctcatggcttcgcaatcagccgcacaggccgtgctccaggaggtacgggcctccatccaggccgtgagcacggaacgaaggcaacggtcccttctcgaatcagcgggagtgggcgcgccggaagcggcaaccgcgttggagcaggcgaaggaatccgtgcagcaaccccgggtggagctggtggacaccaacgacgccacgcaggtcttccaaggactgggccggttcgacctgggtgccgcgcagcagctcctgctgtttgtcttcctgagttcactcacgggtgccgccaccctgatcaaagcccggcgtttaggagtcatagcccgcgtcatggcgggccccgtttcaagctggcaggcgctcgcaggccaggcgctggggcggtttggcattgcggccgtccagggcggttacatcatgcttggaacggcgttgctgttcggcgttgactggggagacccgctgccagcggggataattttggcgttcttctgcgccgtctcggccgcagcagcaatggtggttggctcggtgatggataacgacgccgccgcgtccggtgtgggggtgggcctgggtttggtgctggcagggctgggcggttccatggtgccgccggagttcttctccgagacgctgcaggcagtgtcccgggcgacgccgcaccgctgggcgtacgatgctttcgcggatatccaacggcatgacgggaccctggcggatatccttccgcagctcggcgtcctcgccgcgatggcactggtacttctggcgctcgggtcgttcctgctgcagcggagcctcagccggccgttgtgagtcctgatgtccggcccatgcccgcgttcagaaactggacgaactgcccgagccggaaaaactcccgccgctgcttccgtaaccggtggtgctgccgcctccgcccctggcggagctgacgctgctgactcccgtattgagcccggagttgaaggtggccacggagaagaagtggtaagacggatatacggtgcccaggatgcttggctcgtagctacgccggcgcttgtggttgagtccgtcctgggccgcctccatctccttgcgcatcagctgcgcttcgcgttcgttcttcgcgaatccctcaatgactgtctgggcatggttttccaggagcacggccagccgggaccgggcgtcgtagaggcggtcgagcgccttttcggggctgattttttcctcggcgagctccgccgtccactgttctatgtcccggaggctctgctcccggaaggaccgcaaggccgccgcggtagccgcgtccccctgcccgtggcgcttggtgaggagttgctccagcccggcgagatccttgcggaaaggggcgagttgacggtcccacgcggtaggccacgtgccggccttgttgaggagggcgttggtgtcggcgatgacgtcgtccagggcgtcaagctccgaggctgcgtctgcgtattcccgggcgagcttgagattcttgcgccggccgagctcgcgtccggacagcgcgtgcactttgttggagagcccgctggcggcgttgtaccggttcaggaaagtgcggtgcttctcaaggacgtggccaccataccgggaggcttcgggaatggtgcccgcgttcagctctgtcacttcaaggtccatgctgacattggcgtagctttggtcaccacgctcaatctctttccggctggaggacctggtaacggcccgcacgatgatccaggcggcggcacccagtgctgctgttcctgcggtcacccaggcagtgatcaggaaggctgcggaccggtaccacggctggttgatgagctcggccgcacggcggacccccgcgacggttccgtccgtccactgagcgtcttggaggagatccttggccgcgtcctggatgtcgttccgctgctcaagggacaccttccggtcttcgcccatgtaggttccaacctggcggcccaccgggtcaagggcaaaaatgaagagcccatcggcccacttctgcccgtccgcgctgatccactccggatgctcactccgggcaatcctcaggacctcttcgttgaggttgtcctcggtcctgccgttgtaggtgtagatggcaacccgcgtgggctcgtagaagtcaatcccctccagggcaggtacaagcttattccggtccaggaccccggcagtgtcctccacttgcacagacaccggcggatcagcgaaggcaaccgctgctccggccggcagcagcgctgccagaaccagcagcaggcccacaaacctctgcactgcggtgttcatctgagtcaaccttttgctcccctgcgcgctcacacggcgttccatccgttgtcggagggaagcactacgccattgatgttggaaccgtcccggctgagaaggaaggtgatcccggcggcgacttccccggcctccgcgatgggcggcacgtttgcctggagcagggggccaaggacctcggcgccaagctgggacttgaattccgcgtggatgttggtcctggtgccgccgggggctactgcattgacccggatgccgcggcgcccgtacatgactgccgagctgcgggtcaggccgatcagggcgtgtttggagacggtgtacacgaacccaagctccgcgtagtcggccaccagcttgtccagcccctccccgctcatgtcggtggcaattacccggccgccttcgcgggcaacgcgcacggcagatgcgcgtcctatcccggaggccgcgccggtgacgatgacggcctggccctcgaaccggcccggtgtgatgttttcctgccacacaaccatgggtgctcctcaatcctcagcacgtgttgcttcccgctgctgtgtggtgctctgcttggatgagcggttacacaggaacccccgccatcatcatgcagtgccagaagaagtcaccacagtgccgaaagtcccctgaccaggagcgcagaagctatgcaggattcaaggtccatcgttgccggctatgacggttcggctgaagctgcaaccgccatccattgggcggcggagcaggcgcagctgcgcaaccgcccccttcttgtggtgcactgctccctctggccgctgctgaccaggaacctcggccccgttcctggtgttgcggacagcgggctggagcgggcggcgcaggaaattctccaggaggggatcgcccgtgccgaagcagcggcacccgggctgaaggttgaaggcaccctgttgcacggactgccagcgtcgtacctcgccgagatctcttccggggaggagatgatcgtcgtcggcagccggggcttgggcgggttcctgggcctgctggtggggtccgtgagcctggaactggcggccaccgcagcgtgcccggtcgcagtgataaggccagatcttcaccctggcgggcccgtcgtcgtcgcggtggacggaacggggtcccccacggcgctggaggaagcctgtgaactcgcctcggcctgggcgacgggcctcaccgtcgtccacgtccagcacacaccgccaggattcgggcatcggcaaatgcccggcgccgaagctgccgccggggatgtcctcagttctgccctcggccgtgcccgcaccctggccccagccgttcctgtcgagggaaaggtgctcaccgatacgtcagtggcccatgccatcctcaaagcctcggaaggtgcacggatgctggtcgtgggcaccaagggccaggggctcctcagggagacgataggttccaccgcccatgctgtcctgcaccacgcacgtggcccggtcctcatttcacgccgcggcacaaccgcccgcatcagggaagaacaatgaacctcatgggagcactgttcgtagctggattggttcatcgggcacgatgggagccatgaccatcgaacttcgtctatggacatctgaagatgctccggcgctgtgcgccgcgtacggagagaacccggatttacacacacagttcggtggcgctgacctttccacggttgactccgcgcgtgactatatcggcaagcatttttccttcagtgaatccgggcgcaattgggccataagtattggcgatttagctgtgggcaatgtcggactgtccgccatagagcaacgccatggaactgcctgggcgttttactggctcacatcccctgctcgcggccgcggttatgcatcccgtgcccttgccacggtagctgccgaagctttcaacgacggcctcttccgcctcgaacttggacatcgagtcaacaacccggcgtcctgcaaagtagctacccgcgccggattcatccccgagggccttgagcgccagaagttgcagtacggtggcgaacggttcgatgtggagacgcatgcacggctacgcacggaccccatcccggatctggaacttctttcaacagcacgctgaggaatacccatggccatcaaattcgagaatgtcggcatcgccgtccgcgaccttgaagcagcaatcgccttttttaccgacctcgggctcactgtggttggccgtgacactgtcagcggcgagtggacagaaactgccgtaggactggatggcaaccacgccaagattgcgatgctcgagacgccagacggccatggtcaacttgagctctttgaatacatccaccccaaagcgaatgaaacggccccaacccgccccaacgacattggcatgcaccgcgttgccttctcggtggacaacctggacgaagcccttgaggtagccgccaagcacggatgccgaccgctgcggggggtggcgacctacgccgatgcctataagctcacgtacctccgcggccccagcggaatcattgtgatgctcgccgagaaactgcaggaagactgacaccccgcgacggcatattcttggccaccgggacctaggacccttatcgatcccggggccctcctccatccttgaggttgacgcagccgtccgggaacaacccgctcgccgaccagcaaggagcagttatgaaggcaattgtgtacggcgggcccgggaagaaatcctggaccgatgtgccggatccgtcgatcatcaatcccagcgacgccatcgtcaaggtggacaccaccaccatctgcggaacggacctgcacatcctcaagggtgatgtgccggcagtccaggagggacggatcctgggccacgaaggcgtgggaacaatcaccgaggtggggtcctccgtcaccacactgaaacctggcgaccgggtgatcatttcctgcatcaagtcctgcggccactgcgccaactgcaaaaccgggctctattcccattgcctgggggacgaaggcgcatcaggaatcggctgggtctttggccacctcatagacggcacccaggccgaatacgtccgcgttccctatgcggaaaactcccttcatctcctccctgagggggtcaccgacgaacaggccgtcatgctctcggacatcctccccacgggcttcgaaatcggggtccagtacggccgcgtgaagccaggggacactgtggccgtggtgggagcaggcccggttgggctggcagcgattgccactgcggggctctacggggcggccaccatcatcgccatagaccttgaccggaaccgcctggagcaatcccgcgccttcggggctacacacgttgtcctgtcgggtgattccgactggaaggaccaggtactgtcccatacggacgggcagggcgtggatgttgccattgaggccgtgggcattccagccacgttcagcatgtgcaccgatattgtccggcccggcggcacagttgccaatgttggcgtgcacggcaaaccggtggaactgcacctggagaacctctggatccagaacatcaacatcagcatgggcctggttaacgccaacaccacgccgatgctcctgaaactcgttgcgcagaagaagctgcccgcagaaaagttcgccacccaccatttccgctttgagcagttcatggacgcttacgacactttcgcccgggcagcggagaccaacgcactgaaggtggtcatcaccgcctgacgggcacggcacgggggcatccgaccggctgacagccgcaccgcggcctatgctggtccagtgacccctgccccctccccaagcccgctcgacgtcgtcgtccattcgggaccggctgactggtgggtcatccttgccggcctgggtcccctggccgtcctcatcgctgccctgctggcgttctacatcaattggcgaacgctcaaacagcgcactgctgccgatgccactgcgctggagcagaagcgggaagcggacgcccatgccctgctgcaaaaaaccgaggccgacagccgtgcggaatggtggcgccggacgcagtgggccctggaccgggcactggaccaggacgaagggacaaaggccctgggactggcaaccctggaagtcctggcgcgcagcgaactggcccgcaacgaagagcttgagttgttcgacatcgcctggaagagcgtgtggggcgaggaaaacgcggacgacgacgggcagggcaccggggcggaccaggagacggcgttcgtggacgccggcggcaacataggcgagaatggaaccacgggtgaagacactaccaaggaggttggaccatgagcgcagcatcgtctgaacaccggttcgtccatactccgcggagcgccaccgccaagccggccccgaagaaagccactcctgccgagcatcgcgtccaggtggctgctgccaggctgcgcgtcacgctcgaccagcgcctcggccgcgaaacaccggccaggaccaaggcgctggccagggaacccatctaggtttcgttttgcaggctgagaaggccaacgcacgtgggtgctggattgggtgagtagtggctgcagtaattcttggatgggacccaaccggatccgacccctgggactaccacgccgccgtcgggcttgtggcggagtccggcaaattcctgcggcgctggagtggcagccggccactcaacgtcccggcaggaactgaagcctggcttttcgtccagggccgcagcgacgccggcaccgggctgatcggccatgggatggtggtgtccgagccgtaccaggcgcttcccgacgacggcggcgccgcggcctggcacgtcagcgtgctgttcgacgcactgcttcccctcggtgagcagatccgtcaggacacgctccgcgcagcagtccccgggattgcctggagtgacacaatgaaccgcctaggcgttgccgttcctggtcacgcggtgcccggcatccgccgtctgtggcgggacctcgggcctgcggccaccggtcctccacacattgtttcgggcaccctcccgccggacgccgtcagcactatcgacatgaaccgccatgagcggaaccctgacgcacgccgggtgtgcctggcgttccatggaacgtcctgcgctgcctgcggtttctccttcgaagccttttatggcgacgccggttccgggtccattgatatccaccacgtggtgccgccggagatgctggggagcgggtaccagctggaccccgttgccgacctcgtgccgctgtgccccaattgccacgccctggcacaccccagcgccggcccgccgcgcaccgtgtcggagctccggcacatcatctcagcctccggccacctgaggggcgaggtggtcagcgactttgccctccatgcccaggaagatgcgaggaagatacttgaaggaccggggatataccggcaggagccccaggtctaggttgccgggcgttagcgccgcgcccgcctgaaggcgagagcggcgcgcgcgttgccggaaagatgcaccagggccgcgatcaccaggaaagccaccaggacctgggctatggacgccagggcagcaggccagccgcccccaagggtgggatccaggaaatcgtagacgtaccagccgtcgatcgaaccccgtgcccaggaaaagatgaggaaggccaccgggtaggcaagccacgccaggggccgccaccagggaccacggactgtcctcgtgaccaggagccagtcgagcacaacgtaaagcggggccaggcggtggtgggccatctgaggccagtacaggtcccagctccaccatggttcgtccggcggcgccacgaggacaatgtagatgagtcccgtcatcaccaggtagaggacaaacgcgccgaagaggtggtcccaccaccgcggaaacctggccgccggccatgccgccgatgcgataagcaggagcccgagtccaaggttcgcctggacggtgaattccgaatacagctggacgacgtcgacgtcgttgcccggcagggttgcgtcgtaggtcttctgcacgagggcggcgagcacgaacgcgcccaccagcagccggaccgccctaacccacgggctgtcgggatgcagggcgctgccaggtccagcgtgatgctccgccggggaaaccaacttgcgaggactgctcatgcgcaaagtgttgcacgccaggggcgtccctgcgcagggcacaaagaccgcctgtcagctccttccagccgctgggacccgcattccgctgtaggccatggcggctcctgccaggaatatgaggacagcgacgtagaccgggccgaggtgtccaagcgttgccaggccccaagggtaatgcgccgggacagagactgcgaggctgactgccgtgacggtgactgttgcggcgaaggcccaccgttccccccgccgcaccccgaaccaggacaaggctgcgatagccagcccggtggcagcgatgaagccgctgagcgcaatgtgcaggtggctgatgtagtgatacagctgggggctgaacgcctggacctccgccatgcccatgtccacctgttcgggaccgatgcccagctccaggaaggcgcccgaaaagttgagtgccaggaaagctgcggcgtaccccacgaaggccagcccggcgagagccatcagggctgctccggtccggagccgggactgctttgccggggtagtttggatggcaggcacagccgccaccccctctctggttcacgttcttccttgatgagagtcccctgtccgcacgcctgtcaagggaagcttctgcagagaaggctgggcgggagtcctccggattgggagacgcttcgacccggcggcacggagatgccggcagccacattcgccacaaaggcttgacggctgcaaaacgttttgcatatagtgatgcaagcaacatacaaaacgttttgcaaaggaacgaagtcaatggcgacaaaggtaaacatcagggacgtggccaaggccgcaggcgtctccgtgaccactgtgtcgcacgccctgagcgaagcgcacagctcccgggtcaacgcccggactgtggagcacatcaaggccgtggccggcgacctcggctacgcccctaaccggctggcaagcgggctgcgcaaccagcgctcccagatccttggccttgtcagcgacgaaatcaccaccaccccttttgccggtgccatgatccagggtgcacaggacgccgcttccgaacacgggcacctcctgatggtggtcaactccggcctcgacaacgaactcgaactccaggaaatccgggcactgcagcagcaccaggtggacggcattatcttcgcgcgcatgttcaaccagcaggtatccgtcccggaggagctccgggcagtgcccaccatcgtgctggatgccaccccggacaaccccgggctttcctccgtggtgccggacgagttcggcgccggtgattctgccgccgagctgctggtcacggcggggcaccgcaacatcgccatgatcaacaacgaggacgatattcccgctgcccacgggcggctcgcaggattccgggcaggcctggaccgccacggcctgcatctgccggcggagttccttgttgcgggccatcccagcacaacgggaggccgggaagcggcgctggagctgctgtccaggaaggagcgtcccacagcactgttctgcttcaacgaccagatggccatgggcgcctaccaggccgccggccacctcggccttcgcgtccctgaggatgtctcggtggtcggcgtggacaaccttgagctcatcgccgatgggctctggccgggcctgtccaccatggcactcccccactacgagatgggcagatgggctgtcctgaagctcctcaacgaactcgaaaaccccgaagcgccccggttacacgaaaagatcccctgcccgcttgttgagcgggagtctgtcgctccgcccaagggctgaccggcagcgccggcccagctactggcgcggccactctccaccgcatccacatctcccacgaaaacgggaacgcagccgttgcagcggccgcgttccctgcaggacccaatcaatccctccaccctgtccaagcagaaagaccgaaccatgaacaagaagctcaccaggatcctggcgaccagcatagccgctgccgccctcaccgccaccctcgccggctgcggcaagggcagcgcctcctcttccaccgaaggatccggcgaaattgccctgtggacccacaacgccggcaacccggaagaactggccgcggtgcaggggatcgtcgattcctacaacggcagccaggacaaagtgaagatcaaagtccaggccttcccccaggactcctacaacgactccgtggtctcggcggccgccgccggcaacctcccctgcattgtggacatcgacggccccaacgtccccaactgggcctgggccgggtacctggagcccctcgaactggacacggacctgtccaagcacctcccaagcaccgtggctgaatgggacgggaagccctacgccgtgggctactacgacgtggccctggccatgatggcccgcgcctcagacctggaggcggccggcgtccgggctgccaccatggagcagccctggaccaaggaagagttccaggacgccctcaccaagctcaaggccctcggcaagtgggagcacccgctggacctcggcacggccggcaccggtgagtggctcccctacgcctactcccccttcctgcagtccttcggcggagacctggtcaaccgggacggcttccagagtgcggatggtgaactgaacggcgacgaagccgtgcagtgggccaactggttccgcggactggccgacgggggcttcatggccaagaagagcggcaaggactccacccaggatttcctgaacaacaagagcgccatcgtgtacaccggttcgtgggctgcggacaaggccaaggaggccctcggtgatgacctggtggtcatgccgccggttgacctcggcgaaggcccgaagatcggcggcgcctcctggcagtggggcgtcaccagcggctgcagcgataccggggcagccatggactacctggcctattcactgaagccggagaacatcgccgcggttgccaaggccacgggtgccattccggccagcgaggaggctgcggcccagatccccagctttgccgagggcggtgccaaccggatcttcatggacttctcccgggaatacgcagtcatgcgccctgaaactcccgcctaccccttcatcgccaccgaattcggcaaggccacgcaggacatcctgaacggggccgacccccagtccacgctggacagcgccgtgaaggcgatcgacgccaacatcaagtccaacggcggctacaagaactagccggagcacgccggatggctgcggcgcaacgtgccgcagccatccggccgcccgacctacggagacccccatggctactgttccccttcccacacgcccacgtcctgccaccccggaaaccgccctgccgccgtcgaacgcgaaaggcaaggcccccaagacccacagccgccctggcttccgccgcgagcagctcagcggctggggcatgatcgccccggctgcagtgctgctgctgtccttcatcttcatcccggccatcctcggcttcggcctcgccttcaccaacgcccggctcatctcgccgcgtcccgtcgagttcgtgggcgtggacaacttcgcccgcctcttctcggaccccacgttctaccgggccctgctcaacgtcgcctatttcacggtggtcattgttccggtgcagtccggcctggcactggtgatggcgctgttgatcaacaagaagttccggggcgtgaatttcttccgcaccgtgtacttcctgcccgtggtcacctccatggtggtggtgtcgctgctgtggctgttcatgtaccgcaaggacggcctgatcaacgagatcctctccgcggtcagcttcggcctcatcgacggcccggactggctcggtgacccgaacacggctatgcctgccatcatcatcctgtccatctggcaggcagccggcttccacatgatcatctggcttgccgggctccagggcatctccggcgaactgtacgaggcgtcgcagctggacggcaccagccgctggcagcagttccgctacgtcacctggccgggcctcttccacacccgcagcctggtcctcgtgaccatcactatccaggcccttggcctcttcgaccagatcagcgtgatgacccagggcggtccgatggactcgaccaccaccatcatttacgaggcggtccagtccggctaccggcagcaggaaacctcctacgcctccgcgatctcgctggtgttcttcgtcctcgtcctgatcgtctccgcggtgcagcgccacctcacgcgggagaaagactgacatgaaaaaccaactgttcctgaaagacgcgggcaccatgctggtgcgcatcctcttcgccgtcgtcgccgcgttccccatcgtctttatgctggtgtcctcgctgaagccggaccagcagatcttcggcgatatgtcctccctggccgcgttcctgccggtaggcaacatctccttcgacaactacgcagccgtgttcgaccgcgtcccggccgcacgattcctgctcaactctgtgggcgtctcagccgtcacggtcatcctgggcatcttcgtcaacagcctctgcgccttcgccctgtcccgcatgcaggtccgcggcaagaagattgtgttcaccgcgatcctggccacgctgattgtgccgttccagaccctggccctgccgctggtgtggtgggtcaaccagctcccctactttgaactgaacggcttcagcctcgaattctccaagggctggctggacacgtaccaggtccagatcattccgttcatcgccaatgccttctccatctacctgttccaccagtacttcgagtccattcccaaagagctggacgaggccgcgcgcatcgacggcgccggctggttcaagatctaccgccaggtggtcatgccgctgtccggcccggccaccgccaccgtggcgatcctgaccttcctcccggcctggaactcctacctctggccgctgatggttgtccagtcggaggagctgcgtccggtgatgatcggcatccagtacttcttccagttgaacgtctcgtggggtgaggtgatggcgtacgcgtccctcatcacggttccggtggtagtgctcttcatcgccttccagcgttcgttcgtcaacagcatcgcctccagcggcgtgaagggctgaccgtgaattcattgacgacggcgccaggcgcaccttccgctcccaccgcgcgtgccgccgcccctgcccgtcccgccgcggaccgttaccggccggagttccacttcaccgccgaacgcaactggctgaacgatcccaacgggctggtgtacctcaacggcacctaccacctcttctaccaacacaaccccttcggcccgtactggggcaacatgtcctggggccacgcaatttccccggacctgctccattgggaagagcagccggtggccatcccgtgtgacgagcgtgaggccatcttctccggctcggccgtgtttgacgagcacaacaccagcgggttcggctccgccggcaatcctccactggttgccatttacaccagcgcctacagtgacgcttcgccgctggccggccggcaggcgcagtcgctggcgtacagcctcgacgagggcaccacctggaccaagtactccggcaacccggtcctggaccgcgcgtccgcggacttccgggacccgaaggttttttggtacgacggcggtgccggcagttactgggtgttggttgccgttgaggcggtgcagcgccaggtggtgctgtacaagtcggcggaccttaaaaactgggagcacctcagcacgttcggacctgccaacgccaccggcggggtctgggagtgcccggacctgttcgagctgccggtggacggcaacccggaggaaaccaggtgggtcctcatcgtcaacatcaacccgggcggcattgccggcggctcggccgggcagtacttcctgggcgcgttcgacggcgtggagttccgttccgggtcgacggttaccgagggcctgcaacaggacggcagccggatgcgtgagtacggctggctggactggggacgcgactactacgccgcggtctccttcagcggggtcgctgacggccggcggatcatgatcggctggatgaacaactgggactatgccggctccactcccaccggccactggcgcagtgcgatgtcgctgccgcgggaggtctcgctggcacgggctgacggcgggaaaatggtgcttcggcaaacggccattgacccgtttgcagggcaggaatccccgagcttcagcctgggtccgcaggccctcgaacccggcgttcaggaactgccggtggcggccgccgtggcgcggatggacgttgtattcgagccgggtacagcaacccgtgtgggggtggtggtccgggccggcgaagccgaacgcaccgtcatcagctacgacgttgcggacggcatccttcgcctcgaccggcgggagtcggggcaggtagatttccatgcggccttcccttccgttgaagccgtcgccgtaccgctgcgggatggccgccttcgattgtctgtccatctggaccgctgctccgtggaggtcttcgcccaggacgggctcgccaccatcacggaccttgtgttccccgcggaggagagcacggccctggcggtgttcgccgaaggtgggggcgcgcacctcgtggcgctcgacgtcgtcggacgctgacacccgccggtggtcccggctgccgggaccacctgccctcaggctggggacgtctcggtggagctcgtgtcggcagcctgcagccaggtggtcagcaccgcgcacgcgagctccaggttccccatctggcagtgctggtccgcgtgctcggcccgcgtgaacatccgcgtggtgacgcttcgggcggccacgagcgcctttgcctgggccctggccagtgctggcggttggaaggcgtcgtgttcgccgcacatcagcagcacgtcctggttcacccggccgctgtccaggtgtgtggcgttcatgcccaggaaccaatcggcgacgtctgccggatcgtctttgtcgagcatgtacaggacctggtccaccacaacacgcagggtgggaaacagccgggcccgggtccgcacgctccaccgcatgaagccgcggtgtcgcaccatggcatggatcgggccgcgcgccacgcgtggcaccctgtaaagccagtcgtaaaccggtggccaggccacgacacggtggatccggggctcgcgtcctgcggcacgcaatgcccagtaaccgcccatcgagattcccaccagggcagcctggtccagccggaagttgtccaacaccgccccaaccggcttttcccagtcgtggtcgaaggtgagtccgtttaacgtccgcgcacggccttggcccggcccctcgaaggcaaccacggtgaaacctgcggccgcgatcctttggcagatggggaagaactcctcgatcagggagtcgaacccgccgtgcagcagcaccgtgccgccgtttcgtgggccggacgccggaagcgaataggccggcagcgacgccccgccgtaggggatgttgtgacgtgtcagtccagcaccgaatgccgtgtcgaagagctgcaggtagcggcggtagcggtccgttttctccactgaccgtggtggtgtgaagaactccgcgatcctcgcgtaacccgccgcctgccggtgccggtcctctgctgcggcccggttggacaaggtctcgaacacggccgcgcagtcatccatcccccgcacgtgtggtgcggcgctgagcagctcatcccggtcggcgaagcccagcgcatgtgcgcggttgagttggtagtgaatgaagtcccgccggtggaaccgttcgaatcccaccggcagggcaacaagcgctgggctcatcactgcccagcttgtgtggttccaaacatcagggtccgccgccgcacatcgtagtagacggtgtctgaccgtttcaggaggccatggaggacctcggcatcttcggcgtcgagcgtgagcacttcttcccaggccccttggtcgaggaccagctgaagggtccacgtaccaggctttcctgcgtctccggccacccagctgaactggtaatggttgacctgccggacttggatgctgtcatctgtgatcggttgttttggcgtggggctcatggtcccctcctcgtttcgctgtggcgggcccgctgcataagccaagcaccaatctagacctggtgtacctcatgatccagagccgattgattcagcccggtcgcggaggttcagcagcattttgcgcatcatccagaagtcgccgaactcaagaagaagagagaaggcgatggtgggtgagagccaccggtaccgagaacgaacgcggctgattaaccgcgttgaaccgtccgaacaagggtcgagttgccacgtccaggtggtgtcaccgggcgtaccccagatcatggacctaggcgcgtcgatcgcctgtactggcatgccgtgcttgccgtcgggactcattggcacgatgtcgcccacggcgaggttctggagttccggaatgattcgccgggcgctggggcggcccaggttgtcgaggatgtcgtagctgtaccagccggcccgggtgagtccggcctggaccagccacggccagatccgctccggtggcgcgccaaccgtgatgacccgcgtggcgttgaacgttggcctcggcacgaggtcgtcgccgggcaaagaccgcgcgacctcttccggcatggcgccccagtggagctgccaaggacgcacgtaccgggcatacgttgtgatcgcaacggacgctgcgatcactatgctccaacgcaggtgggcttgcatcacccaagtatgtccgtcactcccctgccggttccagaggccaaacgtcccggccagttcagcgaccgccgagcccctgaaggattgctgcgccccattgcgcgctgttagccaggatcacgaacccgactgccggaacgctcaacgcccaggctgcctgccgccgtcgtgcctggtccacaagcagccggagggaagtaaagctgcgttgaagggccggcagatcggtcatggcaggaggctgccggcaccaggtccccggctgaacggccgcctgcgcgatctgtgccacctgctccgtacccagcacgggctgcaactggcgcagccaggcaaggagccgcgcctccctcaccacagccacgcgctcgggccgcgctttgatggttaacttcttcgggttgacgatgacgacgacgccggtcacctcgacatggaagccagccgcggtgctcagaagctttgctgcccgggcggcttcgtgcgcagagcaaagaaggtgccgcgtcctctttcccgcaaccaggagtgcccgcccggccacccagacaggctggccggagtggttcttggtgttcaaagtaaaaactcccgccggccctaccagcacgtggtctatatccgcggagcctgtgcccaccggtactgcatgcaagaccagccactcggggccgagcccctcaaggattcgcccgacggcgatctcgccgagcgcccccttgtaccacgttatggtttccggtctgagcgggctggcaccaaacacccgctgcagccatttacggggcggaacgcggctttggagcgccatcaactcttcgatcactgcctgcccgggaacccgctcgcccaactgcagtggtgtggcatcagcgctcatggccgtctcccaaactttcggatgctggacagcgtagatcgggaagagatcgaaaaacagccgcaaagggccctgatcctgaatgcttcccgaatatttgcccaacgttgagcccttcttgcgggagcgtgaatttggtgccttagccaagacctcgcagcctcctgctacgtcccttctagggcagcccgtccgctgcgccaagtccgcgccgggcgacgacgtacccccagagcaacagcgcgtgtggacgcgttccccgccagctcagggggacagaaaagccgtcccgctccacaacagtggctgaccaccggcggcgtaccagcccgggccggcggagtcggacattgtcgaggtaggcgtacgggatccatcgccctgcgtgttgctttgcaagcctgactgcacgcgccgacgtcacggtggcgcgctgaaagcgggggttttcgccctggtccaacggaccatgcggaatggttccggcgggcaggataaggatgccgttcatgttgacccacacttgaacccgcctgccatcgctggcggcgtccccggaaaccagccggcacaggtcatcgtcctcttcaggttccactgactgcggcggatgggacgcagtggctgaggtgtccggctggtccgcgaaataggggtcatgcgccctcacgttggcagctgcgacagcctgcatcacggctgcgcgcaatccatcagcgcacaaccggggcgcggcaacggcgaacacctcccggtcgagctgtacaaccgagcggacgccggcctgcccacccaagagttcggccagatcgtcatggtcggggcggacaagcaggccaacttcatcgcccagtcccacctgccagctatggccggcaatctcgggttcggtctcgagctccacatcgatccagtccgccaactccaccgcaccaaccggtctgagatcctcccctgcaatgcacggcctgaggagtcccagacggtgcaaaagatcagtggtgtggacagtacagtcatgcttgtgcggtcggtgctgcaccatcaggctcccccaggattagtgcgggccaggacctggacgccccaaacggcaggcgccccggttcgcttcctgggtccacatcgagatgacatcgaataagccggtttcgaagtgagttcgatactaagtcatcccacctggggagatgcaggtcccagaccaaaacttttgatccggcacgtggggatgttgccgtgctgcatctgcaccgctggcagccgtgtcagttccaagggaccttgggctctgggggccgggccggccgggccgtaatgtcatggcatccaggatttccgtggcggtgtgcacaggttccgtaggatgcccggacacttacctcaggagacaggaagatgctttcacttcgaaccgcggaccaccgcagaacggcccgcattccggggcgttgggttccgggagccatcgggaccgcaatggctgtcggtgtccttacccacgtcgtgctgccccgtcttttaggtaggtggggtgctgccgggtcagaggcgggtatgccgcttccaggggatcacctgatccctgaacccgactccgtgcagacaatggcagtgaccatctccgcgccgccagcgcaggtatggccctggctggtgcagatgggggttgaccgggccggactgtactcgtacacgtgggttgagaacggactgctccatttgggcgtaaccaacgcagataggatccacccggagtggcaggacctcgcagtaggcgacattattgccttcacgcccgcccgttaccccggagggcgcatggggccccgggtagtggagctggagagcggccggcacctcgttctcgacgcaagccctggcgcgccgccgggcacggtcaccggaacgtggcagttcatcctccacgaagcggacgacggcgggacgcggctgctgctgcggacacgcagcggcccgggccggcccgcagcgctgcgcttcatggacttcctgctgcagccggcttacctggtcatggatcgcgcgatgctgttgggcatcaaacagcgcgctgagcgggaggcgcagaaggactatggctatgcggaaagcccgctcagctaactccggttcgggcgcctggcgatcgggataaggcgagcgcccatccacctgcgattccaatggcaagcagtacggtgatgaagccgatcaccggtgcgcttggccatgtcagggcacctccataccgcagcagggcgagcgcctgcagaatgacaaaggcaatggaggtcagggccacggggcggacggcgcggagatcggcgctggactggccctgcgcagcggaccatcccaggccgaccagccacgctccgatggccctcgccgtcagctcggacagcgtccacggccaccacgtcgcggcgtaagtaggcaccgccaaaagcgccacgccgtataacagcagtaccccggcgattcccaccataagcagccggagcgcagggggcagcaccggccgtcgcggcgtcacggacgttagagcaggacgccgggagcggttctgcaaccagctgatcacgagcatcgccacgggcacggtggcataaattgccaaccaagcccaggtggccacctgggcaagtgcgccagtgtccggcgacaagtgaaaacgatcgagatgaagcagcgtgactccgagagtcagcgtggtgaagacgaacacgggccagactgccagcctcgctgactcccaactcgctgagcgggcgcccgctatctccaagccggcggccgaccagtatgcggccccgaggaagacggcggtcatgggcggattgactgtccacgcgaaccattccgcagtccgtagcggaaacacgaacagcaccagcccggcaaggaacacgaggaatgcagcgacgtagagcagcagccgcatcgccggaatcaacggtgtgacctcagctgaagcgggcatcaccgggcagctcctcgggtactgccaccccacccgggggaaaggcgggcagggggtgctcggccaggtaggtgtggagcatcgagaccacggtggccccgtccccgacggcagtagccacccttttgatcgaaccggcccgcacgtcgccgatcgcgaagatgccgggcatgctggtttccagggccagtggatgcctgccgggcctgatggacccggcgtcattcacctcccggttggcgccggtgcggaggaaaccggcctggtcacgctctacggtgtcgggcagccaggaggtccgcggcaccgaaccgatgagcacgaataaaccgccggcttcgatctcctcgctcggcgttgagtcgggggctccgggtgcggcgaccttgaccgcggcaaggaatccgtcccggtcgcgggcacccatgatcacggtgccatagcggatcgcaacgttcctggtggcctccagttgggagatgaggtattccgacatgctcaccgacagagtgggtccacgcaccagcagcgtcaccttcttcgcaaatttcgcaaggtgcaggacagcctgtccggccgagttgccgccgcccacaacacagacgtactttccggccatcgacggtgcctcggagacagtggccccgtagaagacgcccctgcccaccagatcctctacttggggtatgcctatgcggcggtagtccacgccggtggccaccaccactgtgcggcaccgcaccacgctgccatcggaaatcgacacagaatacagtgctccgtccgcgccgaggccctccaccttccgcaagaacaggaagtccgtgcccaaagtccaggcctggtgaaacgagcggtaggccaggtgggcgccgctgacaccgcgggagaagccagggtagttgcggatcaaggaactggtgccggcctggcccccaacagcttctccctccaccaccatggtggcgaggccctccgaggaggcgtatacagcggccgcaagaccggagggaccggctcccaccacaaccacatcaaagatcttgtccgccggtggcggtcgcgtcacgcccatcgcttcggcgatctccaggtcactggggttctggaggacaattggtgaagtggtgaactccagcaccagaaccggcagcctggggtcgcgcaggcccaggctctccagcgtcctttccgcggtctcggacccggcagcgtggaagcccaccgggatgtggtttcggctcaaggaatcgcgcagccaatgggtcctctcgtcgccaacctccccgatcagccggaccgcctcgaacccgacgccctgtgccaggtgccagtcgtcaagggcgtcagtgatcgccccgtggaattcttcgtcgcgcgctcgttcgggtcgtatgatcagcagctccgcgtacccctgcccgatcgcccggaatacagtgggggcgctggcgaagtcaccccaagtcaccacaactgcacgttttgcggccgggtgaaagccataggcacgacgcaggaaatcaaggccaccgcgatccgccggtccgtagcatccgagtatgagcgcgaccgggcgattccagcgccggagtccctcaagcaccgcccgcccgtgggcgtgtccctcgcaggccactacctcgtaatcggcaccgtagcgtcggcgtaactcatctccgagaatgcgccgtgagtccgagtctgtggtggcaatcagcatgatcggaaccgagtgctccatggccgccgtctttccggttcaatggttcggtggcgctcacgatactcgcggtaggacacaagcgacaaggggtgctgttttggtccttctttaccggggccggggttatatcgaaccccgctggccgcctggattccgccattccaaagatgcagagattctgccagaatggctcccgacggagggctggcaggacgacttgaacgggaccggagcgatggaagtggaggaccccatggaggaccgccctatcccgggaatcagccttaccgccacacccagtggaacggggtgtctggagtgcctcagcggtgacggcccgggatggtggctgcatcttcgtcgctgcgcccagtgcggccacatcggatgctgcgattcatcaccctcccagcacgccagtgcccacgcgcgcaccgccggacacccggtcatgaggtcctttgaacccggggaggactggttctacaaccacaccacaaagaagttcttccgtggtccgcggcttccggatcctgagtccaggccaccggagcagccctcacctgcaccgccagacaaggtaccggcagactggcgggagcgcatccaccggtaacagcggatccagaaccaaccgcggccgcctgctagtgacccgggagcacgcactggctaaaatcagggttcagcgctcaatcggcagagcccgggcgagcagagaggccagccatggatttcagtgcgtcccctgaatatcagctcgaccctttcccctactacgcacgaatgcgcgaaacagcccctgtctattacgacgaacaatctggcagttggcacgtcttccggcacgacgacgttcagcgggctttgtccgaatattcaaccttctcgtcgcacatgggaggtgacgatgcatcggggaccggccaactgttttcctcgagcctgatcgccaccgatcctccaaggcaccggcagctacgctccctggtcacccaggcttttacgcccaaagccgtggatgcgctggcgccccgcatcgccgggctcacggacgagctactggagggaatcgcggaccgcggcagcgcagacctgattaaggaactggcgtacccgttgcctgtcatagtgatctccgaactcatggggatccccgcgcaggaccgtgagcgcttcaaacagtggtccgatgtgatcgtcagccaaacacggaccgggtcggccagcgagaatcacatcgccgcaaacatggagatgacgcagtacttcctggccctgatcgaccaacgcaggagccagccgggacatgacctgatcagcaccctgctggcagcggagattgacggccaaaaactgacggtgccggaactgctcggtttttgcgctttgctgctcgtcgcaggcaatgagaccaccaccaatctgatcggcaacgctgttttgtgcctggctgagaaccccggcaccatggaccgcctgctgagggaacccgccctgctgccccagaccatcgaagaggtgctgcgttttcgatcgccggtccagtccatgtatcgaatgactgtcgcggaggcagccttgggagacgaagtgattcccgccggcgcaccggtcgtggcttggataggctccgccaaccgcgacgagcggcagtttcagcggcctgccgagttcgacatagaccgcggccagaacaggcacctggcattcggccacggcgttcacttttgccttggcgcgccccttgcccggctcgaagccaggattgcgctgggtgccctgctgtcccgttttcccgggctttccctggttccaggagcgcatctggaacgaatggacagcactatcgtctacggggtgaaggcactcccggtgagttggcagccagcctgaccggcaagagttggcgcgcccatgggagcgacggataggcggcaggtggttgtacttttttgttggccagcaacagctggcctgtccctgcagcagatgaaggcggacggtaacgtcccactgctcactccggccggtcctcaagggacgagatgatactgccgcagccttggaagaacattcgccggccaagaccgccgtcagcccagatccagacaatggagtagtcgcccgtcatggcatccacgacgcccgtgccggaaaggccggcgtccagaaagctcaccctctcccctattgtgaaccgcggatgccggatcctcttccgacgcagcttcgagtgggaggttccggttaccactggaagatgcctgtcggctggaaggtgaacacgttcatgaaattccttgggtcgcgggcggttctgccagctcattacaaccctgcccgctgctcccaggtcacgcatacacgtggtgaaatcacagtatccgtattgatgggacgctgcaccgagaacgcttgtttttcgaatgtgaccggccaacgccttccagccataggctgccgctacatcggcagcaggaagggcgaggacacctggcggttcaccttcatccttggtccggtaccaagccatatcactctgcgcgccctcgctgaggacggctcggtgctcgccgagcaggtgaacgatcaccgtgagtggcctgtgaccggcagattttcatgggcctaggtggccactgccatcgagcgggtggataggctgggtggatggcgacagttatcctcgtgcggcacggccgcaccacagccaatgccactggactgctggccggccgggctgccggtgtcagcctggaccaggttgggcgcgagcaggcggctctgaccggagagcgtctcgcggcagtgcccgtagttggggtggtatcgagccctctcgagcgttgtcagcaaaccgcccagctcatcctcgatcgccaggccggcactccgtacgcgccgttggaacccgatcttacggagtgcgattacggccaatggcagggccgtacgctcagtgatctcgcaaccgaagatctgtggtcggctgtgcaatcgcagccgtccgccgtcatctttcccggcggtgaatccatggccgggatgcaggctcgagcggtagcagctattcgacgccacgatgcagccttcgaagccgagtacgggccaggagccgtatgggtggcggtgagtcacggtgacgtcatcaaatcaatcgttgccgacgcgctgggcatgcaccttgacctgttccagcgcattaacgtgggccctgcctcggtatcgatcgtgcactacagcgccactcggcccagcgtttacgcaaccaacaccgatgccggggacctgtcgtggctgtcgaacagcatcctccctgccgacgcgccggtgggcggcggtgcagggcaacaggcgccatgaggcgcctgtgcctaaaatgctcttatgcctacacgtgttcatgagttcgactggcctgatcgggtcgtcgtcggcaccattggccttccgggggcacggacgttctacctgcaggtgcgggcagggaaccagatcgtcagtatcgccatggagaagcagcagtcggccctgctcgcggagaagatcgacgaaatcctcgaccagcttctcaccgtcgagggcaaccctcacagcgttcccaccagcactcccattgaactggttgacaatgacgagcttgaggccgttgaggagcagtttcggaccggcgccatgggcttagggtgggacccgacgacggcgcaggtcgtgatcgaggcctacccgatcaccgatgtcgacgctgatagtgacgacgaagcaccagatgaggatgacgccgaggtgcccgaaatgctgctggtgcggatgcccgttggcaccgcccgcgcatttgctaagcgcacgcgggaggttgtgggcgccgggcgtcccgcgtgcccggtctgcggttaccccgtagacgccgacgggcacgtctgcactttgcccgaggcgtgatgccggcgccggacctggtgacggccgagctgacgctcaccgggcgcattacgacggcgtcgaacgcaaccttcgtgggcagcatcggcgacaccacggttgtctacaagccgatagccggcgagaaaccgctgtgggattttcccgacggcgtccttgcccaccgggaggttgccgcctacctggtctcggaggtcctcggctggaacgtggtgccccgcacctggctgcgcgacggtccgttaggcgaagggatggtgcagctgtggcaggagagagaccccgaccagaacgcggtggacctcattgcgtcggatgacgtaccggagatcgggtggaaacacgtcctcgaaggtcaggatgagaccggacgaatggtcgcgctcatacacgaggactctccggcgctcagacgcatggcggtattcgacgtcgtcgtgaacaacgcagaccgcaaaggcgaccacatccttgccatgacggacggacaccggcacggcgtggaccacgggcttacctttcaccgcgaccacaagctgcgcacggtgctgtgggggtggctgggagacgccctgacgggcgacgaacttgagggcatcgaccgcgtcagcgcaggactggacggtgagctgggccgaaaccttgctgacctgctcagcgccgaagaaattgcgtcgctcgctgcgcgctgtgcccggttgcgctcggcgggtcggttccccgctccaagcggtcagatgtcggcggtgccctggccgctgttctgagcaggaaccgcagcttctgcaaaacagggcacgaaagaggcccgaacccgcggatcacgcgggtccgggccttgaccagcccttcggtcgggcgggactcagacggaaactcttagaagtcccagtcctcatcctcagtgttgacggccttgccgatcacgtacgacgaacctgaccccgagaagaagtcgtggttctcgtcagcgttgggcgacagtgccgagaggatggccgggttcacgtcggtgacagacgccgggaacatggcctcgtagcccaggttcatcagggccttgttggcgttgtagtgcaggaacttcttgacgtcctcggccaggccaacaccgtcgtaaagatcgtgcgtgtactggacttcgttctcgtacagctcgaagagcagttcgaacgtgtagtccttgatttcctggcggcgctccggggaaacggcttccaggccacgctggaacttgtagccgatgtagtagccgtgcactgcctcatcgcggatgatcaggcggatcaggtcagccgtgttcgtcagcttggcgcgtgatgaccagtacatgggcaggtagaagcccgagtagaacaggaagctctccagcagggtggaggccaccttccgcttcagggggtcgtcgccctggtagtagtccatgacgatctgggccttcttctgaaggttctcgttctcggtggaccagcggaatgcctcgtcgatctccttggtggaggccagcgtggagaagatggaggagtagctcttggcgtgcaccgattccatgaacgcgatgttcgtgtagacggcttcctcgtgaggagtcagggcatcagggatgaggctgacagcgccgacagttgcctgcacagtgtccagcagggtgaggcccgtgaacacgcgcatggtgagctgctgctccgccggcgtcagcgtgttccacgactggacgtcattggacagcggcaccttctccggcagccagaagttgttgaccagtcggttccagacgtccacgtccttgtcgtcctggatgcggttccagttgatggcctcgacgtggctaagcagcttgaccttctcggtcatgtcatcccctaagcgttgggtggttttctctaagttaaagcgtacgacggcgggcgggcacccgccgtcgtactggcacatttagttgaagactaaagcatgcaggaaacgcagccctcaacctccgtcccttccagcgcgagctggcggagacggatgtagtagatggtcttgatgcccttcttccaggcgtagatctgggccttgttgatgtcgcgcgtggtggcggtgtccttgaagaacagcgtcagggacaggccctggtccacgtgctgcgttgcagcagcgtaggtgtcgataaccttctcgtaaccgatctcgtacgcgtcctggtagtactccaggttgtcgttggtgaggtacggcgccgggtagtacacgcggcccagcttgccttccttgcggatctcaatcttggacgccaccgggtggatcgaggaggtggagttgttgatgtaggagatcgaaccggtgggcgggacagcctgcaggttctggttgtagatgccgtgctccatgacggaagccttcagcgccagccagtcagcctgcgtggggatgtgcacgttcttgaacagctccgcaaccttttcagtctgcggcagccattcctgctccgtgtacttgtcgaagaactcgccggaggcgtacttggacttctcgaagccgccgaaggtctggccggtctcgatggccagcaggttggaggcgcggaccgcgtggtacaccaccgagtagaagtagatgttggtgaagtccaggccctcttcggaaccgtagtggacccgctcacgcgccaggtagccgtgcaggttcatctggcccaggccgatggcgtggctctggtcgttgcccttggcgatggacggcaccgaggtgatgttggacatgtcggacactgccgagagcgagcggatggccgtctcgatggtcagcccgaagtccggcgagtccatggtcttcgcgatgttcagcgagcccaggttgcaggagatgtccttgccggtgtcgtcgtaggacaggtcatcgttgtacgtggtgggctgggagacctggaggatttccgagcacaggttggacatgatgatcttgccgtcgatcgggttggcccggttcacggtgtcctcgaacatgatgtacgggtacccggattcgaactggatctcggcgagggtctggaagaactctcgcgccttgatcttggtcttcttgatccgggaatcgtccaccatctcgtagtacttctcggtgaccgagacgtcggagaacggcatgccgtagacgcgttcgacgtcgtacggggagaacaggtacatgtcctcgtcccgcttggccagctcgaacgtgatgtccggaatcacgacgccgagcgagagggtcttgatgcggatcttctcgtccgcgttctcgcgcttggtatccaggaaccggtagatgtccgggtggtgcgcatgcaggtacaccgcaccggcaccctggcgggcaccaagctggttggcgtaggagaagctgtcttcgaggagcttcatcacggggatgacgccggaggactggttctcgatctgcttgatgggcgcgcccacctcgcggatgttggtcagcgcgaaggccacgccgccgccgcgcttggacagctgcagggcggagttgatggagcggccgatcgactccatgttgtcttcgatgcggagcaggaagcaggagaccagctcaccgcgctgcttcttgccggcgttcaggaacgtgggggtggccggctggaaacggccttcgatgatctcatccaccatctgcagggcaagctgctcgttgccgcgggccaggtgcagggcaaccatgcagacgcggtcctcatagcgctccaggaaacgcttgccgtcgaacgtcttcaacgtgtaggacgtgtagaacttgaacgcgcccaggaaggtctcgaagcggaacttcttcttgtatgcgcggttgaacagctcacggatgaagttcatcgtgtactggtccagcgtttcgcgctcgtagtagtcgttcttgaccaggtactcgagcttctcttccaggtcgtggaagaacacggtgttgttgttgacgtgctgcaggaagtactggtgcgcagcctcacggtcggcctcgaactggatctcgccattggggccgtacaggttcagcatcgcgttgagctcgtggtagcccaggcccttgtacgctgcgggcatctcgggcttctcggccctggttacttctgtgtctgcgacagtcgtgtccaaaacgtgtccaatccattgtttacgcgggccacgtcttctggcgtgcccattaattcgaagcggtagaggtgcggtaccccgcacttggcggcgatgatgtcccccgccatgcagtagttgtccccgaagttggtgttgccggccccaataacaccgcgcagaagctccctgttctgcgggttgttcaggaaccggatgacctgcttgggaacggacccctctcccccggtgcctccgtaggtgggcaccaccagcacgaacggccgggtggcgaggaggggtgcgtccttggctaagagcgggatccgggccacctcacggccaagcttcgagacaaagcggctggtgttctcggatgccgaggaaaagtagatgagccggctgcctgtggctaccggcgggaccggcccggaagaatccacacgctgagccgcgtagaaatcctggactgctggcgctgccgttgaagtcacctcggctggttgttggttcccggcagggaaagggtacttatgccacggaggaaacggcggagagagccagttcctcgatcttgtccggacggaaacctgaccagtggtcctggtccgtgaccacaacgggagcctgcatgtagcccagtgacttcaggcgctcgagggcctcggcgtcctgggagatgtcaacgctctggtaggtgatgccctttttgtcgagcgcccggtaggtggcgttgcactgaacacaagcaggctttgtgtaaaccgttacggtcatggttcctgtccccttttctggaaaacttgctggtccggtgtccccgcccaagctgtacctagatactacatctagtgcagacgcctctttggaaccccaagatgatgtattacaagtatgtcatttaatgcacttttaatccacaggcaggtgcctccaaaatgtccggaatcccgctgtttttgtggacgaagtccacaccctgtggagtacttagccacatttttcacccagcgtgtcggggaaaagacggcgtgtcggatagtgccggctcccgccaaagaagagtcaagaatcactgcatgtagtgatccattcggcccaggacggctggctgccggagccgtagcatcaaagggtgcaggagcagctttcccgggtagcgcacgggccgggacggccccagcggcgggaaccgcaataaggactggtagggcaatcaggaccgatagagagggcacgacgatgaaactcaccacactggcatggtccacggccgcaaccgtagcgactgctgctgcgggcggagcagcgaccgacccgaacagcagctggtaccttcggctgcggaagcccgggtggcagccgccggcgattgccttccctgtcgtgtggacggccttgtacgcggaccttgcagtgagttccgccgtcgccctggacagcgccgccacaaaagatgttgcggccgggcgggacagcaccgcagccgggactacctcgacaaacagcaagggcaaccgaccggaggtccgcgcctaccagggcgccctcgcggcaaaccttgtcctcaatgccacctggagctggctgttctggcgctcccgccggccctggctcgcagcagcggaagcggcattgctggcggccagcagcgcggacctggtgcggcgcacataccgcttgaacccccccgccggagcagccctcggcccctacgccgcatggtgcgggtttgccaccgtgctgtccgcgtcaattgcccggctcaattccggcagcggcaggcgttgacaggagtgcgccagttcagccccgcgccaggaggttgtcccggatctcccggcgcaggaccttgccaatgagtgagcgtggcagcgagtccagaatgaccacccggcgcggcaccttgtaggcggtgaggtgttcccgtgcaaaagacaggagtgcgtcgggatcgacggtggtgcccggaaccgggaccaccgcggccaccacatcctcgccgcctccgccgcgcggcagccccaccaccgagacctccgcaacatccgcaaaggtggcgagaacctcctccacctcgctcggcgaaacgttgaagccgccggtgatgatcagttccttgatccggtcccggatggtgacgaagtggtcatcgtccacggagacgatgtcgccggtacggaaccagccgccgtcgagcagggcgtcctcggtctcctctggccggttccagtatccgttgaacacctgggggccgcggatcaggagctccccctcctcacccggggcccggtccagcgccacgttgcgggggtccaccacccggatgtcggtcagcggaaacggtactcccacggtgcctggtttgcgggtgggaccgaacgggttgccgatggcgatgggagaggtttcggtcagcccgtagccctcgatcaggtagccgccggtggctttctcccacgtctctaccgtcgccgccggcaggttcatggccccggagatcgaaaaacgaatgctttccagcccaatgccccgttccgccgccgcggcggcaatccggtcgtagatcggcggcaccgccggcaggaacgtcgccggggacttcctgaacgccttgagtacaaggtcgacgtcgaatttggggaacaggaccagcttcgccccgatactcagcgcgaaggtcatgcacagcgtcagtccgtacgcgtggaacagcggcagcactgcgtagacggtttcccggccatccttgagcccgggcacccaggcccggccctgcgcagcgttggcctgcaggttggcgtgactcagcatggcgcccttgggtgagccggtggtcccggaggtgtactgcacgacggcgaggtccgccgccgccgggcggggatgcttcttccggagagcgccgttttccaggagctgccgccatgacaacacgggccgcagggcaggagcggcgctgcctttcgcgtggtccttgccaacggtcagggcggcacgggctttgcgggccgcgggaaccgggaaccgcagcgccacccgctgcagcaacggcatagcggggattagctccacggaaacgatagtgcggagcccgacgtccgccggcagctggcggacccgctccacggccttgtcccatacgattgcgacgacggccgcgtggtcctcaaacaggtgacgcagttcgcggtccgtgtagagggggttgtgctcgaccaccacggcaccgaggcgcagcaccgcatggaacgctatgacgtgctgggggcagttcggcatgaccagggcaaccctgtcaccgggtttgacacccagcttcttcaggcccgccgctgcccggctgatgagtgttccgagctcgcggtagctggtccgggctccaaagaattccagggcggtcttgttcccgtacctgcgcaccgactgatccacgaggtccaccagcgaatcctccgggagcaccggggcggcgggcacccctggcccgtacgaagcagtccaggggcgttcaccccagtgcatccctggctggggagccgctgcgtttccggcggcgccggacgccttacgcgtggccttcatcgtcataaccgtccttgccgctggaaccgccagttagcgggcctggcggcacgccgcaaagaatcctacccgtgcaggtgcggcgggcaacacgcggcaccgctgttacagctgcgcctcccggcggtccagcaccacctgctgcacgtccaggtagccggactggaaccctgcccgcgagtagcacaggtagaacagccacatccgctggaacaccgcgtcaaagcccagctcccccacctcccgggaccgctcaaggaaccgttcctcccagagccgcagggtggcggcgtaatggtcccccatgcccatcctctcgcgcacccgcagcgtggtgtgctgctgggtgatgctctcgatggcgcggacggagggcaggaagccgccggggaaaatgtacttgtggacccaggtgtaggcgttccgggtggcgagcatgcggccgtgcggcatggtgatggcctggatggccaccttgccgccgggtgccagcacccggtcgatggtctggaagtaaatgggccagtactcgtagcccacagcctcgatcatctccaccgagacaacggcgtcgtactccccctcaacagcccggtaatcctgcagggccacggtgaccttgtccgcgtagccggcagccgcaatgcgttcctgcgcgagggcctgctgttcgctggacagggtgacgctgtagacggtggcgccgcgggctgctgcccgcagtgccagttcaccccagccggtgccgatttccaagagccgggtgccggcaccgacgccggccttgtccagcagcctgtcgatcttcgcctgctgcgcttccgccagcgcctcccagccaacagaagccaggggttcagcggtaagcggaaacagggccgacgagtaactcatggtggagtcgaggaagttggagaacaggtcgttggacaggtcgtagtgccgggagatgttgctgcgggtgttctgctcggcgttccgttcctgccggggcgtgcgcggcaggtacagcgcgcgcagcttctgcagcggcgtgggaatgagcgtgtccaccgaggcggcgaagacctccagcactcctgcgaggtcgctggcttcccagtccccggccatgaaggactcgcccagcccgatcagcccgttgtcgccgatccgggcttcaaatgcgtgcggccggaccatagtcatcaccggcgcgtccgggccgcccgtgccaagcacggtgccgtcggggtactccacgcgcaggggcaaccgcttcacggcccccctaaagaggaggccggcagcttttccggccaccgctgctttggctcccgacggcggctgcgcaacttccggccacaggtccggatcgatggttgcgggcgacgccggcaccccggttgccgtccacgttgcggcatacggcgtggcagcatcctccagcgtcttgcgctgcgccttgcctccggtggatgcagttgcctggttgtcgtccgtcattgtcattgaactgcctcctgtgaggggtggtgtggtcgggcgacaaccggcaggcgtcttgcccagagtgtaatgccctgcaccctgatgagtgcggaaaccagcagtggcgcggcaggtacggcaaccgccgccgccaggatgttccggagcgtggcggaccggcgcgtgccgtccatggacgccacgaaaggccggtggccctcgcgctccagcacgatggacaccccgagccgctcccccggcgcgggcagcttcatgcggtactgcccgtccacatcgttgaacggcgaaacgtagaacgccttcggcaccgaggcgcggcccgccgcatccgtctgcagcaggtaacagtgccgctccccgtacgtgttgtggacttcggccaccacgcactcaagttcgccgttggtccggtagcaccagaacagcgtcagggggttgaaaacgtagccgaaaaccctggcgctggtcagcatgtggatcgcgccgccgtcgggctctatgccctgggtgcgcaggaaccgctccacgttgctcctgatgctggcgccggggtcccccaggtggtcaccggaccggaacacggccagcgggcggagcaggaacgggaggcggggcagctggtccacgtcaacaaaccacgagtagctgcggtaggtgaaggcgttcttcagcggcgtgcggcgcacatgcgaaatggccgtgcggtagatcgctgcctcaatggtcatgccggctcagccgcggaaagcagctcccgttccccgccgtccccggactcaacctggtcagcaggctcggcggccagccaagagcggccaagcgcctcggccgcccgcaccccggagagtgcgccgtcctcatggaaaccccagcccaggtaggcgccggcgtacgcgatcctgttgtcactgagaccggcgatcgactgctgggcccgcagcgattcgggcgtgtactgcgggtgctcgtacaccatccgctccaggacccgatcatccgcgatcagttcagactcccccaggctcaccaggtacggcttgccgtccgccgggctgagccgctgcagccgggtgaggtcatagctgacaaggactttgtccggccgggcttcgcaggagggaaggcggtagttccaggacgccctggcgttgtccgcggagggcaggacggccggatcctggtggaacacagtgtggttgaccgagtacggcatgccgcccagcgcctccttctcggccggggtggcgtcggcgaggaagcccagtgcctgggccgggtgggtggcgatgacgacggcggcgaagccttccgtcccgcgttcagtggtgatctccacgccgtcgggatggcgccggatggcggtcacgggcgtttccagccggacgtccgccaacgtggctgtcagtttctcgacgtacctagcggaaccgccggtgacggtacgccactgcggggagcccttgacgccaagcaggccgtgatggcccaggaaggtgaagaggtaccgcgccgggtaggccagcgcggtagtggggtcgcaggaccacacggcgctgactaccggggtcatgaagtgcgaaacgaagtagggactgaacttttcgcgttccaggaactcgccaagggtgggttcgggaacctcgggatccggggtgaccgaggaaaccggtgccgtctccagcagcgcccgcgccttgcggtagaagcgtgtcacttccagcagcatcagcaggtagcggccgcgcagcaggcttgacggccgggcaatgatgccgcgtccgccctcgcgggcccctgcatactccagcccgcagccgtcacaccggacggacatgctcatctcggagtcctgcgtctccacctcgagttccgcgaagagccgcagcagcgtgggataggtccgtgtgttgtggacaatgaagccggtgtcaacaccgatggtggagccgtccgcctgcggcaagtcatgcgtgtgggcgtgccctcccagccgcgaatcggcttcgaacagcgtgacgtcgtcctgcctgttaaggacgtaggccgcggtcaggccggccacgccgctgccgatgacggccacccgccgtcgcccgcctccggttactgctgggtcaggtgacaatgcatgctcctctgctggacatttgccaatgctagagggcaattcggcgccgccgtgccagcggatgggtgccgcgccgggcaacttcttcagcgccgggcggcggagtactgtgggcaggtggtaaacccggtacacctgaagacccttctggaggtcacccggctcggctcctttgcggccgcggccgccacgttgggctatacggcctcagccgtctcccaacagatgtccgccctggaacgggacaccggcgtcgtgctgttccagcgctcggcacgcagcgtggtgcccacggaagccgccgtcgtcatgacccggcacgccgccaaggtgctgacagacatcgaggcactgatggctgccgcctccaaaacacaggattcggccaaccaggaactccggctggggatcttccccagcctggccacgtacgtcctgccgaggatcctgaagaacccggcgtggaagaagctgggaatcgacctcaaagtgtctgtcgctgaacccgggcagaccatccaggggctgcgcaccggcggcgaactggacctcgccgtggttttccaggtggggcagacgggtttcgcgtggcccaacacgattaaccggcaatggattggcgacgacgacttccgggtggtgctgcccgccggctggggcttccgcagtgacgcaaaggtcgccgccgaccacctctccgaaatgccgtggatcatgcaccatccgggaaccagcgacgccatggtgatcgagcggctcttcgccggctgcaacctccatccgcgcgtagtggcccacagcgacgacttccacgccagcctggagatggcggccgcaggactgggagcggccctggttccggaactcgcgctgcggaacaaaccggccggtgttgtggtgctggatgttccggagatccggctggccaggaacgtctttgccctcattatcaatgacaggaaaaccgcacgggtccagctcttcgtggacctcctggccgagacactcgccggaatgcgcacggccgtgaattaggcctgaatgctggaatgcgccgctgttcgggtctatgttgaaactatgagcaaggtagcgagccggcacttcggagagatcgaactcaaccacggcaaagatcacttagtggccgcgaagcacgaacttcgcgggcatccgctggaactcgacctcaacatcacggcgcacgaccacttcgatgaagccgctatccggaaagtggactaccgcctgcggttcctgcccgaactcgttgacgaggtccgggacatgatcgccgaggagctggagcaggaaggcaccagcccccaggaatacctgcacttccactgcaacgccctcaaggacgaacacctgcaaaaggtcttcggcgtcaccgaccgcagccagctcaccaacgaagtcttcctcaaagccctgaagctgggccacgtgggcatctatcccggccagcccgagcgctacttcgtcctcgacttcaccctgggcgagcacttcaccgatgaggtcctcgtggcgtcagccgacgaggacggcgtggtggacgacgagatcgtctgggagtcctgaatcgagtgctccgtacctgccgttttgagcgtccataacggcaggtacggagcactcgatggttatttgcgacggcggctgcccacctaaggtgagcagccgccgcttctgcctaatgcgctgctactgcttggccgcctgcagcaggtcggcgcggaccgcctgggttgccttgaccaggttccgcagggaatcctcggtctcggcatagccgcgggtcttcaggccgcagtccgggttcacccagagctggcgggacggaacgtgcttgacggcggtggccaggagttcggtcacctctgcctcgcccggcacacgcggtgagtggatgtcgtagacgcccgggccaacgccgcggccgaagccgtgggactcgaggtcgtggacaacctccatgcgggaccgtgcggcctcgatggacgtgacgtccgcatccagtccgtcgatcgcatcgatgatcacgccgaactcggagtagcagaggtgggtgtggatctgggtggcgtcggcagcgccggcggtggccaggcggaaggagtccacggaccacttcaggtaatcggcgtggctggccttacgcagcgggaggagttcgcgcagtgcgggctcgtccacctggatgaccttgatgccggcagcttcgaggtctgcgatttcgtcacgcagtgccaggccaacctggttggcggtctcgcccaggggctggtcgtcacggacgaaggaccaggccaggatagtgaccgggccggtgagcatgcccttcatcggcttgctggtcagggactgcgcgtactttgcccactcaaccgtgatcggggcactgcgggtgacgtcgccccacaggatggacggacgggtgcagcgtgagccgtaggactggacccagccgtggaccgtgacgtcgaagccttcgaggttctcggcgaagtactggaccatgtcgttgcgctcgggctcgccgtgcaccaggacgtcgtagccaagctcttcctgcagctcaacaacgcgcttgatctcgtccttcatgagcttttcgtactgcccgccggtgaggtcacccttgttgttgcgggcgcgcgccgacctgatctcggaggtctgcgggaaggatccgatggtggtggtgggcagcggcggcaggtgcagcgcctcttcctgtgcggcttcgcggacttcgtagggcgagcgggtgaagtcggctgcggtcagcgcttcggtgcgtgcgcggacgtcggagcggcgcacgccttctgcggtggcgcggaaggcgatcacggccgttgcctcgccgatggccgcctgggcggaggcgggatcggccaggtaggacgcgagggtcttcacctcgacggccttctggtccgagaacgccagccagctgcggagctgctcggagagctgggtctcctcggcaacatcgtgcgggacgtgctgggtggaggtggaggtggagacggcgaccctgccggctgctgccttcagggcgtccagcttggcggccgacgcggcgaggtcgttgcgccagatgttgtggccgtccacgacgccggcaaccagggtcttgttgcccaggccggcgagtgccgcggcggagggaacagtgcccttgaagacatcgatgtggagggcgtcgatgttggtggcagcgagggtgccgagctggccgtccagcgaaccgtacggggttgagacgaggatctgcgggcggttagccgcggcggtgaggacctcgtaggcacgggccacggcggcctccacctcgccggccggggtgtcctggtccaccaccagggcgggctcgtcgagctggacccagctggcgcccgcggcggagagcttctccaggagctggacgtagacgggcaggatgtcctcgaggcgggacagcggcgcgaacccggcgggtgcgccgtcggaagccttggacaggagcaggtacgtgacagggcccacgatgtaggggcgggtctcgatgccgttggccagtgcgaacgcgaactcgtcaaccttggcggtggaggcgagggtgaactctgtttccggtccgatctccgggaccaggtagtggtagttggtgtcgaaccacttggtcatttcgagcggctgctggtccttggtgccgcgggccagggtgaagtagccgtcgaggtccagctgcccctggccgttgaggagcttgccgaaacgggcggggacggcgccgaggtgggcagtggtgtccaggacctggtcgtagtaggagaaggtgcccggcactgcggcgggttcaatgaggccgagttcctgcaggcggttggcgatggccagctggatgtccttggcggcggcgtccagggcggcggcgtcgatctttcctgcccagtaggcttcgacagcctttttgagctcgcggcggcgaccgatgcgtgggtagcccaagatggatgcagcggggaacggagtgtggttgggcgtggtgtttttagacatgggaaatcctaagagttgggtacaggtccgctctgaggcggaagaagcaatggagaaaggagtgcgtcagctggcgagctggcgggctgctgcgtccgggcggatgccggaatgggtgcgccgcggaagggccagcttgtccagcaactccagggcactctggtgctcattgaaggtgtaaatgtggatgccgggtgcgccggccagcagggctgcgttggcaaggtccaccgtggcatcgacaccaatgcgcagccgttcaaggtcgttgtccgctgacgccaggcgttccagcagctcaggagcgggctccacaccggtcagttcgccgaggcgcctgacgcgccggaggctggtgaggggcatgacccccggaatgatcgggatggtgaccccggcacggcgtgccctggtgaggaggtccgcatactgatccgtgtggaaaaagacctgcgtgatggcaaaatccgcaccggaacgctgcttggcaagcagcacctcgacgtcgtgcgcctcgctgggcgactccgggtggcgggtgggatacgccgccacgccaaccgcgatcttgccggcgcagagcagtgccgaacggcgctgctcaacgcggcggatcagctcgatcaggtcctgggcgtaccggagcgaaccggcaaccggcgccgcgccgtccttgggcaggtcgccgcggagcgccaggatcccgcgcaccccggtgtccagcagttcaccgatgatccctgccagttcctggggcgtgttgcccacgcacgtcaggtgcgccagcggccggagggtggtttccagcaggagccggttgatgagttcgacggcggtgtcccggtttgagccgctggcaccataggtgacggaaacgtagtccggtgcggtggtttccagttcccggatggtggtccagagggtttccgcggcagccggcgaacggggcgggaaaagctcgtaggagagcgccaccggagcggtgtcggaaagattcgggtgtgtgtcaataaggcttggtggagacatttgcatccttggctttgggccattggggctggcgtcgtatgcgacggcggaccggcaatgaatttgagtttggggaacacggaagaactccacaggacgcagccgcgactgttacgcctggattgaagttctccgtgagcaaatgtcaggcccacatgggggcacccacaccctccgcaaggaggatcgctgacacgttacctcggtaacttgtataagactctatgggcggcaggtaccgctttcaagttgggcccgaattaagacgcagttttacggcctgcagctcgtctccacggaattttgttcgagccggtgccctaccatggccggtcggtgccggcagagtccccggagtcgtccaggtagtcctccctttcgcgtccgctgttgcgttcacgctgggcctgccgggcactgtcttccagttgatcgagcttgctttgctgggcggaatcctggctgtcctccccggggctttcctcctgcccggcctcctgatcctgttcctgctcctgctcctgctcctgctcctgctcctggcgggtttcggcgagtttttcctgcagccgcgcttctgctccggccagcctgtcgcccgtatccgccggaagctggtcggaaaaacagtcgtccggcgccgctgcgacggcagcgagcgcttcctcgaacagggcggccgcggccgggtcctccgcaccgagtttttcgtcgccgagccgctcaatggccaggaccaggttcaccctgataacgcaggcaccggccgatccggattggcggggcgggacgaggcccagtgcctcctcaaaccggagcctggcggcggcgaagtccccggaaaggacgtccgcgtccccggccgcgaagggcgccttgtgcggctcgacgaggttcacgacgtggagtgcttccgccgcggaccggaccgatgcggcatcgttcgcttcataggcgctggctgcacgtgctcccagcaggccaaggctcaggagtttggccgcaacacacagaatgaggatcaccggtactgccgaccaggccaggaggcgccgccttgttgcccggtggtccgcgccatgcttggcggacgtcatcggatcaccgccttgttgccgctggatttttggtcgctggagcgcccggcggccgcaggagcagtgcgtgaaggagctgtgcgtgaaggaggggccaacggtatgctgcggagttcgcggagctggcggaggagcaggaccagctcccccaggccaaggacaaaggcccctgctgccggaacccagtaaagctcggtccgtgcggccagggagccgtcctggccggcgttcgtgagggcgccggcgtccagggtggcggggcggccgtcctgcagcatcggggcggcggggttcccggctgaccggtgcatgtatggcacgcccagctgccccgcgatctgctggagccggccttcatcaatcctggaaagagcatacccggcgccatcaccgctgctgtcccggagatagggggcgtccccacgtcctgtggaaccgtcgtcgtaatcctccccggtgttctcccgcatcctgccgccgccggcagtgccgtagcccagcaccgctcccccggccaccaggccatcatcaaggtccatcggctccggtgctttcgcgctggtctgttcgccgtcgccgaggtagaacacgagccggggccgcccggggtggctctgccgggcaagggtaaggcgttcggacaacacctggcgggccgccgtgatgctgcttcccttggcataggcggtcacctgcggctcgaggacggacgtgatggtttcgagcgccagcgtatcggtggtcaggggcatcctcacatgggccgtggtgtcgaaggtgatcacggagaaccgggcaccgggcagttcttgggcaatggccgcgatgtcctgccgtacccccgccatccttggttccgcgttgccgtagtcctccgccaccatgctggtggtggtgtccactacgaagaacacgttcagttcggccgaggccgcctgggcggttcctcccggcaggcctgggcgcagcgcagcccccaccagcaacaggaccagcagggcctgccgaaccccggcacggcggctcgatcccccgcgctgctgccggctgttccgcggcccgcggtacagctgccatcccaggaaggccagggcggcagcggcgaggggaagaagcagccaccagggcagcaccggttggagggtcatggccgcaaccgccagcctgcaaccgccaggaccagcccggacaggagggcagcggccagcggcaggcccggctcatccgagacaactgcgcgcggggcgccgctgagcgctgttttttccgtttcctcaacgccccgcaccacgcccggcacggcctcggggctgtccagcgcgtagtaggccccgccggtggactctgccgcggcccgcagctgcgctcctggctggtccgggccggcgccgtagtcgaggtccccgggattgagcgcgtagacgtgcaccgctctttcccgagccagggctgcggcttcgtcaagggtcatgatgggctccccggagaggaagttgtccgtcgccaggatcacagaccgcgagcgcggcggctgggcggagtcctgggtggcggcagggtcctgggtaccgccgggattccggttcccagcctggccggcggcgcgcgggaagctgttgaggcaggatgccaggccgtccccgatcagggaggagccccggccgctccacgttccgtccaggaatccggaactgccgggcttgccgtcgaacgcgtcccgcgcctgcttcagctgctcccgggcgtagtggtagtcgtcggtcagcggaaatacctggatggccgcgctgtcaaagatggtgaggccgatccgttcgccgtcgaactccgccgcgagttcggcgaagacatccaccaccgcggcgtcggcgctgctcatggaccccgaggtgtccaggcacagcatgatgtcccggttgtgctgttcgggccgcgtggttgtcacgccgacgggccgggctgctgccaccgccgtggaggcgagcagcgcggcacaggcgagcagagccgccgcaagccagcggcggtgccgccgcagggcagcctggtattcctggaggagggtgagccggtccgcatgggccaccggacgccgtcgtgcgttggctgtgctgtccgtccgtttggctgcccaccaggctgcgcctgccgccaccgcggcggggggaagcagccaccaccacatcagttccatgcctgcaccgccgttcgggctgcggcagcggacgaggctacggagggaacggggtcggggccgaacgcggccgggtacagcgcgccgacggcggccgcggccgctggaaggggatgcccggccaggtccgcctgcgtcatgcggggcgcgtccactccggtggcgtcgcggacgaacttcctcagcaggaggctgatttcctggtgggagtcgcgggcgctccgcgttccggcggcagcatcccgttccacatcatcgatccgctgcaggtacgccgccttgagggctgccaggtccgtcagctgggcaggccgcgggatgccgtgcgcctcccgcggcctgcgcgtggctgcaagcacgaagccataccaggcggccaccaggaccagcagcgccacgccggaccacatccatgccgggccatactgcagggggccgtagaacccggggtcagcctgcacggcggtgcctttccaggagggcgaacagcgcggtgaccacgtcccggctgcccgccacctcgccctccgtgataccggcctggcgcagcatggctttccggccggcgtcgcgatcggcgacggcggtggcataggcagaggcgaccgccgggtccctgccaaggtgtgcaagaagcgggtaggagccggagacgctgtaggagtccggaacctggtccggcggcaggaggggtgcgtccgggaccagtccggcgtccctgaccgtaagccagaggatctcgtgctgggcctgaaggcggcgcagcagctggctggtggccgggctcgccgccacctcatcggcgacgacgaacagcaggttgcggcctttgatggtccgcgccacgtgctccagctggtcttcgatcctgctgggcgcggcgttcagtgttgctgcagaatccacccgccggaggaggcgttccaggtgggcctcgccgcccttggcgggcaacgccgtcgtgcccccggaatcgccggacaccagtcccaccacgtcaccgtgccggtgggcaaggtaccccatgacgcccagtgccatcaccgcgatgtcctttttcgtttccccgctgcgggccgccgcggccatgttgcggccggtgtcggtgaccaggagcactgtctgccggcggaccgcaacgtaacgcctgatcagcggtgaaccgtgccgtgccgatgccttccagtcaatgtcgcggacctcgtcccccgggatgtaggcgcggaggtcatcgaagtccaggctgcggccgcggaacaccgagccgtattcgccgtcaagcatgccgcgggctttgcggtgggcgaagatggccatgtccgacttcacccgctggaggaggctggtcacgccggcctcagggcgtctggacggcagcgacgacggcgtcaatcaccgtttccacccgcacttgttccgccactgcgtcgaagttcaggatcaggcggtggcgcagtacccggtgggccagcgttttgacgtcctcgggaataacgtggtccctgccgttcagcagtgcaaccgcgcgcgcggcctggctgaaggcgatgctggcccgggggctggcgccgaactcgatgaagccggccagccgggaatcgatgtactggtgggcgttcctggtgacgaagaccaggcccacgatgtagttgatcacggcgggatcgatgtacacacgccggaccagtgcctgggcggcggtgacggcctccagggaggcggccgcggccggcacctgctccggcgtgtacaccccggcatcgatgcgcctgatgatctcggcttcctccgccggggacggatagtccagcacgtccttcagcatgaaccggtccatctgggcttccggcagctggtaggtgccctcctgctcgatggggttctgggtggccaggaccaggaagggcgagggcagccggtactcctggccgccgatggaggtctggcgttcctgcatcgcttcaagcatggcgctctgcgttttggcgctggaacggttgatctcgtccaggagcacaatgttggcgtggaccgggcccagctgcgtgacgaacgtgccgttggcggcgtcgtagatctgggttcccacaatgtcgctgggcagcaggtccggggtgcactggatccgccggaaatcggcgcttactgcctctgcaacggcctgggcggccgtggtcttggcaaggcccgggacgctttccaggaggatatgcccgccggtcagcagtcccaccagcagcgattcccgcagccgggactgccccaccaccttcgcatcaaagctggcggcaatgttcgctgccacctgctgtgcccgggccagttccgacggttcgattctcgcggaagcactggtcgaaagcactggattttccccctggtggctgaactacgcgtggctgccggccggctgcactccgcccgccatcctatccaagaccgccccggcattgtggacaatggggacccctccccatcagccgttgccaggtctatccttttggcatgagcgagcttccagccagttacaaggagtttctcgccgacaaaagcgagatgttcatcagcaccgtcaagcccgtcctgcagcagtccgcggcggacaggctccacggcgttcgggtggtctacaacccgggctccaccggccaccaggcccacctcgacgattccattccgttcggagtggtcgtggaggacatcgactgagaccggttcccctgcgcttccggcgccggccgcggtgccggttcatccccgcacggctccggacagggcaaaggacccgctgccgcccctcgccacgatgacgtagagaaccaggaccggcagcgaatacagaatggagaatgcggccaactggccgtaagccactgcaccgtgctgtccaaagaagctgaagattgacaccgcggcgggttgccttgcctccgagaggagcagcacgaacgggacaaagaagttgccccaggcctggatgaacacaaagatgaacaccacgcccagcccctgcttcatcagcggcaggacaatggtccgcagggccgtcatccgcgatgcaccatccacccaggctgcttcttccagcgacactggcacgccctccatgaagttccgggtcatccagatggccatgggcaaggtggtggtggccataaagaagatggtggccgccattgaatcgagcagttcaagctggacgaagagcccatacacggggaccatgatcgccgtgatgggcaggcaggtcccaaaaaggacggtgtacatgaagggccggttgaacctggaccggtagcgggacagcgggtaggccgccagtaccgccgccacaaccgtgaccgtggccgtccccccggagagcagcacactgttccacagtggccggagcagcagctccggcgtcagcactgcggcgaagttgtccaggccggcccggtccggaagcttcagctcatgtccggcttcggcgtccagcgaagccaggatgagccagagcaggggcagcaggaagcaggcgccaatcagcagcagcgcaaggtcagccggagtgctgctggcgcggcgccgcccgggtgcggcaggccggagcggaaggctgcccagcgtcctggcggtggcggtcatggccggggctcccggagcagccgtacgtaccccagcccaaaggcggcgccgatcaggatcagcaccgaagccacggccgtcccatagccgatatctccgaacttgaaggcctcctggtaagcaaggacaggcaaggtggtgctggcgttggccgggccgcccgcggtcatcacccagacgagggtaaagacggcgagggtctgcagcgtaatcagcatcaggttggtggtgatgctcccccggatcatcggcagcgtaatgaacgcgaaccgctgccagccgcgggcgccatccatctgggccgcctcggtcacctccgccggaacctcattcaatgcggcccggtacaccagcatggaaaaggctgtcccccgccacatgttggcaagcatcacggccaccatgggaaaggcgtacaaccagtcctgccggacaagtcccaggccgcccagcagctggttcagggtgccgtccccgctgaagtaggcgtaggcggcgaaggcggccacgatttccggcagcacccaggcggccaccacggtggtgcccacgacggcggacaccagcggccgtgcccgtcgcatcagcacggccagcgtgaggcccagcaggttctggcccagcacggccgacccggccacgaacaccaccgtgaggaggacggacagcggaaacaccgggtccgccagcagccgctggtagttctccagccccacccatgaaggattgcgggcactgcggccggtgaggccggcgtcagtgagggatgcgtggaaggcccagagcacggggccggccaggaagacaaggaggagcaggacagcaggaaggaccggaaggtaacggagcagttgccgtgccgtggctggagagcgcacccgctacttccggacggtcttggcggcacccacgatgtccgtcaccgcggcatcatagtccgcagccgcctcctggggcgacctgctgccggtgataacggcctcggtggcttcctggacagccgcggaaatccgggggtagtcggcagttgccgggcggtacttcgtcaccgaaacgagcgcggaaacatccctgacgaacgggttggcgtcgaggtaccctgggtcggcggccacgtccttccggacggcaatctgcgagctttccacggtaaagctgagggagttctcttcgttgagcgcagtggtcaggaagctgaacgccagctcaggctccttggactccgccccgagtgccagcgtccagccgccggacatgctcacagcccccggggcctggccgtgctgggtggggaaaggggcaacgccgatgtcctgttcgtagcccggccactcatagcttccgccgtcctgccagaacgacggcgcgtaggagccttcaacggtggcgcccatctttgcgttggggagccactcaccgaacactttcttccacacgttggcatcgagggcctcggctggagaaacggccagctgttcgtcataaagggtcttgaggaaggccagcgagtcctggaagccggccgaacccaccacccatttcccggtctcttcgtcatagagcgaggatcccgtgccgtacagcagctcgtagaagctttgcatgacggttccctcgccggttcccttgccggcgtacatgttgaacgggatgacggtgggatcgttggccttgatcttccttgccgtgtccaggatgtcctgccagctgcgcggctcccagggaagggtgaccccggcagcttccaggactttccggttgtaccagatggcgcgggtgtcggtgcccaggggcactgcgtacgtcccgccgtcgtccgcccgccctgccgccttggcgccgtcgtcgaacgtgtcccattcctcccagccctcaaggtagctgtccagcttcaggaggtagccggcgtccacgtcggagcggactttgaacgtgtcctcgtaaaaaatgtcaggcgccgtggacggcgagcgcagggcaagggccagttttgtcccgtagtcgtcgtcgttggcctggatgggctgcaggtcaacggtgactccctggtttgccgcctcaaactcctgtttggctgcctggagcatggtgtccagggcggtgaacgagtccgtcttctggtaggcgactttcagggttttggacgaggcgccggggtcgcccgggctgcaggccgccaggacaaccgttgccgcggcaatcagggacatggtcttcagggcccggcgacgcatggcgctccattcggtcgatggcggcggccctgttgttggcgggccccaaaccgcacagtatgcacatgctagatggacgtactgcggcaggcaaggcgctgcgcgcagcccgttgggtcagctctcgaggaggaggcgctgggcccgcggggccagcgtatgttccaggaccagggaagccgccccgatggcgccgacgtcatcccccaccccggtgcccacaacctcgatgggatggatgagccgggtgtcgctgtgggcatccagcagcgccgggaccttctcgaggtagcggtctgccaggcggctccagaacggcccgccaaacaccacccgttcaacgtccagcgtgttggtcaccacggctaccgcccgggccacgcgcaccgcggaccgatcgatgatggcaagggcctgttcgttgccctggtccgcgaggtcgcacaaccgggaaaagctctgctggatttccgctccgctgttgcctgaacgggagccgtccaggatgccggcatcttccgcttcggctaccagcacctgcgggatgcaggtggatttcacgcagccgcgcaggccgcagtcacaaggggcgccgtccgggtccacaatgatatggccgatctcgccggcatttccggaggttccccggatcacctcatcattgaggacaatgccgcagccgatgccggtgcccatgtacataaagatgaagctgccggagccactcgggccgccggcccaggtttccgctacggccgcgctggtgacgtccttgtccaccaggaccgaatatccggtggcttcggaaagcgcgctgcgcagttccaccctgtcccagccgggcagcagcggcggatccaccaccgtgccgttgtccaggtcgatgggccccggcgcggcgactccgaggccggcaatccgctcccggtccacgccggattcctccaccagctggtcgatctcgtccgcaatggtggtgatgaccgccgaggggtcgttgcccccgggggttttgatccgggaatgccgcaccaccgagcccacgaggtccagcaccacgaatgtggtcaccgcgggatcgaggtggactccgagggcgaacacaccgccggggtttagccggaggatggtgcgcggcttgcccgggccgctgccttccttgccggcctccacgatcaggttctggtccaggaggcgccgtgagatgttggagatggtctgcggcgacaggcccacaatctgggcaagttccacgcggctgaggcctcccgaggacctgcggatggcgtccaggatcaccgtgaggttgaagtcccccattttgggcaggttggttccgcgcctcggtgaggattggcggatctcagtcacagcgtcccctaaacgtcttcggccacgtacatatggtgatgcttgaatcgtacgttacgcgtggtcacagacccataggacggcgcgacggcgcggcgcggccacagcgcgctggcttggcagcgaaggcggggctgcccggcaggctgcaggccacggctcaggcccctgctgcgcccgtgccgcggcgggtgctcaaggtcaccgtgaacttggggttccggcccttcaccacggttgccccgacgtgccgctcaagggccggcaggtagggcaggtggcgattgaagaccgtccacagttctccgttcggggcgaggaccctgcctgcggcttcaatcattttcaggcctgctccggcatggacgcccgcaccaacgtggaacggcgggttgagcaggaccaggtccacgctgccgtccgccatggtgctcagggcgtcgtcctgcaggaccgtgatgcgctccgccaggccgttggcctccgccgtggcctgcgcggaggccacggcggcggcggactggtccgtggcggtaacctgcgaaccggggtgctgccgggcgtacatggcggcaaggatcccggtgccgcagccgaggtcgacggcgtgccgggccgccgtcatggagggaaggaacgtcagcaggaaccgggtgccaatgtccagtttggtgcctgcgaacacggcaccatgggcggcgaccttgaggtccagttcagcgaggtgttcgacaacgggatagcgttcctgctccccgctcccctgcggcccatccgccaggatcacgcgggacttctgccgggcaagctggggccggaccgtgcggaagtgccgttccagcacggcgttcatgccgagcgacatgtgcttgacccgcccgcccgcgagcagcgtgacgtccggtgcggcatagtgggccacggcggcagcaacttcatccagttccgccagggtcttgggcagctgcaaaagcaccgcttgggcgcctgcgagaagctccggcccgagcggcacctgcgtgaagccaggctggttcccggcgccgccgtcgggcattcctgctgtggtgtccggcaccggggcggcctggcgaagtgcggccgcgttgagctgcagggcgcgttctccggtgatcaggtcctggtgcacgcgcaccgaagccgggctgagtgtggccagggcgccgagggtcagggccccgtaccggtccccgatgacggcaaccgcgcttccgccaggcacgagttccgcagctgtctccagcaggagccggtccgtggcgtcccacgcctgcaggttgggcgcttccacatccggcctccgccgaagtgcgctgaagacgtcctcaagtgtgtctgatgccaagtgttcctgccgcttccgttgtgcgtttgatgtgtgcgtttgcttcagtgcctggaccgggcacggaccatgccccggccgtcagccccaacttgctggtgttgccgccggactgatcccggggagtttcaggatggccgccacggcggcgcggcccgcccggttggccccgatagtggacgacgacggcccgtaacctaccaggtgtacgcggggttccgcggctacctgggttccgtccatcgctattccgccgccgggtcccctcaggtgcagcggcgcgagatgctccagctccgcacggaaaccggtggcccagaggatcgcgcctgccggctggaaacctccgtcagcgagcctgacgccgccgggctcgatggaggtgaacatcggctgccggtccagggcgcctctggccgccgccgctttgagtgcaggcgtccggatcaggccggtcaccgacaccacgctctgcggcggcaggcccctgcggacccgttcctccaccagggccaccgcgtcgtgtcccgccttggcgtcgaactcctcatcccgccacaccggttccctgcgggtgaaccagctggtgctggtgacgcgcgaaatctcgtcaaggaggcccacggccgagatgccgccgcccaccacgatcacatgctgtccgacgaaagcctccgcagaaacgtagtccgccacgaggagctggcgtccgcggaaggtggactgcccggggtagatgggccagaacgggcgggtccaggtgccggtggcgttgatgacggccctggctgtccagtcgccgtccgacgtggcgatccccagccggccggcggggtccgcgtcctcccggctgaccgagtggaccttcacgggccggcgaacggacagccccagttccttttcgtagtcgcggaagtagcgcgccaggaattccgagctgggttcccgcggatccacggcaggcttggctatgccgggcagatcactgatgccgttgaccgtttccatccgcaggctcttccaccggtgccgccaggcacctccgggaccgtcctcggcgtcgaggattacgtggtccacgccgcggcgttgaaggtggtacgcggccgagagccccgcctggcctgcgccaatgaccacgacgtcggctcgggcggaattcactcccccatgatagtcgcggggcgcgtcccggccttagtcttggcccatggagacgggaggaccaccatgaccacaagcaaaggacatgcagcgcgcctggcccaggccctgtcagttgtgctgggtaccgaagagataccgttgcgtctgcgggcctgggacggatcagaggcagggccggagggtgcacctgtgctggagttccattcccgccgcgccctccgccggatcctgtggtccccgggccagcttggcttgagccgggcctacgtggcgggagatatcgactcccccgggaacatcttcgctgccttcactgccttgagttcagcggggaagttcgcggagcccggtccgttccggcggcccacggccgggggaatgtggacactgctgcgcacggccgtccggctgggcgcggttggcccccagccggcgcccccgcccgaggaggcaaaggtggggaaaggcaggctccattcgcgccggcgcgactcggcagccatctcccaccactacgatgtgggcaacgatttctacgccctggtgctggggcagtccatggtctactcatgcgcggtctggccggagggcagcagcggcacggaatccgcggaaaccgggaaccggctcgccgccggcctcgacgaagcccaggaggagaaactcgacctggtgtgccggaagctgggcctgcggccgggaatgcgggtgctggacgttggctgcggctggggaagtttcgcgctccatgcggccggaaagtacggcgcaacagttgtgggcatcaccctgtccaccgagcaggcgaaccttgcacgcaagcgggccgccgaggccggcctgaccgagcgggtggacatccgggtccaggactaccgggatgtcggggacggaccgttcgatgccatcagctccatcgggatgtccgaacatgtgggcagggagcagatgccggcctatgcggccgctttgttcagcctgctcaggcctggcgggcggctgctgaaccacgcgatttcctggaacgccgggcgcaccaagccggatcctgattcgtttattccgcgctacgtgtttccggacggggagatgatcagccttggcgagatggtgaccgccctggaggccaccggattcgaggtcctggatgtgcaggcgctgcggcggcactatgcgttgaccctgcgtgcctgggtcagccggctggaggctaactgggaccacgccgcgaagctgaccagcctgggcagggcgcgggtctggcggttgtatatggcttccagcgcgcttggctttgagggcggcctgacgggtgtcaaccaggtcctggttcagcggccgggtggtgaacagcccccgctgcggcggacagcctggctctgaaaggaaaccgcttaacgccgaagggacggtcccgatggggaccgtcccttccgatgttcctgtgccttccggcttgttgcaggatgcttaccggtggagctgaggggactcgaacccctgaccccctgcatgccatgcaggtgcgctaccagctgcgccacagccccggacgtgccgctttaggagtaactcccgaagcaacccgttcagcttaatgcactttcgccccgcacgccaatcgtggtggcgcgtcccgggctgcgctccgtgtgggtctgccggctgggtccgcgggcacaacgaacaaaaaaatccgccggaatcacagtgattccggcggatcattcggtggagctgaggggactcgaacccctgaccccctgcatgccatgcaggtgcgctaccagctgcgccacagccccgaactattgctgccctttcgagctttttcggctttccccgaagcaactcaaatatcttagaacagcaattccgaaaattccaaatcgggcatattccgcgcgattccgcggatttattcggtctcggacccggcggtggctttggccgacgcgtcgtccccgagctgcaggtccaccacggggcagtccttccagaggcgttccagggcatagaacacccggtcctcctcatgctggacgtggatgacaatgtccgagtagtcgaggagcacccagcggccaccggagcggccttcacgccggacgggccgcaggtcctgcttggcgagttcttcctcaataccgtcaacaatggcgttgacctggcgttcgctgggtgccgaggcgatgaggaaaacgtcggccagggccagccgctcgctgacgtccagggcaacaatatcctgggcaatcttgtccgcggctgcccgagcggcggcgcgggctatggtgatggacgattctgatgcagtcacgtgactccttgttagttaaatatgcggggggccgtccgttgccggccggctgttggtgatcagcgggacatgccgttgatcatcaggatggtgcccgagaccagggccacgatgccgaatgccaggaccaggaactgcaggaccctggtcctgttcgcccgggcaagtcccgccgtggctgcgtccaagggatccaggccgtgggcggacgaggcggggatgcgcggcaggtcctcgaagaggtcgtctccctggcgatcttcagtcactgccacctgcgggagctccgcggcccgggcagcagcttcagccctcgcgatcacctgcgagcggccgggtccggcatcagcaggggcagtgcgctgggggcctggcgatcgccgcttcttggtaccggaaggcgtgaccttggttcccgggcgtgtggtgaccggtacatgcgaggttgcgggcggcttcatgacgggccggtcgatgccggggacctgcacgaactccagcggcgtgaccattgccaggttgttggcagtggagggcgcaggccgctgtccggccgccggctttccggcctggtccttcttgccggcgtccccgggacgttttccggcatcccgcggaagtccctgggcgggatttgttggaggggccgccggaaccgcgggggccccggcctgctcggccagcttctgcttggccatggcccggcggttcatgaccgccgcacgctccgccagggcaatttgctcagccaggatttccggatcaaccgcttcgggatccagggaagcgatgtgctccattttggcgatctggtttttggcctgctccgcgagcagggatcgggctgccagcgcctgttctacggtcatgccctcggcggccggggggccgggctttacgccgggggtggctgtcgcgccctgacgggcctgctcccccgcgccagtgttcttcgcgccggcagacgggccgctgccctggctgctgccgctgtgactgtctttgtggccgctgtccttttggctgccaccgttccggggcccctccgctggaccctgaggagtggaagcctgcgaagtggaagccagcggaacggaaaccggcgggacggaagacgggggcacaatagggttggccgcagtcagcgcctgttccttgagctgctggaggcggagctgccgccgggtgggaggaccacccgcggagagctggccttctttttcctccagttccttgatggcgcgaagggctgcgcggtcccgcgcccggatctgggatgaccgctggctgttgacctgccctgcggccgttccggcggcaccagatcccgagggggcaccaggtcccgagggggcagcagcaaccggcgcagcaccatccgtctttagggcaggctggagctgctccgtgcccttggaagcagactcctgctgggcgtccctggccttccggagttcccggcggctgcggatggggggctgttcctgactcattgagaactcattcagtactggctggttcacgtgctagggacggtggggcatcggcttccgcggcctcttcgtacaggccatacttggcgatgtactggacaacgccgtccggtaccaggtaccagaccggatggttcgcggccacgcgcgcacggcagtccgtcgaggagatggccattgccggcacctccaggaggctgacgtcatcgcgtcccatgccgtccaggacatgcccgggccgggtgaccccgacgaaatgggccagggaccacagctcgtcgatgtccttccaggagaggatctgcgccagggcgtccgccccggtgatgaagaagaggtcggcgtcagggcgctgggcccggaggtcgcggagggtatcgatggtgtacgtgggacctggccggtcgacgtcaaccctgctgaccgtaaagcgcgggttggacgccgtggcgatgacggtcatcaggtagcggtgctcgggctcgctgacgtgcttgtgcgacttctgccatggctggccggtggggacgaaaaccacctcgtccagatcaaactccgccgccacctcgctggcagccaccaggtggccgtggtggatgggatcgaaggtcccgcccatcacgcccagccgcagcctgccgctggcacccgagcggtgcaaaacgcgggaaatgttagtggccctgcccgtgatcgtgcttgttcgggtgctggcggtgcggatccgcatgctcctcggtgaccgtgtggcggttgcccaggttggagtaggacagcgtgatgaacatcatgaccagcaggatggcgaagatgaccacaccgaagacccacggctcggcccacagcggcgcgagttcgtgttcttcgccttcggcgatggacgttgcaatctgctggaacagcatgttctccccttgggctcaaacgattgtggcagcggaaagctccgccgtttttggcttctggtctatgttaccgtgcgctacccgcgcacctggccctcgccctgcacgatccacttcgtggtggtgagttcggtcagccccatgggtccgcgggcgtgcagtttctgggtggaaatgcccacctcggcacccagccccaactccccgccgtcggtaaaccgggtggacgcattaacaatgacggccgcggaatccacctcagcgatgaaacgctcggcgttggacaggtcattggtgaggatggcctcggtgtggccggtggaccacgtgcggatgtgccggactgcctcgtcgaggttgtccaccatggcaaccgcaaggtcgaggtccatgtactcggtgccccagtcctcgtcggtggccggttccgactcgatggaggcagggagggcggcacgggtgcgctcatcggtgtgcagcctgacgccggccttccgcagggcggccgccacggccggaagcacgcgtgaaccggagtggaccaggagcgtctccaccgtgttgcagacgctgggccgttgcgtcttggcgttcaggaggatttccaccgccatgtcctcgctggccgactcgtcgatgaagatgtgcacgttcccctcccccgtctcgatcacgggaacggcggagttggtgacgacggcctggatcagctcgcgcccgccgcggggaataagtacgtccaccctgccgcgggccttcatcaggacgttggcaccggcgcgcccgtactggtcaactgtttggacggcgtcggcaggcagacccacggactccaaggcttcgcgcagcacccgtaccagcacctcgttagtggcctgcgcggcgctgccgccgcgcaggatcacggcgttgccgctcttgagagccaggcccgcaatatccaccgtgacattcgggcgtgcctcgtagatggccgccaccacgcccatgggtacgttcacctggcggaggcgcaggccgttgggcagcgtctgtccgcgcacaacgttgcctacgggatcaggcaggttggccaggttttccagagccgccacgaggcccgcgatgcgggtttccgtcagggtgaggcggtccagcatggcagcggaggtgccgttggcctttcctgctgccacgtccatggcgttggcggtgaggatggattccgtgctctccttcagggccgtgcctactgcccggagggcacggtccttccatgcccggttggccatggccatccgccgcgccgcgtggcgggaacggtcggcgatggcgtgcactgctgcctcaacgtcgccggatgacagcggaacgtcagccgggactgccgatgactcaacgggctgcgtggcggcagcggtgtctccggaattttcggcagtcttgtggatcagggcctcagtcatgttccaagtttaggcgagccggaagctcagaccagcaccaggtcgtcaacatgaacaacttcacggtcatagccgctgcccagcgcttcaccgaggtcccgggtggaccggcccagcatctggggcagctccgcggacgagtagttcaccagtccgcgcgcaaccaccgcaccgtcggcacctgctatctccacggcgtcgcccgcttcaaaatcaccgtggaccgcagaaataccggcaggcaggagtgatgtgcggtggtggcggatggccttcacggcgccgtcgtcaagcacgagccgtccctggacagatgccacgtgcgccagccagagaaggcggacaggcttacgggcaccactgaccgtgaaccaggtgcccacgtcctcgccgttgagggccgcggcggcgttgggcgtggaagtcaccagggcgtggatgccggatccagccgccatggacgctgcctccaccttggtgagcatgccgccggtgccgacgccggccttgccggtcttgccaatggagacaccgtccaggtcgtgtgccccttccacaagcgggatccgcttcgcgccaagggacggcgggccgtcgtagagggagtcgacgtcggacagcaggaccagcgcgtccgcgcggaccaggtgggccacgagggcagcgagccggtcgttgtctccgaagcggatttcatgcgtggctacagtgtcgttttcgttgaccaccgggaccacgccgaggctgagcagccggttaagggcgcggaacgcattggtgtgctggctgcggcgcatcaggtcttcggcggtgaggagcacctggctgaccgtcacgccgtgggccccgaaggcctgggtgtagcgggccatcagcaggccctgccccacgctggcggccgcctgctgggtggcgaggtcgcggggccgcttggccaggcccagcggtgcgaggcccgccgcgatggcaccggaagaaaccaggatgatctctgtcccggtgttgcgcttggcggccagtgcgtcggcgagggcggtcagcgactcttccgagatgccgcccttgatgctggtcagcgacgacgagcccaccttcaccacgatccggtgcgcgttggccagcacgctcctgtccacggaccgcgccagcggttccgcggacgcagccctagatgtcatcgtctgcgcccagtccactctccttgagcggcttggcaaccctgcggctgctcacggattcggtccagatgcctgccttgcgctccgcttcgagttcggcgcgggcagcggccttggcgtccttgcgttcctgctgctcgtcacgtttctggccacgggtggggcggtcgccgatgtccgcaaaacggacgtccgtaccgcgtggcgaggccagcagttcggctcctgccatcatggtgggctcccagtcgaagacgacgccgtcgtcctcgccgataacaacggtgtcgccgggcttggcgccctgcttgaacagttccgtttccacaccgagcttggccaggcggtcggccaggtagccgatggcttcctcgttggtgaagtcggtctgcttgacccagcgcaccggcttttcgcccagcacgcggaacagcggctcaaggcccttctcctcccggcggatccggaagccggtttcgttgacggcgcggggcttgatgaccacaggctggaccttgggcggcgccgctgccaccgcgtcccgggctgcctgcacgatttcggccattgcgaagcccagctggcgcaggccctcgtggctggttgcggagatttcgaagacccggtagccgcgggactcaagttccgggcggacgaattcagccatgtccttgccgtcggggaggtccaccttgttcagggccaccaggcgggggcggtggttcagcggaacaacttcgccgtcctggcctgcgtagctcatgtccacggcgtacttttccagttcggcctcaatgacggccaggtctgagaggggatcgcggtccgcctcgagggtgccgcagtccaggacgtggaccagggccgcacagcgctccacgtggcgcaggaagtggtggcccagccccttgccttcgctggcgccttcaatcagcccgggcacgtcggcaatggtgaagcggacgtcgccggcctgcacaacgccaaggttcggtaccaatgtggtgaacggatagtccgcgatctttggacgggccgcggacatggcggcgatgaggctcgattttccggcggacgggaaacctaccagggcgatgtccgcaatggacttcagttccaggacgatgtcgctggattcgccttcgatgccgagcagcgcaaacccgggcgcgcggcgcttctgggaggaaagcgcggcgttgcccaggccgccgatgccgccggccgccgcaacatattcggtgccctcgccgacgaggtccgcgaggaccgtgccgtccttggacttgaccacggtgccgtcagggacgggaaggatgagcgtctcgccgttcttgccgccgcgccagtcgcccatgccggggccgccgttggtggcatggcggtggggtgcgtggtggtagtccaggagcgtggtggtctggtggtccacgcgaaggatcacgtcgccgccgttgccgccgttgccgccgtcgggccctcccaggggcttgaacttctcacggtggacggagacgcacccgtggccgccggtaccgccggatacgtgcagtactacccggtctacaaagctggccacgtggatctcctcagtgctgtttcctggacgcccggggcgccaagatgattgtaatgcggttaaaagaacagtggagcggaccatatggcccgctccaccgcttcagatctggttgttactctgcagctgcagcagcaacgatgttgacgacgcgacgaccgcggcgggtaccgaattcaacggcgcccggggtcagtgcgaacagggtgtcgtcgccgccacggccaacgccggcgcccgggtggaagtgggtgccgcgctggcggacgatgatctcgccggcggaaactacctggccaccgaagcgcttgacgccaaggtactgtgcgttggagtcacgaccgttgcgagtggagctcgcgccctttttatgtgccatctgaaatgcctgcctctaaattctggggaatctgctgaaaaacctgaacagtaacggaaggttacttgataccagtgatcttgaccttggtcagttcctggcggtgaccctggcgcttcttgtaaccggtcttgttcttgaacttctggatcacaatcttaggaccacggaggtcctggaggatctcagccgtaacagttaccttggccaggtcagcagcggcggaggtgaccttgtcaccgtcaaccaggagcagtgcgggcagctgaatggtgctgccagctccaccggcgacgcggttcagggtaacgaagtctccaacggaaaccttctcttggcggccgcctgcgcggacaatcgcgtacaccacttgggaactcacttctctcgacgtttattacaaatttgcgtgcggaacccggttccataattgggtgggctctcgctgtgcctcaacgccgtggggtcataacccaagtgttggcgtaagcaccgaagatctagaatacgctagttttggcttcggccgcaaatgaggctggttccggcgggttgtctgtgataggaaccacagcccaggtccgcacccttacctgtgccccaccatagtaccggcggtacgctccaccatgcgtcaggaatgaaggcgcggcgcgtcgaagaagtctacttcgaggcggcaggactgcctgaacgccgtcaccatcgcagcccggtcccctgcggaggcgctgcggccggccccgtccacagtggcaaccgccctgcgggtggcggcagcgaagtcctcatccgcgtacgtgcgcagccactcggcgtaggggtggccggctggttccccggcagccacgaactcggcgtggagcgttttgcccacctcggcgtacaaccagaagcagggcaggaccgctgccgccagcacggcgtaactgcccgacgccgatgccgcggccaggtggtccacgtatgacttggtcacgggtcccagctgcggttcaacggtccgtgtactgagccaggagcggtgcagttcagactccacttccaggcattgcgccgcggaacgtgcccagaagagctgctcctcctctgagggggccagggcacttgcccgcgcgagcacccgcgagtaaccgttgaggtagatggcgtcctgggcgaggtagtaggcaaactcctcctccggcaggctgccggaaaccaggccgcggatgaagtccagtgcgtagatgtcctcgaggtccttttctgcgtccgcccagagctgcgccgcgaagctcccctccccgcgcaccgccggcacgtggtggaagtggtgcacaggtccggcgcccgtccccacctccagggttcccgaggcctccagcgcgccggcgagccagggcttgacctcacgcagggctgcttcccagtcccccagccgcgcctggaccgtggccatggccgccgacagggagcatccggtgccgtggctgttcactgttgacacccgctgtccgggaaccaccaccacgtcccgggacaacaggccggcggtgttaatgagggcgtcggggcattcgtcccctacgaggtgcccgcccttgaccagcaccgtggctcccgtggcggcggaaaggttacggccctgctccagtgcaccttcccaggtttcctgcacgtcgccgcccacgagcatggcgagttcagccaggttgggcgtgatgaggtgcgccagtggcagcaggccgcgaagcgcggcttcggcggattcctggaggagccggtcgccgctggtggccaccatgacagggtccaggaccacgacggcgggacgcaccttttcgagccacgcacggacggcttcgatcaccccggcatcgcccagcattccgattttcacggcgtcgatgctgatgtcgtcactgagggcatcgagctgctgggtgaggaaggcggcggggggaacgtggacgccgcgcacgccgcgggtgttctgcgcggtgagggcggtgacggcggccattccgtaaccgccgtgggcggcgatgcttttcaggtccgcctggatgccggccccgccggaaggatcggatccggcaatggaaaggacccggggcacgtcgcggtacaggcgggcgggggccgcaggcgcagaagcagtagcaggcccggaagcgggtgcaggggtgccctggatggtggcagtggtcattgcaagggtggaagacaagagacatcccttcgccggtgctagccggacaggttcaacgggtctggatctcagccggctctctgcgcggcaccccgtgtcggttccccagcctagcttttttgcggtgcactgcgtgaaggtgacacagtgcggccgcagcgggatggaaggcgcgtgttcaatgggggcattcaatagcgtcgcggaacgccccttaaatgacggatgcccggccggccactgactgtggctggccgggcacccggtcaatgcttgccctgggctccggattcctggagctcaggtccctggagattccgttcctggagtccggttcctagagctccgaggcagggaccccgacgccgaggataatcggcgcgttcgacggcttgtcaccggccggttttgaagcacccgcctggtccgctcccggggccttggcggcgtgggaatgcccggccgcgggggctggaaccttctcgtgctgctggaccgaggtctcgttggctgctccctgggcgcggctggcactgcggttccggcgtgccctgcgcgggcgtgactgctccagggtgtggtcggagtagtccttctccgctgcggcagccaccggccgctgctgcggctggacggctgccggttcccgctgttcccgggcctgctccggctcgggcgtcagctcaggggctggagcctgccggggagcctcttccgccctgcgctgtgccggctgccctgccggcgtttcggccggcatgtcggctgccggagcgggctcgcccaggtgggcgaaggccgcggccaggcggtccagggtgagggcaggctttggctgctgctcctctgcttgctccacgaagggcaggactactttttccccgccaaaggtcaggacggccgcgggcctggacgcatcgccgtcgtgcttctccgtttctgccagcactgcaggctgggcctgcgttgcctgcctggcggcagccaactcatcgtcatgcaggtgggccgcatgggcagccgccgcgatgttggcaagggccagcctggtggcctccgctttcgcatgccgctcggcgtccgtcggatcagggtggaccgtgtggacgtggacggcagctgccggggcggcctccggctgctggccgccgcggccgcggcggcgcttccggtcagtagtacgggcaccgggctggctgctgtccgtgcgctgcgcctcgacgcggttgccctcggcgcgtgcttccgggcggtgctcggcacgctgcacgtgatgctcggcagccacaatgttggcgcggcggtgttccaccgggtcatcgtgggtgaccacgccgcggccggcgcaggcctcgcactgctcgccgaacacctcgaggagccccgtgcccatccgcttacgggtcatctgcaccaggcccagcgaggtgacttccgcaacctggtgcttggtgcggtcacggcccaggcactccaccatgcgccgcaggaccaggtcccggttggactcgaggaccatgtcgatgaagtcgatgacgatgatgccgccgatgtcgcggaggcggagctgccgaactacttcctctgcagcttccaggttgttcttggtgactgtttcttccaggttgccgccgctgccggtgaacttgccggtgttgacgtccaccacggtcatggcttcggtccggtcgatcaccagagagccgccggagggcaggaagaccttccgctccagggccttgtggatctgctcatcaatccgccaggcactgaagatgtcctggtccttggtccacttctcaagcctgcccacgaggtccggggcaacgtaggtgacgtacgcctcgatggtgtcccaggcttcctcgccggaaacgatcagcttggagaagtcctcgttgaagacgtcgcggaccaccttgatggtgaggtccggttcgccgtacaggagctccggggcaaggatcttagtggacttcgactggctttcgatgccctcccactgggcacgcagccggttgatgtcgtgcgtcagctcttcctcggaagcaccctccgcagccgtacggacaatcacgccggcgtgctcgggaaggcggtccttgaggatccgcttcaggcggttgcgttcgacgtcgggcagcttccgggagatgcccgtcatggagccgccggggacgtagaccaggtagcggccgggcagggagacctggctggtcaggcgtgcgcccttgtggcccaccggatccttggtcacctggaccaggacggtgtcgccggacttcagtgcgttctcgatgcggcgctgcttgccctcaaggttgacggcctcccagttcacctcaccggcgtacagcacggcgttgcggccgcgcccgatgtccacgaaggcagcttccatggacggcaggacgttctggaccttgcccaggtacacgttgccgatcagggagtcctgctgggtcttggacacgaagtgctcggccaggacgccgtcttcgaggacagcgatctggattctgtcgtcgcgctggcggacgatcatctgccggtccacggattcccggcgtgccaggaactcggcttcggtaatgacggtgcggcggcggccggtatcgcgtgattcgcggcggcgctgcttcttggcttccagccgggtggagcccttgacgctggtgacgcggttgttcacggccggttcgctcacggcgcgcggggcgcggacccgggtgaccgtgttgggcggatcgtcgtcttccccgcctgtcagttcgaggtcctggtcgccacggcggcggcgacggcgacggcgggaggtcacgccttcttcggcctgcccggcggagtcctcatcagcgtcctcggcggcgtcactgtctgcggcagcggcgctgtctgcatcttcaccgtcgcgctcgcccgccctgctgcggccacggcggccgcggccgcggcgcctccggcggttgccggcatcgtcagactcgtcctcggcgtcgtcagcctcggcatcctctgcggggaccgggaccgggaccggggccggccggaccactgtgctgaggtccggggcctggaaaagcaccgaggtgggggaacccggttccatgaacagggacccgaacggactggcgggggctgaagccccggcctcgggctctgcagaagagttggccccgccttcgccggaaggctcgacggcggacgtgggctgcgcggaaccgctggtggctttggcggcgggcgcctgggctgcagcctttgttacgggttcagtgccggcgggcgcatcggcagcggccggagcagcggtgccgggcgccgcgggtacgggctcagctgaagcgggctcggccgaaacggtctcggtgggtgcggactcggcaggtgcggccgtccctgccggcggttcctctgcttcgacgacggccggggcggacgtcttgcgggtggcaacccggcggcgccggacaggctttgattcttccgcggctaccgctgaaggctcagctgcaggcgcctgctgcgtgccgtcgtcgttggcgttgttggtgatcccggcttcagcgccggcctcggcagcaaagaccggaagaggctcggcggtctcgactttcttccgcgaacggctccggcgggcgggcgccttggcctcggccaccccggcttctgcggccccggcctctgcggtgacagcatcgggggcagcgtcagcggtcacggcctcgccggttttcggagcggctttccgccgggtcctcgtggccttcttcggcgcggagtcggcatccgtggccgctgcttcatcattaacggctaaaacttgttcattatccatatgtggcaacactcctgcccctgacgtaccgccacatccggcacccattggggcacatattgtcaaaacccgcaggcgttgacagaagtcacgtggatacccccaggttcgcaccggcagtggggtgcggcagcccgtgggggccggcaggatgttctgaaacccgttgttcaacgtgccacaaccaggtgccgtccaatggagttgcggagttcggatcgaagaatccaaagcctgcgctgctcatcattggcggtcttgcgaacaagctgccggaccggagtccgaatgtggatcgggttccagccacgttcattctctcataccccggctattcaacggcggaagcaggagcacttgttccctttcctgggaggtctttccagcgtccggcgttacaatcgggcaaggaccacccgatgaaaaggacgccttgccaatgcccagcatctcccccttgagcggcacccacgcgccggaacggactgcggatccggacagcagtgcagccgtatcccgcccgccgatgacccgtgaccggccgctcggctggctgatggtcattaccggtgtgatcggctggctggcctccggagcactggtgctggagaaactggaggtcctcaaggaccccaaccacaccacggtgtgcgacgtgaacccgtggatctcctgcggccaggtgatgcagacgtggcaaagctcgctgtttggtttcccgaatatgttcattggcatcgttgccttcgccattaccatcaccgtgggtacgtcactgctggccggcgccagtttcgcccggtggtactggctgggcctgcaggccggcgtcacgctcggtttcgcgttcgtggtgtggctgtggtcccaggccctctacgccatccacattctgtgcccgttctgcatggttgtctgggcggccatgattccgctctttgtctgggtgaccatccgcaacgtcagcgccggggtcattcccgcccctgccaacgccgcccgcatcctgggtgactccggctggatcatcaccgccctgctgtatgtggccgtcatcgccaccatcttcttcgccttcatccaggtgttcgccggaacctcaggcttctaggcctgctgacaaaaaatgcccctggttccgaagaaccaggggcattttgctgtccctgggcggtcagccctggaaccagatcttgatctcgcgcccggcggattcggcggagtcggagccgtggaccaggttctgctggaccttcaggccccagtcgcggccgaagtcgccgcggatggtgccgggggcagcagtggtggggtcggtggtgccggccagcgaccggaagccctcgatgacacggtggccctcgaagatggccgccaccacgggtccggaaagcatgaagtccacgaggggctcgtagaagggcttgcccacgtgctcctcgtagtgctgctccaggagttcgcgtgaggcgtcaaccttcttcagttccgccagggtgtagcccttggcttcgatccgggccaggatggcgccggtcaggttgcgggcgacgccgtcgggcttgatcaggacgagggtgcgctcagtagtcacaactgctccaatgcgttggtaaggggtttcggggtcaagtctacggggactgcggctgctggccgggctccgccccatccggatgggcggcttcccaggcagcctgttcgcgggcccgttccgcggcctcccggtccagccggattccggtgcggatgccataccaccacgccgccgcgaacagggcgcccaccaggaacatggccggctcgaagatcccggtgaggatcaggaccagctgcaggatccagcccagcccgatgccccagggcttggtgaggaaggcgcacgcaacgatcatcaccacgcacaatgcaatccccacccccaggatgaccgccggcgggaactccccccgccgcaggccgaacaccgccagggtggcgaagaacatcacgaaggcttccagcagcaggaccgtggaagcgaacatcaccttggtggaacggcgcttcttgggcatgcccggccgccactcgcgctgcgctttggtcaacttggccatggactcaggcctccgtctttccgagcaggatccgtgcctcggccacgagcgtgatggagcctgtgaccagcactccgcctgagagatcgtcattggcttcggcgcgttccaccgcccattccagggcgtcgtcgagcttttcggcaatgtgcacgttgtcttcgccgaagccaagctcaaccgccagttcagccagctcagcagccggcacggcgcgcggggagttcgactgcgtgaagcagaactcctccgccatcccgccgagggactccttgagctggcggaggatctcttcggcgtccttctccttgagcactccgaccaccgggacaagccgggtgaaggtgaaggcttcctgcagggcggctgcggaggccttgatgccgtccgggttgtgggcagcgtccaccacgatggtgggagctgtccgcaccacctcaaggcggcccggcgacgtgacattcgagaagccttcctggagcacctcgaagtcgagttccttttctcctccgaagaaggcttcgagagccgccactgccaccgccgcattctgcgcctggtgggcgccgtgcagcgggaccagcagttccgggtagcggccggcaatgccctggatgctcaccacctgtccgcccactgccacggtccgggattcgacgccgaattccacaccttcgaagcggaagggcacccccacgtccttggccttgtccagcaggacctgcgcggcgtccagcggctgggcggcactgatgaggtagccgccgggcttgatgatgccggccttttcgtacgcgatgtcctccgtggtgtctcccagcaggtccgtgtggtccagcgagatgggggtgatcacggaaacctgcccgtcccccacgttggtggcgtccgtgatgccgccgaggccaacctcgatcacggccacgttgacaggttggtccgcgaagatggcgaagcccaggatggtgaggcattcgaagtacgtgagccgcggttcgcctgcagcctcgagctcggagtcgacgatctgcaggtaggggcggatttcgtcccagatgcgcacgaaggtctcgtcggggaccgggtgcccgtcgatactgatccgctccgtgaccgtggacaggtgcgggctcgtgtaccgtccggtgctcaggccatgggcccgcaggacggattcgatcatgcgggcggtggaggtcttgccgttggtcccggtgacgtggatgatcgggaacgccttgttcggctcgcccagcacatccatcgcccggaacaacggggccagccgcggctccatcttgttttccggcgcccggcccagcagctcggcgtagacgctctctacggaaaattcgtcagtcatggatcaggcctctactttttcgacggcgacggccggctctgcggcgtccccaagttccgccgtgagttccacggacagggtctcgcccttcaccaggccggcgttggccagcagggcgtcgacgacgttctgctgtgcggtcacggtggtccggatccggtcgctgacattgagtccggcgtccttgcgcgcctgctggatggcacggaccatgtcgcgggccaggccttccgcctcgagctcaggagtgacctcggtgttgaggaccacgaacccgccgccgggcaggaccgccactgccttggtggcagcggcagcaccgccgtccgactctgccacgacggtttccagcgtgtactcctgcggctccagctccaggccgcccgcggtcactacgcctgcatcggacaccgaccagtcgcccgacttggaacccttgatggcctgctggacgttcttccccaggcgcggcccggcggcccgggcgttgaccacgagcttctgctggatcccgaactcttccggcgcggccgtggcagcatccagcagcctgacggagcggaggttcagctcatctgcgacgacggcggcaaaaccttccagcgcatcggcgccgggtgccacgaccgtcagttcctgcagcgggaggcggacgcggaggtttgcagccttgcggagcgaggagcccgtggagcagatctgctggaccttgtccatcgcctggaccaggtccgggttggcggggaacagcgcagcgtccggccagtctgccaggtgcacggaacgtccgccggtgagtccgcgccagatctcctcggacaccagcggcagcagggaagccgctgcgcgggacaccgtctccagtgcggtgtacagcgcatcaaaggcgtcctggtcctcgtcgaagaaccgctggcggctccggcggacgtaccagttggtcagcatgtccaggtagctgcggagggcatcgcaggcacctgagatgtcatagtcgtccagccgttcggtcatggtgccgaccagttcgccggtgttggccagcaggtactggtccagcgtgtcggcgtagccgtcgtagcgcagcctggcatcgtagcctgagccgccggccgcggcgttggtatacagcgtaaagaagctgtacacattccagagcggcaggatgacctggcggacgccgtcgcggattccctgctcggtgaccaccaggttgccgccgcgcaggatggggctggacatcaggaaccaccgcatggcatccgagccgtcgcggtccagcacctcggagacgtccgggtagttccgcaggctcttggacatcttctgcccgtccgagcccagcacgatgccgtggctgatgacgttgcggaacgccggccggtcgaacagggccgtggagaggatgtggagcatgtagaaccagccgcgggtctgcccgatgtactccacgatgaagtccgcagggttgtgggtatcgaaccaggcttcgttctggaacgggtagtgcacctggccgtagggcatggagccggaatcgaaccagacgtccaggacatcctccacgcgccgcatgacggactggccctcttcgggggtgcggggatcgtccgggttgggccgggtgagttcatcgatgaacggacggtgcaggtccacctggccgtccttgttcagcggcaggcgaccgaagtccgcctcgatctcggcgagcgagccgtagacgtcggtgcgggggtattcggggtcgctggactgccacaccgggatggggctgccccagtagcggttgcggctgatggaccagtcgcgggcgttctccagccacttgccgaactggccgtccttgacgttgccggggatccagttgatctcctggttcagttcggacatccggtccttgaacttggtgacttccacgtaccaggaggacacggcgcggtagatcagcgggttgcggcagcgccagcagtgcgggtagctgtgctcgtagctggcctggcgtaccaggcggccctgggcgcgcagaacctgggtgatgggcttgttggcctcgaatacctgcaggcccacgatgtcgtgcaggtcgccgtgcttgaagagcgggaggaacttggcgccctcgtccacggagaggaccaccgggataccggcttcctcgcagactttctggtcgtcctcgccgtaggccggagcctggtgcacgatgccggtgccgtccgttgtagtgacgtaatcggcaaccaggaagcgccaggcgttctccatgccgtacttttcgttgtccgcgaaatcgctccacagcggctggtacgccaggccttccagctcggcgccggtgtgcgtggaaacaacagcggcctgggcggcctcgaaatcgtcgtagccgaggtccttcgcgtagttgcccacgaggtccgcggccagcaggaagctgcccgagacgggagcgtccgcggcggcggccttgattccgttggggccggccggcagcacggcgtacgtgatggaagggccgacggcgagcgccgcgttggtgggcagcgtccagggcgtcgtggtccaggcgagggcctggacaccggcaagctgccgggacaggtccgactcccctgccgtaatggggaaggtcaccgtgaccgtctggtcctggcggttcttgtagacgtcgtcgtccatgcgcagctcatggttggacagcggcgtctcgtccttccagcagtacggcaggacccggtagccgttgtaggtcaggcccttctcgtgcagctgcttgaacgcccagagcacggactccatgtactccacgttgagggtcttgtagtcgttgtcgaagtccacccaccgcgcctgtcgggtgacgtagctcttccactcgtcggcgtacttcatcaccgaggcacggcaggcgtcgttgaacttgtcgatgcccatggcttcgatctgggtcttgtccgtcattcccagctgcttcatggcttccagctcggcgggcaggccgtgggtgtcccagccgaaccggcgctctacgcgcttcccgcgctgggtctggtagcggcccaccaggtccttggcgtagccggtgaggaggtgcccgtagtggggcaggccgttggcgaagggcgggccgtcgtagaagacgaactcgttacttccgggctcgccgcccggggcgtccgcgctccgctggtcgatactggcctggaaggtgccgtcctggtcccaatacttcaggatgcgctcttcgatctccgggaacttcacggaggcggaaacggcggcaccgccggtggacgaagggccggtggaggctgaggccttggggtaatacgacatgtcgacatcctgggttgagcttggcgaactgccggcttgcgccttctgttccgttcaggatgcgaggacggatcctgtggtgtccgtccggactccacgctcaccgcggtaccacctcacttaccggcgttgcacgcttcccgggggaacgtgtgccgcgacggccactcattactgctgtgacgggcttacccgtccggttctactggcgcgtgccccctgtcgttagaccgggtccgcgtgttcttccggaagctcaccggtgattgccgggtcatagcctttttgagtctactatttccggggccgggccaccaataatagaacctatgcgagagtacggggccggggtgcgcggcggggaacctcgccggcctcggtcccggtggtcggctgccgccgttttcctggccgtgccgggtgctgcgctggtgttcctgcgcatggttccgtgggatgtcggcaccccctggatccagttgctggccctctttcccgcggggctgatatcaacgacggcggcgcttgctgccgccgtcgtcgccctcttccggaacgctggacccctcaggaccgtgtccgctgccctcgtggcggcgctgctcgccgtccagctcaactgggtgttggaccgggtactgcctcctgacactctggccgggccgccgtccggaaacgtgcagccggcaaacgtccagtcccctgcccggtccgcggaccaggcccgggggccggtggtgacagtcatggcggtgaacgtgggctacaccggaatcgaccccggtgccctgcttgcagagatcaggagccgcaacgtagatgttttggccctgccggagcttgcgcccgccggcctgaaggcgctcgatagggcagggctggcatccctgctgccgttccgcgccacagatgtggcctgggacaagataggaagcgcccttttctcgcggttccccctccagcaggtggatcgtgtgccaggttcggcgttccaccagagccgcgccgtggccagctttcccagcgccgccgggccagtgcacctgaccgccgtccacgtcgattcaccgcgccggggacatattgcgtcgtggcgggccgagctccggctgctcggcgaactgtggcaggtactgccggacagccagcctgccatcctgctgggcgacttcaacgcgagcgcggaccacggtgagttcaggaatctcctgtccacggggctttccgacgccgccgaggtgaccgggaagggcctggcccccacctggcccgtgaattcgccggcgccggctttcgtggccatcgaccatgtcctggtcacccccgggattgaggtactggactttgacgtcgtcacgctcccgggaacggaccatgccgcggtggtagcgcgcctggtcctgttgtaggtgctagcccttgcggatgagcttgtagtttgaggcctgcgccaccggccggacaacgatctggtccaggttgacgtggtgcggagcagtgaccgcatagcggaccacgtcggcgacgtcactggccgtgagcggcttctccaccccctggtagaccttgtccgctgcctgccggtcaccaagccggttcagggcgaactcctcggtctggaccagcccgggggccacctcgatcacgcggacgttgtgctcggcttcctccagccgcagtgcctccgtcagcgcacgctgggcgaacttcgccgcgttgtagccgccaccgccctcgtatgccgccagcccggcggtggaggtcaggttcaaaattgtcccttcgccgttggcccgcagcatcggcaggaacgccttgatgagtttcatggtgcccagcacgttcacccggtacatccactcccagtcccccgtgctggcggagccgatggtatccgcgcctctggcgccgccggcgatgttgaccagcgtgtcgattccccccgcttcggttacctgcgacacaagccgggacacgtcgtcgtcctcggaaatgtcggcggggagcgcgacggcgccggtctccttctccagttcggccaggcggtctgcgcggcgggccacggcaaacaccttccagccgtccgccgccagggcgcggaccgtggcctcaccgattccgctgctcgcgccggtcaccaaagctgccttcttctgcgaaacgtcaatcatggcaccaccatagcgggaaggcgggagggacgacgccgccctgccgcccatgggaagtgggcgccggcaccgcggcgggcgggcggacaggcccggacatgaaacaattgccacatggctgaagacacgcagggtacagacacgcccaccaccgcccccatcaacgttccggacaagccggccctcgaaggcctcgaagctgccctcacgcagcggtggctggccgaggggacctacaagttcgaccgggagaccacccgggaccaggtctactcgatcgacactccccctcccaccgcgtccggatcgctccacgtggggcacatgttctcctacacgcagaccgacgtgctggcacgctaccagcggatgaccggcaagaacgtcttctatccgatgggctgggacgacaacggcctgcccaccgaacgccgggtgcagaacttctacggcgtccgctgcgacccctccatcccgtacaaccctgactaccggccgccggcgcagcccgcgaagaaccagcgggacttcgacgtcgtctcccgccggaacttcatcgaactgtgtgaagagctggccgttgaggacgagaaggtcttcgagaaccttttccagacccttggcctgtccgttgactgggagctcacctaccgcaccatcgacgacaactcgcgggcagtctcgcagcgcgccttcctggccaacctggccgcgggcgacgcctacatggcggaagcacccacgctctgggacgtcacgttccggaccgccgtggcgcaggcagaactcgaggaccgcgagatgcccggcgcctactaccgctacccgttcttcaccgaggacggggagaagatctacatcgagaccacccgtccggaactgctggcggcctgcgccgcgctggtggcgaatcccgacgacgaacggtaccagccgctgttcggcaagaaggtcacgtcccccctgttcggcgtggaggttgaggtcaaggcccatccgctcgcgaaggcggacaagggctccggcatcgccatggtgtgcacgttcggcgacctgaccgacgtcacctggtggcgcgaactgcagctgcccacccgggccattgtgggccgcgacggacggatcgtcagcgaagctcccgaatggatcaccaccgacatcggccgcgaagccttcgccgctattgcaggcaagaccgtcttcagcgcaaaggaagaggtggtgaagctccttaccgccgccgaactgctcgacggcgagcccaagaagatcatgcaccccgtgaacttctacgaaaagggcgacaagccccttgaagtagttacctcccgccagtggtacatccgaaacggcggccgggacgaggagcgccgcgaacggctgatcgcacgcgggcatgagatcgacttccaccccgctttcatgcgctcgcgttacgagaactggattgccggcctcaacggcgattggctggtgtcccgccagcgcttcttcggcgtgcccatcccggtctggtacccgctggatgccgacggcaacccggactacgactcccctatcgtcccgtccgacgcacagctgcccgtggatccggcagcggacgccgctcccgggttcgacgaatcccagcgcgacgttcccggcggcttcaccggcgacgcggacatcctggacacgtgggccacgtcctccctgacgcccaagatcgtgggcggctggaagcgcgatgaggacctctttggcaaggtcttcccctttgacgtacgcccccagggtcacgacatcatccggacctggctcttttcctccgtggtccgcgcggacgccctggagaacagtgcgccgtggaagcacgcggccatctccggctggatcctggaccccgaccgcaagaagatgtccaagtccaagggcaacgtggtggtacccaccgacgtgctggaggagtacggttcggatgctgtccgctactgggcggcctccgcgaagctcggagccgatacggcctacgagattgcgcagatgaagatcggccggcgcctggccatcaaactgctgaacgcgtccaagttcgtgctgaacctgggcgccacggaagactccgtgctgtccgccgacctttccgtcctgaccaatccgctggaccgggcggtcctggcgcagctgtcggaggtggtggcccaggccaccagggcctttgacaactacgactacgcacgggcgctgcagatcacggaaagcttcttctggcagttcacggatgactatgtggagctgatcaaggaccgggcctacggcgccgctggtgaggccgagcaggcttcggtgctggcagcactggccaccaccctggatgccctgctgcggctctttgcgcccttcctgcccttcgccaccgaagaggtgtggagctggtggcgcaagggctccgtccaccgtgcccagtggcccgcaccgctggatatcccgggcggcgacaccaccatgctcgcaacggttggggtggccctcagcggcgtccgcaaagccaagtccgaagcgaaggtcaagcagcgcaccgaggtccttaccgcgaccatcacggcgccggaagcattgaccgcgcagctgcaggcaggcctggctgacctgaaggcagcctccaacgcgcgcgagatcatcctggtggccggcgagggcgagctgagcgtcagcgacgtggcacttgctgccacggaagagccggcgaaagcgtagccgcagtcctgccctgttccggccggccctgtttcagggcaaaggggaagccccatcagcgttttgccgttggtggggcttcgacttttcggccatccggtgacgtcttgatggtctggcaggatccgctgatcttcaggtcttcctaccacgtcactggtagcttgcatctgactttgccgatggctgcgtcggatgacatatcactgaatctttggttcctgcgtccctcttctttcgaagtgggtaagctccattgttgtcctgcccaccggcaagcgcaagagccccggtggaactacaaccaagtagttctaccggggctcctggtgccaggccggtgatgccggcgggctcagtcctaggtgaactccggccgctcggtgcggctgcgcttgagctcaaagaagtgcgggtacgcagcaatcgctgtggtggcgtcccacagcctgccggcctcctcgccgcggggaatcctggtgagtacgggaccgaagaacgcggttccgttgaaggccaccacgggagttccgacgtcctggcccaccagcgagatgccctcctggtggcttgccctgagttggttgtcgaaggcgtcggtggaggctgccgcggcaagggtggccggaagcccgcagtccgcaagcgccttggtgatgaccacgtcacggtcctgctcgccggcttcgtggatcaatgagcccatggcatcgtagagcgccttgactgttgcatcgccatgctgctgctgcgctgcaatgatcacacggacaaggccccaggcgttgtccatggactcgcggtagccgggttcaaggtcgcggccctcgttgaggaccgccaggctcatgacgtgccacgccgtttcgatgtcgcggacgccttccacttcgccgatccagcgggaagtgatccaggcgaaggggcacagcggatcgaaccagaaatcggccttgttcttcacgggctcagtcatggggcattccttcgctggtctccgtggcgcggtaaatgccacgtcgtgttcggggttagtgcgggtgacggcgctgtgccgggacaagccggcttggaccaaccatgccgggacagaccgtacagacgaatcaggcggacttacggcgtttggtgacgtgcggaacgatggttggttcggcacctttcaggacaacgtcctccgtgatgataacgctggcaacgtcttcgcggctggggagatcgaacatcacgggcaggagtacttcctccatgatggcgcgcagcccccgggcacccgtcccccgctccagcgcctgctcggcgatggcgtccagcgcggtgtcgtcaaacaccagttcaacgccgtctatctggaacatcttctggtactgcttcaccagggcgttcttgggcgtggacaggatctggatcagggcatctcggtccaggttggacacggtggtgatcacgggcagccgcccgatgaattcgggaatgaggccgaacttcagcaggtcctccggcatcacctcaccataggagtccaccttcttgctggcctcgttgaggggggctccgaagccgatgcccttccgtccggacctggatccaatgatctcctcgaggcccgcgaaggcgcctgcaacgatgaacagcacgttggtggtgtcgatctggataaattcctggtgcgggtgcttcctgccgccctggggaggaacggaggcaacagtcccctcaaggatcttcagcagcgcctgctggacgccctcgcccgagacgtcccgggtaatggaggggttttcgctcttgcgagaaatcttgtcgatctcatcgatgtagataatgccctgctcggccttcttgacgtcgtagtcagcggcctggatgagcttgaggaggatgttctccacgtcctcgcccacgtagccggcctcggtcagcgccgtggcatcggcgacggcgaacgggacgttcagccgccgtgcgagggtctgggccaggtaggtcttgccgcatcccgtgggcccgatcaggaggatgttggacttggcgatttcgacgtcgtcatgatgcccgccatcagcaaggcttccggacttgggtgcatgccctgcctggatgcgcttgtagtggttgtacacggcgacggcgagggagcgctttgcgggttcctggccgatgacgtattcctgcaggaaatcaaagatctcgcggggcttggggagttcgaagctccccagatcggcaacttccgcgagttcctcttcgatgatctcgttgcagagctcaatgcattcatcgcagatgtagacaccgggcccggcaatgagcttgcgcacctgcttctggctctttccgcagaaagagcacttcagcagatccgtgctctcgccaatccgagccatatgtgaaccccttagtatcttgctgccaggcagccttgcaccgttgctggaatcttcaccagcctgcatggaccggttgtgacaacatccactctaggtcacattcgcttcccaaggtggaaggaaaaggccggtggggccaattgattggccccaccggccctttactttaccgctacctggtgattgcctgcggtttgatcttgcgtgaatcgaggacctggtcgatcaggccgtaggactgcgcttccgcagccgtgaggatcttgtcgcgctcgatgtcgttgttgacctgctccgacgtccgtccagagtggtgggcgagggtgtcctcgagccaggagcgcatgcgcatgacctcggcggcctggatttcgaggtccgaggcctggccgccctggccgccggacagggcaggctggtggatcaggacccgggcgttgggcagggcaaggcgcttgccgggagtacccgccgccagcaggaccgctgcggcgcttgcagcctggcccaggcacaccgtctggatctccggacggatgtactgcatggtgtcgtagatcgccgtcatggccgtgaaggaaccgcccggcgagttgatgtacagggtgatgtcgcggtccgggtcggtggactcgaggaccagcagctgggccataacgtcatcagcggaggcgtcgtccacctggacaccgaggaagatgatgcggtcctcgaagagcttggtgtagggatcctggcgcttgaagccgtatggcgtgcgctcttcgaactggggcaggacgtagcggctggtcggaagattgccggcagtcgatccgaagttgtaggtcatttttggtgctcctgatctaagtgttctaagtgccgggttacttctcggaggctgactcgccggaggaaccgcttgcggttccgccaccgccggagacggagccggcgtgggcggcaatcttgtcgaagaagccgtactcgagcgcctcggttgccgtgaaccacttgtcacggtcgttgtccttgaggatggtttcaacggtctgcccggtctgatcggcagtcagctcggccatgaccttcttcatgtgcaggatgagttctgcctggatcttgatgtcagaggcggtgccgccgatgccgccggagggctggtgcatcaggacgcgggcgttcggggtggcgtagcgcttccccttggtgccggacgagagcaggaactgtcccatggatgcggccaggccggtggcaaccgtcacgacgtcgttcgggatgaactgcatggtgtcgtagatggccatgccggcggtcacggagccgcccggtgagttgatgtaaaggtagatgtccttttccgggttctccgcggacaggagcagcagctgcgagcagatggcattggcgttgtcgtcacgcacctctgagccgagccagatgatccgctctttgaggagccggttgtagatgtagttgtcctgggctgcaggatcgacagtcgccatccggggggactctgggtgctgtgacatatgtactaacctctcgctggtgacggtgacatcactgaaaatcactacttggacactaaccggtttcaccggcgttttgttcgcacacccgcggctgttcgctgacggcgcacgatcggccgggcagtcccggcagcggccggatcttaactcaaagggcccccggatcgagtgatccgggggccctttggcggtgcgtcctgaagcctaggccttggcctctgccttgtcttcgtcagcggcggtctcttcggtttcagcttccactgcctcggctgcgggagcttcctcttcaccgccggggcgcacgaagtcgctgaggtcaacggccttgccctcggtgtcggtgacctcggcctggccgaggacaacagccagcgccttgcggcggcggacctcggagaccatcatgggcacctggccgctctggtcgatgatctgggcgaactggttcgggtccatgccgtactggcttgccgtggtgacgatgtagtcgatcagctcgttctggctgacgttgacttcttctttctcggcaatggcgtcgaggatgatttcgttctggaaagcacgggccgtgttggcgcggacctcttcgcggtgctcctcggtgtcgtgctcgccttcaccgtgtccgttgccctccttgaagtgggcctcgagctgctcctcgaccacggaatccggaacgggaacctcaacgagctcgacgagcttgtccaggaccttgtcccgggcctcgacgccctgctccactaccttggagtcggcggcctgcttggcaaggtcttcacggagttcggccagggtgtcgaactcggaagcgagctgggcgaagtcgtcgttcgcctcggggagttcgcgctccttgacggccttcacaacaaccttgacctgggcctcttcaccggcgtggtcaccgcccaccagggtggtgttaaagatggcatcctcatcggcgctgaggccagtgacggcttcgtcgagtccgtcgagcatggtgccggcaccaacctggtaggacaggccggcggcggagtcgacctcttcgccgtcgatggtggcggtgatgtcgatggtgaggaagtcaccgtcggcagcggggcgctctaccgacttgagcgtgccgaagcggccgcgcagttcgtcgagggccttgtccacgtcttcttcggacgactcggcggctgcaacctcaaccttgatgccggcgtagtccgggagttcgatctcggggcggacgtccacctcggcagcgaacttcagtccgccgtcggtagccgacgggtccggaacctcggtgatctcaacctcgggacggctcagggggcggatgccggattcctgcacggcagcctggtaccagccgttgaggccttcgttgatggcagtctccaggacgtagccgcggccaacgcgctggtcgatgagctttgccggtaccttgcccttacggaagccagggacctggatctgcgaagcaacggtcttgtaggccgagtcgatgctgggcttcaattcctcaaaggggacctcaacattgagcttgacccgcgtgggggtgaggttctcgacagcgctcttcacggtctaagtactcctgggtttgtgggatgggtttctgcaaacgcaatgttttgtccaggccaacaggtccgggccgcagagtcggggtgacaggatttgaacctgcgacttcctgctcccaaagcaggcgctctagccaagctgagctacaccccgtaagtgcacaggcaagtctacggtcatacgcgccgagtttgcacatttgacacgtaggccatggattaggtttagttgtatccggcttgaacagccagcccgaagtcgcaggcctgctaatgttgcagacgcagcttcttccggggacgtagcttaatggtaaagcctcagtcttccaaactgattacgcgggttcgattcccgtcgtcccctccggacacgcaaaggcccctcagttgaggggcctttgtcgtttattccgcgggacgccggcaccggcaagccttcgtggggcgctttgacggcgcacgggccgcaaatccacagcggcggacggcgtgtccgtgtcgaagtgtcccagtccggttcgcccctgaaccaccggcgccgtgttcaggtctggcaggaagggcaccagtacagcttgcggcccaccagttctgcggccagcactgtggtcccgcagacccggcagggcaatccgtcacgcttgtacacaaaatgcgcgttgtcccgggcgggaaaggtgccgcttttcagtgcggcggtttcggccgcgggtctggccgccttgccgtttcccgtccagtacttgggcgtcgtggtgatgatcctgccgtcggagacgccgtcgttcatcacggagacgacgtcgcgccacagcttccgtgcctcgttgtcagcaaggttgctgcccggcagccaggggtccagccggcgccggaacaggacttccgcacggtagacgttgcccacgcccgcgatgatcttctggtccatcaggagcgcggccacgggtgccttgcggccttggaggttggcggcaaaccggccggcgtcgccccggcggtttaccaacgggtccggccccagccgtgcccgcaccatgtcagtctcagccagggtgatggtttcgcaggtggtggcacccctcaggtcggcccagccgttcgtggcggcaagcctgacccggacggcgcccaccggcgccggcggtccggcataggaggcgtcgccgtcgtcgtttccttccgcgaaggtttcctgctcccccacgcggcgcggcgctccgatgctggaagatccggcgaaagtgctgtcgccgccgaagctccaggccccgtacagcccaaggtgcacatgcagcaccagggcattgtcgaagtgcaggaaaaggtgcttgccgtgcgcttcggccgcgaggagcgtgtgcccgtccagcagcgcggcacctgcgctgaacctgccctgcgggctggacacactgagcctccggccgccgaagacgtccccgaactgccgcgccagcctgcggacggaatgcccttcaggcactactcgatgacctcgccggttgattcgtaggcggcgatcttgccgatgcggcgcacgtgccgttcgtcgttgctgaaaggctccgtcaggaaggcttcaacaagctcggttgcttcctccacggtgtgctggcggccgccaacggcaacaacgttggcatcgttgtgctcgcgcgccaggactgctgtggagtggttccaggccagtgcggcacgaacgcctttgaccttgttggcggcaatctgctcaccgttgcctgatccgcccagcacgatgcccagggcgtggacccctgcctgctggtccgcaaccaccgcaagggcggcgttaatgcagaacgacgggtagtcatcctgcgcgtcgtaggccttgggaccgtggtccaccacctcgtatcccttggcggacaggtgctgcaccaggtgggcgctgagctccatgcctgcgtggtcggtggcgatatggacccgcgggaaggcaggggaagaagtcacgagcagaatccgttcggttggggcgccggcagccggccgggacggcgcaggccagggtcaggacaacagggtcaaggatactaggactccggctgggcggctgggggctggccgccccctccgcggcgggccctcgcggcgacacgggtcaaaacctcagccagcctggcagcggaagccgggctgccgccgctcaccgcgagccgctggccgtcagttttgctgacgacgacggcgggaccgctgctgacgagcatggctgaggttccgccgtggtgccggtagccccacccgccatagtctgcagccttcacatctgccgcggtggcgccggagatggctcccgccggcacgttcatgaccggcacgatgccggccaggaggaccttcaggccctgccggtcggctttgatccgggcgaacaggaaggcggcgcccaccacggcgaggagcaccaggagcatcccaagccagggcacggcgaccgtaattaacgcggagggaaacagcgacgctatggcgatcatgatgaagactgagctgcgggcgtgcacccagaggcggatgctgtcccgcgccaggtccgggtccgcttccctggcgagggcgagctggagcgcgcggtcatcgtcgagcgaccactgctggtcggccttgaaaacgaaggcgatgatgacgcccagcgatacggccgcaccgcttccgagggcgaggaccgtcatgtccacgtgggattcccgggcgtctgccaatcctgcctgccccaccaggccggcagcgacgacgctggtgacaaaaaggctgaggaacagtccggcacccatcatgatccggcgcatgattgcaggcctgttgagggtcacagcctgggagaggaccagccagcccgccgccacgatcgccgccgctcccacgcccacataggtgccgaagggcgcgaaggccgcgccgccgtcgtccgtccaccggatcgcgagcggctcgggaaggtccggccggatcaggaaggcgcacaccacaaaaccggcggcaaggaccaccggaaaccctgcggcgaagcgcagcgccctggcgtccaccgaatccctaagcttgcccatgatccaacgctactccggccgcaggcgcctggcgtcctgcatctttccccgtccgctgtgagccgcgctacgtttccgggggtgaaggaatgcaagaatgagcagtgccgccgctgggcaccgccagccggcagacgcaatctttctggagggccctgtgccaggtatgaatctcacgcgagttgaagccaatgaacgtgccaaactgatctccgtcgagtcctacgaggtcagcctggacctgacccgcggtggaaacgtcttcggcagcaccaccaccgtgaagttcagcgccaggcccggatcctccactttcattgacgccgtcacctccgccgtccacagcgtcaccctgaacggccggagcctggatccggccaccgtggcggacggcgtccgaatccagctgccggacctcggggagcagaacgagctcactgtcgtggccgatgcgccgtatatgaacaccggtgagggactgcaccgcttcgtggacccggtggacaacgaggtctacctgtacacacagttcgaggttccggactcccgccggatgttcgctgtgttcgaacagcccgacctgaaggcggcgttcaccttcacggttactgcgccctcgcattgggacgtcatctccaactcccccacgcccgcacccctggagaccacgcccggggacgacggcggcgcccgttccgtctggtctttctcccccacaccgaggctgtcctcatacgtcacggcactgattgcaggtccctaccagtccgtgcgcagcggcgtggtgagctccgacggccggactattccgctgggcgtcttcgcccggaagtcgctgatgcagtacctcgacgccgacaacatcttcgagctcacccgccagggcttcgcattcttcgaggcgcagttcggctgcccgtacccgttcgagaagtacgaccagctgtttgttccggagttcaacgccggcgccatggaaaatgccggagcggtgaccatccttgaaggctacgtcttccgcagcaaggtcacggaagcccagatcgaacgccgtgccatcacggtcctccacgagctcgcccacatgtggttcggggacctggtgaccatgcgctggtggaacgacctgtggctgaacgagtcctttgccgagtacatgtcccacctcgcggcggtggaggcgacgtccttcaccagcgcgtggaccaccttcgcctccgtggagaagtcctgggcctaccgccaggaccagctgcccaccacgcacccgatctttgccgagatcaacgatctccaggacgtcgaggtcaactttgacggcatcacctacgccaagggcgcctccgtcctccgccagctggtggcatgggttggcccggaacagttcatggccggggtgcgtgagtactttgccaagcattcctggcagaacaccgagctgggcgacctcctggtggaactggagaaggccagcggccgcgaccttgacgactggggccggcagtggctggaaaccgccggggtgaacaccctgaagccggagcttgaagtggacggcggcggcgtgctcacgtccttcgcgattgtgcagtctgcggttgaggagtggcccacgattcggccgcaccgcctggcggtgggcttctacaacctcagcggggccggcaagcttgagcgggtgcaccgcgaggagctggatgtcgacggcggacgcaccgaggtgcccgcgctggtggggcttgcccggccggacctgatcctggtcaacgatgacgacctcgcctacgccaaggtccggctggacgaaaagtccctggcaacggccacggcccacctgaaggacttcagccagagcctgccgcggaccctggtctggaactcggcctgggacgccgcccgcgacggcgagacaccggcgcggcggtacgttgacctggtcctcgccaatgtggcggcagagtctgactcttccgtgatcctggtccagctccgccagctggccaccaccctgaatttctacgttgcggagaagcaccgcgaggccaccgcggtggcagccgcggaccggctgtgggacctggcgtccggggtggccggcggatccgacgcccagctgcagttcgtcaagtccttcgcactgctggcccgcagcgggtcccagctggacagggtggcggggctcctggacggttcggccaccctggaggggctggccgtggaccaggacctgcgctgggaactggtggcctccctggtggccggcggacgcctcggccaggagggcattgacaccgaactccagcgcgacaacacgtccagcggccagaatgccgcggccctcgccaaggctgccatccccacccccgaagccaaggcagcggcctgggactccatcgtggtcaagggcgagctgtccaacgctctccagggttcagccgtgaccggcttcatgcgggtactggaccgcaccctgctggagccgtacgccgaaaagtacttcgaggccgtgccgggcatcgtcgaaacccgcacccacgcactggcccagcagatcgtcgtcggactctacccggcgctgctgaccacccaggcgaccatcgaccgcacggacggcttcctggcggcgcttccgccggcaagcgccgcgctgcggcggatgatgctggaaaaccgcgacggcgttgcccgggcactgcgcgcccgcgccgctgatgtcctcccggacgaagcataggagcccgggatgggactcagtgagcaccggtacaagctgaccgtccagtggacgggcaattcgggtgaggggacgtcgtcctaccggggttattcccgggaccacgacatccttattccggggctgccggtcctgaaaggctcagcggaccccacgttccacggggacaaggagcgctacaacccggagcagctgctccttgctgccctggcccagtgccatatgctctcctacctgcacgtggctgtgaagcacggtgtggtggtcacggactaccgcgacgaggcgtccgggatgctgaagctgaaccgggatggcagcggccagtttgagagtgtcacgctgcgcccgacggttacggtggcggatccggcgcatgtggagctggccgaacggctgcaccatgaggcgaaccaggtgtgcttcattgcccgcagcgtgaacttcccggtgggacatgaacccgtcacgctaacggcctgatggcccaaccaggtagcgctaagtgtcgttttcagggctcagaacgacacttactgctacctagttggggcgggcggactcaaaggctccgaggcagcttcttggccagccgcgcctcggtctccggcgcaaggccggccttccgcggccggtcgactccccgggcgcgttcgtccgccaacgtgtcagtcagcgtctcctgccagggccggagctgcaggccccgggcaagggctgcgctgttgcttcgggccatgaagccatcgtgccctggcgggagccacagcggcagagaatccgggcccgcccagtagttgacgccgtgctccgccagccacgtctcctccgccggaaggatcccgccgcggtggctcgcagcctcccgggaagcggcaataagtttcccgaaaggcacctggtttcccacggcgttcagcgccccggtcacgccgtccccggctgcgcgcaggatccaggctgcgaggtcgcggacgtcgacgacctgggtggggctgttgtcaatggcgggcacgatgaccggccggctgtgccgggcgaaccgtgcaggccagtaaccgtagcggtccgaactgtcccccgggccgccgatcaggccggcacggcacaggtgggctttcccgcccgtggcccgcatggttgcttcctcgatggccaccttggattcgccgtacgtgtccggcgtggacggagtgccggccgggagcgcaggcaggaggggagcgtcctcgtccgcaccagaaaccgaagcatcttcataaacggagcaactggagacgaacgtccagtgcgctgcacggtctgcgagtgcctcaagcgcctcggtggcaggcacggggtcgcgggcgacgtcgaccacggcgtcccagtcccccgtggcgccggcataggcgtcggcgcccagtgaacggtccgccctgagccaggatgcaccccggggtggaacagccgcggaaccgcgggccaggcaggtgacgtcatgcccgtccgccacggcgctccggacgatttctgcggagaggaaggccgttcccccgaggacaaggatgcgcatgatgagaggctacggcgatagtgttgaaggagaacagagccgtccgcgccgggcgtaaccggcagcacggcacccccttcccggcacagccgaacaacagcaggagtaccacccccttatggtcagcacgttgtccatccttccttccgccgccagcgagccggacggcatcagcgtcaccggcatcgtgatcagcctcggcgtcggcgttgccatctggctggtggccaccttcgtcatctcccgtatcaccaggcgcgtggcggcaggcagcaacttcttcaagaaacccaccttcaggtgggccgcccccgccttcagggcgctggaccatgaacggcgcgtacagcgtgcagaaaccatcggttcactgctgaacagcatcgtgggagtgctggtggtggtcatcaccggcatgtacgtcctgcagaatttggacatcaacatcgcgcccctgctgaccagcgttggcatcctgggtgtggccatcggcttcggcgcacagcagctgatccgcgacttcctggcaggtattttcattaccattgaagaccagttcggtatcggcgacgtgatcgaaaccagcgaggtggtaggcgtggtggaatccatggggctgcggatcacccgcgtccggtccgacgacggcgccatctggtacctgcgcaacggcgagatcctgcgggtaggcaaccgctcccagggaacgtacgtgcccctgcacgagtcgccggacggcaccacggaccagggctctgaccacggcgctgagaacactaagaccgagcagaaagccggagaatagcgatgaccatccccatcgaaccgcagcggccgcagttaatgcagaacgatccgttcagcaagcccggctataccgacaacttctatgatgccgtgggcgggcacgacactttcgtgaagctgatcgacgtcttctacgacggggtggcaacggatcccctgctgcggccgatgtaccccgaggaggaccttgcaccggcgaagcgccgcttcctgatgttccttgagcagtattggggcgggcccaccacctacggggaggaacgcggccacccgcggctacgcatgcgccatatgccgttcaaggtgacgcctgaggccaaggaccgctggctcttccacatgcggacggctgtggacgccctggaacttccgccgctgtacgagggcaccctgtgggactacatggaacgggctgcactatccatggtgaacagcccctcggcatcctgactgataacgccgtaaccggcggttaaagaagtccgcttccggtccgcgccagtacgtggccgcggctgcccgtgaggcggaaccagcggccggcccggtaaagcttctggtcgccatcggcgaggaatcccaaggccagtgcggcgaaagccgctccggctggcagccctgacgcatcgagttcccggccccacaccgcagcgcgggcgttgttaacgatcagtgcgccgggcttgtccggcacgattccagccacttcggcaatgcctgcttcggccgccgcccgcagttccgcatcgggccgggagccgatcagctcccacccgctccgcggagcgcccacgcccgtccaggactcgctgacggtggacggcggcacgggaagttcgacgtcgtcctggccggcgcgggccaatcggtccaagacagcggacaatgccacggtcacatccgtcgccgaggcttccgccagggccatggtgcgcagccccaggatcgtcggggtcgattcgcccaaaagcctcggccggagcacgcacacatacgcggccaggacggaacctgccccctgaagccggatggcgccgtcgtcaatggccttggcccgcgtggcgaaggtcttcagatcggcgagatcctgggagtcggcaaaacggaaggacgaggtgaggagatcagacacaccaagaacactaccggctggggctttgttgagcagtcccggggtgccgtctagagtcgaaccatgactgaagccgacgccggactgctggcgctccccagcgaagatcccacctcatcgctcatctccctcctcgaccttggtgagctggagggggcgcggacggatgaggacatcttcctcggaccttcccagcagcagccccaccaccgggtgttcggcggccaggtgctggcccagtcgctcatcgcatccatcaggactgttgcccctgaccgctttgtgcactccatgcacggctacttccttcggccgggcgacgccaacaagcccatcacctttggggtccagcgcctccgggacggcaggtctttttcagcacgccgggtccacgcctaccaggaaggcacgcccatcctgtcgatgatcgcctccttccagggggaggacgaggggattgagcaccaggccacgatgcccagtggcattccggaccccgagtcgctgcccagtaccgctgacctgctgggaaagttcgaccaccccgtggcgcggcactgggcctacgagcgccccttcgacatcaggcatgtggatccgccgctgtacgtctccgcgaagggcaagcgggaagcccgcaatgcggtgtggatgaagaccttcgggccgatgccggacaaccccaacctgcaccgggcggcgctggcgtacgccagcgactacacgctccttgagtccatcctgcggcgccacggcttgagctggattacccccggaatgaacgtggccagcctcgaccacgcgatgtggtggcaccgccctgcccgcgtggacgagtggctcctgtatgtccaggaatcaccgagcgcgcagggcgcccgcggcctggcgacgggcaagatcttcaaccaggccggccagcacgtggcgtccgtggcgcaggagggcatggtccgggtgcccacggacctgaagaacaaggtggtgggcgccttccagtccaaggtgatggagcaccagatccgcaaagccgggcgggactgaccggaaacaccgcccccggggcgtttgacgcaaagcaggccggcacccactgggtgccggcctgttctgcgctgttggtggagtgttgccccttgtatcccgccgcctgtcagtcgcgggtgaggcgacggtgcgtgacgcggtgcggcttggcggcatccgggccgaggcgttccaccttgttctcctcgtaggattcgaagttgccctcgaaccagtaccacttggaggggttctcctcgtcaccttcgtaggccaggatgtgcgtggccacccggtccaggaaccagcggtcgtgagaaaccaccacggcgcagccggggaactcgagcagggcattctccaggctgctgagggtttcgacgtcgaggtcgttggtgggctcatcgaggagcagcaggttgccgccctgtttgagggtcagcgccaggttcaggcggttgcgctcaccaccggagagcacgccggccttcttctgctggtccgggcccttgaagccgaaagcggcaacgtaggcgcgggacggcatttcgacctggcccacctggatgaagtcgagtccgtcggagacgacctcccacagggtcttgttggggtcgatgccgccgcggctctggtccgcataggaaatcttgaccgagtcgccaatcttgagatctccgccgtcgagcggctccagccccacgatggtcttgaagagcgtggtcttgccgacgccgttggggccgatgacgcccacgatgccgttgcggggcaggctgaaggacagtccgtcgatcagggtgcggtcctcgaaacccttttggaggttcttggcttccagcaccaggccgcccaggcggggtcccggcgggatctggatctcttcgaagtccagcttgcgggtgcggtccgcttctgcggccatttcctcatagcgggccaggcgggccttggacttggtctggcggcccttggcgttggagcggacccattccagttcctcgctgaggcgcttggcctgcttggcgtccttcttgccctggacttccaggcgggcacgcttcttctccaggtacgtggagtagttgccctcgtaggggtacaggtgaccgcggtccacttcggcgatccattcggccacgtggtccaggaagtaccggtcgtgggtgacggccaggacggcacccgcgtaggaggagaggtgctgctcgagccacagcacgctctctgcgtcaaggtggttggtgggctcgtccagcagcaggaggtcaggcttctgcagcagcagcttgcacagggcaacacggcggcgctcaccaccggagaggttggtgacgtcggcatccgccggggggcagcggagggcatccattgcctgctccagctgggagtccaggtcccaggcttccgcggcgtcgatggcttcctgcagctgtcccatttcctcgaggagagtgtcgtagtcagcgtcggggctggccatttcctcggagatttcgttgaaccgctggatcttgccgtagatctcgcccacgccttcctggacgttgcccaggacggttttttcttcattgagcgggggctcctgcagcaggatacccacgctgtagccggggctcagccgggcctcaccgttggagggggtgtccagtccagccatgatcttgaggatggtggacttaccggcaccgttcgggcccacgacgccgatcttggcgccagggaagaaggacatgcttacgtcgtcaagaataagtttttcgccaacggctttgcgggccttggtcattgtgtagataaattccgccatggttccaaatctagtgggttggcaggcatatctcacattccgcgcggcaggctcaggtgcctacaaagcacttgccgctggccaggactggcaggacggtcactgccacggcaccgtcgcggacctggccgatcacgcagtcacgcccttggagcactgccgcctcgatggcatctgcttccagccctgtgggtgtccggctctgcgacacttcaagtacccccggtgcaatgcccgctcccgtcagtgcatcgctcacctgggcagtggccggtttgggcgttcccgccgccagtctgcccagcgcgtcagtgacggtctgccggacagtttccgtggcggcggctgcagcggagtcgttcgaggcggccccggaggtatccgccaggggtcctgcggcttgcggcccgggcgtgccggggcccgtctgacctgcgtcagctgagccggcaggctgtgacggtgcgcttcctggctccgcaactttaggcgctgctgaaccgggggcgctgacagaaggcgtcccgccgacgcagcccgccagggatccggccagggcggcgactgacagcgcagccagcaggcggcgggcggggcactgcggtgacaaccgggcaggtttccttgaaccggcgcgggcaacctgcggttcccccgccgtgacaatctgccgggagtggaggataagccgcatgcagccattctgccacgaggtggtaaacctccttcgcaaccaggacgggaacaacctcgacgggcaggacacggccgggggtgccgtggtcctgcccgcaaaggcagccatggaagcgacagcaacagctctcctacactccggattcggcgagctcccccgtttccaggtccagcgcaacgatgtcgccgttggggtcctcgatgtaggcagccgccggatccgcgccgccgtccaggacttcgtcaccgtcttcaggttcgtcgaacggtccgtccgccggacggtgctcgccctcggagaggggaggctcgtgctccacgagcgagaggatcggcttggcagaggaacggatgaagttggccgtgccccacgtgagatcgtgacccacggcgtcggcatcaatggtgtgtgagtagtagacccggccgtccctttcccagctgcggattttcagcctgccgaccactatgacgggctgtcccttccggatgctgcagccgatgcttcccgccaggtggcgatagccctgaaccaggaaccagttggtgtggccgtccatccaggcgcctgtttccttgtcacgccgccgcgaggtggacccaatccggaaagaagcggtggccactccccctggtgttgttccgcttttgatctcggtggcaacgaaaccccggatcgttatggtgtcgctcatctttacgtcctgtcttcatgagtgatgccctagcaggcaggaccagcatcgcccgcgcccctgtccgggatcgatggcgtggcccgcctatgtggacaacccggccctattcccgcctgtggtggaaaagtcggccggccggcggtggttgaccatgccgggactctgggcaatgtaaactttttgaggcgccggagatcagttccggaagcaatgcctcagtagctcaggggatagagcagcggccttctaatccgccggtcgggggttcgattccctcctggggcaccaaacggatacaccccggttcacgaaccggggtgtttcgcattttcaccagtgccccatcacttctgccccccggaacatcggcggcaaggcagcaccaagcgcaaggtcagcggggtgcgcgtcaggcctgcagccggtacggtgcctccaccagcgaccggaccacgctgccggccgcccccaggagcgccccggcatcccccaccgtggacgtgatgacgtgttcggggggaagcgcaccgggcgcgtacttcgccaggctttccagaagcgggccgtgcaaccactggtcaaggacggcgaagtgccctccgagcaccacggcgcggacattgaccacccgggacgccgatgccacggcaacccccagcgccctccccgcccgctggacggccgtcagcgcggcgggactgccggcggccagggcgcccagcaggtccgccatgctttcggtcctggtccggcccttgacggtgattccggcagcagaaaatatcgcgtcctggcccgcaatcgtctccaggcaccccgtcccgccgcaggaacagggcgtaccctcggggtccaccacgatgtggcccacctcccccgcgttgccttcagggccagtgaaaagctccgaattcaggacgagcccgccgccgacgccaacttcgcccgagatgaacaggaagtcccgcccgtgggggctgtgggcaagctctgcgagcgcggcggcattcgcctcgttgaagagggaaacccccagcggcacgccgggaagcaaccgggccacatccagctttgtgtccacccagcccaggttgggggccacggtgacagtcgaactgccggcctcaacaagtccggggacggccagacctccacccagaacgtcaacacccagggcagaagccgcttgccgcacccccaaggccagggcggcgagggcggacatcacggcgccgcttgcactgtcacggttgtcccgttcccggacctctttcaccacgagctccccggaaaggctcgtcacgcccgcggcaatgtagtcgacgttgatttccatacccatgacgccccgcgacggattcagttccagccccacccccggccggccccgctccccctgcctgctcaggccgacttcgcggaggatgccggcgtccaggagatcaaggacgatgctcgaaacggatgcttttgtcagccccgtggccgcggcaagctgggcccgcgtcaggtggaatccggcgggtgattgcaccaccctgcccaggaccagggcgaggttgctccgccgtacgtccgccatgtttcccggcgtcccggcatccaacggtgcagtagcaggtgcggtactcgccatggccgctctccttgggttcgaaccgggaccgttccttcggcccctcttgaccctagcgtaatcacgcttatatagttcaagcgataaactaacttgcccaaacagcggcaacctgactgcaaggacgcatcatgactctctccccgactcccgctgacaagttcaccttcggcctctggaccgttggctggacgggcgccgatccgttcggcgtcgccacccgcgaagccctggaccccgtggaggccgtgcaccggctggccgaactcggcgcctacggcatcaccttccacgacaacgacctggtgcccttcgatgccacggcgtcggagcgggagctgatcctgaagaacttcaaggcagcccttgccgagaccggactgaaggttccgatggtgaccaccaacctgttcagccacccggtgttcaaggacggcggcttcacctccaacgaccgctccatccgccgcttcgccctgtccaaggtgctgcgcaacatcgactccgctgcagagttcggcgccgaaaccttcgtgatgtggggcgggcgtgaaggcagcgaatacgacggttccaaggacctctccgcagccctggaccggatgaaggaaggcgtggacaccgccgccgcctacatcaaggacaagggctacaacctgcgcatcgccctcgaacccaagcccaacgagccccgcggcgacatcttcctccccaccgtcgggcacggcctggcgttcatcgcccagctcgaacacggcgacatcgtgggcctgaaccccgaaaccgggcacgagcagatggccggactgaacttcacccacggcatcgcccaggccctgtgggccggcaagctcttccacatcgacctcaacggccagcgcggcatcaagtacgaccaggacctcgtgttcggccacggcgacctcaccagcgccttcttcaccgtggacctcctcgagaacggtttcccgggcggcggaccccgctacgacggcccgcgccacttcgactacaagccctcccgcaccgacggctacgacggcgtctgggaatccgcgaagtccaacatgtccatgtacctcctgctcaaggaacgcgccctggccttccgcgccgatccccaggtccaggaagccctcaccgcctccggcgtcttcgagctcggcgagcccaccctggccgccggcgaaaccaccgccgacctgctggccgacaccacagcctttgaggatttcgacgccgacaaggcagccgaacgctccttcgcgttcgtccgccttaaccagctcgccatcgaacacctcctcaacgcccgctaggaatatggcactcgtagcaggcatcgacagctccacccagtcctgcaaagtggtgatccgtgacgcggacaccggagcacttgtccgccagggccgtgccagccaccctgagggcaccgaagtccaccccgaccactggtggacggcccttcaggaggcagtggcagcggccggtggcctcgaggacgtggcagctgtttccgtcgggggccaacagcacggcatggtctgcctggacagcgacggcggggtggtcaggcctgcgctcctgtggaacgacacgcggagcgccggcgcggcgatggaactgatcagcaccgcgggcggcggcgacgctgccgccggcgcccgctactgggccggcgccacgggcaccgtcccggtagcgtcgctgacgctgaccaagctgcattggctggcagtgaatgagccggacaacgcggcgaagacagcggccgtctgcctgccccacgactggctgacctggcggctgttgggccacggccccggcagcggacccgggaacctcgaggccctgactacggaccgttcggacgcttccgggacgggctactactcgacggcggcgggcacctacctgccggaggccctgaagtcgtcgctggggcatgttccgcaccttcccgacgtcctgggccccctggacgtggcaggcaaagcttcctcaggcgtcctcgtggccgcgggtgccggggacaacgcggcagcggcactgggcgccggcgccggcgtgggcgatgtggtgatgtcgctgggcacctccggtacggtctttgccgtgtccggcacgccggccgccgacccgtccgggctggtggccgggttcgccgacgccgcaggacactacctcccgctggtgtgcacgctgaatgccacccgcatttttgatgcgaccgcttcactgctggacgtcagcatcggggagttcaacgagctggcgctgtccgccgaaagcggcgcgggcggcctgaccctggtgccctatttcgatggcgagcgcacccccaacctgccggatgctaccggctcactgcacggcattacccgcgggaactatacgcctgccaacctggcgcgcgccgccgtcgaaggcgttgtgtgctccctggcggacggactggcagccctccaggaccagggggtggaggcacggcggatcatcctggtgggcggcggcgcccagtcaacagccgtccagcaggcggcggcacagctgctgggaatcaacatcaccgtgccgtgccccggcgagtacgtggccgacggcgccgcccgccaggccgcaggggcgcttaccggacacttcccgcagtgggcgcttgacgccgtcgacctccccgcgggcaaggacgacgcgggcgtgcttgcccggtaccgccggtacgcctcgatgtacgcctagggacccgaggcaggaaaagacccggaccgcacacgcggtccgggtctttttggtggggcgcaggctcctgccgtgacgttagcaggagcccgcggtctggacaggagatccagagcgtgtcaggcgtatgggaggacaagctccgcgtagcgatccttcactgtggacaggaccgtgttgccgtccgtgtcccagatctcctgattgaagatttcgacttcgatgtcaccggtgtagccggcgtcgcgcacccaggtgccgatggtggcgaagtccaccacgccgtcgcccatgtatccgcgggacagcagcggatcggcggcgatgggcatgttgaagtcgcacacctggtaggaagcgatgcggttctcccggccggcgcgttcaatctgcgccttgagttccggatcccaccagacgtggaaagtgtcgacggcgacacccaccgtggaggcgtcgaacggcgccgcaaggtccagcgcctggcccagggtggagatcagggcgcggtccgcggcgtacatcgggtgcagcggctccaggaccaggcggaccccgttcttctctgcaaagggaaccagatcggccaggcggtccgcgacccgccggcgtgcagccaccacgtccttctcccccggagccagcccgccgaccaccaggaacagttcccgtgtgtccagcgcgacggcttcgaggatggcggcccggttgtccgccagtgccgcggcctgcccctcggcgtcaggtgcggtgaggaacccgccccggcacagggaagaaactcgaaggccggcgtccttgatcaggcgcgccgccttgtccaggccggcttcctccacgcggtcccgccagggcccaatggcggggatgccggctttgacacagccctccaccacctcggcaagggtccacttcttggtggtggcgctgttgatggagaggcgcgcgaagtctggatagatggtcacacgcccaccccgttgatccgcaggtagtcggacatccggaacgcagccagtgcggggtcccgcagcaggccggcctggtccgccagctcgaaggtcctggcgaggtggcacacggaacggccggaatgcaggccgcccaccatctggaagccgggctgcttgccgttgagccaggacataaaggcgatgccggtcttgtagtagaacgtgggggcgctgaagatgtgcttgcccagttcccgtgtggagtccaggatttcgcgcgccttggcggcgtttccggcgtcgtagttctgcagcgccaccgaggcggccgggtagatggctgcgaagatgcccagcagggcgtccgagtggtgcgtgccgtcgccgtcgatcagttccgggtagttgaagtcgtcgccggtgtagagacggacgccctcaggaagcgcggcgcgcagggcaacctcgtggctggcgtccagcagcgagactttgacgccgtccaccttgtccgcgttgtccttgatgaggcccaggaaggtttcagtggcagcagccacatcatccgaaccccagtatcctgcgagggcgggatcgaacatggtgcccagccagtgcaggatcaccggctggtccacttcccgcagcagggtggagtacacgttcaggtagtcctcggggccgctggccaccttggccagggcacgcgatgccatgaggatgacctttggccctgcttcgctgataactgcaatctgctcgcggtaagcctcaaggactgccttaaggccggcttcgcccacgggcagggagtcgatgtccagctggtcggtgccggcgccgcaggaaaccaggtcccggactgacttcccggctgtcgccgcatttccggatgagaccaccgaagcagcctcgacgccggtgcgcttgatgagctgctgggtggctgcccagtccaggcccatgccccgctgggcggtgtccatggcgtccgcgacgccgagcccgtaggaccacagttcgtggcggtaggccatggtggcgtcccagtcgagccgggcgggagcgccgggagtgttgtccgcgaggacttcggggatgacgtgggcggcggcgtaggcgcgccgggcagtcagcggggcggtgggacgcgcccaggaggtaccgccctgcagccggtactcgcgggtgccgccgtcgctggaggggaggatgagcgaagtcattagagggtgatctccgggatgtcgagggtgcggcgttcgtcgttggacttcaggccgagttcagcgagctggacgccgcgggcggcggacagcaggccgaagcggtgctcgcggccggccacgacgtcgcggaggaactcttcccactgcagtttgaagccgttgtccagctcagcgttcgcgggaacttcctgccactggtcgcggaaggactcggtgacgggcaggtccgggttccacaccggcttgggggtgtgggcgcgctgctgggcaacacacttgttcaggcccgcgacggcggagccgtgcgttccatcaacctggaattccaccagttcgtcacggtaaacgcgcaccgcccaggacgagttgatctggccgatgacgtcgtcgccgcccggggtctcaagctcgaagatgccgtaggaggcgtcatccgccgtggctgtgtattccttgccggcttcgtcccagcgcgccgggatgtgggtggcggtcttggcgttgacgctcttgaccttgccgatgatgccctcgaggacgtagttccagtggcagaacatgtcagtggtcattccaccgccgtcttccttgcggtagttccaggaggggcgctgcgcggcctggatgtcgccttcgaagacccagtagccgaactccccgcggatggaaaggatgcggccgaagaagccttcgtccaccaggcggcgcagcttgaccaggccgggcaggtaaagcttgtcatggacgacgccagccgtgacgccggcttccttaccgatgcgggcaagttcgatggcctcttcaagggtttccgccgtgggcttctcggtgaagatgtgctttccggcgagcattgcctttttcagggtggctgcgcggaggctggtcatggaggcgtcgaagatgacgtccacggtgggatcgttgatgaccgcttccagatccgtggtccattcagcgaccttgtgcttttcggcgagttcgcggatcttggcttcgttccggcccacgaggatgggttcgacctggatgcgggtgccgtcttccagggtgaatccaccagcatcgcggatgggaaggatggaccgcagcaggtgctggcggtagcccatccgtccggtgatgccgttcatggcgatgcggatggtttttgtttcgaagcccatgtgtcctccacggtgagtgagcagttgtactcaagctggtctgggaaagcgcattcccactacgtcaatgatgcactgcggggataacggttggcaagcgctttccggaagaacttgaaactgccataatgtggtgaccccttattggcccccgttatccaggagttcccgtggctgcaagtacccttaccgaggtggcccggctggccggagtctcccccgccaccgcgtcccgggtattgaacggctcggcgcgcaagccgggcaaggacatcgcggaccgggtgcgccaggcggccgaatccctggggtacattcccaatgcccaggcccaggggcttgcgaagtccagctcgggcctcatcggcctgattgtccacgacatcgccgacccctatttcgcagccatagccaggggcgtccaggctgcggcccgggagcagcgcaagatggtgctcctggccaccaccggcggggcccccggcgaggagcgcgaagccgttgcagcgttcgccgcccggcgtgccgactcgatcgtcattgcgggatcccgctcgtgccggaccgaggaccgggacgacaacactgaactggcggcggagcttgaccggtactgccgcaacggcggccgggtggccgtcgtgggacaccctgtggtcggcgcgaccgctcctgagggctaccacgtggtggctgtgcccaaccaggagctcgcgggggccctggcagttgaactcgctgccggctgggacggagatttcgtcatcatcggcggcccggaaggcctcctcacctccgacgaccggatccgtggcttccaggaaggcctggcccgggcaggccgcgcacccgccgagatcctgcgcacggcattcaaccgcgcgggcggctatgacgccggcctccagctggcggccaggatcaagtccggcgcgtccgggggcggagaagccgccgcccccaagctgtgcatcttcgccgttaatgacgtcatggccatcggcgcctcggcggcactgcgcgctgaagggctgcggatacccagggacgccaccattgccggcttcgacgacatcgaaacgctgcgggacttccgcccggcactatccaccgtacggctgccgctggaggaaatcggccggcttgcaacccgggctacgggccgcatgtccggcgacagcgatgcggacgaggacggagagcagccgaccgtcaccggtgaagtgacgcttcggcgcagcaccgaggcggtggcctaggaatgaagtccgcactgacgagcattcctgcgcatcacccggccggaagccggggtgcgaaaggaacaagtccggccatcctggtcctgcccggcggcggctatgcccgccaggccgaccacgaggccgagcctgtgggcgagtggctcgccgccctgggtatccacgcgttcgtgctgaggtaccgcgtggcacctgaccggcacccggcacccttggaggacgccaaggaggccatgctgcacatccgcaacggagcccacggcctcgcagtggatccgggccgcgtgggcgtcctcggcttttccgccggcgggcaccttgccgccacgctgtcgacgtctacgtcaaccggaagcgcccgcctggacgtgcaggaagctgtcccggacctaaccgtgctgtgctaccccgtagtctcctatacgcagtccgtgcaccaggggtcggtggacaacctccttggcagcgcgccgtcgtcggaccttctcgaagaactctccgccgaacggaacgtgagcgccgcaacccctccggcgttcgtctggcacacggcggatgatgcggccgtcccggtcagccacagcctggactacgccggggcactcatgcgtgccggtgttccggctgaactgcacgtctttccccgcgggcgccatggccttggcctcgcggcggaggaacccgggccggaccagtgggcacaattgtgcgccgcgtggctggaccgcgcgggctggacctccaggccttctgctgcgggcagtccggactagccgagtgcccggatggtccaggacgccgtatgcgactccccggccttgaggtggaggaggtcagtgcctgagttgaaggcgtccggcgggcaggtcatgggctcgacggccagtcccaagcggtccggccccacgggtttgtcagcggtgtggatctgcacccatggccactcggcaccccattccagttccacgcccgttccagccggatcctgcacccggacgcgggccgccccctgttcatcgcgggagatccccgtgaaagcgtgatcgatcttcaaggaaccaagccggcgggggctgcggtagtcgaattcgtgccgctccacgctcttcatgcctgtcgggaggagccggtcgggcgtcacttccaggaattcgcgtgccggcagttcaagggtccagtcatccagcttcccttgccctgctaccagatacggatgggggcacactccgtaaggggcggcggcctgtccaacattcaccgtgctcaccgtgctgcgcagcccgtcaggacccagcgaataggtaacggagacctccaggtcggacgggtagtccgggccggcgctgaccctgcaagccagcaccaccgagtccgcagttgcctgccgaagctcccagtcctgcccggtggcgagcccgtgcagtgcggagccccgctcgggctcgttgatcacggcttcgaattccttgccgtcgtaggtgtacctgccgtcggccagccggttgggccacggcacacaaatgactccgcggtagtcggggatgcgtccctccgggccaaagcccaccacgaggtcccgtccatggtgccgcagctcccgcaacgcgcccccgcgggatgtgaccagcgcagtgtaggggccgctcgcgatgctgtgttccgtggatggcatggaaatcctcttggcagggacatttttgttagcgctaaccagcgtagcgcagttctcctcctgcgcagtatccccctgcaggaacggcgcgcctgctgctactcccccgtgctggctaaagttgcatcatgaaccacggggacgcggtgaatgtccgggtgctctctgccatccgcacggcactgcaggaaagggccgatcccgtacggggggccggcgcaatggcctacatgaagtccacaatgccctgcctcggagtgcgcgtgcccgaggtgcgccgtattgcgtcagctggggcggccggggcccccttcgagtcggcggaccagctccgtgccacggccctggagctgtggcgcggcgcagcttcgcgggaggaacggtatgcagcaatcgacctgacggccaacggcctggttgccggggacatggcgatgctgcctgtctacgaggaattcgtccgcagtggcgcctggtgggattttgtggacggcacggcgggacggctgtgcggacttctccaggccaaccgggcggagatgacgggggtgctgctccgctggagcaccgatccggatttctggatccggcgggccgccattctgtcgcagctcaaggcgaaggccgcaactgattccgtgctgctgacgcgagttgtggaagcgaacctggcggacccggagttcttcatccggaaggccattggctgggcactgcgcgagtacggcaaaacggacgctgggtgggttgccgcgtttgtggctggacacgcagcagccatgagtccgctgacccgcagggaggcggtccgacatctggcgcaggttagatgacggggcgttcgacgacgttcccgtgcgtcttgcggaacagccggcgggtgcggggatcccagaagatcaggtacaggccgaacagcaggccggtcaccgcagcagccacgcgggccagggcgagcgcgaatcccaggtcctcggtctgcaggtaggggaagacttcgagctggtccgagatggcatagatcatgaagaaggagacaacaaagtagagcgctttgacctgccagtcgttcctgatgccggtcacggcgaagagcggtatcagccagacgacgtaccaggactggatcatgggagccagcaggaccacagcagcaaaggcaagggtgaggcggcgtatcagcctgtcatggtccccgcggaagatctgccaggcgatgacgcctacggccagcagcttcccggcgtcggacacaaagcctgccagggtggcgccgtcgagtccgaacgagttggccagcgaggcgaccaccatgccgatcagccccacgggcgcgtaccagatggagatgcttcctggcgcggagagtccgttgatccagccgaagccgaaaccgttgaccaggctcatcgcggccaggatgcccaggctcagcgctgccgtcaggccccagaacgtgaacttccggagccagccggcatccttgcccgcccacaggagcccaatgaacggcaggaacacgatggtgatgggcttcaccgcgatggagagggttaccaggacaacaccgcggacaaccctgtgcgtggcggagtagtagaggccggccagtgccagtccgatcatcagtgcgtcattgtggacgctggcgatgaagttcgtcaggaacagcgggttcgcggcggtgagccacagggcgcggtgcgggttgactccgtgcagttccgcgagcttgggaacgtagataacgcacaggaccactcccgccagcgccaccagccggaatagcatcacgctcgcctcgggctggacgttggtggaccagacgacgaactgctcaatccacaggaacaactggccgtaaggaacgggggcttcggtccacatcttgtccgcgcccagttggaagtagttggacagtgccgagatgccgttctcgtaggggttgaagccctccaccatgagcctgccctgcccgatgtaggcgtagacgtcccggctgaagaggggcacgctgaacatcatgggcagcccccatgccacgacggccatcagggtagctttgcgtgcctcgtcgccccacacccggaccctctgcccgagcctgagccacgcccgcaccaggagcatgccgccgacagcaagcaggatgattgagagggcaacgccggcagcttcagcacgcatccagatgaacaacggcatccggcggagttccgaaaccggcgccagccagcccacgcccagggatccgatcagcatgaacatggatcccacgaatccggcaagaagcggggaacggggattatccacttccgcaccgcccgctgcggcagtagcggcggccgccgtctccctcgtcgcaggcacaggcgccgtcatctcaggaacgtccaatctttctcgtttgcggttccgccaggcgggatggaaccggccggggcgcgtcaccacgggcgcggcacgacccgccgcgtctccgaaatcctagcaccggccggtggccgggaggtgaaacggtaggctggtccggtgcctatatctaacgaacgaatcgtctggatcgactgtgaaatgacaggtctggacatcaagaacgatgccctgatcgaggtggcggccctggtcaccgattcggaactgaacatccttggcgacggcgtcgatgtggtcatcaagccagatgatgctgcagtggcccagatgaacgactttgtccgggacatgcacacgaagtccgggctccttaaggagctcccccacggcaagacaatggccgaggccgaagccgcggtcatggagtacatctccacatgggtcccggacccccgcaaggcaccgctgggcggcaactccgtggggactgaccgggtgttcctgtcccgcgacatgcccgcagtggtggagcacctgcactacagggtcattgacgtcagcaccatcaaggagctttcacgccgctggttcgcccgggcctactttcagtcgccggcgaagaagggcgggcaccgcgccctgggggacatcaaggactccattgatgagctccgctattaccgagaggctgtgttcgtgccctccccgggaccggacagcgccacagcgcagcggatcgcgaagcgcatcacggcggccaacgaccggcagccggaagcgtaatctgcgccacctttcgcggttttttccgcgaaatcggcaaaagtggacaaagcacccctgaacagcaggtaagctatatgagttgcctttccagagggccggtccgccggtaaatctgcaggcacatggtgggcttagctcagttggcagagcgcctggttgtggtccaggaggtcgcgggttcaacccccgtagctcaccctcacgggacggtatgtgcagccgtcctccaaggaggccgcaccggatatccggtgcggcctccttcttttttcactgctgtgcacactttcttttgcacgaaacaccgccgaaggaccacctgaagatgaccgttctgccaatcaccatctggggagaacccgtactgcaccgccgggcttccgaggtggaagtattcgacgacgaactgcgcaccctgatagctgacatgttcgaaacgaacgacgccgccaacggcgtgggcctggcggcaccccaggtaggggtcggcaaaaggatcttcgtgtacaaatacgccaacgacgacggcgctccccccaccggcgtggtggtcaaccccgtcctgaccctgtctaagatttccggcgctgttccggatcctgacgaggaagaagaagggtgcctgtcctttcccagcggacagtacccgctcaagcgcgccgaatgggcgcgcgttgaagggtttgacggattcgggcagccggtcaaattcgaggcgacgggctggtttgcccgcgtgatccagcacgaatatgaccacctggacggcaagctgtacgtcaaccggctcatggaccgctatgcgcgcaaagccaagaagctggcgaaaaagaacggctggggcgttcccggcctgacctggatgcccggagtggatccggaccctttcggccactaggtgcaatgaccggacacgttgatcaatcgtgagcagggcgactggctgccgcatgcggtgttgggtcggtgatggttgtagtggtgcagccagccatgtagctctccacgacgatcagcctcggaggtatagcagcgggcataggccccgccgtcgcccaggtgcggtggaagcgcttcacgctggtttgttgttcgccgaggggccagggcattgtggggtgcacttcaattcggctgaccccttcaggctgtatgtgcagttcagttggttcgagaagccgctgaccgaatggccttggcgaggtcgcggggacggctccacataggccaatgccccgtcgggaggtcaatgacgtcgaggtgctcgatgttcgcgacttcggcaaacatggcatggcctgcgcgggccagctccagcacctgcgcgctcgggatcgagcagcacacgagtgtggtccggaccttgcggcgggcatcgttcgtgagctcgacgggctgacgaagcacggcgccgggctcagggacggcccgggcccgaaaacgctcgaggacctctgtgctcaggccttcaaggctcgcctgctgtgcgaggacgtcgagggacggcagcggaagctcctccaactcctccgggatgtccgggccgaaggcgcttcccgtcaccacagggccggagtcgacccacaccactcgatggacaagctcagggtgtcggtcaaggacgagactgaccggggcgttcgccccgctgtgagcgacgagagttgctggctgatcctccgaggccccgagttgagtgaggacgtccaggaccgctgcggcttgatcgtcgagagtcttcgccgcacgctcgggatcgtccacgtcgagaccgggcagtgtcatcgcggttgcacgagagtggtcggttgtcaggcgttcaagcacttcgtcccatgcccaagcgcccagccagtggcccgcgatgagaataataatcggactgcttgtagtagttgtcatgtcaataccctcgcaggcactacggacaacggtatgtcactatttatgtcatgaattcgccggggcttgaactgtgaagcgagtcgaacggctccatgctctatccgagatgctgcgccgcagcggcacgcgaggggtttccgccgaacggttggcgagagaatttgaggtatccgtgcgcacaatcaagagagacctcgatgcgttagagaacagcggtgcgcccatatggtctcgcccaggtccgggcggtggctacggattggctatgggcgcatccctgccgcctgtcagcctgtccccagcgcaggccgtggcgctcatggcagccgtgtccgctgcgcccgatgccccctccgccgatctggcagcagccggtgtccagaagatcctggacgtcctcgatcccaaaacccgagcacgagccgacgagctggcccaccgcgtctgggtcaacgcgcttccctcctcttcgcgcgcaatcaagtcggcactggatgaggcgatggccgagcagcgggtgatccgcattcgctacacgtcgagagacgggaccacgaccacccgcgacgttgagccggtgctgttcgcctccaccaacggccagtgctacctggttgggtggtgccggctgcgcaacgcaatgcgatggttcaccgtctcgggcatcgagcgagccagcgtaaccaagacggcttgcggcggccacgccatccacgaggtcggagaacccccggcaaacgccagaccggtgcacggtcggggcgaatgagtaactcaatcaacgtctccggtcaggacaaccaggcccgacggtgggcgctgcccgaatgccagggcccggcggcagccacgcttgcgtcgaacgcggtacagcctggttctggctcagcgggcggcaacagtctgctggccggggcaggaacccaggacgcgcttcatggcatccctctccgcctcggtgacccacaggccgtaggcggccttcactgaaatctggcgcgccacatagtggcagcggatcgacttgtttttaggaagccaggtggcggcgtcgccggcgcccttctgctggttggcgggaccgtcggcggcgataaggttgagcggatcgttggcgaggctctggcgctcccccgccgtcagcgcctgcgcgcctttctgccaggcatcgccgagggcaaccacatggtctatctggaccgcccggctgctgtctgagccacggcggaagtccacaaactgcccggtgtagggctcatggaacgaaccggccgccacccggcatccggagccttccgtcagtactacggcggtgaggtcgcggcgcaggatgtcgttgcgggtatcgcagccgttccggtccacgtcctgccaggcctggccgtaggcgtcccggctgtagtccgacgcggcggcgcgtcccttgacggccagtccgtccagtgcggcgagggcagaacctgcgggcaccgggtgcacaggcttaacaggtttcatccacgcgggatcaaaaacaggagcttcagtggggccggaaattgcgggctccgccgcggcaaactgtcctgcggtaaagaaccaggacagtgccgccaaggccgacactgcagctgctgccaggattccccacgcctggcgtgaacgccggcgcgcccgtcgataggaggaccagctcacggtcatggggttcctggctttgcggtactctcatgcaccagaagagcctaggtcacccgtccgaaacccccgctgatatccacagtgtggagggagagtggaaggtcacaccggcggggtttactgctcccgcatcacccttcgaaggtcttcctcggctataaccagcagcccttcgagctggcggacccggttctctccgacgtcgcccgttttgtgggcggcgcgggcgccctcaagcagccggacagcctccttgtggttggctttggcgacgtcgagggcgtgctcaagggttgtttcgtgctggagcgtcgaatcattttccattccaccagtgtggtcccgtttcccggctgattccagcaccaccagccgggaaatcgggagaccctgggcggatgcctaaacggcgatcgctgcgagggccgctgcagtttcctttgccgggaacgacggcgggttcacgccggccatctcctccatgacgcggaccacctggcagctgtaaccgaactcgttgtcgtaccagacgtagagcaccaggttcttctcgttggagattgtggcaaggccgtcaacgatgcccgcacggcgggaaccgacgaagtcggtggacaccacttcgggtgagtcgatgtagtcgatctgcttgcgcaggtccgagtgcagggacatctcccgcaggtagttgttgacctcgtccttggtggtcccgttctcgaggctcaggttcaggatggcgagggacacgtccggggtggggacgcggatggagctgccggtcagcttgcccagcagttcggggagggcctttgccactgccttggcggcgccggtctccgtaatcaccatgttcagtgctgccgaccggccacggcggtcgcccttgtggaagttgtcaatcaggttctggtcattggtgaaggagtggacggtctccacgtgcccgtggaccacaccgaacttgtcgttgatggccttgagcaccggtgtgatggcgttggtggtgcaggacgctgcggacacaatctggtccgtgtcctcgatggtgccctggttgatgccgtgcacaatgttcttcaggtcgcccttgccgggggcagtcaggaggacccgtgcaacgcccttgctctgcaggtgctgggagaggccttccgcgtcacgccagcgcccggtgttgtccaccaccagggcgttgctgatgccgtaggcggtgtagtcgatggtggccgggttgtccgagtagatgacctgcacctggacgccgttggccgtgatggtgttggcttcctcgtcaatccggatggtgccttcaaaggaaccgtgcacggagtcgcggcgcagcaggctggcgcgcttggagaggtcgttgtccgagcccttgcgtacgacgatggcgcgaagccggagaccgtggccgccgccggccttttcgatcaggaggcgggccaggagccggccgatccggccgaagccgtaaagcaccacatcggtgctggtgcggtcatcgccgccgcgtttgcctacgacgtcggccagttcagcacggaggaattcttcaagggtggcgccgttgccctcttccttgaacttctggttcagccgtgcgatgtcgatcgctgccgcgccgagctccaggttggccagggtgttcaggagcggggcggtctcctccagcagcagttcgtccttgctcatgcggcgcgcaaagcggtgcgccttgaggatgttcatggtggacttgttgatcaaactccggccgtggatgctggtgaccacgttgttttcgcggtacagccggccgatcaccggaatcatggcctcggcgagggcctcgcggcccatccacgtatcaagacaagaatctgacgtctggctcacagaaataccttcctcggttcagccgtgtacgtcctcgtacacggttgtcggccaccacatgtcgtgcaggggcccctgcgcccgcgggggtctgcccccgggcgcctggatcacacgcaaagaaaaaccgccggctgcgaacgcaactccggcggaagaactcctgcgtccgcatccattctaatttggctggcgtcagtaattcggcccggatcgagtgaaatcactcacagggaagtccgccgcagcggacctgtcagttgtggatggccgaatagagattgaggctggatgaaaaaaccacccaggacagatacggaagcatcaacaggcctgcggccgggctgaccggaccgaaccgcaggatgaggaaggcaaccgaggccccaagggccgcgatcaccaggaaagccgcccagagcgacgcaccgccaaacacgggaaagagtccgaaaaaggccagcggccatgcggcgttgagtaccaactggctgaggtagcccgccagggtgcctcctgtgagggcgcctttgcgccataccagccaggcggccacggcaaccgcggcgtacagcagcatccacatgctcctgaacatccacccgggcggcatccagggggccttggcggactcggcgaaccagccgccggaatgcaggatgatggggaccgacgccgcggcccatgcggccagcgagagcgaaaagaaaccggccagggcaacagcctgttggctgcgtccggggactggctgcggagcgggagcgccggagttgtctaccgggtcttgatttgcgggcacggttcaggatccccaacacatcgtccaaggtcaaaccggtgtggatggatgggttgaccgatacgccgggttctgtgctcccgttccgttaccggaacgggagtagcggccatccatctacgaacgccgttgccggcgccctccagcggcctacccggacactcgggcgggcagccctcaaacgtgccctgtctggccttgctccgggtggggtttacctagccttcccggtcacccgggaagctggtggtctcttacaccaccgtttcacccttacctggttcgtgccgctttcaaaccggcgcgatccaggcggtctgttctctgtggcactggcctgcgggttaccccgagtgggcgttacccaccaccctgccctgcggagcccggacgttcctcgagccacttgcgtgacgcgcggccgcctggtcaacccatccaacccccagtctaccggcgggctgaccctttcccgccgccggtaggatcggacggtgctgattctgcttcccccttctgaaggcaagacacccgccgcccgcggatccgccgtcgactggccttccctgagcttcccggagttgaactcctgccgtgccaaggtgctggacgcgctgggaacggtgagcgcacacgaggacgcgctcgcgttgctgggtgtgggggcgtcactgaaggatgacgtcgatcgcaacacgcggcttcatgacgagccggcggcgcccgcccaccaaatctattcaggggtgctttatgacgccctgggctacaaaaccctctcggctgtgcagcgccgcaaggcggtcgagtccgtgctggtggtttccgcgctctggggtgcgatccgttttggtgacagcgtgcccgcctaccggctgtccatggggacagcactgcccgacgtcggccgcctcgcctcgttctggaagcctcagctcaccgatgcccttgccggagcggtggaggggcaattgctggtggactgccgctcaagcacctatgcagcggcgtgggcgccgcccgctgcccagaccgtgtccgtcaacgttttcaccgaggtgaacggggtccgcaaggtggtgagccacttcgccaagcacacccggggcgaactggcccggcacctgctggtgcggcgcggtaaggccccggcaacgccgtcggaactcctgaaggccacgcgggaactgtgggccgcggaactggttgaaggttcagcccggaaaccgcacgccctgaacatcatcctgccgggctgattcccccgccccttcccaagtaagtagcgctaagtgtcgttatgagccgccaaaacgacacttagcgctacttacttagtcaggcccactcttcggagcggaccaggatggcgccggagtccgggcagaagacgatgtcgtcggctgctgcggctttgatctcggcaaggtcgccggggctcagcttcatgccggacgcctcggacgtgccatggaacagccgggctgcgcccactccgcgcctggccagagtcttttcgtagacggccagcaggccggcatcgaggccggcggcgaattcggtgcgctgtgcgcggaggccgcccgcttccgcctccacgacggccagttccgcgtccagctcggcgcgaatggtgccgaacgatccctggatgtcgtccacaatcccctgctgccgggcctgggtggcccgcagggaatcaaggcgctccatcacctcgagttcaatgtcctccaggtcggagcgccgcttgttgagcgaggcgatgtccttctggagggccaccaggtccttggacagtccggtgccgctgttcagccgtgcctcatcccgctggatgcgcgaggcaacctgttccacgtccgcctcggcgcgcttgagttcggcttcggcgtcgtggacggccactttcgcggctcccagctcaccgttggcgacggaaagggcggcttcgaggtccttgatgcgcggatcggtttccagcgagcggcggcggtttgcaagcgacttcaacttggcatccagcccctgcagtccaagcaacttcaactgttccgccggtgctgccttcgccactgttacctccgcttggtcccttccggccggagccgggcgcctggacggcgcttcctagactctagcgcctgccctgctcccctgcctcgccgtggccccaacggctccgggctcaacccggagtcaggatgaagtcccagggatcgctgttggtggtgctgacctggatttcgacgtcatggccctggtcggcgaggacattgcccagcgcggctgccgcagccggcagccacagccactcgctggcgaagtgcgaaacgtcaatcaggtagggcctgccgttcagggcggcctcccttgcttccgacgccggatggtggcggaggtccgcggtgacgtagacgtcggcgttgctggcccggacctcgttgaagagcgagtcacccgcgccgccgcagacggcaatgcgccgcaccaggccgtccttgtcgccggatacccgcactccccctgccacggaaggcagaatgccaaacacccgggcagcgaagtcccccaggctcatggcttccggcaggtcccctacccgcccgataccctcctcgggcagtccgtttgccgccaccgtgagcggggccgcgtcctgcaggcccagggcgtcggccaggacatcggaaacgcccccgacggcggaatcaccgttggtgtggacggtcagcaaggctgtgccggactcgatcaaccggtggacggcccggcctttgggggtggtggcagcgactgaggtgacacccttcaacagcagcggatggtgggtgatcaggagttcggcaccccactccacggcttcttcgatgacttccagggtggggtccacggcaaacatgaccctcgtgacaggagccgacgggtgtcccgccaccagccccacctcgtcccagttctccgccagggactcgggccacagttcatccacggccaggagcatctcgcccaaagtggggccctggggctgcccggccgccgcatccttgccggccgcctctttgccggaaggggcctcgccgccgcgaggcccgccgtcgtgattctcagggccggtaacgtcggtgtccacaggttccatactcttagttttaccccatcgcgtcctccgcgccgcacgttgacaggcggcgcccggggcgcccggggaatcatccggcgcccccaaccattgaagaggtcatgaaaacttttgttttaggcggaggctgcttctggtgcctcgacgctgtctaccagaagaccaagggtgtcagcgctgtggtgtccggctacacgggcggccacgatcccaaccccgactattactccgtgtgcaacggcaccaccgggcacgccgaggtggtggctgtgaccttcgacgaggagatcatcccggaagaggtggtccttgacatgttctttgccctgcacgatcccacgacgctgaaccgccagggctacgacgtgggcacccaataccgttcctcgatgttctacgagaccaccgaggagaagatccttttcgaggaagcgattgaccgcaaccagtcgctgtgggcccatccgatcgtcacagaggtcagccggctgccccgcttccacgtggcggaggacttccaccagaactactacgccaagcatcccgagcaggggtactgccaggtgatcatcaaccccaagctcgccaaggccaggaaatattactctgcatggcttaacgcttagcccccgttacgcggcctcgttaggctgacctcagtattcacccctcagagataggcgtatgtacatggcacggatctatgacgatgtgacccagctggtcggcggcaccccgctggtcaagctcaaccggctcagcgaggggctggatgccaccgtcgccgtcaagcttgagttctacaacccggccaacagcgtcaaggaccgtatcggtgtggcaatcgtcgacgccgcggagaagtcgggtgcattgaagcccggcgggaccattgttgaagggacctccggtaacaccggcatcgccctggccatggtgggtgcggcccgcggctacaaggtcatcctgaccatgccggagaccatgtccaccgagcgccgcgtcatgctgcgcgcctttggtgcggagatcgtcctgacccccggctcagagggtatgcgcggcgccgtggaaaaggcccaggaaatcgtggccaacacggaaaactccatctgggcccagcagttcgccaacgaggccaaccctgagatccaccgcaccaccacggcggaggaaatctgggccgacaccgacggcgccgtggacatcttcgttgcgggcgtcggcactggcggaaccgtcaccggcgtcggccaggtcctgaaggagcgcaagcccggcgtccggatcgtggcgatcgaacccaaggactccgcaatcctcaacggcggcgcacccggccctcacaagatccagggcatcggggccaacttcgtgcccgaaatcctggacacgaacgtgtacgacgaggtcctggacgcaactctcgaggactccgtccgcgtggcgcgcgatctcggcgtcaaggaaggcatcctcggcggcatctcctccggcgccatcgtctggggcgcactggagctggcgaagcgccccgaaaacgcgggcaagctgattgtcgccatcgtctgcgacttcggtgagcgttacatctccaccgtgctctatgacgacatccgcggctgatcaggccgctcttcgcccgtttcctgtagaaagaactctgtgggctttttcgcaagactaaaggaagacctcgacgccgcccggtcccacgacccggcggctcgaggttctttcgagaaccttttcgcatactccgggctgcatgccatctggatccaccggctgacgcaccgcctgtggcaaaacccgggcctgcgtttcccggcgcggctgctctcgcagctgggccgtttcctgaccgggatcgagatccatccgggcgccaccatcggccgccgcttcttcatagatcacggaatgggcgtggtcatcggggagaccgcggaaatcggtgaagatgtgatgatctaccacggggtcaccctcggcggccggtcactcgcacggatcaagcgccaccccaccatcggcgaccgcgtgaccattggcgccggtgcaaagatcctggggccgatcaccatcggcagggacagtgccgtcggcgccaacgccgtggtggtcaaggacgccccgccggaatcgatcgtcaccggcgttccggcgaagtggcgccaccgtgacgcccagcgcgaaaccaagcctgcggtagacccggcggaatacgacatcgaataccgcatttgacggttagggccggtctctgggccgtccagtaaaagcagcgcaagcagaaaaggcgggcagttcccggatcaccggaaaccgcccgccttttctgctttgtggtggaactagtgggtgtctaccgcttcgatttcggacttgtcctcgccccacagcgtgtggaacgtgccttcggcatcgacgcggccgtaggtgtgggcaccgaacaggtcgcgctggccctggatgagggctgcggcgacgcgcttgcggcgcaggccgtcgtagtaggccagtgaggaggagaagaccggaaccgggattcccagctggacagccgtggccaccacgcggcgccaggcgggaagggcgccggcgatggcttccgtgaacgccggagcgaacagcaggttggccggcttctcctcagcggcgtaggccttggtgatgtccttgagcagttcggcgcggatgatgcagccggcccgccacagcgaggcgatctcgtccagcttcaggtcccagttgtattccttggctgccgaggtgagcatgtccaggccctgggcgtaggaaaccagcttggaggcgtagagcgcctggcggacgtcctcaacgaacgtttcagggatttcgacgtcggcctcgtggcctgccagcagttcctggcccagcttgcgctggccggcctgggaggagagcgcacgggcgaacacggattcggcgatgccggagaccggggaacccagttccagggcggagatgacggtccagcggccggtgcccttctggcctgcggcgtccactaagacgtccacgaacggcttgccggtcttggcatccacgtggcccaggacctcggcggagatctcgatcaggaaggaggacagctcgcccttgttccagtcggtgaagatcttggcctgctcggcgggttcgatgccggcaccggaacggagcaggtcgaaggcttcgccgatgacctgcatgtcggcgtattcgatgccgttgtggaccatcttgacgaagtggccggcgccgtcggtgcccacccaggcgcagcagggctcgccgtcgacctttgcggagatcttctcgagcagcgggcccagcgccttgtaggactccttggaaccgccgggcatgatggagggtccgttgagggcaccttcctcaccaccggaaacgccgacgcccacgaagtgcaggtccttcttggcgagggcggcctcacggcggcgggtgtcctcgtagtgggagtttccggcgtcgatgatgatgtcgccgggttccaggaggggttccagctgctcgatcacggagtcaaccggcttgccggccttcaccatgatgagcacccggcgcggtttctcgagggagtccaccagctcctgcaggctttcggtgcggatgaagtcgccatccgttccgtgcttggccagcagggcgtccgtcttttcgactgagcggttgtgcagggcgaccgtgaagccgttccgggcgaggttgcgggccaggttggcgcccatcactgcgaggccggtgacaccgatgtgtgcagacatcaaaactccaattcatactgtgcgatggatatgcagtggctcccggtgcgcggaagtccgttgcagaccaagggtctgaataaagcatatatattcatgaagtcacaggaaagtaacgcccacgtaatggaacagtttgtgtcgctgccagtcaaggacggctgcttccaggcgcacctgttcccactaggcttagctgcatgaccagcagcctgcaccaccgtgccattgagaacctgggcacgcgcatcatctcgggcgaccttcctgcaggccacatcatgcttgccgaaaaacttgaggatgaactcaaggtttcgcgttcggtcatccgcgaggccgtccgggtgctgcaatcccttgggctggtggaaaccaccaagcgggtgggaatccgggtcctgccgccaaaccgctggaaccccttcgacccgcaggtcatccgctggcggctcgccagcaaggcacgcggtgcgcagctgcggtccctggcagagctgaggtcggccgtggaaccggccgctgccgaacttgccgcgcagaacgcccccgcgccgctgcggctggagcttgtggatgttgcccatgcaatgcgcgacgccggccacaggggggaagtgccacgcttccttgagctggatatccagttccattcattgctgctctccggatccggcaacgagatgtttgcgaacctctcggggcaggtagccgagaccctgaccggccggaccgtgcatggactgatgcccgaccatccgcacgaggcagcactgcagtggcacgtagacgtggcagaggcaattgcccggggcgacgccagtgctgcccgcgaggcctccgacaaaatcatgcggcggaccatgtcccagatgtcagacacctggacggaacagccccgggtttttatccctgtgcaccgctgaccccggtccacggcgggagtattgaaccgctgtggcattccaaactcacggcggttggtgcgtgacacagcaggaaacgactttttgtttccgtaagttcacggtatattcaactcaggccctccaccgcggcatcccccaatagtcgcggtggagggttttccattgccctgacaggcctgttccggcgggcgggcctcccctaggcagcatctgcaactgactcccgcagccgccagcttccgcccagcccgtccctttccaggagcatggtggtgagcgccgaccccgcgttcctccccagccggacctggagctggaggacctcgacgtccacccggctaagccccctgggcatccggcggcgcgtctcccaccagttgacccgttcgaaccacctcaccggttcggcacccacggcccattccctgccattgctgagcaccgccgtcggcctgccatcggtgcctgtcctcacaatcacgtgttccatgcctgcaagctatggcagggggccgacattcaagcccggccgggaaacaggcggtaaatccgggcagcaggaccttgggcagcaaaaaaccccacagcttccgcctgaaggcgcaaactgcggggtttcactgtgggtcctaccgggatcgaaccgatgacatccacggtgtaaacgtggcgctctaccagctgagctaaagacccattattgccggatcaggagctgctgcgccctgaccaacgaacatagactctacccgacgccggacataaattgcgaatcgacgcgcccgctctgcccgtgccgctgcccggttatatcggcggcagctccgcggcgagccaggtcaacgattcgctgacgccagcttcaagcttgacggtggccttgtcgtccccccgcgtggccccccggttgataatgaccaccggtttgccgtccttcgccgcgtgcctgacaaaccggagaccgctcattaccgtgagggacgatcccgcgaccaccagtgccgcggcctcgtcaaccatccggtacgacgtctcaaccctgtccttgggcacgttctccccgaagtacacgaagtccggtttcagtgttcctccgcaggcggggcaaacagcaacaacgaagctgccgatcagggcctggtcctcaacggttgagtcggcatccggcgccatttccaccaggcctgattgtttcgcccgatcaaggaatccggggttcaactcctccagcattcctgccagcaggcggcgggagtaggtccggccgcagtccaggcacactatctggtcgtatcggccatggaggtccacaacattgacgctgccggcgtcctggtggagccggtcaacgttctgcgtgatgaggcccgtcaggtgtccacggcgttccagttcggcagcggcacggtggccctgattgggatcagcatggcggaggtgtgaccatccgatgtggtttctcgcccagtaacgctggcggttcgcggccgccttgacgaactcctgataggtcatgggcgtccgcggcggcgaccctggcccccggtagtcgggaatgcccgagtccgtgctgaggccggcaccggtgagaagcgcgaaccggccccctgccagcaggtccctgatgcggaccaggacctcgagctcatcggcggaaggcagggcgggaggaaccggcggcatgctggcaaatcccgtgaggcccacaccatgccgctgttcagccataatccgtcaggccttgtccagcccggccaatgccttgcggtattcgccaaagtcccgggcctgtccgcgcgcgttcaccacggtgtagcggatggtgccaccggcatcgatgatgaacgtgccccgtagcgccattccactctcggggtcgaacacaccgtagaggcttgctgcagcaccgtggggccagaagtccgccagcaactcgaaggtatacccctcctgctgggcgtaggcccgcagggtgaacttgctgtcaactgagaccgccaggacaactgcgttctcgtcttcgaacagggccaggttgtccctgatttcgcagagctcgcccgtgcaaatgccggagaaggcaaaggggtagaacaccaacaccacgttctggccgcggaatgcggacaacctgaccggctcgccgtactggttgaccagttcaaagtcgggtgccgcagcgccaacggcggggacggcaacggaggcagcggcaagcgctgccgtcacttgttcttcctgctcaccagccgcgttgcgctccagtccttggacacgcctgccgacgtcgtcacgtgcagtccggcggtcggcgccgcctcctggatatccgccggggagacgtatccagtccttccggacttgggtgtcaggacccaaacgacgccgttttcgctgagggtggtcagcgaatccatgaggctgtccaccaggtccccgtcgccgtcgcgccaccagaaaacgacggcgtccgccacttcatggtcgtcctcgtccagcagctcggaacccgtcaggtcctcaatatcgtcacgcaagtcgaaatcgacgtcgtcgtcgtaaccgaactcctgaatcagatccccattcttgaaacccaatttttccgccacatttaccgaagtggcggcgtcggcctcgctcacgtgtacctccaatgccttttatgcgcggtgcgcatagtgatttccattactcccagccaacaccctttgtgcctgagcttcaagctgccgcccccgtgatgcggcatattctgcgtcacatcaggttccgccaacccgcagcacagcggcttttcgtcacacaaccagtatgacggcgaaatacaacagggccgcccaagccgcggctacgcatcgcgttggggacagagttagagtggcaggtgacaactatgcctgcggggcaacaaccctgtaactccaatgcagacgtaggaatgctaggaccctgcccggcacacatgaccgggctgttgtaaccgatacgtcgcacacggcgtatgtacgccgggcggtcaccctgcccggcctgagtgcgccatcaatgcgcgcaaagagaggttggacgtggctgcaggagaagatacctcccatatcctcagcgggttgactaaccagctgcctgatcgtgatccggaagagactgccgagtgggttgagtccctggattcattgatcagggaacagggcactgagcgtgcccaattcatcatgcggagcctgctgcagcgcgcgggcgcgcagagcgtcggggtgccgatggtgaccaccaccgattacgtgaacacgatcccggtggaccaggaagccgaattccccgggaacgaggagtacgagcgccggtaccgggcgtatatgcggtggaacgccgcggtgatggtccaccgggcgcagcgggcgaacatcggcgtgggcgggcacatctccacctacgccggcgccgcgaccctgtacgaggtgggcttcaaccacttcttccgcggcaaggaccaccccggcggcggtgaccaggtcttcttccagggccacgcctcccccggcatgtacgcccgggccttcatggaaggccggctctcggaggaggacctggacgggttccggcaggaaaagtccaaggaaggccacgccctgtcctcctacccgcacccacggctgatgccgcacttctgggagttccccaccgtgtccatgggcatcgggccgatgaacgcgatctaccaggcccagtccaaccggtacctgcacaaccggggcctgaaagacacctccgaccagcaggtctgggcgttcctgggcgacggggaaatggacgagcccgaatcccgcggcctgctccagctcgccgcgaacgagaacctggacaacctgaacttcgtgatcaactgcaacctccagcgcctggacgggcccgtgcgcggcaacggcaagatcatgcaggaactcgaagcgttcttccgcggcgcgggctggaacgtcatcaaggtcgtctggggccgggaatgggatgacctgctcaccaaagacaccgacgggtcgctggtgaagatcatgaacgaaacccccgacggtgactaccagacctacaaggcagaatccggcgggttcgtccgcgaacacttcttcgggaaggacccggccaccaaggacctcgtcgcggacctcaccgatgaccagatctggaacctcaaacgcggcggccacgactaccgcaaggtctacgccgcgtacaaggcagccaccgaattcaagggcaaacccaccgtcatcctcgccaaaaccgtcaaaggctacggcctcggaccgcacttcgagggccgcaacgcgacccaccagatgaagaaactcaccctggatgacctgaagaagttccgcgaccacctgcggatccccgtcacggacgaacagctcgaaaaagacctgtaccagcccccgtactaccaccccggcacggacgccccggaaatcaagtacatgatggagcgccgcgcggccctgggcggttccgtcccggagcgccggtccaagcacgccgagatcaccctgcccgaggccaagtcctacgaggtcgccaaacgaggctcgggcaagcagcaggccgccaccaccatggccttcgtgcgcctgctcaaggacctcatgcgggacaagaacttcggcaagcacatcgccccgatcatcccggacgaggcacgcacgttcgggatggacgcgttcttccccactgcgaagatctacaaccccaagggccagaactacctctccgtggaccgcgacctcgtcctggcctacaaggaatccgcccagggccagctgatccaccccggcatcaacgaagccggcgccgtggcagcgttcaccgccgccggcaccgcctacgccacccacggcgttcccctggtcccggtctacgtgttctactccatgttcggcttccagcgcaccggcgacgcgttctgggccgccgcggaccagatgacccgcggcttcatcatcggcgccaccgcaggacggaccaccctcaccggcgaaggactccagcacgccgacggccactcccccctgctcgcctccaccaaccccgccgtcgtcacctacgaccccgcctacggctacgaaatgggccacatcatccgcgacggcctcgaacgcatgtacgggccggactcggaagaccggaacctcatgtactacctcacggtctacaacgagccgatcacccagcccgccgaacccgaggaactggacgtcgagggcgtcatcaagggcatctacctgctggctccggcgaagatcgatggtccgcggacccagatcctggcctccggcgtgtccgtcccctgggccctcgaagcccagcggatcctcgccgaagactggtcagtctccgccgacgtctggtccgtgacctcctggaacgaactgcgccgcgacggactcgccgccgaagaggaagccttcctcaaccccggcgaacccgcccgcgtccccttcatcacccagcaactcgaaggagccaccggccccgtcgtcgccgtgtccgactacatgaaagccgtccccgaccagatccgccaattcgtccccaacgaattcgccaccctcggcgccgacggcttcggcttctccgacacccgcgcagcagcccgccgcttcttcaaaaacgacacccactccatcgtggtgcgttcactggagatgctcgcccgccgcggcgaggtggatgcgcaggccccgatcaaggcgattgagaagtacaggcttcacaacgtcaatgcgggcaccacgggcaacgccggtggcgaagcctagcttggtccctcagtaaagacgcgacggcggctccctccgaaaggcgggggccgccgtcgtccgttaaggccttggtgtcatgtgacgcagggcaaagcggattgtagcctttgcacaaatggaggttgcgggacgctgcccgtatgctcaaagaatgccagcacctgccaccccgtccgccaagcgcaaaccgtccactccgcgggtgactccggagaagtcggagaccctcaagaaactgcgggcacacgtgggccagctttccaccaccaccatgcgcgagctggaaaagtccctgccctggtacagccggctcagctcggacgagcgctcggcgctgggcatggtggcacagaacggcattgcggctttcgtcacgtggtacgagaggcccagctctccgtcatggatcctaacggacgtctttggaacggcacccaccgagctgacccgctccataagcctgcagaaagcgctgcaattgatccggattgtggtggaggtggtggaggaccaggtaccggtcattgcaccggaggccgaccagccgtccctccgtgaagccgtgttgcgctactcgagggaggttgccttcgctgccgccgacgtctacgcgcgcgccgccgaatcccgcgggtcctgggacacccgtctcgaggccctgattgtggacgccatcctccgcggcgagaacacggacgctttgcgctccaggatcgcggcgcttggctggaaagcccaggagcgcttcacggtcatggtgggcaactccccttcggagcccagtgccagctacgtcagtgaactgcgccggatggccggccggtacgcggaggacgcgctggtgggcatccagggcgaccggctcatcctcatcctgggcggagtgcaggacagggaaacagcgtatgtgaagctcagcgaaatgtttgctcccggccctgtggtgtacggccccgaggccggttcgctgctggaagccagcgggtctgcccagtcggcttttgcgggcctcaccgcggccagggcgtggccgtccgccccgcggcccgtggctgccgacgatctgctgccggaacgggtcatctccggggacgacgccgcccgccgttcccttgtcaagaacatctaccgccccctgctggccgcatccaatggcctggttgaaacccttggcacctacctggaactggggcattcacttgaggcaacagcgcgggaactcttcgttcacgcgaacactgtgcggtaccgtttgaagcgcgtctgcgacgtcacggggtgggacccgctcctgccgagggaggcttttgtcctgcaggccgcacttgttgtgggccgtctttcgacgccaccgaaagctgcggctgaacgccagccgtcccggaatcagccctgaggcgttgtagacttcctacaacctgaccccgtgagcttggtgcggacaaacaccgctggatcactcagtaatttggaaagctggatacgtgcttgcaatagtctgccctggacagggctcacagaccccgggttttctggtcccctggctggaactgcccccggtggcaggccagctggccgccctcagcgacatcgcaggcattgacctgatcgcccacgggaccacctcggacgaagaaaccatcaaggacactgccgtagcgcagcccctgatcgtcgccgccggccttgttgcggctgcttccctgttcgatgttgaactcagctcccttccggtcatcctggcaggccactccgttggtgaaatcaccgcctcagcgctttccggggtactcaccgagcaggaggccatgacgtttgtccgcgagcgtgccaacagcatggctgcagccgctgccgtcacccccaccggcatgagcgcagtggtgggcggcgaccccgccgacgtcctggcagccatcacggcagcgggggccaccccggccaacgtcaacggcgcgggccagaccgttgccgccggaacctttgagcagctgaaagccctggccgacaacccgccagccaaggcccgggtcattcccctgaaggtggccggcgccttccacaccagccacatggctcccgcagtcagcgccctgaaggcgctggaaccgcagcttaagccgcaggcaccgaaggtgccgctgctgtccaactacgacggcggggaagtcaccgacggccacgccgccgtcgagagcctcattgcccaggtgtcacgtcccgtccgctgggaccgttgcatggagacgatggtcgcaaggggcgtcaccggcgtaattgaacttgctcctgccggcacgcttgccggcctcgccaagcggggcatgcccggtgtcaaaaccgtggcggtcaaaacaccggacgacctttccgccgcactggcgcttttcgcagaactggagggcaacgcatgagcgttcccacgctgaaacaggccccgattcaggagcacacccggatcctcggcctgggtgcctaccggccggacgttatcgtcaccaacgaggacgtgtgccagtggatcgattcctccgacgaatggatccgccagcgcaccggcatcgtgacccggcaccgggccccggctgaggtcagcgtcattgacatggccgagggcgctgcccgcgaagccatggataaggctggaattcaggcctcggacctgggcgctgtcattgtctccaccgtgacgcatccctacgccacgccgtctgccgcggcggccctggcggaccgcctcggcgccaccccggcacctgcctttgacatctccgcggcctgcgccggctactgctacggcatcgcccagggtgacgccctggtccgctcaggcgccgcgaagtatgtcctggtggtgggcgcggagaagttgtcagacgtcatcgacaatcgtgaacgcaccatctccttcctgctcggggacggtgccggcgccgtcgtcatcgggccctccgaaactcccggaatcgcaccttcggtctgggggtcggacggcagcaagtgggacgccatcggaatgacccgttccatgctcgatgtccgggaccttggcctggctgcccgccagtcggattcgacaggggaccttgccctgctcgaggaagcccaggaactctaccccaccctccgccaggacggccagaccgtcttccgctgggccgtgtgggagatggccaaggttgcccagcaggccatggacgcagccggagtacaggccgaggacctggtggccttcatcccccaccaggccaacatgcgcatcatcgacgagatggtgaagaagctgaagctgcccgagacggttacagtggcacgggacatcgccgatgcaggaaacacctctgcagcgtccatcccgctggccacccaccgcctgctggccgaaaagccggaactgagcggaggactggcgctccagatcggcttcggggccgggctcgtcttcggcgcacaggtagttgtccttccttaggaacgccccaacaggccgcaaccgcgtcctgaaccatttccggcagaccctgccggcaatacaagaaaaggagccatcaatggctagcaacgaagagatcctggccggcttggctgaaatcgtcaacgaagaaaccggcctggcccccgaggccgtggagctggacaagtccttcaccgaggacctggacatcgactccatctccatgatgaccatcgtggtcaacgccgaagagaagttcggcgtgcgcatcccggacgaagaggtcaagaacctcaagaccgtcggcgacgccgtcagcttcatcgccggagcacaggcctagccaaggcttccgccgttcatcggcatggcagggctgccggtccggaagaccgggccggcagcccgccgcatttttccggcacttgccccacgcgcagtgctcctacgggcactgttcccggcagtgttgttgcttgaagcagtgtgccgatcattaatacgcgggacctccggtaatcggattccccaccgacagagagtgatcccatgacacgcaaagtagtcattaccggtctgggtgccaccacgcccatcggcggcgatgtacccacgatgtggaacaacgcgctcaagggggtctccggtgcccgcaccctggaggacgactgggtagccaagtacgagctgcccgtccacttcgccgcgcgttgcagcaccccggccctggacgtgctcagtcgcgtcgaggccaagcgcatggacccgtccacccagttcggcgtcatcgcagcccgtgaagcctgggctgactccggcatcactgagttcgacaaggacaggctggccgtcgccttcgccacgggtattggcggtgtctggacactccttgatgcctgggacaccctgaaggaaaaaggcccccgccgggtcctccccatgaccgttcccatgctgatgcccaacggtgttgccgcagccgtcagcttggacctcggtgcccgcgccggcgcccacacccccgtttccgcctgcgcgtccggcaccgaagccctccaccttgggctcgacctgatccgctcaggcaaggccgacgtggtcatgtgcggcggcgccgaagcggccatccacccgatgcccctcgcagccttcgcctccatgcaggcactctcccgccggaatgacgacccgcagggcgcctcccgtccctacgacacgggccgcgacggctttgtgatgggcgaaggcgccggcgccctggtccttgaggctgaggagcacgccctggctcgcggtgcgcgcatctacggtgaactggcgggcacttccgtcaccgctgacgcataccacatcaccgctcccgaccccgcaggcctgggtgccacccgtgcactcaaagctgccatgttcgatggccgcatccagcctgaggatgtggtccacgtgaacgcgcacgccacgtccacccccgtgggtgacaagccggaatacaccgccctccgggctgcactggggaaccatgtggacaacgtcgcagtctccgcaacgaagtcccaaatgggccacctcctgggcgcatccggtgctgtcgaggccgtactgacagtgctcgctgtttacgaccggaaggcaccggtcaccatcaacctggagaaccaggacccggagatcccgctcgacgtcgtcacctcggcccgcgacctgcccgccggcaacatcgtggcactgagcaactcgttcggcttcggtggccacaacgccgtgattgcggtccgcagcgtctgatcttcagaacgttgtaccgcctacaaaaggaggccccgccgtgtggcggggcctcctctttgctatggaagattcaggtcgacggcggtcagcccacctggtggagccaacgaacgggtgcgccttcggcggcgtgccggaacggctcgagctcctcgtcccaggcttcgccgagggcgagggagagctcgtggtagacagctgcggggtcgccggcgcctgactcgtaggcataccggatcctgtcctcggacaccatgatgttcccgtgcacatcggtgacagcgtggaagatgcccagctcaggggtgtgggaccagcggccgccgtcgacaccctggctcggctcctcggtgacctcatagcgcagatgcgcccacccccgcagggacgacgcaagctgtgatcctgtaccgggggcaccggtccaggacagctctgcccggaacattccgggcgcggcaggctgcggggtccactcaaggtccgttcgcttgtccacgacggatccgatggcccactcaacgtgggggcacagagccgtaggggccgagtgaacgaacagcacaccgcgggtcattgcaacagacattccatcctccatagctctaggtacgtcttccccaacgacctctgcctgaatggaactgccgtgccgtgcactgcggttgtggttcctgcctgcgtattcagatgtatcagataaagctgtgtccgggcttaccgtgacgcaaaaagctgctagcttcaagcgggacttgaaagttgccggacgtgactcttattgtgccgtaccgcaccaaattacgccagtgcgattccgggcctcggacttacgccctcgggtgggcctgctggtagctcttccgcagccggtcaaccgagacgtgggtatagatctgggtggtggccaggctgctgtgcccgaggatttcctgcactgcgcgcagatcggctccgccgtccagcagatgcgtggccgccgagtgccggagcgcgtgcgggcctgacgcggaggtgtcaccgagcccggcaaaaaggtcgttgaccatggagcggacctgccgctggtccacccttccgccccgggcgcccaggaagagcgccggcccgctgttgtccctgaaaagcaaaggcctgccgcgccgcagccagtcatccaccgcgagggctgccggaacaccgtacggaacagtgcgctctttgttgcccttaccgatcacacgcaaagtccgccggtccgggtccaggtcatcaacgtccagccccgccagttcgcccacccggactcccgtggcgtagagcagttccacgagggcacggttccgcagggcgagcggcgcaccctcggccgccgcttcttcgagggttgccagaagccgggtcaactgcccggcctgcaataccccgggcaaggactgttcacgtttcggggccttgagccggagggcgggatcagtggtgagacgttcctccgccatggcccaggccgtgaaaaccctgacagaggcggaccggcgggccaaggtgctgcgcgccgcgccctcctggctctgggccccgagccagcgccggagggttccgagttccaggtcctggagccgggcggcgccttcggacgcagcgtgggacaggaggctgcggacgtcgcccaggtatccgcggagagtatggggtgagaccgcacgctcggcggagaggtactgcgtgaaggcgtccagcgccccgccgagctccgcaggcaatccctcataatccacccacttactctctcagcaacggcggggaaatcagtagctgacacgctccactcctgccggtgcctgtgcttcccgtcccgggcggaccgggcctgccaggcagtgcgcgtcagccggttgccttgccgcgtttccagcctccccgctctgagacggcaaggcccagcaggcccagccggcccagcccggcccgcaccgactcctgggcaaggcccgcgaccactgaaagtttttcgacggacgtcacggagcgcagcggcagcgcgtccaggaggataaggtcctccagcgtcagcccgtcctgcaccgcagcctgcccgtggcggggatcaggaagggcagagccactggggctggccagctcggcaacctcggcagcatccgtcacgcagacggcacctccgtcccgcagaagccggtggcatcctgccgagttggcgctgtgcacggagcccggaacagccccgacggcacggccgagggtctccgcgtggtgggccgtgttcaacgccccagaccgccacctggcctcgaccaccacggtcacagcggacagggctgcaatgatgcggttacgttggaggaaccggtaacgggtaggcgcggaccctggcggaacctcggccaggacagcgccctggttgcacacggcccgcaggaggtcctcgttgcctgagggatagaaccggtccactcccccagccatcacagcaatggtggggaccgcgccggttgcccccgcaagggccgcgcggtgggcatgcgcatcgatcccgtacgcaccacccgagactacggtgaagccgcgctgggccagcgagtacgcaagatcgccggtgacggcggcgccgtagctggtgctgtcccgtgagccaacaagggctatggatgttgccgctccgggcagctgctgttcctgtcccctccaccagaggcagatcggctcctggattccgaggtcagccagctggcttggccacaactcgtctgacggtatgatcagccgcccgccgaggcgcgccatggtggcaagatcccgctcgggagccaggtcgggtatgcgtggctgccaacgcttcagggaggtggccatcccggcccagctcgtggtggaaccatcaccggaaagcagagcagtgatctcctgctccagctccggaccggccgggagttggcccgtggcgatccgcagggcgtccacggccccggccacctggaccagggcaaggccggcagcgtcctgcggttccataaggcgtgagagggcagcgcgtgaacgccgctcgatgtccagatgcatgcctgtctccttcatgctgcagccgccgctgcctgccgaagccccagcgcctgcccgatgtcgttcgtgtccggctgctcccggtaccccaagtcggcgagggtccacgcaagccggagtacgcggtcatagccgcgcgcggtcaggacgccccgttccagggaatggtccaggatgcgggtgactgccggtgggagccgaagttcgccccggaggatgcggccggggatctgcgcattggtttccagcccgtagggcgccaaccgctccagctggcgggcccgtgcgcccagcacccgccgtgcgacggttgcagtgtcttcctcggcccccgcctgcccgaagtcggccagggagaccctttccacctgcagctgtatatccaccctgtcgaggagcggaccggacatcctggccagataccggcgccgcatcacgggtgtgcacgtgcagtcgagtccttttccggaggccttgccgcagggacagggattggcggcgaggaccaactggaaccgggctggataagcagcagtcccggctgaccggtggatcaccagttcaccgctctccaggggctggcggagggcatccagcacccggcgctcgtactcgggtgcttcgtcaaggaacaggaccccgcggtgggcgcgggaagcggctccgggccggggaagtcccgagcctcccccaatgattgcggcggcggttgcggaatggtgcggactttcgaacggtggccttcggagcaactgcaccgaagatgaaggcaggccgcacagcgaatggatagccgtgacctccatggactcatggtccccgagatccggaaggagcccgggcaggcgttccgccagcatggtcttgcccgcgcccggagggcccgtcaggaggagatggtgcgccccggcagctgcgacttccagtgcgcgccgggcatccccctgacccgagacgtccgccatatcagggtacgtgccggtctccactcctgcctccccggcgctgtccgtgtcctcgggctcgaaatccagcgcaagctcctggggatctgcgccgaattccagcgccagccgggccagtgtgctgtacccccgaacgttggcatcaggcaccaacgatgcctccgccaggttggcctgcgccacaacgacgtccggatatccggcctgcaccgaggccatcaccgccggaaggatgccgcgtaccgggcgcagccggccatcaagtcccagctcggcgataaacaccgtccgcccggtgggtttgatgtcattggcggcacggagtacggccatggtgaccgccaggtcgaatccggatccccgcttcggcagggaggcagggatgaggttggcggtgatcttgcggcggctcagcggaattccggaatttttcgcagctgagcggatccgctccttggcctcgttaagggaggcgtccggcagtcccagcagtacgaatgcagggagggtctggcctatgtcggcctcgacctccacgatgtacccgttaagccccaccagggcgatggagtaggtgcgtcccaggggcattcagcccacccccctgaggtgctctaccaggggcgacccgccgccgtcgtcaatcaccgcgatgacgtcaacgcgccgcagcggcatccgaagctcacggtcccggcaccacgcggccccaagccggtgcagccgcgccagcttatccggacccacagcctcaaagggatggccgtaatcgagggtacggcgggttttgacctcggcgatcaccagggcatcgccgtcgagcgcgacgatgtctatttcgccctcggtgcagcgccagttgcgctccaccacgagcatgccgagggtttccaggtaaccggcggcaaggtcctcgccgtgccggcccaacaggtctttcgatttcatgtctacctccgcaaccagcctgaaggggctggatcacgaaggacaggacgacggtcccctatgtggatgaacctgggccgacgggccctgtgaaggaaaagtcagctgtgcaggaaaagtccgggcccgggcagaatgctagttgcccaggtcgacgtccttgggcagggccagttcctcgttgcgcggaagctcttcgacgttgacgtccttgaaggtcaggacgcggacactcttgacgaaccgtgcggaacggtagacgtcccagacccaggcatcctgcagggtcaggtcaaagtagacctcgccgtctgcgctgcgggcctgcaggtccacgtggttggccaggtagaagcggcgttcggtctcgacaacgtagctgaacagcccgacgacatcgcggtattcacggtagagctgaagctccatgtcggtttcgtagttttcaagatcctcggcactcatgcatccatcttgcaccatcggcagggcggctggtgtccggcgcggggctcagtcccccgcggcagcttctcccccgcctggccctgaaccgtccggcaggccggcgtcagccagttccccaccaaggagccgccagctgacccggtggtacggcgtgggcccggccgcacggaggacatcccggtgcagtgcggtggcgtagcccttgttgatgtcccagccgaagtccgggaactcaccatggagctcccgcatcaaccggtcccgctcaacctttgcgatgacgctggcagccgccacgctcaggcactgcatatccgccttgaccttggtgtgaaccggagcgtcgcagctggcctccacttccggctcgtcgaacaaggacagctgcccggcaggtgaaagccagttgtggcttccgtccaggagcaccgcctcggggcggacacccgcagaaaggacttcctgccaggccctggttcctgcaaggcgcaacgcggcgatgatgccgatggagtcgatttcctgcgctgaggcgtggcccactgccgaggccacgctccaccggcggaccagcgggtcaaggcgttcccgctccgccggggccaggagtttgctgtcccggaccccggccaggggcttctgccgttgcaggtcgaccacggcgatgcccacgctgacgggcccggcaagcgcgccgcgccccacctcgtccacgcctgcaaggtagcggatcccctgggccttgaaggtccgctcgtgcctgagggtgggtgccttgcccggtgagggaatcttggcgcccggtgagggaatcttggcgcccggtgagggaaccttggtgcccggtgagggaatcttggtgcccggtgagggaaccttggtggaaccggacctgggcttgagtgcggcgggcatggtcagggcgccgccggtacgttgcggaacacgtccggatagttgcctaaggtggtgaaccggctcagcggccaggcaatgacggcggccttgccttcgaggtccgcaatgtcgatgaatccgccgtcggagtccatgtgggcgcgggagtcggcggaatggttgcggttgtctcccatcacccacaccttgccctcggggacagtcacgtcgaagttgcggatctgcgggatttcagccggattgatatagctctcgttgacggcggtcccgttaatggtcagtctaccgccggcatcgcagcagaccacgtggtcccccgggagtccgatgacccttttgaccaggtgctgttccgagttgtccggcagcaggccaacgaacgtcagcccgtcctggacccacgtgaaagggccctgcggttgttccggcgctgcctggagccagcccttggtatcccggaaaaccacgacgtcgccgcggttcagtgcgaacggctcggggaccaggaggttgacgaagatcctgtcatccacttccagggtgttgaccatggattcggacgggatgaagaacgcgcggaacaggaaggtcttgatcaggaaggaaaggacgacggcgatcaccaccaccgtggctacttccttcagccatgcgaagacggggctgccggcgggcttcgctgctgacttggcggcggcgcggctgcccgcggcgccgggcgcaggtgcgccaggaccttggccggaagtcccgggaacagcatcggccggaacgtccgaagcgccttcgtggcgtggttcgggtgtccgcgcgtggttctcgggcatttactgtccgttctctgttgtgggtcctgcaggcggacggggtattgaagcaaatctatcaagcggccagatgatctggaccggcctgccgatcaccctctccagcgggaccatgccgccgccgggggctccgagcaggcttcgtgagtcggccgacagggagcggtggtcccccatcagccacagccggtcgtccgggaccacggcactgaacttttgcgtactgggggcatctccgctgaagatgtagggctccgccaggggttcgccgttcaccgtcacgttgccgccggcgtcgcagcaggccaccgagtcgccggggagcccgatgaccctcttgacgtaggtggtgtcactgccagtgaggccgagccagtgtgtgacggcggccgcggtgtccaccagggcgccgttgccgctgttaagcggggcgaaactgcccctgccgtcaaagacgacaatgtccccgcgccggatgggctcggcgcggaagtcggtccgggacaccaggatgcggtccccgccttccagcacgggttccatggacgcggacgggatgaagtacacatcgagccagagagatcggaccaatccgctgaccgcaacggccaggatgacggccaggaacgcaaaacgccagcccattttgcggggctggcgttttgtgtggtccattgtccgtatcctgggcgctggtgctgaatggctccggcgctggccggatacggctgcggcccggcctctgcaggtccgaaaggacttacttggcggtgctgaagtcgcgcttttccttgatcttcgcagccttaccgcgcagtgcgcgcatgtagtaaagcttcgcgcggcggacgtcacccttggtaacgacctcgatcttgtcgatgatcggggagtgaaccgggaaggtacgctccacaccgacgccgaaggaaaccttgcggaccgtgaaggtctcacggacgccgtcgccctggcggcccaggacgaagccctggaaaacctggacacgggagttcttgccttcgatgatgttcacgtgcaccttgagggtgtcacccgcgcggaactcgggaacatcggtacgcagcgaggctgcatcgagggaatcgagaatatgcataattgcactcctggtgaacgccacaggtcattcactttgggtcacggcagcaaaacctggaacgctcgtggcgcaccggggatttccgccgaaaggtaagtggtccggccacttcactgattgatgaggccggttgccttagctgttggttgcgctccccctgtggcaggtgcggacccagcagacacaaggactaattttgccacactgcggaggctacagccaatcccgcagctcccgcagcccagggagctggccgcggcagcatgacgcccttagccctgcgtggcgccttcagtgccggggcggcggcgcaggcggccgtcgacgacgtcgtatcccaggtcctgcagttcggtgcggtcggcacgcggcagctttccggcgtcgaacgcttcgaggaggtcggggcggcgctccgccgtccgccggaactgctcgtggcggcgccactgcgcgatcttgccgtggttcccgctgagcagcacggccggcacttcccgctcgcgccacacagagggtttggtgtagacggggtactccaggagcccgtcggaatgggattcctccaccagggactcgggattgcccaccacgcccggcagcaggcgtccgacggcttccaccatggcgaggaccgcgacttccccgccattgaggacgtagtcccccagactgacggggcggacgtcaaaatgctcccgggaccactcaatgacgcgctcgtcgatgccctcgtagcgtccgcaggcgaacgcaaggtgctcctgctcggccagctcgtacgccagcgactgggtgaacctctcccccgccggcgacggcacgatcaggaccggcctgcccgatccctccgggcggtcggccgcgatggacttcaaggcctgcgcccacggttcgggcttcatcaccatgccggcgcccccgccgtagggcgtgtcgtcgacggtgcggtgcctgtccgtggtgaaggcgcggaggtcgtggacgcggaggtccaggatcccgtcctggcgggctttccctatcagggacagttccagcggtgccaggtattcgggaaaaatactgacgacgtcgatccgcatctaggctttctcctccggctccgaagcggctgcttcgtcctccgcattcagctcgaagaggccgtccggcggcgtgaggaggatgaaacccccgtcaacgttgacctcgggcacgatctgctccacgaagggaatcaggatttccttgccctccggcgtggtgaccatcagcaggtcctggacgggcatggtgttcagtgcagtgaccttgccgaccacgcgggaaccgatcctggcctccaggccaacgagttcgtgctcgtaccagccttcgtcgtcgtcttcgtccagctcctcggtttcgatgaaaagcttggcgccccggagggtttccgcttcgttgcgggtcccaatttcgtcgaagcccagcagcaggatgtccttgttccagcgggcgctgttcacagtgagcgggcccgctgacgccggctcaaccacaaactcggtgcccggcacgaacctgtccccaggggcgtcggtcaggacctggaccgtcacttcgccgcggatgccgtgcggtttgccgattcgtgccacctgaagctgcatgtgttcctctgtgttggatgtggttgacggtgctctggtaaaagcactccggcccctccaccgcatgggtggaggggccggagctaaaactgaatagtgccgagcgctcagcggcggcggtcggtgtcgacgacgtcgacccgcaccggttcgccaccggccagggcagccaccacggtgcgcagtgcgcgcgccgtgcggccctggcggccaatcacccgtccgaggtcgtcctggtgaacgcgcacctcgagggtgtccccgcggcggttgctcttggagttgaccttgacgtcatccggggaatcaacgattccgcggaccaggtgttccagcgcttctgccagcaatctactcagcctcggtggtctctgcttcggcctcggcgggagcttcggctgcctcagacttggatgccttcttggtgatggcttccgggatgatcacggaacccttttccggggcaacgaaggcttccttctgggttttggtcttcagggtgccttcctggcccggcaggcccttgaacttctgccagtcaccggtgatcttgaggatcgcggcaacctgctcggacggctgggcgccgacggacagccagtactgggcacgctcggagttgacctcgatgaatgagggctcttcggtggggtggtacttgccgatctcttcgatggcgcggccatcacgcttggtgcgtgagtccgctacgacgatgcggtagtacggtgcgcgcatcttgccaaagcgcttaaggcgaatctttacggccactgttgtggtcactcctgtttcagaaaagggggtgaacccggcgttctgcacccgtggggcgggccgtacttgcgggttcgaaggacaggatccagacgcggagagaggggccacgcagatcgagtacctgtttattgtgccagatcagcgccgggatttcgacttggggcggcgtgacgcgggcgacgccggccggaggttccggccggatcagctcaggcggaccagacgtacaggccggtacgctccgagtcgtcgattccgccggcgagttcggccagccgctgcacgtacgtccgcgcttctgcagcaccaaacggcatgtcatcctgggccgcccactgttcggcaacctcttcgaggatgtcgccttccccttcggtttcataggacagcaggtccgccagggcgcgcaccatggccggcggaacggccaggagcgaatcgctggccacatccaccatggtcagttcgtaatcagctcctccggcgtgcacggcggtaccggccaggtcgcccagctgctccacttcgaaatcactgatgtccgggatccggactgcgtcgcctgcgggcgcgctgccgcccccgtcaaggacgcccgcacgcttcagtgctgcgtcgtgggtggcaacaaagatctcggtgaagcccatggggattgccctcattccgttggcggtgcggccgccgggaggctgctcctgcccggccgttcggattcagcctagttcggattcagcccagttcggaatcatgcccggtacagccgcggcaggacttttccggcaaactccaggctgacggaacaggcgcgggccgcgccggcagtgccggtggtcagcgcacagccacccggatgcggttgcgccacggatcctcgaaccggagttccgctccggtgtggtgggcggcaacaccggcgaccttgaggcggtcggcgagagagccgacgtcgtcccccgacggcacctcgatgaggacctcacccaggccgagggtgtccttgcgcggtcccgccccgcggctgttccagacgttcatggccatgtggtggtggtagcggcccgcggagacaaagagggcctgcccgtgccagccggcggtcttctcgaagccgagggtccccacatagaagtcgcgcgccgtctggacgtcgcccacctggaggtgaacgtggccaacgcccgccacggacccgagctggcgctccagggaatcttccgtcaggtgctgctcgaggtaccgctgcggcgggagggccaggctgtccatcaccacgtccgtgccgttccaggaccagctgctgcgcggccggtcccagtagagctcgatgccgttgccctccggatcattgaagtagaaggcctcactgacaaggtggtcggcgctgccggtgaacgagcgtggttcgaaccgggcggcggtggcgatggtggcggccaggtctgcctggttctcaaacagcagcgccgtgtggaagaggccggcctctcccctgcccggcaggttcagcccgggcgcgggagccaggtgcacaagcggcttctgcagccggccgaggtagattccgccgtcctgctcggcaatgacctccaggccgagggcccgctggtagtaatcggtcatcaccttcatattgcccaccttgagcatcacagtgcccatagcgaggtcggcaggcagaagatcctggcttgcggcttgtgcagtcattgataactcccggtgctgtgggccttccggctggcaggccttacactcttaaaattacttgaagcttcaatttattccaagtcccgcgccagatctcttgtcagcggatcacccgtccgcccaggacaacgtgcgccaggccatggaccgcctccggtaccttccgcgggtcctcccggcacaggacaacatctgcccgcgccccttcttccaggccctccgcgcccagccactcccgcgcactccagcacgcggcgtccagggcagacgccatgggcaggccggcagcatgaagggccatgatctcgtcggcgatcctgccgtgccggatcacgctgcccgcgtcggtcccggcgtagatccgcacgccggcctcgaaagcctcaagcacccgttcctcccgccgttcccacagtgaacgcatgtgcgctgcataccgcgggaacttgggcgccgcctgcgcagcaatgtccgggaaggtggcgatgttgaccagggtgggcacaatgggcaccttttgctcctcgaaccggggcaggtgccgcggcaggaggccggtggcgtgctcgacgcagtcgatgccggcgtccagcacgtcatcgagcgtctcttccgcgaagcagtgggcggtgacgcgcgcgccttcgtcatgggcggcccggactgcatcgcggacgacggcggcagggaacgatggcgcgaggtcgccggcgtcgcggtcaatccagtcccccacaagcttgacccatccgtcgccttccctggcctgtttacggacagcctccaccaggccgtccggttcaacttcctcagcgaagccccgcaggtaccggcgcgtgcgcgcaacgtggcgtccggcgcggatcagcaccgggacgtcttttctgtcctgcagccaccgcgtatccgccggggaacctgcatcgcggaccagcagggtgcctgcgtccaggtccgtccgtgcctgttcttcggcggtcggagcatccacgggcccgccggcgcccagcccgatgtgacagtgggcatccacgaagcccggcagcacccatcccgacaggctccggtccggggccttcgccggccgacggaacgtcagccgcccgtcaacggaccacagtccgtgctgctcagtgtgcggcccggtcaggaccgtccccgcgaactcgataatttctgccatgactctgcctctttcccgcccggacaggctagcaccgcgtgatgtgacaagcgcctcgtgggggcgtgtggtagctttcatcctgaccacacgggtgcccctgcaggggctgagatcgggctgacgcagcctgcgaccgtcgaacctgtccgggtaatgccggcgaaggaagtgagtattccttgagtacaccaaatcagcagctgaaccctgccctcaacaacccgggtgccgccactgacgggaacccgcccccggtggcgcaatccctgaaatcccattccctggcctacctcgaggacgccgggaccgggatccgggtgcccgtgacggaaattgcgttggagccgtctcccaacggcgtgccgaaccagccgttccggacctaccggacggccggtccggggagcgaccccgtccagggccttcctcctttccgcaaggattggatcgaggcgcgggcagacacggaagcgtacagcggcagggagaggaacctgctcgacgacggccgctcggcggtgcgccgcggcgccgccagcgcggagtggaagggagcgcctcccgtgccccgccgcgccgtcgagggccggaccgtgacccagatgcactacgcacggcagggcgtcataaccccggaaatgcgcttcgtggcgctgcgggagaactgcgatgttgaactggtccggagcgaactcgccgcaggacgggccatcattcccaacaacatcaaccaccccgaatccgagccgatgatcatcggcaaggccttcctggtgaaaatcaacgccaacatcggcaactccgcggtcaccagttcgatcgccgaagaggtggacaaactgcagtgggcaacccggtggggcgcagacacggtgatggacctttccaccggggacgacatccacaccacccgtgaatggattatccgcaactcccccgttcccataggtacagtcccgatctaccaggcgctggagaaggtcaatggcgaagccaacgccctgacctgggagatcttccgcgacaccgtcatcgaacagtgcgaacagggcgtggactacatgaccatccacgccggcgtgctgctccgctacgttcccctgaccgccaaccgcgttaccggcatcgtgtcccgcggcgggtccatcatggccgggtggtgcctggcgcaccaccgggagaacttcctctacacgcacttcgacgacctctgcgagatcttcgcgcggtacgacgtcgcgttttccctgggcgacgggctgcggccgggggcaacggccgatgccaacgacgccgcgcagtttgccgagctggacaccctcgcggaactgacgcagcgtgcgtgggagtacgacgtccaggtgatggtggaaggccccggccatattccgttccacctggtccgggaaaacgttgaacgccagcaggagctgtgcaagggcgcgcccttctacacgctgggaccgctggtgaccgacgtggcgcccggttatgaccacatcacctccgccatcggcgccacggaaatcgcccgttacggcacggcaatgctgtgctacgtcactcccaaggagcatttggggctgcccaacaaggacgacgtgaagacgggcgtcatcacctacaagatcgctgcgcacgccgcggatctggccaagggccatcccggcgcgcatgaacgggatgacgcgctatccaaggcacgcttcgagttccggtggcgtgaccagtttgcgttgtcgctggacccggagacggccgaggccttccacgacgagaccctcccggccgaaccggccaagaccgcgcatttctgctccatgtgcgggcccaagttctgctccatgcggatcagccaggacatccgggacgaatacggatccgcagagtcgcaggcagccctggcggaagcagcagccggcatgcggggcaagagcgaggaattcctggccgccggcgggaaagtctatttgccggagctgagcgttccgccggggcggtaggagcctgcaggttccgtccggctggtcattgggggctggccggacggggtcccgtggatggcagtttcggggatcaggaggcgcgtgcttgcacgttgctggagtcgctgatgaacgaacggatgatgcggtccccttccggggagtcgtggggccggtggccgccggcggccgtgcggtggagcgccccggtttcacggaggtagccggcgatctcttcgtagagcggctcccagccgccggtcaggacgagcgtcggcacgccgggcacgatgtgcagaagggcttcccaggaaggtgcctgcagccgcagccgcctggcggagcgcttctcctcggcggtcaccggctgctgcaggtcggtggcatagaccctgcggacgaactcgcgctggaagtcctcgtcagtcagttgatgccggacgttgaacaggggctgcatcagcccgatgtgcgccgcggtggccggcagttcggcggtcagggacaggcaggccggctccaccagggtcagcgagtagacaaggtccggacgttcgacggcggccatcatggcggagatggcgccctgcgcatgcgccacgacgtggccgccggcgatgccccggccgtcgtccccaagggagttcaacaggatgcgcgtgtcctcgtcgaacgaggactctatgggttctgcaacggaatcgaagccgtggcggcgcaggaacagggcatcgtaggacagggccacaccgtgctggcggggccaggctgcggctccgaagctgcccgcgccgtgcacgaacactaccctctgcttgaacatgacccaaccttattccacggccccggcatcccaactaagtagcgccaagtgtcgttatgaacggtcaaaacgacacttggcgctacctggttgggagaaggggatgactacttgccgaggaacttgtcgaagcccttgggcaggttcagctgggagggatcaaagtcgcccgcctgctggccaaaggctgcgccggtgggcagcgccttcgcggcgttcgcccggcgggcatcggcgtccttgcgctcctgcgcggccttggcggggtttccggacttggccttcttcttgggcgcgctcttggcgttcttccgggcaccgccgccggcccccggcatccctggcatcccgggcatgccgggcatcccgccctgggccattttcttcatcatcttctgggcctgcgcaaagcgctccagcaggccgttgacctcggaaacatggacgccggaaccgcgggcgatgcgggcacggcgggagccgttgatgatcttgggagccacgcgctcatgcggagtcatggacctgacgatggcctcgacccggtcgatctcgcgctcgtcgaactgctccagctgctggcggatgttctgcgcacccggcatcatcatgagcatcttcttcatggagcccatgttgcggatctgctgcatctgggccaggaagtcgtcaagggtgaagtcctcctggtcggcgaacttcttcgccatccgggcggcttcatccttgtcccaggacttctcggcctgctcgatcagggtgaggacgtcacccatgtcaaggatgcgcgaggccatccggtccgggtggaaaagctcaaagtcgtccaggccctcaccggtggacgcaaacatcaccggcttgcccgtgaccgacgcgacggacagcgcggcgccaccgcgggcgtcgccgtcgagcttggacagcacgatgccggtgaagttgacgccctcgtcgaaagcgagcgccgtgttcacggcgtcctggccgatcatcgagtcgatgacgaacaggacctcgttgggcacgatggcgcggcggatctggcgcgcctgctccatcatgtccgcgtcgacgcccagccggccggcggtgtccacgatcacgacgtcgtggagtttctggcgtgcttcctccacaccggcgcgggccacctcaaccgggtccccggcagggtgctcaagctcggtgtaggtggcgccggggtgcggtgcgaagacaggcaccttggcgcgctggcccacgatctgcagctgcgtcacggcgttggggcgctggaggtcgcacgccacgagcatcgggctgtggccctgtgccttcagccacttggacagcttgccggcgagggtggtcttgccggcaccctggaggccggccagcatgatgacggtggggccgctcttggccaggcggatccggcgggtttcaccgccgaggatctccaccagttcctcgttgacgatcttgacgatctgctggctcgggttcagtgcaccggaaacctcagcgcccagggcgcgttcccgtacccggccggtgaactcacggacaaccggaacggcaacatcggcgtccaaaagggcgcggcggatctcgcggactgtggcatcgacgtcggcttcagtaagcctgcctttaccgcgcaggttcttgaaggttgctgtcaaccggtcagagagtgaattgaacacgcgacgtgcacttctttcagtggatgatcgggactcgactatctagggtaccaagccgggcccgcaagatggcatgctggccagatgacgagccaaccaactgtgaagaccctgctcatcctcggcgcctcgggggacctgacgggccggctgctcctgccgggactggcgcgcctggtagcgaggggacgcgctgcgggcctccggctggtgggcgccggatcggatccctggacccccgaacagtggcgggaacgggtgcatgcgtccttcgactcggccgccgcgtccgcaggccccgagggaaaggaagccctccagtccctggagaaggaaacggtgtaccaccagctggatgtcaccgcagagggggcgctggcctcgcttcttgaggcgctcgaggggcccaccgccgtctactttgccctgccgccacgcatcagccagcttgcctgtgaggccctccgtccggagcaggtcccgccgggcacgcggctggtgatggaaaagccctttggctccagcgaggaatcggcccgctcgctcaaccagaccctggtccggctggtccccgaagaccacgtccaccgggtggaccacttcctgggcaaggccacggtgctgaatatcctgggcctgcggttcgccaacaacttcctggaacccgtgtgggacaggcaccacgtggaaaaggtggaaatcatctttgacgaggacctcgcgctggaggggcgggcccgctactacgatggcgccggcgccctgcgggacatgatccagagccacctgctgcagatcatggccctgctggccatcgagcctccggccaccatcggtgaacgggacctgcgggatgccatttccgccgttcttcgggccagcagcgtccctgtgccgtatgccgattccacccgcagggcacgctacacagccggccaggcagcaggcaaggacgttcccgactacgcacgggaggagggcgtggacgctgaacgcggcaccgagacgctggccgagatccaggtcaacatcgacaactggcgctggaacggggtcccgttcattcttcggtccggcaaggccctgggcgtcaagcgcaaggaggcagtggtcacctttcgcccggtgccccacctgccgcggggctttaccggcgttgactcgcccaacaagctgcgcattggcttcggcccggacacgctgaggttcgacgtcgacgtgaacgggcccgggaacatcttcagcctgagcagggccaccctggaaaccgagctcagcggctccgacctcctcccctacggcgaagttctggagggggtgctggcgggcgacccgctgctgtccgtccgcggagacacagcggaggagtgctggcggattgtggagccggtcctcaaggcctggcagcaggactcggtccccctggaggagtacgacgccggctctgccgggcccgcagcctggcccaccgcggtgcccggggactaagccgcagcggcttcgggcggctggcgcgccggagatcggcgcacctgccttagataacggaagagcgggcaggaaaccctggggttttcctgcccgctctttgtgttcacggatgtttccgtggagtaccgccggccctagattgcggcgacgccgcgctcaccggtgcggacccggacggcttcggagacatccatggtccagaccttgccgtcacctgcccggccggtgttggagctggcgatgatgacatcgaggatgtcgtctgcctgctcgttcgtggccaggacctccacgcggatctttggcagcagatccacgttgtactccgctccgcggtagacctcggtatagccgcgctgccggccgtagccgctggccgcgctgaccgtcaaaccctgcacgccgtaggcctccagtccttcccggatggcttcgagcttttccggcctgacgatcgctgtaatcagtttcatgcccccacgctttccttacctgttgctgattctgtcttctgcgcacccgttgctgcgtcggatgcctgcgcggcgtccgcctgggtctttccggtgatcatgtcgtgcaggggctggaagcttccgccgtgtcccccgacgccgaactcgtaggcagtctcggcgtgcaggctgaggtccacacccaccgtctcctgttcctgcgagacccggaagcccatggtcttgtggatggccagggcgatgatcgtggtcaggatcgcggagtaggcgatggcgatgccggctgctgcgagctgcgcccacatctgggtcatgccgccgccgtagaagaggccgccgccggcgccttcctcgggaagggcgatgaagccaagggccacggtgccgatgatgccggagaccaggtggacacccacgacgtcgagcgagtcatcgaaaccccagcggaacttcagtccaactgccaaggcggaggcgacgcctgccacgacgcccaggccaagggcaccgattgggctgacgttggcgcaggcgggggtgatggcaacgaggcctgccactacgccggaggctgcaccgagtgaggtggggtggccgtcgcggatgcgctccgtgaccagccagccgagcattgccgcggccggggcggcgagggtgttgacccagatgaggccgccctgctctgcggtggaggcagcgccgccgttgaagccgaaccagccgaaccagagaattgcagcgccgagcatcacgaacgggatgttgtgcgggcggtggttggggtccttgccgaagccccggcggttaccgacgatgaagacgaggatgagggctgcaacaccggcgttgatgtggaccacggtgccgccggcgaagtcgatggcctcgccgagtgccgcgccgacagcgccttcggtgctgaacaggccgccgccccacaccatgtaggcaagcgggcagtagaccagcgtgacccagaccggaacgaagacggtccaggcgccgaacttggcccggtccgcgatggcgccgctgatgagggccaccgtgatgatggcaaaggtggcgccgaagcccactgtgatgagcccatcagggctgtcgatgccttcaagcccgaagttggcgaaggggctgcccaccatctggaggaagccgtccccggaggtcattgagtagccccacaggacccagatgactcccaccatgccgatggagatgaagctcatcatcatcatgttcagcgcggccttggcccgggtcatgccgccgtagaaaaatgccagacccggtgtcatcaacagcacaagcgccgccgacaccatgatccatacgtgacctgcggtaagttccatggtgcacgcctctcttatctatttggtcgaagttgcggagatgatccgcctgccaacgccgtttgcgtcctgtatcgagtgtgtcggcgctgtgtttccgccgcggaggatttgtattgcggcgctgttacaacaacctctaggaagtaaatggtgcatatctggcttgttacggttatgtttcaccactcccgccgaagcccggcacccacgtacgcaaggaccactggaccatgacggcagatacccgcatgagccgcgcaacatcgcggattttttcgatgctgcgcagggacaggcagaagctcccgcgcgacatcaaggttatgctggccgcggccttcctgattgcgctgggattcggccttgttgcccccgtgttgccgcaattcgccacaaccttcggggtgggaaataccgaggcgtccgtgatcgtggcgatcttcgcgttcatgcggctggtctttgcccctgcgggcggcgccctgataggccgcctgggcgaacgccccgtctatgtcacgggactgctcatcgtggcggcgtccaccgctgcgtgcgccttcgcccaggattactggcagctgctgctgttccgcgggctgggcggcgccggctcagtgatgttcacggtggcgtcgatggccctggtggtgcggctcgcgccgcccgagagcaggggacgcgtctcgggcgcatatgcgtccgcattcctcatcgggaacgtgtgcggcccgatcgtcggcgggctcctcgcaggtttcggcctgcgcgttcccttcctggcgtacgcggctgccctggtggtggccgccgtcgtggtccagacgcagctgagccaccagcgccggggcagcgggccccggcaggaccgcgctgacatgccgctggccgaggcccttgctgcagggacataccggtcggcgctggtatccagcttcgtgaacggctgggccacgttcggcgtccggatggcgaccgttccgctgttcgccgtggccgccctcggcgcggggcccgaagcggcggggtttgcgctggcggtctttgccgccggcaacgcggcggccctgacgttctcgggccggctggccgataccctgggccgcaagcccatgatggtggctgggctgctcgtggccggtgcctccaccgccgccatcggcttcaccaccgggctgggctggttcctggcggcatcagcgctggccggcgtcggctcgggactcttcggcccggcccagcaggccgccgtcgccgatgtgatcggcaacgggcggtccggcggtaaggtgctggccgtctaccagatgacgtccgacgtcggcgcgattgttgggcccgtcctggccggtgtgctggccgaccggctgggctacggctgggccttcggagtgaccggcggcatcatggtggtggcggcgtgcacgtggcttgccacgcgggagagcttgtggaagcccgcggcgtaacggcaggctgacgtccgtccgtcagggcgggctgcggctggaggtgcggctagttcagcagcgcgtccacgaagccctcaacctcgaagggtgcaagatcgtccgccccttccccgaggccgatcagcttcaccgggacgcccaacgttttctggattgcgacgacgatgccgcccttggcggttccgtccagtttggtcaggacgatgccggtgatgttgaccacttcggagaacacgcgcgcctggttcaggccgttctgcccggtggtggcgtccagcaccaggaggacctcgtccacctcggccagcttttccaccacgcgtttgaccttccggagctcgtccatcaggccaactttgttctggaggcggccggcggtgtcgatcatcacgacgtcgacttcctggtcgatgccggccttgacagcctcgtaggcaaccgaggcagggtctgcgccgtcgatgtccgacttgacggtgggaacgccgacgcgctggccccaggttgccagctgctcggcagcggcagcacggaatgtgtccgcggcaccgagcaggacgtccttatcctcggccaccaggacgcgggcaagtttgcctacggttgtggtcttgccgacgccgttcacgcccaccaccatcatcacggcaggcctgtcagcatgccgctggacgttcagcgtgcggtccatggtgggatcgacgagcttgatgagctcctcccgcagcagcagcttgacctgctcaggggtccgggtgcccagcaccttgacgcgttcacgcagcgcgtccacgagctgcatggtgggttcggtgccgaggtctgcgaggaggagcgtttcctccacttcgtcccagacgttttcgtcgatcttgtcgctggagagcagggccaggagtcccttgcccatgacgttgttggagcggaccagccgttcgcggaggcggaccagccggcctgccacaggcagcggggtttccaccggaatgacttcaagtcctgcggcgttgtccgggacctcggtggtctccagcccgtccaggtccgtgccttccggggccgtgcggtccgccaccgtgcccggccggtcctccacggccgtgctgccgctccgcgggaggagggggtcgttggcgtcccgcgtgccggggtagcgcgtgatgttcttccgggtcttcatcaggaccggaatcagcccgccgagaaccaccaaggcagcaaggatggacagaagtatgggaaggatgtcattcactcccctagcttctcatagacgccggggctcttttggggccgggaaggcagttgacctgccgttacacgagcagcctcagacctcggccccgagcctctggctgatcacggtggagacaccgtcgccgcgcatggtgacgccgtacagtgcgtcggcgacttccatggtccgcttctggtgggtgatgacgatgagctggctggattcccggagttcttcgaagatcgtgatgagccggcccaggttggtgtcgtccagggccgcttccacctcgtccatgacgtagaacggcgaaggccgcgccttgaagatggcaacgagcagggccaccgcggtcagggagcgttcgccgccggacaggagcgaaagccgcttgatcttcttgcccgcgggacgggcctccacttcgatgccggtggtgagcatatcggaggggtcggtcaggaccagccgtccctcgccgcccgggaagagccttgcgaagacccgcgtgaactgggcctgggtatcctcgaacgcctccgtgaacacccgctggacgcggtcatccacttccttgatgatgtccaggaggtccttccggctggccttcaggtcctccagctgcgcgctgaggaactggtggcgctcctcaagcgcggcgaattcctccagcgccagggggttgaccctgcccaggccggcgaggtcccgttcggccttccggagccgtttttcctgctcggccctgacgtagggctttccttcgacgatgtccgcgccggtgtggtccaccggggcccgaagggccgcccacttgtccccgctctccccggcgggaacgggaaccgggacgtccgggccgaactcagccaccagggcatcgggggttatccccagttcgtcgatggagcggctctccagggcttcgatccgtgccttctgctgggtccgggcgagttcgtctcggtggacgttgtccgtgaggtcggcaagttcacgggccagcagttcgtttgccgtccggatctctgcgagctcccggtccctctgctcccggttctcctccgccaggtcccgttcatgctgtgccaggtccacggacacgtccacatagcggagcgccaggccgacggcggcggaaacggcagcagcccgccgcgccttgatgcggcggacccgggcgcgttcggcagcttcctcgcgcgccctgcgttccgtggcggccgcgcgctccagggatgcggcccggttccgtgtggccgtgagctgctcttcggcgctgcggagcgacagccgtgcctccacctcggcgctgcgggcatgggtggccgcctgggccagcgcgtcacggtgcccggtggagggctcctgttccagcgggacttcctgggctgcggccaaacgggcggtgacggcagcgagcgcctcctcctcggcggcaacgttctcctcagccttggccagcgatgccgccaggcggtcgctttccccgacggcgctgcgaaggacggagttcaggtggcccaggcgttccgccacggcggccagcctggcatccgagtcatgcagcctgtccagtgcggcgtcggcgtgctcctgtgcctccgttcgttgggcctcggcaccggccagggcgaacctgttccgctccaggcctgccgtgacctccgcaagctcgcgctcggcgtcgtccacggcggcctgcacctcgaggagggacggcgccttcgccgagccgcccgtggctgacagggctgtaaagatgtctccggcccgggttacggcggtcagctccgggtgggctgccaccagggcggacgcggcctggatgtcggggacgacggcggtaccggacagcaggtgcgccacgagcggtgcgtacggggacggtgaggtcacgaggtcagctgcccagcgtgcccctgcgggcaggggcgccgtggtgtcccgcgacatttccgcagcggccgcggacgctgcgaccagcagcgacgcccgtccggcgtcgtggtccttgagaagctggaccacggcaacagcggtggccgcatcctggaccaggacggcctcggaggcctcgcccaggaccgcggcgattgcggtctcgaagccgggtgtaacggtcagttgcgctgccaaggatccctggatcccgtcgaggcctgcgtgcagggcgtggctggcgccgtccttccgttcgaggcccagcttcagggcgtcccgccgcgccaccaaggcgtcgcgcttgcggaccccctcgctgacggcggcctggaggcccgcgatctgctggactaccgtgtccagggcctcgctggcggcctcgtagtcggcgtcgagggattcctccccctcctcaacgcccgccacctggttctccaaggccgcgaattcggcctgggcacgggcccgccgttcggttcctgcggcaagtgattcgcgcagcctgcccagctccgcctgggcggattccacgcgtgaacgcgccgccgccacctggccggccaggcgggccagcccctcacgacggtctgctgccgcgcggagctctgcggtgaggcgcttgtcctcttccagggcagcgcgttccgcttcggccttgtccgcagaggctgcttcgagggcgcttcgccggtccaggatgtcgcgctccagttcggcaagctcctcacggaccctggccgcctggcgttccagctgttccggatctcggccgggcggcggggcttccacagagcccaggaggctgttgcgttcctgcgccagagagcccagggaccgcaggcgctccctggtggcggacaatcggtaccaggtgtccctggcggcgttcagctggggggttgcttcagctgcacgttgttccagcacggcctgctgccggcggccgatttccagctgcccggcaacgagggcccggcgttccttcacggcggcctcgtccgctacgtcctgttccagcgccagctgcagctgggcgaggtcgtctgccaggaggcgggcgcgggcatcgcggacatcgaactggacacgctgggcccggcgggccacttcggcctgcttccccaagggcgtgagctggcggcggatttctccggtgaggtcgttgaggcgctgcaggttggcctgcatggcgtcgagcttgcgcaccgtcctttccttgcgccggcggtgcttcaggatgccggccgcttcctcgatgaagccccggcggtcctccggggtggcgtgcaggacgcggtcaagctggccctggcccacaatgacgtgcatctcgcggccgaggccggaatcggacagcagttcctggatatccagcaggcggcagcctgcaccgttgatggcatattccgagccgcccgagcggaacagggtccgcgaaatggtcacttcgctgtactcgatgggcagggcgccgtcagtgttgtcgatggtcagcgacacgtgggcccggcccaggggcggccggcccgaggtgccggcgaagatgacgtcttccatcttgccgccgcgaagggtcttggcaccctgctcccccataacccacgccagggcgtccaccacgttggactttccggatccgttggggccaaccaccgcggtaacccccggctcgaaattgaaggtggtggcggacgcgaatgacttgaacccccggacggtcaggcttttgaggtgcaaggcgtttcggttctcctgctcggcggacgcggatggtggggacagccacggatacctacaatctactgcggggccgggacattttcgtgcagaagcccgtccgggccgggccggatgtcctgttctgcatgtgcaggaatggaccgccaccgggcatgattagtccttgggctttgtgcttgagggggcggttacccgccacagcacaggacggacacgaacagaggcttgatttgatagggaatgcaacgttccggcaccgcaacaccgctctgctctcggtgatcagcgtccaggctccgcggattgtcagttccacggaattcgaccaccggctggcgtccaccctgcgccggctgaaatttccgccgaagctgctcgagcgggtagccggcgtcacgcaccgccggtggtgggcccccgggacgtctttcgacgacgccgccatcgaggcgggcgcaaaggccctggctgattccggcatcgaagcgtccgaggtgggactgttgatcaacacgtccgtcacgcggcggaacctcgaaccgtctgtcgcggtcaaggtccaccacggactgggcctcccgtcctccgccatgaacttcgacgtcgcgaacgcctgcctgggattcgtcaatggcatgaccctggccgccaacatgatcgactccggccagatcaagtacgcggtgatcgtcaacggcgaggatgcacaagccacgcaggaggccaccctggcccggctgcagcggcccgaaacaacccgcgaggacttcaaccgggagttcgccacgctcaccctgggctcaggggccgctgcggccgtcctggggccggcggacgaacacccgggggcgcaccggatcctcggcggcgtgatgcgggccgggacggagcaccacgagctgtgcgtcggcggcatcgacggcatggccaccgacacgaagggccttctcgacggcggcctgcagttggtgctcgacgcctggcacgaggcccagccggagtgggattggggctcgatggaccgttatgtcacgcaccaggtgagtacggcatacacccaggccatcgttgacgccatcgacctggacccggacaaggtgcccatcacgttcccgcactggggcaatgtggggccggcatccctgcccatgacgctggccgccgaagcgcagaacctaaacgagggggaccgcgtgctgtgcatgggcgtcggatccggcctcaacaccgccatggtggaaatcgtttggtagccgccgactggcccggcgtagacccggaatggtcacgcggaatcgctgtgccgtccacctccgccgcggatgagcccgggacggtgcaccactggcaccttttggacaacggggcccagctgtcgcggcgcggcctgtcccctgccggcaccctgctgtgcgtgcacggcaacccgacctggtcatatctgtggcggacactgctggccgccgggtcccgcccggagcagccttggcgcgtggtggccgtggaccagctggacatgggtttctcggagcggacagggacgttccggcggctggcggaccggatcaatgacctcggcgacctcaccgacgcgctggcgctggacggtccggtggtcaccgtcggccacgactggggcggcgtgatcagcctcggctgggccctggcccatccgaggcagctcgccggggtggtgctgaccaacaccgctgtccaccagccttccggatcacccatcccgccggcgctgcggcttgccctgcaccccgcggtgcacaggtggggcacaacgacgtcggacgctttcctgcgggtgacccattccctggcccgcccgccgcttgcccccgaggtccgccgcgcgttcatggccccgtatgcgggcgccggccgccgcgggggcgtgggtaacttcgtcgcggacatccccgcagacgcatcccatcccagctttgccgcgctcaaccgggtcgccgaagggctgcccgggttgaatgttccagcactgctgctctggggcccgcgggatccgatcttctccgaccggtacctcaaggacctggtcggccggctgccggccgcgaaagtgcaccgtttcgaaggtgccggccacctggtcgcagaggaccgggacatcgccggccccgtcttcgagtggctcaccggatacggtggggacggtacgcctgtcggcggagggactgtttccgcggcgggagctgccgtgcctcccccggctgtgccttccccggccgtgccctccattgcgggagatcccggcaccgacttcacgcccctctgggagccgctggcggagctcgcggcaggacccgacggccgggacaccgccgtcgcggaaatggccgcggacgggagtgtttcccgttcgctcagctggctggagcttgaacagcagatcgccgccgtcgccaatggactccggcaggccggggtgcggacgggcagccgcgtgagcctgatggttccacccggcgtggacctgaccgtggtcctctacgcctgcctgcggctcggcgcagtggtggtggtggcggacgccggactcggcacccgcggcctcagccgagccgtcaagggcgccgccccggacttccttatcggcatcgacaaggccctcgccgcagcatcggtgctcggctggccggggcgccgcatcagtgtgaaggacctgccggctgcccgccgccgactcctcgccgtcgagacctccctcgccgcactggcccgccggggcagcctcccggccggaacggcgccggtgctgcaggatccggacccggatgcgcccgcggcggtgctcttcacctccggatccaccggacccgccaagggcgtggtgtacacgcagcggcggctggcggcgatgcgggacaccgtcgctgtgacgctgggaatcggccccggcgcgcgcctggtggccgggttcgcgcccttcgcgctgctgggtccggccctgggggccgtctccgtgacgccagccatggacgtcaccgcaccgcggacgctgacagcccgcgcactggcggacgctgccgcggccatcgacgccaccgtggtcttcgcctcccccgcggcactctgcaacgtcctggccacccgtaacggcctgggacaacccgggcggcaggccctggaacgcgtggagctgctcctctcggccggcgcccccgtccccgaaccgctccttgcggacgtgcagcggctgctgcccgacgcctcgctgcacaccccctacggaatgaccgaggcgctgcccgtcacggatatcagcttggaacagatccgtaccgccgcggcagacgctgcggccggaaacatggctggggcgggcaacggtgtgtgcgtgggcctgccggtgcacagcgcccgcgtcgctgtcatcccgcttgccgcggacggcgccgctcccggcaatatccccgtcacggagccgggagtcaccggcgaaatcctggtgggcgccccgcatgtgaaggaaacctacgacaggctctggctgacgcagcgcgagagcatccgcacggccggctggcaccgtaccggcgacgtcggacacttcgacagtgccggccggctgtgggtggaaggacgcctggcccatgtcgtgaccgcgcccgacgccgtggtaacaccggtgggcgccgaacaggccatcgaacggctggacggcgtcggactggccgccgtcgtcggtgtcggcccttcggggacgcaggctgtggtggccgtcgtcgagacggtgccgccggcccgccgggcgggccctgccgcgccgcagctcgcagcacgggtccgggaagcggcccgcatggcaggcgccagcgtctccgccgtcctggttgtcccctcccagcccaccgacatccgccataacgccaagatcgaccggacccgcctgtcccggtgggccaccgcagtgctggccggcggccgggcgggcaggccgtgagggtcctcgtcaccggggcgagcggcctgctcggcggcggggtggcccggctgctggtccgccagggccaggccgtcaccaccttccagcggcgccccgccggagtcgacggcgccacggaccttaccgggtccatcactgacgacgccgccgtccgccgggccgttgccggcgcagagggcattatccacctggcggccaaggtctccttcaccggcaaggccacggaattcgacgcggtgaatgttgacggcacgcgccgcctcctccgtgcggcccgtgcggcgggcgtgcaggacgtggtctttgtttcctcaccgtccgtggccaactcgggggccgcaatagcgggagtgggcgccgaaccggccgacccggaccgggcgcatggggactattcgcgcaccaaggcccgggccgaacttcttgcgctggctgctgactcgccggatttcagggtcgcagcggtgcgcccgcacatcgtctggggccctggtgacacccagctggtggaacgagtactggaccgcgcacgccggcgccgtttgcccctgctcgacgacggggctgccctgatcgacacgacctacgtcgacaacgccgcctcggccatcgtcgcggcgctgcaccgcatggagcacatccacggccgggcgctcgtggtcagcaacggtgaaccgcggccggtaggcgagctccttgcgggcatctgcgccgccggcggagttccggctccgtcctggtccgttccgggcagcctggcgcgggcggcaggatcgctgatcgaagttctgtggacccgggccgggcgggccggggaaccaccgatgaccaggttcctcgctgagcagctctccaccgcccactggttcgaccagcgtgaaacccgccggctcctggactgggcaccggcagtatccattgacgagggcctggcgaggctggccggacactaccgcgcccggtaggtggctgctctatccggtttcccggcagtgttcccctaccagcggccgttccgcggccggggctggcaggctgggcaggtgtaggacgagcggttcatgaactgctcgcgcttcatgcggctggacacgcctgctgccgcgcagcgcttacaatccaggccttcgcggccgtaggcgttcagggaccggtcgaagtaccctgaggcgccattgacgttcacgtaaagggagtcaaagctcgtcccgccggcggcaagggcgtccagcatgacctcccgggcttccgcgatgacgcgttctgcctcggcacgccgcagcgtgtccgtgggccgggcatagtgcagccgggcgcgccagagggcttcatcggcatagatgttgccgatgccggacaccaggccctggtccagcagggcccgcttcagccctgttttgcgtttccggagacgccggtagaaaaggtcgaatgagaacgccgggtccagcggatcccgtgcgatgtgggccgcttcctccgcgatcagcggaaggggcgattcagcgagtccgccggggccgccgtcgtccgttggaaccaggcccgtgacaaacaggccgccgaaaatccgctggtccacgaaccgcagctggtcgggcatgccgttgcgggggctcagccggagacggaccttgaggtgcttttcgtcaggcacgtccctgtcctgcatcaggagctggccgctcatgcccaagtgcgccatgagcgctacctgcggggcgcccgcactgtcttgggttccggccggcccgccggaaccggcgtccagaagcggcatccagaggaacttgccccgccgcacaacgtccgcgacggtggcgccctgcaggttcccgataaagtcttcggtgcccagcgcgtggcggcggatcgaccgtggatcaaccacctccaccgcgtcaatggtccgtttccggacccagctcaccaggccgcgccggaccacctcgacttcgggaagttcaggcacggggctacgttgcggggacggaaccggcggacgtggctgcccccggagggttgccgggtccggtgagcacccgccaagcgtcggcggccgcctcctgctccgcttccttcttcgagtggccggagcccttcccgtaggcggtgccgccgacgtgcaggactgcagtaaacgtccgcgcatggtccggaccggagccatccacggcatagtggatggagcccagctgacggctggcggccagttcctggatgctggttttccagtccgtcccggcacccagtgctgcggcgtccttgagcagtggaccgatcaggcgcatcaccagctggcgggccgtctcgatgtcgttggagacgtaggtggcgccgatcagggcctccatggtgtctgccaggattgacgccttgttcttgccctgggtgagcttttcgccctgcccaaggtagatgtattccccgatgcccaggctgcggccgatgccggccagcgcccgcgtactgacgacggcggaacgccgtttggccaggtcgccttcgggaaggtccgggttgtcccggtacagggcgtccgtgacggagaatcccaggatggagtcgcccaggaattccaggcgctcgttcgtgggaatgccgccgttttcgtaggcgtaggaacggtgggtgagcgcaagacgaagcgtcccggcgtcaatagagacaccgagacgcttcagaagctcttcagttgaagacatcatgtcagcctgagtggccgattagacgtccgcgaccttgcgtcccttgtactcaaggaacagcgcagtgccggccgagtcggtgacaacctttgcctggtgcggcaggctgtaggtgacctggccgttctcgacggtcttcaccaggtggggggcggttgccttccactgggagcggcgggcgcgggtattcgagcgagacattttccgcttgggaacagccacggctaactcatttctctctagacaaacacgtacacatcaattttgccggtcaggcttagccatatcagctagggcagcccagcgaggatccaggacctcgtggtggtgccccggctcgtcttccaggcgaactccacattcggagcaaaggccctggcagtcttcccggcacaccggctggaacggcagcgcggtcactactgcgtcccgcaacaccggttcaagatcgattacatcgtgctcgactcgacgttgctcttcattatcttcttcgtccgaaagctccacgccctcatagaagaaaagttcctgcacattgacctcaaggtcatacgcaaggggatccaggcatcggccgcactcacctgttacctcggtgagcacggtacctgataccagaattccttcgtgtacggcctcaagcctcagatccagctcgacatccgagccttcctgaacgccaataagcgccacaccaaggtcacctggtgcgggtacatgttccttcagtgtccgcatgcttcccgggctgcgcccgaggtccttgacgtcgaacgccaagggcgaaccagcacctcttttaatgagaactcctgttgaacatatgaccgacgtaccatcttagcctgaagagccacggggactcaaaccggccggcgcacagcgccgaagtaccggacaagcctaccctttcggatgctggttgtgcggaggctcgcccgcgagcatccgccgctgcaccgagcggggcacatagtcagacacgttgccgccaaggcctgccacctccttgatgagggtggaggacaggtgcagatagtgcgcctcagccggcaggaagactgtttccacgccgctaagctgccggttcatggtggccatgggcagttcgtagtcaaagtccgacgacgacctcaggcctttgacgatggccgagacgccgcgctgccggcagtactcggccagcagcccttcccctacgggttccaccacaatgcccttgagtgaggcgagggtttcccgcgccatctccaggcgctcggtcagggtgaacctgtacttcttggcctggttggtggagacggccacaatgacttcatcgaagaggccggccgcccgtgcaataacctcgagatggccgttgtggatggggtcgaaggatccggggcagacagcgcgtctcatgctccgaacctaccccatgggaaggccgggataccatgactggatgcatgcaccacgggaagtttccgcgcccacggctcccgctccctggcagcgcacagccctcggagcaaacctcctctcccccggcggaggcctgggcgtcaccatcttcgaggagatgaccaccctcgctgtccggacaggcgccatcaacctgggccagggatttccggacgaggatggaccactggaaatcagggaagccgcccgggccgccatcgcagcaggcgcgaaccagtatgcgcccggtaaaggcatcccggaactgcgggaggcagtggcggtccaccagcagcgcttctacggcctttcgcccgaccccgccaccgaggtggtcatcaccaccggcgccaccgaggccattgccgcctcgctcctggcgttcgccgggcccggcgacgaggtgctgaccctggaacccttctacgattcctacggcgcggtgatcggcctgtccggcgcaacccacgtgaccgcccccttgctggccccggactttatgccggacatggcagcgctcgaagctgcattcagtccgcggacaaagattgtcctcctgaacaacccccacaacccgaccggcgccgtcttcccgcgggaggtgctgcagcggatcgtcgacctggcacgcacccacaacagcatcctcgtcacggatgaggtctacgaacacctcacgtttggcgtcagccacgtgccggtggcatccctgcccggagccgcggaccgcaccatcaccatctcctccgcaggcaagaccttctccctgaccgggtggaagatcggctggcttacgggcccggaggaccttgtggccgccgtgcggaccgtcaagcagttcctcacgtacagttcgggcaccccgttccagtcggccatcgccgtggggctgggtttgccggactccttctatgagggcatcgcggcatccctggagcgcaagcgggacatcctgagcgaagggctccgcgccgcggggttcgacgtcttttccccgcaggggacgtacttcgtcaatgttgacactgctcccctgggcatcaccgactcggtggacctggcccggaggcttccggcgctggtgggagtcgcggcgatccccgtccccgtgttctgccatgaggagggggcgcagcggacgcgaagcctgctccggttcgcgttctgcaagaaggacggcgtcctgcacgaggctgccggacgcctggcttccctcagcggcaggctctgatgaccgccgggcgtgaaacccgggcacggttcctgcggaccaccgggcagcacgcgtccattgaaccggatgccttcaccgagggcagctgggtcctgagcatcggcggcgcggaacagtctcacgtcaaccttgtccggccggaggagatcttctacgagtacctccgccggatcggccacctggtggaccttgcagcacccgccggagagcctgtccgcgcgctgcacctgggggccggggcattgaccctggcgcggtatatccaggcaacccggccgggatcggtccagtacgccgtggagctggagcgcgagctgcttgacttcgtcctgcgccagctccccctccccgagggcacggacctgcacactgtcaccggcgacgcccgggaagcactggcccggctggacccggaactccggttcgacgtcgttatcctggacatcttctccgggccggaggcaccggcgcacctggcatgcagtgcgttctaccgggaaataagggaccggctcagccccggcggggtgctgatcgtcaatgtgggtgacgaaccggggctcacactggtccggagccaggtggcggccatgcgggaggccatggcggatgtggccgccttcgccgaagcgggcatgttcgagggccgctaccccggaaacgttatcctcgcgggcacgcagaccccatggccccgggactggaccaccgaactgaccgccctcgggccgcacccggcgaaagtcctggccggactggatctggacccctttgcgggctgaccgctgaacagggagcgcgccggtccggctagcgttccgcttcttccggcgcttccggaacgtcgtccccgtcaatggcgtcaggcacgttgggttccgcgtaccaaagcatggtttcgccgtatttcttctcggcgaaccgggccagggcatcaggccactgtggctcaggggaacgggacgagcgctccaccaccaccacggcggcggccgaaaggtgcggtgcaagcttctggagcgcggcattcagcgccacctcctcaagcgggtagggcgggtccataaaaacaaggtcccactcagcggtctccggggcacggtccaggaagggttcgactttcgagcggtgcacggtgacagccttgcgcccgagcacgccgttgacgaggtcggcattgcgctggcacacggcacttgccttgccgtccgactccaccaggtcgaccgtctgggctcccctgctgccgctctcaacccccagggaaccggagccggcataaaggtccaggaccctggcgccggcaatgacattgaaggcgtcaagccgggagaagagcgcctccttgacccggtccgtggtgggcctggtcagggaaccgggaacggcggtgaggggggagccgccggcggctcccgaaatgatccggctcactgaacactcctgtttgcgaagccagtcaatccggcgcgcaccatgctatccgcgttcaaggaacgcctccttttccggattgaggtacttctctatcgcctcggcaagctcggggcgggccgccagggcggggtcttcgcccacgatctgctgggcatcttcccgtgccctggcaataacatccccgtgttccaggacccgcagcagcttgagggtggaccgtccgcctgactgcgaggcaccaaggatgtcgccctcgcgacgcatcttgaggtcctcctcggagagcgcaaacccgtcggtggtcgcggccactgcctccagcctgcgccggctggggtggcccggttcaagggaggtcaccagcaggcaagtccccgggagcccgccccggcccacccggccgcgaagctgatggagctgggagatcccgaacctgtcggcatcgagaatgaccatcagggttgcattgtggacgtccacgcccacctcgatcacggtggtggacaccagcagcttaatgcggttcgccgcaaaatcgtccatcaccccgaacttcaggtccggctcctgccggccatggagcggcgccaggggcaccccggacaacgacggctcctccaacaaatgctcgacgacggctgtcaccgacgcgagctcccgtccgccgtcgccttccgtgtctcctaccggaggcgccgcttcaccgggactgaagtcgccgtcgtcgtccgttccgatcctggggcagacgacgtacacctgatggcccgcgtcaatctcctcccgcgcccgcgcccagatgcggcctgcccaggccgggttctcggcgagccccaccagatgggtggaaatgggggcccggccggccgggagttcgttcaggacggacgtttcgaggtctccgaaaacggtcatggcgacggtccgcgggatgggcgtggcggtcatgacaagcaggtgcgggggcttcctggccttggcccggagcgcgtcacgctgctccacgccgaaccggtgctgctcatccaccacgatcaggccgaggtcgtaaaaggaaacgttgtcgctgagcagggcgtgggtaccgatgacgatccccgcagtcccggacgcggcgtcaagcatggcctggcggcgtgccgccgtgggcatggacccggtgagcagcgagacctggacggaggcgccgtccgttccgcccagcaggccgtcgctggaaaggggtcccagcgtgcggcggatcgaatcgaaatgctgtgcggcgaggacttccgtgggtgccagcagggccgcctggcccccggcatccaccacctgcagcattgcccggagcgccactacggtcttgccggagcccacttcgccctgcaggagccggttcatgggggtgtcccgggccagctcgcccccgagggtctccccgacggcggcctgcccggcagtgagggtgaagggaagatcggcgtcgaagcgggccaggagaccgtccggcacgggcctgcgggctgtggcttcctccgccgcaagctgggcgcggcggcgggccagcgcagactgcagcaccagcgcttcctggtagcggaaacggcggcgggcctgctgccagtcaccggctgactccggctcgtggatcagccggtacgccgtggcaatggggaggaatttctcccgtgccgcgatgtccgcagggatggggtcgggcagggagtcgaggtccgcggtttcgagcagtgtggagacggccttctggattttccagctgggcagcttggacgtggccgggtacacggggatgggcatggcggccatcttttccggatcgcggccgttgtcactgaacatgtcctcgtccaggagctggtagtccgggttggtgaggccgagcgagcccttgaagctggtgaccttgccggaaaagagggccagccggccctggagcagctccgcctgggccttgtagccgttaaaaaagctgattttgagggtccctggcgctttgccgcggtaatccgtgccacctataagccgaagtccctgttttccgtcgtcgtcggaaaccacgacgtcggtgatggtgccgcggcgcgcctgcatgcggcgcgtgctgctggacaggacccgtgcaatcagggtgacttcctcgtcccgcgggatctcgctgatgggggtcagctccccccggttcatgtagcggcgcgggtaatagttaagcagtccctccaccgtggtgatgcccaggtgcttttcaatgactgcggcggaacgcttgccaagccggcgttccagcgccaggtccagttcagcgctcatgcccgctggagttcactgcatccgctgccggatcgagcggcagggcaagttcgctgatgctgatgttggcgggctcaccgagggatcggatgatctcgacggcgggctccccctcgggcacatggacgtggacgcgccaccggtagttgccctcggaatcgggcccgctgcccacctggctcatgatgaccgattcgccgatctcgtccagccgctgccggagggtggctgcgttgagcggcgaaaggctgatggtgcacatgacttccacgccgtcatcgtccggcatggcggtgtggatgtgcggatccgacacgtcgtatccgtgcaggccgtcgaggagctcgctctggagctcctcgcccaggaccgccgagcgcaggcaatcgaggatcagcagcattcccaccccgccggcgtccaccacgtgcgcagaagtgagggcggccagttggtcctcggtgtggatcacggctgcgagggcagcttccacggcggcgtccagggcgaggcccagggcatggttgctgtcgtcgccgttttgccctgcgtccacggcggcggcagccctggctgccgcttccatgacggagagcatggtgccggggacggggtcgctcagggctgaccaggcgcggatctgggcgcggttaagcgctgctgcgaggagggtggatgtcaggcgggtgtgtcctgcgagcggctcagcggcggcagtcaggaacaccgagagaagtgttcccgagtttccccgggcctcctccatcgcggcctgtccggcggtagccagaacggcgcccacgtccatctgggcaggctggtccccgtcggcggaaacggcccgggcggccgcccgcacggtgacgtagaggttcgtcccggtatcgccatctgccaccgggaaaatattaatggcattcaggcggtcgctgtggttgccaagagccgtctcagccttgcccaaccacctcttcatcgcttgcgcgttggcggcaaccttagtgtgcaaagtgatcccatcccccggtgtctgcggaccggccggctatcgtgacgcccgggcgctcgttgattcccagtgcttgtattgagcctatcgcagtgaatccggcgggcagcagggggccggaggggaatgtggccagcagcccgtggtcttccccgccgccgagcacccagtccccggcgtcagtgtgcaggtgttccgctgcgggccgcaggacgtccttgagccgctccagcgggccagcatggaggtcgacggcgacaccgctggctgccgccagccgcaggccgtcccgcaacatgccgtccgagatgtccagcatggccgttgcgccggcagccctcgcggcgggccctgcggccagtggcggccgcggcctgcactgaagttcggccagggcgcggagttcggcgctgagtgtttccagtggaatggtggactccagcagggccaggccggcggcggcgtggccgacggtgcctgcaagggccaggacatctcctggtttggccccggaccggaggactgccgggccgccatcgagggtgcccagcaccgcaaccgtcacggaaatttcccgtccgcgccccaggtcgcctcccgccaccgagcagttggccgcaccgagatccctgatcccggaggtgagtccgtccgccaggtcctccacccagcccacagtggtgtcaggaggaagcgtgaggctcaccaccagcgaagttgcgctggcgcccatggcgttgatgtcgctgaggttctgcgccgctgctttccagccgacgtcgaagccggtggttttgtagccgcttggccactggagcctgaaatcctggtcctggacctgggtgtcgatgctgatgacagtcctgccgtccggagcggcgatcacggcagcgtcatcccccggccccaggagcgtggcggcgcagtgcgtgccctccatggccagccgcggaaagatccgggccagcagctcgccctcggagagggcagagacaggcagggcggagacggtcacggcgggggcggtcagctgattcccggcggcgggctggtcatcgccggactgcgggaggggtcgcgggcgggaggacaagggtttttcaggcacgccactacgctatcgcggggccccgacattgagggcaggcggtgccggcgtcgggcatggtccgttcgcggcgataggctggagggatgcagcgtccccagctttcccctgccgcccgtgttgccaggctggcactgattgggagccttgcggccatacccttgacctcgtgctcgcctcccgtggatgttcctgctgcccaggacgcggccaaccctgcatgcgctcccatgatggtcgcgttgccggacgctattggcgactctccgctccggaaaacgaacagccaggcgacggccgcctggggtgatccgtccctggtgatcctccgctgcggcgtcaacgtcccgggccccaccactgaccgctgtgtgaccgtcaacggcatcgactgggtcattaaggagggcagccccgtctggaccctgacgacctatggccgcgaaccggcaaccgagatcctgatggatcccgacaagatcagttctgccacagtcctggcagacctcgcagcggcagccggcaatgtaccggcggccaggaactgcgtaggccaggaggacctgcagaacctgccgcccagccagtaggctgccggcggggaatgtcagcggagcccggttttgcggttcagcgccaggtagatcagttcatcgatgaggtctgcgtagtccagcccggaggccgcccacatctgcgggtacatgctcttgggcgtgaacccgggcatggtgttgatttcgttgatgatgagctcaccggcgggtgtgtagaagaagtccacgcggctcagtccttcggcaccaaccgcgtcaaaggctgccgctgcgagctcgcggaccctggcgatggcttcctcgggaatgtccgccgggcagctcagggaagcggcgtcgtcctccacatacttggcattgaaatcgtagaactcgtgggtgccgccggccacggagatctcgccgggcatggaagtccgtggagcgtctgtgcccctgccttcgaggacggcgcattcgatctcccggccagtgatcccggcctcgatcaccagcttgaggtcatgcttgcgggcttcctcgatggcggcgtccagctccgccagtgaatcaaccttggaaatgcccatggaggagcctgcgcgggcgggtttgacgaagaccgggaagcccagccggtccacctgtttccggaccagctccgggtccttgagccattgccggtcggtgaccgccacatacgggcccacgttcagcccggccgcctcgaagaccaccttcatgtagtgcttgtccatgccaacggcggaagccagcacgccggcgcccacgtagcgggtgtccgaaagttccagcagcccctggatggtgccgtcctcgccgaacgggccgtgaagcagcgggaaaaccacatcaacggttcccagctcctggggcacctcgttcggggatgccacgatcaactggtgttcccccccgatttccgccagggtgacggtctgcggtgacggcgccacctcgggcagtgccgttgaggacagggaccattgggcggtgtcggcgcccgcgaggacccactgcccggtcttggcgattccaatcggaatcacctcgtacttgtccttgttgatggcgccgagcacaccggcagccgttacgcagctcacggcgtgctcgctggagcggccgccgaaaagtaccgccacccggggttttgtccgcggtgcggtctcccccgcggccaggttttcgtgggacatcgtcagtaatcgccttcaggtttcagttcccgggacagcaggacgggccccagttggtcaacggacagcttgccggccagcacggcaacgacggcggctgtgatgggcatctcgacgcccagcttacctgccagctcatggacggcctggccggattttatgccttcggcggtctgggtcatcttctggcccacctcctccagcgtgaggccctggcccagcagccggcccgcggtgtggttgcgggagagcggcgaggagcaggtggccacgaggtcgcccagccctgcgaggccagccattgtcttggcctcaccgcccagtgccagggcgaggcgggacgtttcggcaagtccccgggtgatgacggacgctttggtgttgtcccccatttgcttgccctcgcagatgcccacggccagcgcaatgacgtttttcacgatcccgccgatctccaccccaacaacgtccgctgtggtgtacggccggaaatacggcgcggtgcagctcctggcgatccagccggcagcggcggaatcagtgcaggcaaccaccgatgcggttggttcttcgcgggcaatctccatggccaggttgggaccggacacgatggcgatgcgttcggcgggcaggcccagctcctcgccgatgacctcgctcatccgggcgtccgtgctgagctcaaggcccttcatcagggaaacaaccatggcgtccggcgcgatcaggcccttccattcccgcagctgcggcctcagcgactgcgccgggacggcgatgaccacgaggtccgcgccctccaggacggcggcgacgtccgtggacgccgagatgctctccgggagcgggatgtccttcaggtactgctcgttgacgtggctggtgttgatctggtccaccacttcggcgcggcggccccacagcctgatggtgcgcggatcgcctgcggcagccgctgcatcagccaggatcttggcgaacgtcgttccccaggagcccgcgccgaggacagcaacggaacgggccgagcccgtctgctttcccccagcggtcacggagtgtccgttccggtcccgggctgctgctgtccgcgttccatgaacctgccgtgctttgcctgctgctgcttggccgggtcccagcgctccgcaggaggctcttctccgcggatgtccgccaggagggcggtgatggcatccatgatggcatcggtggccccggtcagcgtggccttatcgaggggacggccggtgaaggcgctcaaatcgaccggttcaccaactactacccgcgatttcttacgcgggaacaggtggaaccgcttgccgtagcgggggaagacctcgtgggcaccccagtgggcgatggggaccaccggaatgccgccttcaagggcgagccgtgcagccccggtgtggcccttcatcggccagaggtccgggtccctggtgagggtgccctcgggatagatgatgatcgcacctccctcggcaacgatctcctgggcgagctggagggagcggttcgcccccgccgtcgaacgctccaccgggatctgcttggtagcccgcaggacccagcccaggaccggcaccttgaacaggccggacttggcgaggaagtgcggggcaatcctgtggttgtagaggaggtggccgacgatcaggggatcgatctcggtgcagtggttgggcgccgcaataaagccgccggcaggcagcttatcggtgccctcccacttcttgtccatcatgaggttgaacagggggcggactattgcggcgaccaccgcaagggtggcgcggctcttggccggttccttcacgtctgcccgctacttcgtggtggtgatgtcgaagtcggcacccagcccggccagcttttcggtaaaccgttcgtagccgcggttgatgatgtcgatgccggtcacgcgtgaggttcccgtggccgccagcgcggcaatcaggtggctgaagccgccgcgcaggtccggaacgtcgatgtcggtgcccttgagctgggtgggtccggagatcacggcggaatgcaggaagttgcgctggccaaaacggcacggcacgctgcccaggcattcacggtgcacctggatgctggcacccatccggatgagcgcatcggtgaacccgaagcggttctcgtagacggtctcgtggacgattgacacgccttcggcctgggtcagggccaccaccaggggctgctgccagtccgtcatgaagccggggtgcacgtcagtctccaggaccagcgggttgagcttaccgccgtggtggtagaagcggatgccgtcctcgccgatgtccatcccgccgcccaccttgcggtaggtgttcaggaaggtcatcatgtcccgctgggacgcgccttcaacaaagatgtcgcccttggtgaccagggcggcagaggcccacgacgctgattcgttccggtccgagagtgcccggtggttgtagccgccgaggtcgcggacaccttcaatgcggatggtccggtccgtctggacgctgatgatggcgcccatcttctgcagcacggcgatgaggtcgatgatctccggctcggtcgcggcgccggagagctcggtgatgccctcggcgcgggtggcgctcagcaggacctgttcggtggcaccgaccgaaggatacggaagggagatcttcgccccgtgcaggcccttgggtgccgagatgtggatgccgccggggcgcttctccaccacggcgccgaactggcgcagcacgtccaggtggtagtcgatggggcggtcgccgattttgcagccgccgagatcggggatgaacgcctcgccgatggcgtggatcagcggcccgcagagcaggatgggaatccgggagtcgcctgcgtgggcgtcaatggcagtgctggaggccgtcttggctgccttgggatccagcgtgaggtcgccgttgaccgggtccttgacaacggtgacgccgtgcagctgcaggagggaggtgaccacctccacgtccttgatctccggaacgttccgcaacaccgacggttcgttgcccagcaacgctgccaccatcgccttggggacaagattctttgctccccggacgctgacgcggcctgtaagcgggactccgccgcggattgtcagaacactactcatataccggtttccttacgatcactcgcccccaaatccttgcaaaggctccaaccaagcataggaggttgcgttaccgaaccgaaatacgcaggcgacggcggcagggcgtggcgcgccgccgtcgcacctttttaagacaggcaactctgcttcagcccgcggaggaaaggcgcgcaggcagggttttgggcttgaacgaaggccgcgtggcctcgtaggccgtgatgtccgcctcatgctgcagggtcagcccgatgtcgtcgaggccttccagcaggcgccagcgggtgtagtcgtcaatctcgaagggcgcaacgatgtttccgcacaccaccgtcttggacaccaggtccacggtgacttcagtccccggagcgttctcgagttccttccagatgagctcgatgtcgtcctgggcgagctcggcggcaagcagcccctgcttgccggagttcccgcggaagatgtcggcgaagcgcgaggagaggacggccttgaatccgtagtccttcagcgcccagacggcgtgctcgcgggacgatccggtaccgaagtccgggcctgccaccagcacggagccggcagtgaagggctccttgttcaggatgaaggacgggtccttgcgccatgccgaaaacagggcgtcctcgaagccggtccgggtgatccgcttgaggtagacggcggggatgatctggtccgtgtccacgttgctctgccgcagcgggacgccgattccggtgtgggtggtgaacttttccatggcgtgtcctaggctgcgtcggtgcggatggcggcggattcgggggccggatcaaggtccgacggcgagctcagggtgccccggatcgcggtggcagcggcgaccaccggggacaccaggtgggtgcggccgcccttgccctggcgtccttcgaagttacggttcgaggtggaagcgcagcgctcccccacctccagctggtccgggttcatgcccaggcacatggagcagccggcaaagcgccactcggcgccgaagtccttgaacacgcggtcaaggccctcggcctcggcttccagccgcacgcgcgcggagcccggaaccaccagcatccggacgttggggtccttttggcgtccgcggatgatgtccgcggcagcccgcaggtcctccatgcgggagttggtgcaggagcccaggaacaccgtgtccacccggatgtccttcatcggggtgccggcctccagccccatgtactgcagcgcacgctcggcggcggccttggcgttctcgtcgccgaagtcctcgggcgacggcacggactcggacagcgaaacgccctggcccgggttggtgccccaggtgacgaagggctccagggtgtcggcgtccaggtcaacctgggcgtcgaagacggcgtcatcatcagtgcgcagcgtgttccagtactcgacggcggcatcccagtcggcaccctgcggagcgtgcgggcggccctccatgaaggcgtaggtggtttcgtccggcgccaccatgccggcgcgggcaccggcttcgatggacatgttgcagatggtcatgcgcgcgtccatggacagcgagcggatggcggacccgcggtattccaggacgtagccctgtccgccgccggtgccgatcttggcgatgacggccaggatgatgtccttggcggtcacgccgggacgcagtgtgccctcgacgttgatggccatggtcttgaacggcttcagggagagcgtctgggtggccatgacgtgctccacctcagaggtgccgatgcccatggccagggcgccaaaagcaccgtgagttgacgtgtgggagtcgccgcagaccactgtcattcccggctgggtgaggcccagctgcgggccgaccacgtggacgatgccctgctccgcgtctcccaggctgtgcagccggacgccgaactccgcgcagttgttgcgcagggtctggatctgggtgcggctggtgaggtccgcgataggcttgtcgatgtccagcgttggagtgttgtggtcctccgtggcgatggtgaggtccgggcgtcgcagcttcctgccggccagccgcaggccttcgaacgcctgcggggacgtcacttcgtggaccaggtgaaggtcgatgaagagaaggtcgggctgggcgttggctccgtcaccatcacctttgcgcaccacgtgtgcgtcccagactttctcggccaatgtctttgccatggccatctcccttcactgctgtttggctgatgagctcaactgaatcaggacggcccgtcactgcgccagccgaaagatttgcatctcagatattgagacggcaatatcattacatggacaattctagtggagtcggtgtcattgataaagcggcccaggtgcttgacgcgctcgaagccggccccaccacgctggcacagcttgtggcagccacgggcctggcccggcccactgtccaccgccttgccctcgccctggtccaccaccgcctggtgagccgcgacatccagggccgctttgtcctgggaagccgcctggttgaattggcctcggccgcaggcgaggaccgtttgatcgcatccgccgggcccgtcctgatgcagttgcgcgacgccaccggcgaaagcgcccagattttccgccgccagggtgactggcgcgtgtgcgtggcgtcggccgaacggccgataggccttcgcgacaccattcccgtaggcacccagctgtccatgaaggcaggttcggcagcgcaggtactgctcgcatgggaagaccatgaccgccttctcgagggattgcagtctgcacgctttacaccgacagtcctggcaggagtacgacggcggggctggggccagagcctcggcgaacgggagccgggcgtcgcctccgtctccgcaccggtgcggggaccgtccggccgggtcatcgcggccgtctctatttccgggcccattgagcgcctcacccgccagcccggccggctgcacgccgaagtggtgtgcaacgccggacggctcctcaccgaagccctccgcaagaacaacgactgacgcccggcaaaggccgccacaaccagcccgcccggcgctaggatttcgccatgggcagctatgcggtttttctccgtggcatcaacgtgggcggcatcaatatcaaaatggccgctctgcgggacaccctccaggctgccgggttccaggatgccggaacactgcttgcgagcgggaacgtggtcctcaccagcaacctgggcggcgccgctgtgaagcgcacttgtgagaagtgcctccgggatgcctttggctatgacgcctgggtggtggtcctcgaggccggccgggtcgcagaactcgtggcggcgtgcccctacccggacgacaacaaggccacccatacctacatcacgctctcctcggatccggaagtgctcgatgaactcgatgcggccggggctgcactggaaggacaccagcaggagaggctggggccggaggcgctggcctggctggcaccggccggcggaaccctggacagccccttcagcaagatctccgcgaaagccaggttcaaggccgccaccaccacgcgcaacctgcggacgctgatcaaggtccgggacgcagctagctgtactgtcccggcaggttggtgacacggctggccggtggctgacccctgagtgaggtgtggcctcgatgatgattgtagtgatggagccagtcggggaaagcgttaacacgctcggcctctgatttgtaggggcgggcgtaggcccattcgtcgagcatggtgcggttgtagcgctctactttgccgttggtctgggggcggtacgggcgggtgcgtttgtgcttgatgtccgggcccagcgcgtctgtgaaggcgtgggagcggtagcaggagccgttgtctgttagcacccgcttgacggtgatgccgtgggattcgaagtaggcgttggcgcgtgcccagaaaccggctgccgtttctttcttttcatcggccaggagctcggtgtatgcgagtctggagcggtcatcgacggcgttgtggaggtagtggtatccgggtctgcggttggccgcggtaccggttctgttacgccagccggcggccctgccgaacgcgcggtggccgccgccgtcggggatccggccgagtttcttgatgtcgacatggatcaggtcccccgggcctgtcgtgttcgtagcggcggatcactcgtccggtgccacggtccagccaggtcagtttcgccagccggtagcgggacaggacccggtgcacggtggaggggtggatgcccagcagataaccgattcttgccggtccccagcggcggttcacacgcacggcgatgatccgccgctccgtacgtgttgccgtgcgccggggcgaacaatgcgggcggctggagcggtcctccatcccagccgggccgtgctcgcggtagcgctgtgcccagcgagcagcagttggcacggagacctgaaaccgctctgcagcccggcgcaggttccagcactgatcaacgacacattgcgcgagctgcagccgcccccggggcgtcagaagagcgttagggtgggacatgaagacctccgtgcgtggaattggactctagacaagccccactccacccggaggtcttcttcatgtcaccaaaccacgccgaacatcactaacgtccgtggtcaatacagctagccggctgcagccctcctgagcgcggcatcaaatgcggactgccggctgacttccagttccaccggttccaccacaagttcctgcgcaacagcagccactgcggcgttaagccgcctccgtgccctcgccgcccgtacattggccgcagcggcggctatgaagcggccggtgatggccaggaaaatacccagcaccacgcccccggcaatcatcagggtgggaattggccacccctccacccggggcacctcaggcacgggcatctggaaatagcccaaggccgccaggacgccgagccagccaagcccgcccaggacggtgagcagcgccagccactgcaccacgttgaaaactccccaccaccaggacttccggttggcagcgaggtctgttccggcgatggcctggtcaagtgcatcgggcagccgttcccgcccctcccttgccgctccccggatggcggcccgccagggcccgggggctccggtgctcgcggcgtcggcgaattcacgtacggcggcgtccgtgcgtgcccgctccggcgctcctgccggtggcagggatgtccggttgagttccgatggcgccgcgctgcgcagattgagccgccgcagcggatcagcacggaaccgggagagccaccgggtcaccggccagcccgtgcgcctgacggactccagccggtatgactggcccacggcgcggaccaccaccggaacgttggccgccacagccagttcgtcggccagccgggaaatggcagcaggccggacaccggccgcggtcccctcgccggacacagcgcccagttccgctgaagccctggtgatgtcggcagcaaggcgctgagactgggccttgcgcttgacggcaaccccacggatggcagcccggacctggtcaacgccggcccccgtcaacgccgaagccgcaagcacctggaccttggcaagtccgtcccgggcaaggatggaacgcagggattccaggacgggctgcacatcacgttccggcagccggtccacctggttcaggaccaccagggtcaccgcaccgtgggaagccaggcgggacaggaagtcgttatggactgccgcgtcggcgtacttttgcggatcaaggacccacaccaggacgtccaccattcccaccatccgctgtacgacttcacggttggatgccttggtggagtcgaagtccggcaggtccagcaggatcaggccggtgtcctcgtccgcgaatccttcgacggcggcggcgtggtggcggttgcggacgtccagccagtccagcagcggctcgctgccgtccgcaccccatacccctgccaaaggttccgacgtcgttggacggcgagctgccgccgtcgcaatttccgcgccgctgaccgcgttgaaaagggaggattttccgcttcccgtggcaccgaagaatcccaccaccgtatggtctgcagagagcgaccgccgtgaacttgcgcgctccaggacactgaagacttcctgcagggactcgtccggaaggacgccttcgccaagctcgcgggcgtcgttgagggcggagagccggcggtcaagccgggacgcctcgcgggtgtcgctgtggcggctcatgcgttgtccgccaggcgcaccagggcggcggcatgcgcggccagggtgtcgggggtgctgcggtcgtattccggcagccgggaaaggaacttgcgcctctcttcctgcagcaggacctgacaccgggtgtgaaggtcctcgcgcgctttttcggccatgcgcctgacggcgtcctcgccgaagacggcctccagcagccgctggcccacgacggcggttcctccggcgacgcccacctccagtccggtgagccccgccgtcatggaaaagacgacgatcatcagcgcggcgccgagtccgttgatgccgaaggacagccagcgggcctgcgtccgctttccctggccctcggtgcggatcatgtccatcagggcttcctgccaggcccggatctcagcggcggcgcggtcttcaaagcccggcgttgtgccggagaggtcatccgtacccagcagttggcgcccggcggggtcgttccgccagcgctggtcagtgtcctcggcggcattggcggcttcgtcaacaatgacagcctgcaggccggtctcgatggcagcttccaccctcacggcgggtgcgggttcaccacggaagaaggcacccacgcggtcgcggaaccgtcccacgttctgctcaagggtccggaagaattcccccgtacccacaaagtcctgccagcgggccagcacttctccccgcaggagcgcaccgtccctcgtggcatccaggatgcggtccgcagcgtcccggtaggccccgacggcggcatcctcaaggttggcggccgcgtgctgctgctcccgcgcggcctgtgcgacggcggagacgcgccctgccatggccctgacggtcccgttcaacgtccggcgggcgatgtcggaccggccggcggcgtcggcggccaggtccgacagccaggcccgcagcggctggactgccccggcgggcagcatgcccatcggatccagggtggtctccggaatgacgaacagctgcgccgcgccaaggccttcccggtccaggaggctgcgcaggtcctcgctgacctcttcttccgcacccgggggaaccctgtccaggacgacccccaccatgatgtcccgtgaagcggcgttgagaagcagcttccagggaacggcgtcggcgtaacggttggcagtggtaacgaagacccacaggtcggcggcggccaggagctgggcggccagcttgcggttgtcatccgagatggaatcaacatccggggcatccaggacggcaattccggcgggcactcccgggtctgccacgaggacaagggaagacattgcggctgcatccggcaccgctcctgcccggtttgccggcacagggctgttggtgacgaaaccacggatcctgctgaggctcggcagcacgcgctgtccctcgaaccagtccgcctccgacgggtggtgcaggaggatgggctggcgggtggtgggacggatggcgcctgcgcgggtgaccgggtgccctacgatcccgttcacgagggttgacttgcccgctcccgtggaacccccgacgacggccaggagcggagcgtcaaggcttcggtaccgcggaaggatgtagtcatcgagctgggccacggcagtggcggcctcacgccgggcctgctccgagtcaggcagggcaagcggcagttcggtagcggccagatccccccgcacctcttccagcagcgctatggctgccagggctccggcgctgcccgtgggcgtgcgctgcgcggggtgcgggtggtcctgctcgttcggggaggtcacagcaacatcatgccagttcaggctccacacggccgcagttccggtgcgcgttgccggtgggctccagcacacaacgaaaaatggccccgggcatttgcccgggaccatttcgtttggtgaccccagcgggattcgaacccgcgttaccgccgtgagagggcggcgtactaggccgctatacgatggggccgtgtactttaccgtacttttaccagcgtttccgctgatcaagctcagtgattgtttcacacacttcgcttcagtttcaaatcggcgaaccgcctgaaaccttccgttttgagctgaaaatcagtgctcaaaccagagctgggataccaggactcgaacctagaatgacggtaccagaaaccgtagtgttgccaattacaccatatcccaatgatactttcgggccggttttcagggcttttaccctgctccgtgcgcctcagcacgagaaattactttacccgagacttcgtgctcgcacaaatcggcttccggcgtgccggtcgtggacgcggaccgggcggacgcccggcccgcgctgagcgcccttaggcgatgagttcgcccagtgatgacaccatgttgccccggaattcctgcacctgctcccccgccctgttgagccagacacccaagaggccggccgccgtcgagccttctgcgtccagcaggcggttgtcacccacgtagagcgtttccgcaggtccggtacccaggagccggacaccttccaggtagatggacggatcaggctttgccacacccagcgtgtccgtccccaccaggcgcctgacgcgttcaagtcccgcaccgtccagcttggcgcgctgatagtcgtggacgttgttgctcacggcgccgtaagggacgccggcctggtccagcaggtccagcagcggcatgacatccggaaacggcttcacgtaggcaggctgtttttccacgtatgccgtgagccactggtgggattgctcaccttcggcaagctcaaccccgaagtggcccaaagcagcgcggccgcgcagcagccgctgctcgttgaacgtcagttccccggccagatagcggtcgtaatagtgggtggtttcgtgcgtgaagatgcgcccgaaccgctcccatccggcctggtccattcccggcagcaggtgttcgctgacctcccgaagcgctgtggtcatcgaaaactcgaggtccaccagcgtgtcgtctatatcgaacaggatcccgcggactgccccgaagggcgtgtccaggacaccggcgcctgacattcgggtagctgccatcgctgtgcggtcatcagccacggaaggcccggagcctgcgaagggaggattccctgcccaggatcaccatggactcgaacagcggcggagaaatgcgccgtccggaaacagcggtacgcacgggtccgaaggcgagccgtggcttgaggccgaggtcttccacgagggcctgcttgagagctgcctggatctcttcggcggtccactcctgaacgctgtccagggccgcaatagctgcatccagtacctcgtcgaggttctgcgggaggcctttccgggcgtcgtcggcaacgtcgatggcgtcgtcatccttgaacaggaatccgagcatgtccggggcctcgcccagaagcgtgatgcgctcctggatcagcggcgcggcttcggtaaggatgtcctcctgccgtgcagtgagttcctcccccacgtagcccgcagtgcgcaggtacggcaccagccgctcccggaagtcctccggagcgagcatccggatgtgggtgccgttgatagcttcggccttcttgatgtcaaaccgcgccgggttggccaggacgtcgtggacgtcgaagttttcgatgagctggtccacggtgaagatgtcctcatcggcggagaggctccagcccagcagggacaggtagttcaggaggccctctggaatgaagcctcggtcccgcaggaggaacaggttggactgcggatcccgcttggagagcttcttgttgccttcacccatgacgtagggcaggtggccgaactccggcatgtagctggcaacaccgagttccatgagtgcgcggatgaggacaacctggcgcggtgtggaggacagcaggtcctcgccgcgcaggacgtgggtgatgcccatcagtgcgtcatcaaccgggttcaccagtgtgtaaaggggggaaccgtcagcgcggacaatgacgtagtccgggatgctgccggccttgaacgtgatctcgccgcggaccaggtcggtaaaggtgacgtcctcatcaggcatccggacccgcagcacgggcaggcggccctctgccttaaaggcggccacctgttcttcagtcagctcacggtcaaggttgtcgtagcccagcttggggtcgcggccagcggcgcggtggcgtgcctcgacttcctcgggggatgagtagcactcgtaggcgtagccgccctcgatcagcttggccacgacgtccttgtagaggtccagccgctgcgactgccggtagggctcgtggggaccgcccacttcgacgccctcttcccacgtgatgccaagccacttcagtgcctcgagcagctgcaggtagctttcctccgagtcgcgcgccgcatccgtgtcctcgatgcggaacacgaaggtgcccttggtgtgcttggcatgggcccagttgaaaagggccgtccggatcagcccgacgtgcggggtgccggtgggcgacgggcagaaccggacccgcacgggcgtgtcggcagaaacggagggcagggaggcagcattcgacgcggaagcagtagtcatagtggctccaactttaccgtctgccgccaggggtccgggcggcccgggcgtcagcggcggactatggggttggacaggcggccaatgccctcgatctcaacctcgaagcggtcaccggccttgaccaggcccactccggctggtgttccggtcatgatgacgtcgccgggcagcagggtgaaggcctgggacacgacggacaccagctcgcggaccccccggatcatctggctggtgctgccgtcctgccgcagttctccgttgagccggccctggatctgcaggtcctcggtgtccaggtccgtctcgatccacgggccaagcggcgccgaggtgtcaaagcccttggcccgggtccactgcaggtcggtcttctggacgtcccgggctgtgaggtcgttgccgcaggtgtagccgaagatgacatcgtccacgcggtcttcgggcacgtccttgcagatccgtccgatgaccacgcacagctccgcctcaaaggacacttcctcggagaagtccggcagcaccacgggatcgttggggccgacgacggcggtgttcggcttcaggaacaggagcggctgggcggggacttcattgccgagttcatgtgcatgctccacgaagttgcggcccacgccgatgaccttgctgcgggggatgatcggcgccagcagccggacgtcctccagcttgtggcggacggaggttcgctccacgccgttgaagaaggggtctccatggatgacagtgatttcctcactgccggcgtcaccttcgacgacgccgtaaaggggatcagaatcaacaacaaacctggcaatacgcatggctcctaccctaccgtctcgccgggcgtggctccccgggcctgctgctgccctgcgtctccccgaaggtagtgaagctgggccgagacggacgtttcggccgcgcgccgcacggaagggtcgacgtcggcatagacgacgtccgcgacgtcaccggcggaagcttccgggccaaggctggccagggcagcacgcacctgttcgagccgttccaggcggtggcttcgataggcccgggcaacgtcagccagtgacggaagggtagggccgtgggcggggaggaccgcggaaggcccaagagcctccagcttgtccagcgaggcaaggtagtcgcccagggtgccgtcagggtagtcaagcatggtggtgccccggccgaggatggtgtcgccggagagaaccgaaccgtgcgggccgtcaccgggaaggtggaaacagaccgaatctgacgtgtggccaggagtagccaccaccctcacctcgagccctcctgcatggatcacctggccgtcctttaggggaacgcccccgccgtggcagtgggcagtgtctgccgcccgcaccggggcaccggtcacctggtgcagccgtgcagcaccggcagtgtggtccgcatggcggtgggtcacgaggaccagctcaacaggcccggccgcggcgagtgcctgaaggtgggcctcgtcaagcggcccaggatcgaccaccacggcacccgggttgcccggtgccctcaacacgtaggagttggttccctccaggctcatggggccgggattgggagccaggacgaaccgcgtcagggcggagctgcgctgcaggacgggaccggaagctgaagtcaccatcccatccttgcactgcatgctgagccaggtgagttttgcccgccggaatagaacagcccgcggcccgggttgaccatcaaggaagaccacatgttccccaccaggaagccggaaccggacaccatgagcacaaccacccttgctgacctcctcgccgatgctgacgctgctggccacgaccatgctgcgaccgagaagaacagcggactccaacacatccacaaccacgcgaccggcagcattgtctggtttccaacgtggaagaagtaccgcgaaacggccgattggagcgtagccgtggacggcctcaccggagatttcagctcagggacggccccagtggaggaatccgcttccgagctcctggcccaggaccttgacctgctgctgaccagggcagcttcttccggtgacgccaacatctttgtgcaggagaacctggttcagcacctgacgcggacctgggctgttggcgacgccgccgcgaaagccaaggggcaggacctgcccaccggaagcactacaccgtccatatttgccggctacccctacgacgtatacgcccaggatggcggcgtctttgcgacaacgctgtggaacgacatccttgatgcccgccgcaaccaggccatcgccgaagaggcggcccggaaggcgctgaagccggtttcccggaaggcgctgaagaacgctgcccgaaaggccgcccggcgctgatcagccgaccggcatgctgccgaacgaacggcgcctgccggacccaagtccggcaggcgccgtcgtgcgtttgcaaataccctgctacgccaggcgggtcagccagccatgcgtgtccggcacggtgccggtctggatgccgagcagctgctcgcggatggccatggtggtctcccctgccttggcctcctccgagccgatgaactcggtggcgtccttgaggactccgatcggcgtgatcacggctgccgtgccgcaggcgaacacctcggcaatgtcaccggaggcgacgccgtcgcgccattcatcgagggtgatcttgcgctcggtgacgtcgcggcccatgtccttggccacctggatgacggacatccgggtgatcccttcgaggatggtgccggtcagcgccggggtgaccagcgagccgtccttcatcacgaagaaaacgttcatgccgcccagttcctcgaccgcgttgtcattgaactggtcgaggaagaggacctgcttgcagccgttggcctcagcctcctgctgggcgatcagcgacgccgcgtagttgccgccgcacttcgcatcgccggttccgccgcggccggcgcgggcgtactcccgtgagatccagatggacacgggcttcagttcgccgccgaagtagttgccggccggggaggcaatcacacggaaggagacttcccgtgcggcgcggacgcccaagaaggcctcggtggcgatcatgaacggccgcaggtacagcgcctcaccttcgccggcggggacccattccttgtcaatggcaaccagctcacggattgccccgaggaagtagtcggccggcagttcgggaagggcgagcctgcgggcggacttgttcaggcgtgcagcgtttgcttcgggacggaaagtccagatggagccgtccgcgtggcggtacgccttgagcccttcgaagatctcctggccgtagtggaagacggcagccgacgggtccaggacaatgggcccgtacgcctctatccgggcattgtgccagccgccgttgccgttctcgtccacgctgtagtccacgatggcggtgtggtcggtgaagtggttgccgaatcccgggttggccaggatggctgcacgctcttcagcagacttcgggttggccgagggctgctggctgaattcgacgccatgggcagtctgagtcatggttcctccacgatcggccgccccgggttcagcgctgaacggcaaggcggcatttggtgattcgagacaagcttacgcccgatgcctgcggctccggcgcgggttagagtccggccgcgatggcatcgcctacggcactcgtgctgcgggcaccgccgtcgcgcttttcgacgtcggcaaccactgccgcttcgatcttgcgggccgcagcggcgtagccgaggtggtccagcaggagtgcggcggacaggatcgcagcggtggggtcggccttgccctggccggcgatgtccggggcggagccgtggaccggttcgaacatggacggcgccgtgcggtccatgttgatgttgccggacgcggccagcccaatgccgccggtcacggctgcggcaaggtccgtgaggatgtcgccgaagaggttgtccgtgacgatcacatcgaagcgcgacggatccgtgaccataaagatggtggcggcatccacgtgcaggtaatcgtgggtgacatccgggaactcggtggccacggcctcgaccgtgcgcttccacaggtgtcctgcgaagaccaggacgttgtgcttgtggaccagggtgaggtgcttgcgctcccgggcgcttgcgcggcggaatgcatcgcgcacaacgcgctccacgccgtgcgcggtgttcagtgagacttcggtggccacctcgtggggagtacccgcacgcagggtgccgccgttgccgacgtaggggccttcggtgccctcgcggaccacgatgaagtcgatggctcccgggttggcaagggggctgcccacagtgccgtacagcttggaagggcgcaggttgacgtagtggtccaggctgaagcggagcttgagcagcatttcgcgttcgatgatccctgacgggatccgcgtgtcgccgggggccgcgcccactgcgccgaacaggatggcatcccgcgtgcggaggtcctcgaggacttcgtcgggcagggtctcccccgtggccagccagtgctcagcgccgagcttgtagtgcgtctgcttgagctcgacgccctccgccgccacggccttctcgaggaccttgactgcctcggcaatcacttcggggccgatgccgtcgccggggataactgcaagatcgatggaggatgcgctcatattttcagggtagccaagttatccaaatgctggtcaagccgtctcactatccgaacacccggcgacgctctctcacttaatgcaggtaaacaagcaacgctctatcaccgcctgttcagcggtgagagagcatcgggcaaaaacgcacattaagtgagagagcgtgctgagggtcagggcccggccggctcctcgtacttggggaacaccggcgagggtgcgggcagctcggttccggaaacaatccgcgtggggatcgctgcgaactgccgggcttccccttcgggctggccgagcgtggccagcagggctcccgttgcccggggcatgaccggctgtgccaggatggcgacgatccgcagcacctcgagggtcacgtacagcaccgtattcatgcgttcgacgtcggtcttccgcagcacccacggcgcctgctccgcgaagtaggcgttcgtgtcccccaggacaccccagatcgcctcaagggcgcggctgaactcctgcttttcaaaagctgcccgtgctgctgcgaggagggcgtctgcctgggccaggatggcagtgtccgcggcggtgaactcccccggggtgggaacgcgcccgccgcagttcttggccaccatggacagcgaacgctgggccaggtttccaaaattgttggccaggtcagagttcatcctgcccacgattgcatcgtggttgtagctgccgtccgcaccgaagggcacttcccggaggaagaagaagcgcacctggtcaagtccgtactgcgccacgaaatccgctggagcaaccacgttgccaagcgacttggacatcttcacgccgttgttgtgcaggaacccgtggatcatcacccgcttgggcagctcaaggccggcgctcatgaggaaggcgggccagtagatggcgtggaatcgggagatgtccttgccgatgatgtggacgtcagcgggccagtacttccggaatttctccgagtccacgtccgggtaccccacgccggtgaggtagttggtcagggcatccacccatacgtacatgacgtgcttgtcgttgcccggaaccgggacgccccagtcgaaggtggtgcggctgatggacaggtcctccaggccgcgcttgacgaaactgatgacctcgttgaagcgggattgcggcgcgccgaattcgggctgggcctcgtagagggcaaggagcttctcctggtaggccgagagccggaagaaatagctctcctcagccgtccaggtcacctcggtgtccgtctccttggaataccgcacgccgtcgtccttgactacggtgtcgtcctcgccgtagaaggcctcgtcccggacggagtaccagccctcgtacttggacaggtagatgtcgccgttggcttccatcttcttccagatggcctgcgacgcggcgtagtggtccgcgtcggtggtgcggatgaagcggtcgtacgtgatccccagggcggcgtgggcacccttgtagatctcggcgttccggtccaccagctccttgggcgtgatgccttccttttcagccgtctgggcgatcttcatcccgtgctcgtccgtgccggtcaggaacatcacgtcaaagccgtccagccgcttgaagcgcgccatcgcatcggtggcaatgtactcataggcgtggccgatgtgcggcacaccgttggggtaggtgatggccgtggtgatgtagaacggcgttttctctgaagcagtcacgtggaggacgttaccttcggtggggagggacaggctagatgagttcggtcagggtatcgctgagccggacaagttcgtggtcgtgcgaggccaccagcacggcgattccgtcggaggtggtgtccttcaggatgctgatgatgcggttagcggaagcgcggtcaaggctggcggtgggctcatccaccaccaggacccgggtgcccaggatcagggcgcgggcaatggccacgcgctggcgttcgccgccggacagctgggcgggacggtgccgcatgcgccggcccaggccaactaggtccagcaggtccttggccatgtcccgccgctggtccacttcgccgtcgggaacggccgggaggagcacgttctcgagggcgctcattccgtcgatcagggcgccgccctggtcaacgtagccgatgagcgcacgacggcggtccgcaatttcgtcgtcgcccatgctttcgagcgaatcgccttcccagaagacgcggcccgacgtcggcagggtcagtccggcgccgacagtcaggatactggtcttgccggaaccgcttcggccggcgacacagtgcatctcaccggcgtgcagggtcaggtcgaagccttccaccacgctgacggcttcggcgccgcccttgccgccgccatagcggatagtgatgtcgctcagttccagcggcgtggcatggtcggcggctttgacgatggtgttggcccgggtctgcagggggacctcaccggagccggaccggcggctccggtggacattggtcgggtttgtcattggaccactttcgttgcaatcggtatccagcaaagtacagccacgaggccggccacgcccgcccacagcgcggcatagggtgccagcagcaggccgatgcccagggcgcccaatacgcccaggggcagggccatggttcccaccagcgcgttctcgaacaaacggacctgccggagcatgtccgggttccagcccatggcctcgaggatgccaaggtactggcgcttggcattgagttcaaaccgcccggtgaccagggtcagcaccagcccgacggcaactccggcgagggcaaggaggatgctcggcaaggcaacgctggccgctgccaaaccgctcagtgcactggcgccggcagcgcgcgggatgtcgatgagcagggcggccaggccgcctgctgcagccccgaacacgcccacggctacggccagggacagggtgttgaatttgttggtgctcagctggcggttggcgaacgtcagcggtgagtccaccggaatcagccgttcgtcatgctgcggttcctggtcgacctcgtcacggtggcgcagctgctgtgcggcgaagaacgccgccgccgcgtacagcaccaggaccgacgcggacaccaaggcggtggaaaggctccagctggccaggctcagaacgatcccggccacggccagcaggaccgcgccgacgccgaattcctccagcacccagcggcggatccggccttgggtccaccccatggcacgcagggttccggcttcgctcttgcgcttgcggatatagctaaccgtggatgcgccggtcaggagggctgcgccgcagagcgtcaggaagagcagggtgatgttggtgccggacagcgacccggtgacggcctccgcggcgttctgccggacccaggactgctggacggtcccaagggcggattccttgccggcgtcgtccttgctgtagcccggaacgaagatgctggcatcctcccgcgcggaaccggccacgatggtggcctccaggcccatctcgcggatctcgccggccagctgttcgacgtcgggctgcgcttccttccagctgccgggcgccgttgcacggacccggacggcgtcgatgacgttggcgttttcggtgaggccgcgggcagcagcaaggccgtagtagtcggtgatggcgcctgcggactggctggcgagcccggtggcgctcaaggagggttcaagttccgtggcggggacttcgttgcccgcagcgtccttgaccagcgtgaacggggtggggtcgtagccgcccagcggcagcttgttgacgtccccggcggcagcggcaaccgccgagggatcgaaagtgccgtagaccatggcgagcggggcggctgcctgctcccctgtttccaggttctcccggtaggagcgctcatccacgggctcgcgctgggtctggtcaacgggcatgccgttggcgctcttctcgggaagccggttgacggtgacccattcaccgggcactgccgtcttttgctcggcaccgttggcggctgcttcgccatcggtgtacttgggcgccgcggcaaaatcggtgctccaggtggcgggagtgtaaaggccctggttgaagttgccgctgctgccgagcagtgaggagtggtccgtggaacccggccaggacaggacgaaggggtccttcgaaacgaaaggcaggtagtccttgtccagggaacgggagacggtgccgacgtccttgatgaccttgccggcgtcgtcaatctcttcgatcttgacgttgtacttcaggtccagggacgtcccggacctgacgatcaggggaatggcctgggaatcgtcagtcagctgcccgttccgcttggcctgctggtactgggtcatcagcggcgcccagtacttgagcttgacgccgaggaaatccggtccttcctccagctcgtccaggctgatgccgttggtgaacagtccctcgaggtaccgtcccaccgcgccggcgtcgcgggcatcgcccggtggcgccttttccagcggggacaggaagtcgccggcggaacccaggagggcgcgttcggcagccggatcgacggcgaccacggactccgttatttcgggggccatgggcagcgacacggaaaggttgaaaaggttgtgttcggagccgccggccggggcgggaaacttgatcccggtttcgtccccgggcgctgcgatgcggatgctgctgccgccggccgtctgctcctccacgagtctggccttgccaagggtgccttcggcggtggacttgaagagggtctgctcggagacgccgtcggagctgactgcgctggccgtcaggcggtacttcctggtttcatcgcccaggaccgattcggccgccggccactggtccggggcggttgcccccgcggcctggtccgcggtggcggtgccggccagcccggcgttgtagccgagaaagtccattgcgtcgaggcgcggggattcaaggttctgggtcacgcgggagaccaggctgatcggggctgccacggaggtaccggtgagattcctgatggcctccagctgctcaaagctgatgccgcccgagccgttggcgatctcgggctgcaggagcgaaccggagggtgccttcgcctggaccaggacgtcgtagaggccgcgtgaattttcatccacggtcctgttcagcgcggcctgggattggctttggacaaggaccgacaagcacatggctgcgatcaagatggccgcggtcaacagcagcactttgcttctgatgaacctctggacggcgttcatggaactccctgaaacctggattgcgtgcgcacatacgcgccccgcccatgcggacatggacggggacggatgagcaaaagtattggccggcctgccggcccggtcccgaaccaggacccagccattgtaagcagaccggccaatcatacgtggccgtgccgggactcgccgcgggcggccggcggtgcggtgtttcccggagtgcgggttagtcctccaggtccacttcacgcaccatctcggcgccgatgccggccttgatggcgtccagaacctgctggggtacggagctgtcgatggtcagcagggcaagcacctggccgccttcgtcagagcgtgccacctgcatgccggcgatgttgatgttgttcatgcccaggatgtggccgatagttccgatgacgccgggacggtcggtgtaggccaccaccacgaggtgctcgctgatcgggatttcaacttcgaacccgttgatgccaacgagcttctggatctgcttgggtccggtcagggtaccggccacggagatctgggtgccgtcgctgagggcgccccggagggtcaggacgttgcggtacgactcggtttcgggtgtggtgatcaggcggacgttgatgccccgctgctcagcgatgaccggagcgttgacgtaggaaacctgctcggtcacgacgtccgcgaagatgcccttcagggcagccagttccaggaccttgacgtcaagggacgagatctcgccagccacttcgacgtcgaactgggtcagggaggcgtgcgtcaaggcggtgaagatccggcccagcttctcgatcagcgggatgccgggacggacatcgggggcgatgacgccgccggccacgttcacggcgtcgggcaccagttcaccggcgagggcgaggcggaccgacctggcgaccgaaacgccggccttttcctgcgcttcgtcggtggaggcgccgaggtgcggggtgaccaccacgttgtccagcttgaagaacgggaggtcggtgctgggctccttggagaagacgtccacgccggcgccggcgatttggccgtcctgcagggccgtgaagagtgcttcctcgtccaccagtccgccgcgggccacgttgacgacgtaggcggtgctcttcatctttttgaaggcgtccgcgcccagcatgcccaccgtctccggcgtcttgggcatgtggatggtgatgaagtccgcctgggccagaagctcgtccagtgtcaccagctgcacaccaagctgggccgcgcgggctgaggtgatgtaggggtcgtacgcaaggatcttggtgtcaaagcccttcagccgggcggccacaagtgcgccgatccggcccaggccgatgatgccgatcttcttttcgaagagttcgatgcccgtgtacttggagcgcttccactcgccatccttcagggctgcgcttgcctgcgggatgtggcgggccaggctgaggatgtggccaacggtgagttcagctgccgaaacgatgttcgaggtgggcgcgttgaccaccatgacgccggcctgggtagctgccttgatgtccacgttgtccaggcctacgcccgcgcgggcgatgaccttgaggttcttcgcagccgcgatcgcctcggcgtccacctgcgtggccgagcggaccaggattgcgtcaacgtcgccgatggcggagagcagctgggaacggtcggcaccgtcggtctggcggatctcgaagtccgggcccagggcctcgacggtagcgggggaaagttcttcggcgagcagtactacgggttttgacacggctgatcctctgcgttgcagtccgggggataaaaacaagtctaggccgacggaaaggccgggctcacattgttaagtgtgaacccggcctcacagtctgcctttataacggcaccttgggcagccttagcgggctgcggaaccttcgacgtagtccacgtcctgctgctgccaggcgaagagggagcgcagttcgcggccaacagcctcgatggggtgctgctcagccttggcacgcagtgccttgaactccacgccgccgttgtcctggtcctcgatgaagcgcttggcgaaggcaccggactggatgtcggccaggacagccttcatgttttccttcacctcgggggtgatgacgcgcggaccggagacgtagtcgccgtactcagcggtatcggaaacgctccagcgctgcttggcaatgccgccctcccacatgaggtcaacgatgagcttgagctcgtggaggacctcgaagtaggcaatctggggctggtagccggcttcggtcagggtttcgaagccgtactggaccagctgggacacgccgccgcacaggacggcctgctcgccgaagaggtccgtttcggtttcctcggtgaaggtggtcttgatgacgccggcgcgggtgccgccgatggccttggcgtaggacttcgccaggtcccaggcggaaccggtggcgtcctgctcaacggcgatgatgtccgggatgccgcggccggcctcgaactcgcggcgtacagtgtggccgggagccttcggggcgatgaggatgacgtcaacgccctccggagcctggatgtagccgaagcggatgttgaaaccgtgggcgaaggcaagggccttgccgggcttcagcttgtccttgatggagtcgttgtagatcgagcgctggtgctggtccggcgccaggatcatgatgacgtcggcccattcggcggcgtcggcaacgttcttgaccgtgaagcctgcgtcctcggccttggcgatcgacgtcgagccctccttaagggcgatggcaacctcgacgccggaatcgcgcaggttgagcgcgtgggcgtggccctgggagccatagccaacaatggctaccttgcggccctggatgatcgacaggtcggcgtcgtcgtcgtaaaacatttcagtcacttgcgtaactcctcttgagtggattgtagataggtgtcttgtggtgcggttgcgggcgttgcctgctgccgggcagggcccggcagcgtcctaggcggaacgcaacgccctgtcactcatggagcgggatccccgtccaacggccagggtgccggactgcacgatttcgcggatgccgaagggctccagcactgagagcagcgctgcaagcttctccggagtaccggttgcctcaatcaccaacgagtctgtggacacgtcgacgacggcggcacggaacaggtctgcagcctgggtcacctgcagacgtgtcgcggcatccgcacgtaccttgaccaggatgtggtctcgctgtacggaagattcagaggtcagctcaacgatcttgatgacgttgatcagtttgttgagctgcttggtgacctgctcgatcaggtcgccgtcggcgtcgacgacgacggtcatccgggagatgcccggaacctcggtggggccaacagccagtgagttgatgttgaaggcacggcgggcgaagaggctcgcgacgcgggtcaggacgccgggcttgtcttcaaccaggacggagagtgtgtggcggctcatggtcagtcctcttcttcccattccggggtcatgttgcgggcaacctggatctggtcattgctcacgccggcgggcaccatcggccacaccatggagttcgggctcaccacgaagtcgatgaccacaggccggtcgttgatttcgagtgccttctggatggtggcgtcgatgtcctcgtcgcgttcacagcggaacgaggcgcagccgtaggcctcccccagcttgacgaagtccgggatgcggacggtgtcgtggccggtgttgaggtccgtgtttgagtaccgcccctcgtagaagagggtctgccactgccggaccatacccagggaggagttgttgatcaccgccaccttgatggggatgttgttgatggcgcaggtggccagttcctggttggtcatctggaagcagccgtcgccgtcgatggcccagaccacacggtccggctcgccgaccttggcgcccatggcggccggaaccgcgtagcccatggtcccggcaccgcctgagttcagccaggcgtgcggacgctcgtacttgatgaactgcgctgcccacatctggtgctggcccacgccggcaacgtaaacgccttcggggccggtcagggcgccgatgcgctcaataacccgttgcggtgcgctgagcccgtcatcgggttcggtccagcccagcgggtaggtctccttgaggttgttcaggaaagcccaccaggtggtgaggtccggtgttccggatgcctcgaactgggtgcgcacagcgtcggtaagctcggggatgatttccttgacggacccaacgatgggcacgtccgcggtgcggttcttggagatctcggcggggtcgatatccgcgtggataaccttcgccatgggcgcgaaggtcttgaggacaccggtgacgcggtcatcaaaacgggcaccgagggtgatgagaaggtcggactgctgcagagcagtcacggcagagacggtgccgtgcatgccgggcattcccatgtgctgcgggtgtgagtccgggaaggcgcccttggccatcagcgtggtgacaaccggggctccggtggcctcggcgagtgccagcagttccgccgaggcgtgcgccttgatgacgccgccgcccacgtacagcacgggcttgctggcagctgcgatcagcttggcggcctcgcgcacctgcttgctgtgcccgcgggtaaccgggcggtagccgggcaggtcgatcttcggcggccaggagaaggtcatctggccaacctgagcgtccttggccacgtccacgaggacaggaccggggcgcccggtggaagcgaggtggaacgcctcagccatgacatgcgggatgtcgttggggtccgtcaccaggaaggagtgcttggtgatgggcatggtgatgcccacgatgtccgcttcctggaacgcatcggttccgatcacgccgctggacacctggccggtgatggccaccagcggaacggagtccatgtgggcgtccatgatggcggtgacgaggttggtggcgcccgggcccgaggtggcgatacacacgccaacccgtccggtcaccatggcgtagccttgcgcggcgtggccggctccctgttcgtgacggaccagcacgtgattcatgctggaggccatcaaggggtcataggtgggcaggattgcgccaccgggcaaaccgaaaatatcgtcgacgccgagttcttcgagcgagcggacaatagcttgcgagccggtcatcaccgttgggggtacaacgttgttcggcccaaggacaggagaggcagcagcaaggtcggcagcgacgacggcctggtcagccgcccggtcggcgcgttccggagccttggtggctccagcggacttagtagccatcagcgaggggctgatcggcgatcctttgctcatcggactcttccttgtggatcatctgtggttcgtggaaactgcaggaaataaaaaaacccctcagcctggcggctcttcgaggggttgcgcgtgacggttcgttacccggggctaatgtgccacgcgcttggtaaggacgacgacgatgccggtaacgaaagtcatgcgttcagttttccctctgggcaagatgcgtgtcaacgagctgccccgcgatctcaccatgtggacctcattgtccactctttggctggctcccccaactaagtagcagcaagtgtcgttttgagcgtccaaaacgacacttggcgctacctagttgggattagccgccgaaacgcagctgctacccgcagtatgcgcctgtgctggcgctgtgcaccagcttggcgtacttggccaggacgcccttcgtgtagcgtgcgggcaggggctcccagcccacctttcgggcttcgagctctgcctcgtccaccagcaggtcgaagctgcgggcggcgatgtccacgcggatcctgtcgccgtccttcacgaaggcgatggggccgccgtcgaccgcttccggggcgacgtggccgatgcacaggccggtggtgccgccggagaacctgccgtcggtgaggagcaggacgtccttgcccaggccggcacccttgatggcgccggtgatggccagcatttcgcgcatgcccgggccgcccttggggccttcgtagcggatcacgacgacgtcgccggcctggatctggccgttgtccagtgcgtccagggcgccctgctcgcgctcgaacacccgggcggttccttcaaagacgtcggcgtcaaaccctgcgctcttcacgacggcgccttcgggggccatagtgccgtgcaggatggtgatgccgccggtcttgtggatggggttgtccagcgcgcggaggatcttgccgtccacgtccggcgggttgatggcctcgaggttttcggccacggtcttgccggtgacggtgaggcagtcgccgtgcagcaggccggcgtcgagcagtgccttcatgatcacgggcacgccgccgatcttgtccacgtcggtcatgacgtagcggccgaagggcttgaggtcgcccaggtgcgggatcttgtcgccgattcggttgaagtcatccagcgtcagctcgacttcggcctcgcgggcgatggccagcaggtgcagcacggcattcgtggagccgccgaacgccatggtgacggcgatggcgttctcgaaggcctttttggtcatgatgtcgcgggcggtgatgccctggcgcagcagattgacgacggcttcgccggacttgcgggcgaactcgtcacgacggcggtctgccgagggcggggcggcggagccgggcagggacatgccgagcgcctcgccgatgcaggccatggtgttggccgtgtacatgccgccgcaggcgccttcgcccgggcagatggccttttcgatgcgcgtcaggtcttccatgctcatcttgccggcggcacacgcgcccacggcctcgaaggcatcaatgagggtgacttccttctcggagccgtcctcaagcttgacccagccgggcatgatggagccggcgtagaggaacacactggacaggtccaggcgggctgctgccatgagcattccgggaagcgacttgtcacagccggccagcagcacggatccgtcgatccgctcagcctgcatcacggtctccacggagtcggcaatgacttcgcgggaaaccagggagaagtgcatgccttcgtggcccatggagatgccgtcggacaccgagatggtgccgaactgcatggggaaaccgccgcccgcgtgcacgccttccttggcgccctgtgcgagccggttcagggataggttgcaaggagtgatctcgttccacgaactcgcgacaccgacctggggttttgcgaagtcgtcgtcccccatgccgaccgcgcggaacatgccacgtgcgggagccgcgtggattccgtcggttacaacccggctccggggtttgatgtcaggcttgttctcggttgcgatgtgggtgtcactcataggggaaagtctatggctccgccgaacggcgcaacgacagatcaggaacgtttgggtgcaaaaaacagaaaatttcattcaggttatggacatgcatctcagataatgagatgaaccggggctgccctcccccgcctgtggcgcggcccactggggttggccgcctgcgctggcacccgccaaccgccccgtcaatctggacagttctgaccgccggacgtagcgtcggggaaagtacaccttgccatccggactgaagggcttgccatggatttcgttttctggatcattctgcttgttgtcatcgtgggcgtcgtgtggtggctgctcaaacgcaacagttcatcctcggcaccgggggcctccgccccggagaagacccgcgcggacggagcgctttccgggggcagtgccgcagcgtccgctgaagctgccggaactactgggattgccggggcagcaggcttcggccgccccgccgagcccgtggcccccaccaccgccgatgatcatgccggagcaacggcatcggcccgcgaggcggagacggcgcagcccaccggcacgaaggcgcgggaaggttccggcgcttcctccgcggccgccgcagcaaccggcgcgtctggtgtctccggatccaccgccgccccggcagcgtccgggcaggacgtaagccgccaggacgacgacgagtgggagacccagtggtctgaggcttcgggctcctcggcagtttcccccggcgcggcatccaggggcggcggctcgacgggcggcgttcccacccaggcagcccaggttaatccggccgccgaaagcgaggtggccgctgcaacggggcaccaggcggaagctgcggcagcgccggatgcggaatcccaccgtgccccggtccaccaccccgagtacaccgagccccacgctcccacgctgccgggcgcggaaacagccgcagtggagggctttgacgacgccgggacggcagcacaggctccgacgcctgcgggtgccagcgcaccgcagcccttccaggaggacagttcaacggcggccgcggggcccggcgttgtgtccggacacgccgccaccgctgaaaccgcggaccgcacccaatcttccgcgctggtggaaaccggagcggaccgcactcagcagcagccccaggcagcaccagcgccggaaccggcgggacacctggcagccgacgagccctatggcgccggttcggcggccgccggaacagacggcagcggcccggacgggtacaccgtgaaaggcgatgccggagccatggtctactacgaggacggacaccccgactatgagcaggcccaggctgacgtctggtttgaatcggaggcgcatgccgaggcagcaggcttccgggctccacggcggaggcgattctaggagcgcccaagccggctccggccagccccttcccaggcctaacaagcgcttgcctgctgccgctgcggcctgcctcgcgttgcttctggcaggctgcacgggcggacccggcggcgggccgaccggaagcaccacccttccggaggcaacggaggtgcgcgtgccggacgtcgccgaacgccttgaacttcaactggacatcccatggtccgccgtgttcctgccggatggaacggccatcatctccgagcgcgataccgccttcctcaaagctgtgccggcaggagacaggaaggccgtaaccctcggcgaagttccgggggtggcccccgccggcgagggcggcctgctgggacttgcgctgtcccccggctttgcggctgaccgctacttgtacatgtacttcacggcacgggaggacaacagggtcgccagggtgagggtgcaggaatccaggggcggcacactgtccctggacgagcccgagaccattttcaccggcatcccgaaggccaacacccataacggcggcaggatccgattcggcccggacggattcctgtacgtgggaacgggcgactcccagcgcagggaccagccccaggaccctcaagccctgggcggcaaaatccttcgactgacggccgacggccgtcccgcaccgggcaatcccttcggtaacgcgatctacagcctgggccaccggaacgtccaaggactcgcatgggacagcgcaggtcgattgtggtcaagcgagttcggtcccgacgtcaatgacgagctgaacctgattgtcccggggggaaattacggctggcctgcggtgactggcgcgcccggccgtcctgagttccaggacgcaaaagtcgtgtggccttcaacgggcgaagcctcccccagcgggctggagatcgtaggctccactgcatacctgggggcgcttcggggccagcgtttatggacagtgcccctggagggcgctgaagccgggacgcctgtggcccatttcacacgccagttcggcaggatccgcgacgtcgtgcgcaccccggagggcggattctggcttctgaccaacaacgaaaaccctgatttcgtgctggttttgcccccacctgcgtgaggcgggagcctgccaggatgtcgatttcacatgggcaaaaagttcgtgtagagtttcatgtcgttgcggaggtcaacggggaaagaaaagcccgatgaccatagcaaagaagatgcacctctagctcaattggcagagcaattgactcttaatcaatgggttccgggttcaagtcccggggggtgcaccaatgggaaaacagcctccggctcgcagaaacgcgaaccgggggctgttttgttgtgtgccgaattgcaagcgtgcatgccgactttcattccggttttcgcttcaggcctgtggagttggtcgctgtgtggcggcattctttggtcgctccgtgtcgcaggactgcgcgtaggcaaacgccttacggacgtggcgggtctggagaggcaggagttggacgcgctcgtccggcgactaggctggcgccatggagtccttgcccgatgccgcccctggtgaatggcttaagcccttgttggataccatgtggcaagacatgcacgttgtcgtgccacgtggcttccccgcctacgccaggctcttccatccggtggtgcgggaccgcccgcaggacaccggtacgtggcacggacatccccgaacggatgttgttgccctcgacgaggaacaggtccactggtcggtcgtggcggctgcgttcgggacaaagatgcacccgttggcccaattccaccgcctctttgggcaagcacagagccggcaggaagtccttgatagcgacggctggcgttattccgaaccactgaccggcaaccttgcaccggatgcactagcagcagtggctgctcgcctctatgaacacacctccacaccaaacataggggtgtccgccatttgggagggatggggaggcctgacaagttccgccggctatgcccagctcagcttttcagacggctggattccccaggaagatagttccaactccgctgccccgggaacaggaccgggttcgggcctactgccggtagaggtggtcaacggagaaacactccacctgccggggcgcgactactacctcttcaatgctgcgccacagttttacctagaccccggatgggtgaatcacgtgccctggcaccattccccgcaattcccgcagtcaccgagcattctgtggccggcagacagaaggtgggtcatggtgtcggaaatagacttcgactccaccgtggtcgccggcagccatgagctcatatcggctctagtccgtgaccctgccatcgaggcgctgcccgtggacgagggagcagacctaacgtgggacgccgacatccacaaccggcccgtacagtagccaaccctcacgagggacgcctcttccaggacgcgtcgttgcctcgctacttggtgtgagcaccgcttcgagaaaacctacaggagttcagaagactcttcttcggtcaactcaatttcctggccgttgtcgcccacccagcggtacgcctgttgcccggctgccacgttggctcgcttattgagtgtctatgtggagccgtcttgaatctttatgtccatggaccgaggctactgcagaccccctatgctgcgtctccgaccacacgcaggaggtgccggccctggatagggcaatggcgggccagaggcctcggaaacgccgaaatcgccgcttcaatggttctcagtgaagccacggtcaggtcccacatcggcagcatcctggcgaagctcaagctgaaaaaccgaatccagatcgttgccatcgcctacaaaaacaaaaaggcgtgaccgcagctgtgaagctgtggccacgcctgggcgcttgaaccgcgggttagcgtgttgacggcaagttctctgccagtgcgccgtcgccgggagaattcgcaaactggctcgcgagttcccgcaccactgcctggagctcctgccgcagcaggtccggatcgatcgaagccgacgccagcacggaccgctccatttccaccgccgccgcaaccgcttccttgccctgctcggtaagcgacacgacgtggctcctgcggtccgaggtgctgcggacccggacaatgtgtccgtgggcctccaaacggctgagcgtcttacccatggtctgcgcttggacgcggacgtactgcgcgagctgggcttgcgtcatggggccctggacatccaggacctcgatggcgataacccctgcgtgggtaaggccgatggcgccgagtttttcgttccaggagtgttcgacgaggcgcgcagcagtggacaagaggcgccccgtgggccagtgatccatatcaggcatagcagccagtatagccaaatagggattagcgctggttccgggtgcttactaggctggtgtgtcccgcctgcaactaggagaaaaacattggctgaaagactcgttaccggagacgacgcgcccggttttacattgaaggattcgtcgggcaccggcgtcagcttgtccccccgtccgggccgccacaccattgtgtacttctatccggcagccgccacgccgggctgcaccaaggaagcctgcgactttcgcgacaacctgtcctccctccagtcggcgggctacgacgtcctggggatctcccccgaccccgtggaaaaacttgcaaaattcgcagccaaagaaggcctgggcttccctttgctctcggacgcagaccatgcagttgccgacgcatatggtgcctggggcgaaaagaagaactacggcaagacctatgaggggctcatccgttccaccatcgttgtggacccggacgggaaggttgcgcttgcccagtacaacgtcagggccacaggccacgtggcaaaacttcggcgggacttgaacctggacgcctgacaaggatccgctgagccggggccctgccgcggcgacgctacaatggacactggcatccgccgtcgggcccttgtggggcagcaacggcaggaagccctgcgcgagtggtgaaattggcagacacgcaggatttaggttcctgtgccttcgggcgtgggggttcaagtccccccttgcgcactgtggtcccccggctgtggccgggggacttttgcatttaaggctccctccgccgcatcccttccgcactggcacacacggtgaatccgggctccaccgaaaaactccagggaatttacccatccgcatcctgccgccggccgaatagccagtgagacaccagccaagggcaggtgcccaccaggaagtttcgaaagacgccgcaggcaccacgcccgcggcgggcagatgccacaacccaaggagaaccgacatgcagaccatcaagcgcacaaccttcaccgtcgcaggcgttgcagcagcagccctgctcagcctgactgcctgcggcgggtccgcaaccaccaccgcctcctccgccccggcagccgagccgtccgcgtccagcatggccccctcgccgtctgccagcgcctctgctgcagccatggacccggcagccaacctggttggccccggctgcgccgcctacgccgagcaggttccctccggcgcaggctcggttgagggcatggccctcgaccccgttgccgtcgccgcatccaacaacccgatcctcaccaccctcacctcggcagtgtccgggaagctgaaccccaaggtggacctcgtggacaccctgaacggtggagagttcacggtcttcgcaccggtggatgacgctttcgccaagatcgatgcagccaccatcgaaaccctcaagacggacgacgcgctcctgagcaagatcctcacgtaccacgtggttccggggcagatcactcctgacatgatcgccggcacccacgccaccgtccagggcggcagcgtgaccgttaccggcagcggtgacgagctcaaggtcgacgacgccaacgtgatctgcggcggcgttcagaccaagaacgccaccgtctacctgatcgactcggtgctgatgcccaagtagtcaccaggcaggccagttccttccggaaaagccgggggccgtccgaaaggacggttcctggcttttctgccgtggcgggaaccgtccggcgggttccaggtacctccaagtggcgtctattagactgggctccggtccgcacgcggcggagccggcaaaatcccgaggtgataatcgagtgcccagcagtacatcgcggcggacggtcatcaagaccggcgctgttttcctcgccttgggcatgacctcgtgcaccgccgtcccggccccctcgccgtcctccggctcccccagtacaaccgctgctcccgagccctccgcaaccttcaatttcggaaccgcagcccagccgctgggcctggatcccgccctttccagtgacgttgagtcccagcgcatcacccgccagatcctcgagggactggtgggcgtggaccagatcaccgggaaacccacaccactgctcgccacggagtggaccgaatccgacgaaggccgctcctacactttcaagctccggaccgacgtcgtgttccaggacggaaccccgttcaatgccgacgccgtgtgcaccaacttcagccgctggttcgccttctccccggatatcaggcggcaggcacccgggagttccttcaagggagtcttcaaggcgcactcggatgagccggagctctccatcttcaaaagctgcacggccgagtcagcggacacggtccggattgacctcacccagcgtttcaccgccttcctccaggcccttaccctgcctgccttcgccatcgcctcaccggcagccctcgccgcgggcacggctgatgtcctggaccagagccgcggcgggcagcccgtctcaggcttcgggaccaatccggtaggaaccgggccgttcaggctcgcctcgtgggatgagggcagtgtcaccttggccaccaacacgtcctactggggggaacgcggccagatcgccaccatcaacttcgtggcctatgaccacccgcaggcgcggctccaggccctgctggacggcaagatcgacggctacgatgccgtgacggttggcaacttcgaccagctggtcaagcgcgggaagcagatcgtccagcgtgacccgttctccgtgatgtacgtgggcatcaaccaggacatccccgtgctcaagaacctcaaggtccgccaggccatcgaaatggcgatcgataaggaaacgctgatccgtcggttcttcattgacaacaccgccaaggccacgcagttcgtcccgcccaagatcagcggtttcaacaacgacgccccggcgctgggccacgatcctgccaaggccaaggaatatctcgaagagggagggtacgccggtgaggagctgaagttctactatcccctgaacgtcacgcgcccctacctgcccacacccgagaaggtgtacgccgagatcagccgccagctcaccgccgtcgggcttaacatccggcccgttccggtggactgggcggacggctacctgcagaaggtgcagtcccccggcgaccatgcgctccatctgctgggctggaacggctcatactccgacgccgacaatttcgtgggccccctcttcggggaaaagaacggtgagttcggctaccacgatccgcaggtcttttcgaagatcaaccgggcgcgcgggcttccggaaggcgaggagcgggatgagcaatatcacaccatcaacgcccagatcgccgcgaccgtaccggccgtccctgttgccttccccatctctgcgctggccctgtccgaccgcgtactgagctatccggcctccccggtcttaaatgaagttttcacgaaggtgcaactaaagccttgacggggcggtccaatttcagtatgtccgctgcacggggatattctgtgacagccagagccgctgcaatcggagactgatcgtgaccttcatttccaagaccccacatgccgacgtcgtcctgattggcggcggcatcatgagcgccacgctgggggcattcctcaagcagcttgagccggactggaccatctccctgttcgagcggctggaccagccggggctggaaagctccgatccgtggaacaacgccggaaccggccacgccgccctctgcgagcttaactactcccctgcagccaaagacggctcagtggacccctccaaggcgctgctcatcaacgaacagttccagctttcccgccagttctggtcccacctggtggaccagaaactgatcggatcccccaagggcttcatcaataccgtccctcacatgagcttcgtcatcggcgaggaccactcccggttcctgaaatcgcgttacgaggccctcaagccccacacgctgttccggagcatggaatactccgaggaccacgcccagatcgccaagtgggcgcccctgatcgtcaagggacgcgacccgaagcagcgcgttgccgccacgcgcgcagccgagggcaccgacgtcgacttcggggcgctgacccgggagctgaccacctacctcgggaacaacggcgtcgaaatcaactacggccatgacgtcacgggaatttccagggcgtccgacggcggctggaacctttcgctgaagtaccccaagtccggggagcacagcaagatccacgccaagttcgtgtttgtcggcgcaggcggcggcgccctgcacctgttgcaggcctcaggtatcccggaaagcaaaggctacggcgggttcccggtctccgggcagttcttccgctgcaccgacgaaaccattgccgcgcagcacagcgccaaggtctacggccaggcatcggtgggcgctccccccatgtccgtgccgcacctcgacacccggtacgtcggcggcaagcggtcactgctgttcggcccctacgccggattctccaccaacttcctgaagaacggctcgtacctggaccttccgctgtccatccggcccagcaacatcatccccatgctggctgtggccaaggacaacatggacctcaccgcctacttggtgaaggaagtggccaagaagcatgccgacaaggtggaggccctgcgtgagtactacccggaggccaaggacggcgactgggaactgatcaccgccggccagcgtgtacagatcatcaagaaagatccgcagaagggcggcgtgctgcagttcggcactgaagtgatcgccggccgtgacggttccatcggcgcgctcctgggcgcatcgcccggagcgtccactgcggtacctatcatgatcgagttgctgaagaggaccttcccccggaacttcaagggctggcagtccaagctcaaggacatgatgccgggctacggggtcaagttggacgagaacccggacctggctgtcgagctggaaaaggcaacggccgcatcacttcagctggagagcgtttccgccagccgctgaccctgaggggccggcggccggcaccttgagggtccgtatccgtcattcaaccccacaggagatcatgcgatgttccggctggcacaactttcacttgcgaaccgggccctgatcgcactgatcacagtcttcgcctccgtcttcggcgtgatcaccatgtcgtcgctgaagcaggaactcatcccctcgatcgagttcccgcagatcacggtgctgaccgccatgcccggcgcctccccggaggtggtggacaagcaggtaagcgggccgctggagacggcgctgaacggcgtagaggggctggaatccacctcctccacgtcccgcaacggcgtctcgcagatcaccatggtgttcacctatggttcaaacctggaccgtgcgaggaaccagatcgaccgcgccatctccaacgccaagcggtccctgcccgaggatgtccagccgcaggcaattgccggcagcatcagcgactttcccatcgttttcctggctgtgtcctcggacaagacgctcagcgagctgaacgccgacctccagcggctgagcgtgccccggctgcaaaagatcgacggcgtccgcggggctgatgtgaccggcggcgcctcccagcacatcgagatccttccccgcggtgacgccatggccgcggcgggtgcgagcatcacgtccatccgggacgcgctggagaacaacggcgcgctgatcccggccggcacgctcgaggagcagggcaagacgctctcactgcagatcggcagccccgtggattcccttgcggccatcgaggcgctgccgctggggggagcaaaaggcggggccaccatcggcagcgtggcggacgtatcgctgaaggatgacgaacggacatccatcacgcggaccaacggggaggaaaccctcgccgtgtccgtgaccaagaagcctgagggcgacacggtgggcatctcgcacgcggtgcgggacacgctggacgaacttgaggcggaactgggttcgaatgccaagttcactccggtgttcgaccaggcacccttcattgagaagtccatcaaggacctcaccaccgagggcctgctgggcctgggcttcgccgttgcggtcatcctggtgttcctgatgtccacccgctccacgctggtcacggcggtctccattccgctctcgctcctgattaccttcatcggcctgtccgccaccggatactccctgaacatcctgacgctgggtgcgctcaccatcgccatcggccgcgtggtggatgactccatcgttgtgatcgagaacatcaagcggcacctgagctacggcgaggacaaagtcactgccatcctgactgccatcagggaggtggccggggccatcaccgcctccaccctcaccaccgtggcggtgttcctccccatcgcgtttgttggcgagctcgcaggtgagctgttcaggccgttcgccctcacggtcaccatggcgctgctggcctcgctgctggtctcgctgaccatcgtccccgtgctggcctactggttcctgaagaacaccggtgccgcaggggcgggggcggccgctcccgcagctgcccggcggaacgctgacgaggcccgcgccaaggcattggaggcggaacagcgcagcaggctccagcgcggttatctgccaatcctcaccaaaacccagaagcatcccgtgatcacgctggtggccgcagccctggtcctcggtgccaccgccgccatgacaccgctcctggccaccaacctcctgggcaattccgggcagaacagcctcacggtccgccaggtcctgccggccggcaccaccctcgccgacaccagcgcggcagccatccggctggaggaagtgcttcgcggcatcgacggcgtcaaagacatccaggtgacctcgggcaacgcccaggcaggtttcgccgcgctgacctccaccggctcgtccaactccacgttcaccgtggtgacagatgaaaaggcggaccaggaacagttgcaggagacggtgcgcagcgaactggcaaaggtgcccgattccggcaagatctcggtagggacgcagcagggcggtttcggaacctcgtccaccgtggacatcaccctcaacgcggccagctctgccgacctccaggaagccagcgacaccatggtggcggcgatgaccggggtgcccggcaccagcgaggtagcgaccaacctcgcagccagccagcccgtggtccaggtcagggtggaccgggccaagacggtagccgccgggctcaacgaggaacaggtggccggggtcctggcctccaccatcagccccatccccgccggagaagtccggatcgacaccaacgactttcctgtccagatcggccagggcaccaggttcaccagcatcgacgccgtccgtggcattccgctcccggcagcgggcgggcaggtgccgctgggaagcatcgcttccgtggaacaggtggatgtgcccgtgtccatcaccgccagcaacggccagcgcacggcacgcgtgtccgtgacgccgtcggactccaacctgggcgcggtcaacgcggaggtccagaagcggctggcggatgtccagctgccgccgggggtcaccgctgaaatcggcggcgccaccacccagcagcaggaatccttccagcagctcgggctcgccctgctggccgccatcgccatcgtttacgtgatcatggtggccaccttcaaatccctcatccagccgctgatcctgctggtatcggtgccatttgcagccaccggagccgtagcactgctcctggtgacaggcgtgcccctgggactgccctcgctgatcggcatgctcatgctggtggggatcgtggtcaccaacgccatcgtgctgatcgacctcatcaaccagtaccggcagccccgggacggccggccgggcatgaacgtggcggatgcgatcacgcacggggcacggcagcgcctgcgccccatcctgatgaccgcgctcgccaccgtgttcgcgctgacgcccatggccatgggcctcaccggcggcggcggcttcatctctcagccgctggcggttgtcgtcatcggtgggctgatctcctcgaccgccctgaccctggtgctggtgcccgtcctgtacaggctggtggagggccggcgtgaaaagaaggcgctgctccgtgaccttcaggcccgccacgaattcgggcccggaccggacgtggacgaggaattcagggactggacgacgggcatggttcccaaaaccagcgggcgccgcgcggcccccggcggccccgcctagaggccggtacgggcccccgcctagaggccggtacgggcccccgcccggaccgccccaagcccgcacgggcttcacggaatatttccccaagggatgcgttataccctgcggtagatgcaaatgcatctaaattgaactacactgggaccaagcccggagagtccaggaagggaaaggcacatcatgcagatcggtgttttcagcgtcagcgacatcaccacggaccccaccacggggcagacccccaccgagaacgaacgcatcaaggcgtcggtcgccatcgccaaaaaggtcgaggaaatcgggatggacgtctacgccctcggcgagcaccacaaccgccccttcttctcctcctcccccaccacaaccctggcgtacatcgccgcccagacggaacgcatcacgctgtccacggctactacgctgatcaccaccaatgacccggtcaagatcgcggaggacttcgcgatgctccagcacctggccgatggccgtgttgacctggtcctgggccgcggtaacaccgcgccggtgtacccgtggttcggcaagaacatccaggacggcgtggagctggccatcgagaactacagcctgctgcggaagctctgggacgaggacaccgtgaactggtccggcaagttccggacgcccctgcagaacttcacgtccacgccccgcccgctggacggcgtcgccccctttgtgtggcacggctccatccgcacgccgcagatcgccgaagtggctgcctactttggtgacggcttcttcgccaacaacatcttctggcccaaggagcactaccagcagctgatcggcctgtaccgcgaacgctacgagcactacggccacggcaaggcagaccaggcgatcgtgggcctcggcggccagttcttcatgcggaagaactcgcaggacgccgtcaaggaattccgcccgtacttcgacaacgccccggtctacggccacggcccctcgctcgaggacttcacctcgcagacgccgctgacggtgggcagcccgcaggaagtcattgaaaagaccctgacgttccgggagtacttcggcgactaccagcgccagctgttcctgatcgaccacgcgggcctgccgctgaaaaccgtgctggagcagctggacctgttcggcgaggaggtcctccccgtcctgcggaaggagtacgcggcccgcaagccggcccacgttcccgagccgcccacgcacgccggccgggtggccgcgctgctggccgcccaggacgcggaaaagtccgccgcgggcgcgtgatggcaggcaagagcgcggagtcgccggtgcggctcgccgcagaaacctgggagtcgctgttccgggcccaggttgcggtgatgcggaagctgcagtccggcccggccttccggaagctggcagtcaatgagtacgacgtcctgttcaccctgtcccgttgcccgtccggctggctgcggctcaatgaactcaacgacaacgtcctgttgagccagtccagcctcagccggctggtggagcggcttgagaagcgggggcttattgcaaggatgccggcgcccgaggatggccgtggagtgcttttaaaactgacggacgagggccgggagctccagaaggagattggccgtgagcatgtgcgcgacatctccgaactcatgggcccggccctgacggcggcggaacaaaaggaactcatgcgtctcaccaccaagctgcggagttccctgggtccgcggccgccccggcaggacccgcgctagcccagggccacgagcctggcggggtcctccaccggcaggctgccgttgaccacggccgtgacctgcatctggctcaagctcaggcttccgcccaccgtggacaggaatgcggtgtcggctgagtcccggccggccgtgatccgcagcatcgactcccgcggggccaggcccgtgggatcgatcacgtgccagccgccttccacgtaggcttctgcgacggcatggaaatccatggggctcaggccgggggcgtacacggcggccaggcgtgccggaatgtccttggacctcagcagcgcaatggccaggtgtgcgaagtcccggcagacaccgcggcggctcaggagggtttccacggcgccgtcggtcccgcgggaggagccgctgatgtaccgcagctcgccgttcacccagttccggacggcgtgcagcagttccgcgccggcggctccgtcgaattccgcgtacgcggtgggcaggaggcggtccgactccgcgtagcggctgggccggacgtagcggatgcggtcagcaagttccgcttcctcaggctgtgcctttccagcgaccgtggcggagtattgcaccaccacctctgacggttccgcgaactccatgtagtggagccggccgccgtggtggtcaggcacctcgctcacggggacctgcgtgccgctggcggtaacggacaggttttcctcgaaggacgagtagccggggttcctggcggcggcgatggccatggccactttggtgttgggtgtggtcttgaagaccaggcgtgcggaaacagtgcgttccatgactctccgggggtgtcggcaggaaagaagccgccgcttgtcccggccggggatgcgggcagggaacggggactagtttttgatctccagagacattagcatccgctggacgttggcgaagtcagcactctcgctggcgtacttagcggcctgttcaagggtgtcgaatgctttggcgggcgccactttttcatcgggcgcaaaggccctgacggacaccaggtcaccaaaggagtagtcgcccttacccgccggcccgcggactatattgcgcagttcgcaggcctgcccgccggccccgcccacgatgttcgtgattccgtaggagccgaagtaccggtacccctggatgacccggaaaaccatcctgggcggtatggtcccctccccgccttcggcggacagctccgccggcacactggcgatgacggtgtacggcctgcgcgccccctcggggcagtcagcggacgacggcgggagtcccgtccgcagggccgccatgaaggtgccgtccggcttcttgacctcgatcttcaaggcaccgggaagggtcccctcctcaggtgggaccgattgggctatccaggtatccggcagttcgaagaccacggttttcgccggatccgaaaaggtcttccacgcagaggctgtggcggcaggctgggctgttgcggagccggacgcggcgggcgtggcggatggggatgccgcagccgaagccgtcccttccggcgcagcggtggcggttccggtggtgccggagtcaccgggctccgctgtccatccgggcccgctgtttgacggtgtggagcaacccgcaaggagtgcgccggccaggagcacggcggccccgggcaggacccccgctgatgcgatgcgtctcatgcagccagcctaacgggacagggctgccgcggaacctgaccgggagcggcgtttcctgccactcccgcgggccgaaaacgaggggccggcgccgggcaccaacggtgcgtgtcgccgtcggacagtcaacatcggcgccggggactaggctggtgcctatggaagcccaccaacgcacggccgaagaagatttggcggacatttcccccgtcgacgtcgccgactggcggctccggactttcgccctgtacgacaatgtccgcaagctcgcggcggaagatccggcggaagcacattcctactggcgccaccagcgtgacctgatgtttgccacgcaccccgcctcggcactgtccgcagcagacaaggggcgcttctccggcctcaagacggctgactacgatccgatctaccgttttcacgtcccgctgaccaaagagggtgcgggccgggaaatgagcgtggaaaccggaactgacggcgtggtgaatttcgtcaggctgggcacattcgacctgccggagatggggcagctcgccgtgtggaagctgcagggatacggcggcggcatcttcgtgcccttccgggacgcaaccgccggccagcccggcggaagctacggcgccgggcggtaccttctggacaccatcaagggcgcgttccacggggtcagcgggacgggcccggacgccgctttcgtcctggacttcaacttcgcctacaacccctcctgcgcctacaacgaggcctgggcctgccccctgccgggtccgtccaaccggctggccgtggaaatcccggtcggcgagttgtactgaccgctgagggcagcagcacgccccaagtcttctggaggatggctagccgccgagcgcccgtacgctctccacagcatggcggaccgcccccgctgcggtattgaggtcctcccccgtgaccgcggtatcgaagctgaaccggaccgccgtctgggcaacctcggcttcatagcccagcgccgtgaggacaggcgacggagcatcggccccggctgcgcacgcagatccgctggagcacaccacaccctgccgctccagctccaggagcacggattcgccgctggttcccgggaagcagaacgatgccacggacggcagccggcgggaaggatggcccgtaagcaccgctcccggcacgccggtgagaacggcgctgatgaacatgtcccgcagggccgccacgcgtcgtcgttgttcctgctggcttgcctgggcaagcgtcagcgcggtggccatggcgactgcacctgaaacgttctccgtgcccgacctgcggccccgttcctggccgccgccgtggaggagcggctcgatcctggtgcggccacggacaaagagcacgccgcatcccttgggcgcccccagcttgtgtcccgagatgctcatggcgtcgatgcccagcgtcctggtatccaaaggcagccaccctgccgcctggaccgcgtccgtgtggaagggaactccagcctggcgcgcaaccgctgccagctcggtcacaggctggatggttcccacctcattgttggcgtacataacgctgaccagggcggtttccggacgcagcgcggcacggagggcttccggcgtcacaagcccagcgcggtccaccggcaccacgtcaacggtaaatccgtggaagcgctccaggtacagggcggactcctccacggcaggatgttcgacggcgctgatcaccacccggttgagctgcgggttggcagcctgccgcgccagggcaatgcctttgacagccatgttgtccgcttcggtcccgccggaggtaaaggtcacttcaccgggcctgcagcccaggacggcggccacggagtcccgggcatcggcaagggcagcggcagctgatgctcccagggcgtgatggctggaggggttcccgaagtcaccggtcatgtacggccacatggcttccagcacctcgcggcggaccggggtggtggcagcagcatcaaggaaaatcacggcttaccccgctgacagttccacgtccaggccaaggtccagggcggccaccgtgtgggtgagggcacctacggagatgacgtccacgccggtggctgcgattcccgccacggtgttgaggttgacgttgccgcttgcttcgacccgcgcccggcctgcaaccagggcaacgcctttcctgagctcctcaacggtgaagttgtccagcatgatggtgtccacgcctgccgccagcacaggttcgatctggtccaggcggtccacctcgacttcgaagtgcgtggtgtgtcccagctgggcctttgccgccaggagcagttccgtgagcctggcggggtcccctccggtcatcacggccaggtggttgtccttcgccagcactgcatcggacaggctgtaccggtggttggcccctcccccgcaccgcaccgcgaagcgttccaggatccgcaggcccggggtggttttccgggtgtcggtaatcctggcccgtgtcccctcggccagcaggacaaattccgcggttttggtggctatcgcggacatccgctggaccaggttgagggccacacgctcggcgagcaggaccgagcgtgcccgtccgctgacccgcgcaaggtgcgtgccggcgtcgaacctttccccgtcagcaagcagcagctccacgtccgtgccggggtccaccagctgcatggcgtcccggaagacggtggccccgctgaacacgccgggcccgcgggcgttcaggaccgccgtggcgcgggcatcggcgggaatgagcagctgggaggtgatgtccccggccggcgcgtcttcggcgaaagcgcgctccaggatctcccggacgggagccgccggcagggcgaggtccaggccaacggcccttgccgccacgggtgcgattacggacttttcaatcatggacaaggctcgctttcgggcgcaggcgggagtgttcttggagttcatcggcgatgccggcggcatctgccgggctgtcgctccggtaatgggcgcccagggacgcagtccgctcccgggcggcagccacgagcagctgagcggcgagcagcaggttgcggtcctcgtgctcccgcggctcggccccggcggctacggttccgggaagtacgacggcggcccaccggtcaagggtttccgtcgcctcccgcaacagaaccccattccgaagcaccccggccttggcagtcatcaagcgccgaagagcaccgcgcgagaacggggtttccacattgatacttccaccggagctggccggccggctcccgaacgggccacccgacacggcacccgcgcctgctgaagccgcagggaaggtgacggacaaatggtcgcctgagggtgccccggaagcatgcgtaaaggggaggccgcccgcggccgacctagcatgcggaggggcgccctcaggcgactcccagccaaagtcaccggagaggaaatcttcaactgcgcggcggccgaagacgagtccctcgaggagggagttgctggccagccggtttgccccttggacgcccgtgcatgcggcttcgccggcggcgtagagcccggggatgctggtcctggcgtgcaggtcggtgaggaccccgcccatccagtagtgggctgccggtgccacgggaaccaggtcgcgggtccagtcgataccggctgccagggttttttcggtgagggtcgggaaccgttgtgccaggaaaccggctcccctggcggcctcgatgacgcgggcgtcaaggtacacgtggccgttggggtcgccgagcttggccaggtgcagggctatgctgcgggaaaccacgtcgcggggggcaagttctgcgtccgggtggtacgcccgcatgaagcgctttccgttgccgtcaacgaggacagccccttcgccgcggacggcttcggaaatcagcagcggctcgccggggtggcctccgggggtggacccggcggaccggaccaggcaggtggggtggaactggaagaattccaggtcggctgtcctggctccggcgcggaccgcgagcgcgaggccgtcggcggtggcaacggcggggttggtggtctgggcaaacatccggccggcgcctcccgtagccagcaggacggcgtcgccgtgcagcgctgcgctcttcccgtcctgcaggaactccacgccggtgattgcgccgccgtcgtgcaggagggaggtggcgtgtgcaccggtgatgaccgtcagggcacctgcggcctgccgggagagcaccgcctggatgagcgcaccggccactttcgcgcccgtggcgtcgccgccggcgtggaggatgcgcggtgccgagtgggctgcctccagccccagtgccgggcccccggctgcctccacatcgaagcgcacgccgaaccgctgcaggccggcgatgtcgtgccgggcctccgtgcacatcagccggacggcgtcggcgttgcagtgcccggcacctgcctggagcgtgtcggaggtgtgggccgctacggtgtcacccgggaatggttcatccagcacggccgagatcccgccctgggcgtaccaggtgttgctgtggtccagcccgcctttcgtcaggagaaccacggaggcgccggcgtcggcggccagcagcgccgcatacagcccggcaatgccgctgcctacgacgacgagccggcgaccggcgggcatcacgggcccgccggccataaggggcccgctggacactctggcctggctaaacattacggcctggcggcgagcatgcgctcgagggctgtccgggcatggtcctggacggagtctgcgacggtgatgcggttgaccacccggccggccaccagctcctccagtacccaggccaggtaccccgggtggatgcggtacatcgtggagcaggggcagatcacggggtccaggcagaagatggtgtgctgcgggtattccgctgcaagccggttcaccatgttgatttcggtgccgattgcgaaagtggttggctccgtggccgcagcgatggccttcttgatgaagtcggtggaacccgcagagtcagcggcgtccactacttccatggggcactcgggatggacgatcacctggacgccgggaaagtctttcctggccttctcgatctgccccacgttgaaccgtttgtgcacggagcagaacccatgccacaggatcacccgggagtcgagcagggcctgcgcgtcgttaccgccaaggtccttgcgcgggttccacatgggcatctgctgcagcggcacgcccagggctttggcggtattgcggcccaggtgctggtccgggaagaacagcacgcgctgggcacgctggaacgcccactcaagcacggtcctggcgttggaggacgtgcagacgatgccgccgtgctcaccgcagaacgccttcagagctgcggaggagttcatgtaggtgacggggaggaccggaacccggccctcggcgtcgggctcggtgccaaagatctcttcgagctgctcccagcattcggccacggagtcggcatccgccatgtccgccatggagcagccggccgcaaggttgggcaggatgactgcctgttccggcgtggacaggatatccgccgtctcggccatgaagtggacaccgcagaagatgatcgcttccgcgtcgggccgggtgagtgcagcgttggccagctggaaggagtcgcccacgaagtcggcgtactggatcacttcgtcccgctggtagaagtgccccaggatgacggcacggtcaccgagcgcagcctttgcggcgaggatgcgttcgcccagctcagcgtcgctggcgagcttgtactcctccggcaactggccctggcgcggggtggcggccggcgcgacgtctgcgctggaagcgccggggccgtaggcgggaatgccggcgagcgcctcggcgaggtcgtagtcccacgggcccttggccagggcgggactgcaggtgccgcccttcgccgtcgcgccttgttccgcctgttcgcgcgtgatcagctggattgctgtgttgacgctgctcatggtgtgctcctgttgtctgggtcaaggccgggccggccggtaaagcggtagaggcgcggcgggcggtgcttgccgccctggaggtactggccggtttcctctatttcgggggtggatttcagctgccttcggaagttcgccggatcgagctcgcggtccagcactgcctcatagacctcgcggacctgggccagcgtgaagtactcccccaggaggtggtaggccacggacccgtaggccagcttgttgcgcagcctcccgagggcgtagtccacgatcgcgttgtggtcgaaggccagctcccccagccggtccgcccggaaccaccggacgttttcggactcatcggcgagcgcggcttccgtcggctggaccagggcccagtacacgatcgacaccacccgctgggtgggtgagcggtgcagcccaccgaacgcatacagctgctccaggtagctgggggcgagcccggtggtctccctcaggttccgggacgcggcgtcctggagtgactccgcgtggctgagcggaccgccgggaagcgcccagagccccttgaagggctccctgatccggcggaccaaaggcagccagagcgtgggccggccggagctttcactgggccggagggcaaagatgacggtggagatggccagtgaggggggtgccgcctggcgctccgatacattcgcagagctggagtacatgttccaccgccttcctggcagcaggggcccttgttcggcaagggcccggtctagttatggtcagtatgaccaaaactaattgtacgggcacgcgccgtggaaacaccaaatgtttctgcccgcctgcccggactttccaccgggcactccgctaagcactccactgcgccgaataccgccggcgggacggaggcggtaaattcaagtggtcccacaaggagccaccaccagaccccaagaaggttcacggcatatgacgacgaagtcccccacagcccgtcccaaaggacaccgcctgcaccccgtccacagcatgaagccccggcagctcaccatgatggggctgggcagcgccatcggcgcgggactcttcctgggttcgggcgccggtgtgcaggcagcgggcccggcggtcctcatttcgtacctggtggccggcacgctcatcatcctggtcatgtgggcgctgggcgagatggctgccgcgaatcccaacagcggggccttctccgtctatgccgaacgcgcactgggcaagactgccggagccaccatcggctggctgtggtggctccagctggtggtggtgatcgccgccgaagccctcggcgctgcggccctcctcttctccgtctggccggccgttccggtctgggccctggcgctggtgttcatggtggtcttcaccggcatcaaccttgccggggtaaggaacttcggggagttcgagttctggttcgccatcctcaaggtggttgcgatcgtattgttccttgcggtaggtgccgccctgctcctgggcctgcttccggacgtcgcctcgccggggctgtccaacctcaccgctgatttcgcaccacagggcctcggcggcattgcctcggcgctcttcgtggttatcttcgcatttggcggtacagagatcgtgtccgtggcggcagcggagaccgaaaaccccgagcggagcgtggccaaagccatccgcactgtggtgtggcgcatcctggtcttctacatcggctccgtcttcgtcatcgccgctgtcctgccggcaacctcccagagcctgtcctcacccttcgccggcgtcctggacgcagcccggatccccggcgccgccacggccatcaccctggtggccgtcgtcgcactcctgtccgcactgaacgccaacctctacggggcctcacgcatggcctactccctcgcgcagcgctcggccgcaccccggttcctgacgcggctttacggcgcgaacgtgcccatgctggcggtcggggtatcggtggcgttcggattcatcgccaccgtcctggaactcctcttccccgaacggatcctgccggcgctgttccagctggtgggatccacctgcctggtggtgtggggaagcgccctcgtatcgcagctgatcctgcggcgccgcgctgaccgcgccggcacgcccctgcccctgcggatgaagggcttccccggcctgaccatcctggggctggtgctcctggccatcattttcgccgtgggtttcagcgctgaaggcagccggatccagctgttcagcacatttgcgctcatcgccggcatcgcgctggcctgtgcgctgggcgcccggctcacgcagcgggccggcaggtagagtagcgttcaaagcaagaggcaccgaagcgccgggtccgcctgggcgccgtagttgatgaggactgacaccatgagcggcaggcacagcggccaacagcagacgcataccgtggagggcacggacccgcagctctacgtggcggtgcacgaacccgccgctgacgccgggctccgccccgtgctgctggtgcacggcttctcctcgtcgagcaagctcaactgggaggacaccggctgggtggccgcactcctcgatgccgggcggcgcgtcatcacggtggacctgcccgggcacggccgcagcggcgcgccggaggatctggactcctactcccccagcaggatccgggcggacctgctgcaaacagcgttcgacgccggcgtccggcctttgcaggagggggaaccttccagcggccttgacgtggtgggctactcgctgggttcccggctcgcctgggagttcggcgccacccagccggaaatcacccaccgcctggtgctgggcggccccaacatggctgatccgttggcggaattcgacctgcgggcggcacaggactacctggccgacggcacgcctattgccgacgagtccacggcccagctgctcaagatggccctcctgctgcccagcaacaacatcttcgcgctgctctccctggtggaggccatcaaagccgagccctacgatcccacagaggccgtcccccacgtcccgatgctcctggtcgccggggacaaggacgaacgcgctggcagcctgccgcagcttgccgaactagcgcggaaagccggagggaccgccgaacagctcatccttcccggccggaaccatgcaaacgccgtcaccagcagggcgttcaagcaggcggctgtcaggttcctggcgggccaggaacctgcctgagcgccgcgttcttccggcccgttccggggaccggttcttcagccggattctgccggtgcctgggggcgcctaccgtctccgcaaacggtagggtgaaccttaggctggaagagcctggagggactgatgggcacgtttttcgaagatcgtacggacgccggtgaacggctcgctgctgtgcttacgcagttccgggagcggccggacacggtggtcctgggcctggcccggggtggcattccggtagcggccgccgtcgccaaagcgctctacctgcccctcggaacagtcctggtccggaagctggggattcccggccatgaagaaacggcctacggggcactggcgtgggtccggggccgcaccgttcggctgatcaacaagtccctgctggaccgggtcctcgaacacggcgtacgccaggagtggcttaacgaggtggagcagcgcgagcggactgagctgctccgccgggtggagctctaccccggggcggacctggatgtggcggaaaagaccgtcctgctggtcgacgacgggctggccaccggtgccaccatgagggcagcggtagaagcagtgcgtgagggcggcgcggccaccgtcgtggcggccgccccggtgggctccgtggaggcggaggcgtccgtggagcgggtctgcgacgccgtgatgtgcctccacctgcccggcaagttccgggcggtaggcagcttctaccggcactttgaccagctgtccgacgacgaagcgatcagcatcctcgagcagtaacgccgcgggccctcctcctggcctgatacggcaaagcgggccggaccgccatggtccggcccgctgtcgttaggaagacggagggactagtggctgacgccgagtggacgccccttggtttccttggccagaaccacaccgatggcggagatgacgcacaggatcatgatgtagatgccgatggagcctgtccacttggtggcctgcagcagggtttcggcgatggtcgccgcgaacgcgccgcccaggatggcgccgaacgcgtagccgatggagattcccgagtagcggacgttggccgggaacatctcggcgtacattgctgacatcggtccgtaggacagtccgagtccaatggtgaggacaaacagcgccagtccgtacagccagatgttcctggtatcgatgagggcaaacatgggaatcatccaggcaaagatgatggcgtaaccggtcaggaaggttttgacccggccgatccggtcggagatccagccgcccgccagggtgaagatcagccagccgaaggatgcaagggtggtggccaggagaacctggggcgtgggcatctgcagcgtccgggtggcgtaggcgatgaagaacgcgatcagcaggtacccggcggcgttgttgccgatgaagatcatggtggagtacaggaccggcttcttgtagctgcggatcagttctccgagcggagctttgctttcctgcttccgggcggccatctcctggaagaccgggctttcggccacggcccgccggatcaagtaccccacaatgatgagcacgatggagagcaggaacggcacccgccagccccaggccgcaaagtcttccttcgacatgctggagttgaggaagaagagcaggccggtggccaggatcatgccgatcggcacgccgatctgcgggtatgcgccgaacaggccgcgcttgttcatgggtgcgtgttccaccgccatcagcgccgctccgccccattcacctccggccgagaagccttggatgatgcggagcgtgatcagcaggatgggtgcccaggcgccgatctgcgcgtaggtgggcagcatgccgatcagtgcggtggcggcacccatcatcaccagggtgaagacgagcatcgccttgcgtcccaggcggtcgcccaggtgcccggccaccacggcaccgaggggccggaagaggaagctgatgccgatcagggcgaacgagaggatttgcgccaggcccgggttggactggttcagcggcgccaggaacagcggtgacagcagcgtcgccgtcagctgcgcaaagatgaagaagtcgtaccactcgatggtggtaccgacgagggtgccggcgaggaccttgcgttcctcccgccgggagctgggaccggcgagcgtgtccaccttggaaggtgtggtcattgaaactccgttgttcaaggcagcagtgctgccgggacgccttcaggattaccgacagaacggtcagttagttagtagggtacaccgaaaatgtgaggcggaacacgggcttccggaactttcttgtgcggccagcacatagtgcgggtctccccatggcgcctgcggcccggcatccggcgcccgtggactcgccgaagcgcgagttctatatttggaatgctgtttcgtattcaggacgcgagcccgggtggcaggcccggtctcggggcgtcgcgcgtacccgccacctaggatggacaccatgaatcccaccgccgcagccccggccgcagcagcgccggcgcaggcttccccctcccagaccctgtcgaggggaatccgcgccctggagatcatggcggcagcatccgggcctttgaccatcgctgaacttgcggacgccatgggcgtgcaccgctcagtggcataccggatccttcgcaccttggaggaccattcactcctggtgcgtgacgacgccggccgggtccagccggggcctgggcttgcggtactggcgcgcggcgtgtcccgcaacctgcaggctgccgcactgccggaactgacgcagctggccaatgccctggatatgacggcgttcgtcgctgtctgggaccaccacgactgcatcaccctgctcacggtggaaccgaggcattccggcgccacggtggcgcagcgtcccggcacccgccatcccatcaacgccggcgcgcccggcatcgccatccagtccgcgctcaccgaggcggaatgggaccggctggccacgggaatcccctaccgccccgaagccgctgaagcccgccgcgccggctattccgcgagccacgacgaggtgatcgccggggtttcctccctggcggcaccggtccgggttcctggcggccgccccgctgcgctggccgtcgtctatatccgctcatcccgtgatcccgcggcggtgggagccgcgctggttgagagcgcggcaaggattgaacggcagctggcctaggccttccggctaagaacgacggcggctcccgcacccaggagtgccagcccggacgctgcgcagaccgggacaaggaaggctgctgcgtagccgtggctttcggcgagctggccgcccagtgaagaccccagcgcagtgccggccacgatgccgctggccagcgccgtcatcacggtgcccaggcggcccgcaggagccacagacccgccgacggcgaaaactgtgaccatgaccggccccaccgggaggcccaggatcagcagcgcggccaccatcgcgggcattgaggacggcaggagcagcaacagggacagcgcagtcatcagcgcggcgcacagcacccagcgccgggccgggccgaagcgttgcggccagtacgcaacagacaacgcagccacggccgagctcagccccatcacggcgtacagcaggccggctgcctcagagcctgcaaaacctgccgagaaagagctcagggcggtctgggtggagccgaagaatgttcccatgcacaccatggcgagcaccggcaacgccaccgccgccgggagccttccggcccgggacgctgaaccggctggcacctggcctcccgtggcgggcctgcttggcggaactgcccggtgcgtccggtgtactgcgaaggccggaacaagggtgatggtcagtgcaaccgcaactgcgaggggcagccagggcgccaagaggctggccagaatgcccaccagcgcggggcccaggacgaaggtcacctcatctgcggtgctttcgtaggaaagggccgtgtccaggtcccgtgcctggtccctggccgagccgtgggcggccagggccatccagcggaccctggcaagcgggcccacctgcgggcagctggcgccggagacgaaggcggcggccaggacagctgcggggacgcccggggatcccgccgttgcccacacggccattatcagggccaccacggcaatgctgttcaggagcgcggccagcaggagcaccgggcgttgtcccctgcggtcggcaagtgcacccagaaccggcgcacccatggctgaaccgatccccacggccccggccgacatcccgcccagggcgtaggagccactggctgacgtgaccagcgtcagcgtccccaccgtcagcatggccagcggcagccgtgcaaacaggcccagggggataaaggcgcggccggcaagaaggggcaacctggcgaaccggccgcgggaagccgcaggcggttgtaccgggactggtagaccaggggtggctgaagccggcgttggggacggtgacaattctccggcggcggggccgggtacttgagtgttagcgggtgaagcgggtgtgttcaattccgggctcgttcatgtcgtgcgcatcgtccctcctcccgatgcgcgcaacccggtaacagtgcaagtatatccggcgcgattcagtccggtccgcagctcagccggttgcagcggccggccggtcacactggtgcgtctgctccgtccgatatccggagcgtggagccgttccggcccttgatcacctggagttgggcgccgatccgctgcttcatctctgcgacgtggctgaccagccccaccacgcggccgccgtcccgcagcccttcaagggcgtccatcacctgttccagggactgctcgtccaggcttccgaatccctcatcgacaaagagagtttcaatttccactccgccggcctcctgctggacgacgtccgccaggccaagtgccagcgacagggaagccatgaacgactcaccgccggacagggtggaggtgtcccggcggaacccggtccactggtccaccacttccagtccaagccccgattttgctccgcgcgcggccttggcgtctgtgtgctggagcaggtagcggccatcgctcatggccaccagccgttcggaagcggccacggcaacctgctccaggcgggcagccaggacatagctgttcaggctcatccggtagctgttctcgccccgcccggccgccgcatcagccagcccggccagcatctgcgcccgttctgccggctgcctcgctgatcctgccaggtcctcgtactcagcacggatgctgcgcagcgaggcgaggcaccgggcggccatgccggcagccaggtcagcatcccgggcgtcctggagggcctgcgccgcagcttcacggagggcgtcgagccgctcccggtccatctcgtagcccgcggacttctcctccagcgccagcaggacgtcgtcggacacgaacagctcggccactcgcgcttcctcgtcctgggctgcccgcacccgggcctcgagtgcggcggcctcatcggcgtcgagcagttgctcacgcgcctcgtgtgcggacgtaaaaccggccgcagggagggccagctccagttgttccagagcctctgctgcctggatctccatcctgtggaggtgcgcctgcgcctcaaccgctttgttgagcactgtcaccgcggtctccagtgcacgccgccgctgggcgaggctgcggtgggttcccctcagcccggccagcgcgtggtccagggccgaggactgttcggacacgtcggcaagtgaggccgcggtccgggccagctcgccttcggtaccggtgcgggattcctgagcggccgccgcagcggtgtcgagtttgccgagccgcagcctgactgcttccagttccttgactgccccatcggcgtcggcggctgcccggcgcgcaccctccgtagcactgagggcctcgtcctccgcggtgtccccgccctgcccggcgagcacggccaccaactggctggcctcccccagctcgcgggccaccagggcaaaggcggcttccgctgcttcgtggaccagccgggcttcttcctcttcctgtgcaagttccgggccgccggagcttcctgcggccggggcggggtggtccgggctgccgcagacggggcattgttccccgtggaccagcttggcagccagctcggcagcggcattggccagccgctgctccctcaaatccagccagcggcgcttcgcctccagttgcccgtcacggcattcgtcatggcggaccttcaccagctcccgggcggcaatggctgagccgtagcgcctgaccacgtccagcagttcctccgcggccgccgcttccttttggcgcagggcggcagtggccgcatgctgttcaaggtcctgcagcccgtcctggagacgggtccgttcgtccgtcagttccttggcacgcttgcctgcctgttccagggcggcggctagctcctcctgatttttcaagaggctgccgtggcgcttccgaagggcctgcagccggtcttcgtccggcagcctggcttcgaccacggccaggagggagcgcagccggccgagctcgcttgcggccccggcggcaggttttgcggcatccgcagcggggcccggcgctaagtggagttccagttcagccagttcggggtcctcccccgccgccaggctgagaagggtgaaggctgactccactgcggtagcggcgctccgggctttggcggcactggcatcaacgttccgcagctgcccctgcaggacctcggccttccggtgccgggccagccggaggaggtgatcgtcaagcagctgagcgccttgctccaccgccagtttccgggccgcggcggaatccagcttccggcgccgttcggcgcgcagtgtttcgacatcaacggcgttcctgcattcggtgctggcggcctcgatctgccctgccttccccgtcagctcctccaggcgggcggccacggctccctcgagccagccgagccgcgcggcggtgttctccggagagggagcatcggagccgtcaaggctgaggcgcgcaacctcggcctccgcgcgggctgccaggagttcgagccgtcccgcaaggtgggacacctcatcctttgcagcctgcgcctggcgtgacagttcctgctccacggattcgaaccgctcggtaccgaaaagcttctgcaggagttccagccggtccgtggccttggagcgcaggaacgcagcaaagtctccctgcggcagcatcaccacgcgggtgaactgctcccggtccatgcccagcagggccaggatctcagcgccggcctcgtcattgcgggcagacttttccgtccaggtcccgtccacccgttcccggagcagtgtcttggcctgctgggtggtgaatccgttcttcccccgggcgctcggtttgtcccatgccggggaccgtgccacttcaaaccggcggccctgggcagagaactcgcaggccaccgcgggttcctgcgccgggtccgcatggtcgctgcggaggcgcttaccctcctggcgggctcccggaacggaaccgtagagggcaaagcagatggcatccaggacgctggttttcccggcacccgtggggccgttgaggaggaaaaggccgtgtgcgctgagccggtcgaaatcgatctcctcggtgccggcgaaagggccaaacccggaaatcagcaggcggtggatcctcatcgtgaaccctccaggagccggacgttctccagcgcggcagcgagcgccgccttttcggcgtcatcggggaccctgccccgcacgtgctccaggaagccgcagcataccgagaggtcgtcaggcgcctcggcgagcctgctgctgtagctggaagcggcagcaggggttccgcccaccggatcgaagctgaggaccagcgtgtccgggaaccgggagcggagccgctccatggccctggctgggcgctgggcgtcggtcagcgtgacctggcagtaggctgtttcggcccattggtgctcgggcagttcaaggagctcttccagcggcccgcgcagcacggccagcgcccgcggcgcgtcccactggacttcctgcacggagctgacgccctccgcgtccacgtccacgagccagccgcccttccggtgcgttgcctcggaaaaggaatacgccagcggcgacccggaataccggacctgcggcgagagggcctggcggccgtgcaggtggcccagcgcggtgtagctgaagccgtcgaagaggtccagcggaacggctccgacgccgccgatgctgaggtcgcgttcgctgtccgagctgatcccgccgctggcaaaggtatgcgccaggaccacggagtggaccgcggcggacgctgaacgccgttcgatatcctcccggatcatcgctgttgccgcccgggtgacctcaaagtggctggcggtgtccaccccgagctgttcggcgacaagacggggctcaagccacggtatgccgtagatggcaagcacggcttcagcagtgttgccgtcggcatcgtccaggggcagcagcagcggctggtccaggctctcgatcctggtccggagatggactcccccgcgttccaggaggcgggaggcaaaacccaggcggatcgcggaatcgtggttgccgctggtcagcacgacctgtgcgcccgcagatgtcaggcggaccagggcgtcatccagcaggcgcactacgtcgacgccgggaagggcacggtcatagacgtccccggctaccaggacgacatcgacgccgtgctcagtgactgtgcggaccagctggtcaatgaaatcccgttgggcatccagcatgccaacgccgtggaaggaccgccccagatgccagtccgatgtatgtagtagccgcatgtttctaagctatcggctgccactgacagcaggcgtaaccgccgcgttcaccgcggatcagccccgtttgccgtcgaagaattcctgggcttcgctggacccggtttcaaccgtttcggcggactcccctgcctcattggtttctccggtcccggcctggacgacggttccggcgccggcatcggcggccgctccgaagctccggaagacaagtccggcaatagcagcccccagcagcggggcggccaggaacacccagaactgccccacggcccagcccgagctgaagaccgcggacgcaacggcgcgggcaggattgaacggcaggttccccaccgactggcccagctgcagcagcaccgcaaaggtcaggccgaccgccacgggggctgcagaccggctgcccccgtcccggatgtcccggcctggcgtgcccaggaagacggccacgacaattgcggctccgagcatttcgaggagcagcactgccgccagcggcgcctggatgatggagtgctcgccaaagcctgcagtcacggtgtcaaaagcgctgcggctgtccgcgatgcccggcagggtgcgcaggatcccgtaaagcgcgaaggctcctgagagtccccccaccagctgggcgcccacataggcagcagcagcgccggccctgatccggccggccacaaggtggcctgccgtgatggcggggttgaagtggccgcccgaaacgtgggcgaacgcgagcatcgctgcggtcacggccaggcccgcggcaagtgctgcaggaagggggctggaatccggaatggtgaacaggggcacgccaagtccggccaccacaatgaacaaggtgccgaacgcctcggcccccagcctgggcaggagccccggccgtgcggcctccgggccgcggggcagcaggacgtcgtggggggcgggggcgggggagctcatggcgggaccctttgatagacagaagatggcggtgctgccgccgggcaacccgtccattattccagccgacgctggacgtttgctggtgcagcgcctttcgctgaatgccggggcaggcgcgcgtcacggcgctgccggaggccgcggtaaatttactgcatgagcatcgaacccggtccgtccgtgcccgccctgaagtcccgcatccacggctgcctgctgggcggcgcgctgggcgattccctgggctacgccgtcggcacggagccggttgaggagatccggcgccgcttcggcgggcgcggcagcaccggatccggccgcatgaccggcaggttctccgacgagacccagctgaccctctacacggtggacgggctggttgaggccctggaatgggcgaattcgggcgtgggcgcggacgtgaacgcctgcctgtggctcgcctacctccggtggctggcaacccagggggaggccgctccgccgtcggcccccacaccgcagccccgatggattgacgggcacgctgtcctccgccagcggcggaaccccagcaccacctgcatctccgggctggcaacgggtgaaatgggcacctccgtccgccctgtgaaccccggttcgaaagactggggcaccgtggtcaggtcagcaccgttcgggctgatcccgcacattacgccggacgccgtctacaagctgagtgccgacgccgcctccctgacgcacgggcatcccgtggcgcgccaggcttccggaatcttcagcctgctggttcaccgattggtttcgggtgaagggctcacggacgccgtcaccgccgtgaccgcccacgcccacaccctgggaggtgttgcgccggaactgcccgaacgactggcagccgcgctctcacttgccaccaggggcgtggccacgccggaggaactcaccgatgcgctcggtgacggccggaccgccgaggacgtcctcgccgtcgcgctgtacgccgtgctcgccactgtccccggcaccgggacggacaacgccgggacggctaacgcagggacggacgacgacggcgcggacacactgcccgtccggcacttccgggaggcggtgtccctggcggtgaaccacggcgggcagagcgacgccaccggttccctggccggcaacatcctgggtgcctactacggcgaggagtgcctgcccgaagactggctggaatcactggaggcgcctgaggcaatccgcggcatggccagtttgctggtgggagttacgtccgccgaaggctgatgttgttgcacgcatcgcaaacatcctccgggatcactccgcggcgctgcaggaacccgaagaccacgcatcccaggcagaaccccgcaaaggcttcaagcgacgccgccacgatgaggacgcccagcaccgcccacgccgcaggcaccgctccggccacgaacagggcaagggctgctgtggagacggccgcccccatgccctgcgcaaaacgcttgggcggcccggccaccagcttcacccgtcccagccgcggggtgatgaccttgacggacaacagtgccagcggcgaaatcttcggtccgaagagcacgcgcagccagaacccggcggcgatggccagcaggccccagcctgagccgagggcaagcgtcacaaccgcgagcgccaccaccagtccggcagtgacgcgggcggcgtactcgttgaccggattcgggaaggcgaacagagagctcatgtgccaaggctaggagcgcatggtaccggggcaaaggtttgttgcgccctgtgaagaagtggccgtaccggcggccttaggcgatggatgctgccgcgaagtcgcccaccatctgcaggaactcgccttcggacagtacctcgatggcctgcccccgcccgtggagctccagcacccgccgggctttgccggtcagcctcccggagcggaggtcggaggcaacaaagccgtcccctaccaccaggacggtggtacgcccggtcacccggctctccggccgggcgccgacgtcggcagagcgccttttggcttccgggcggccaatggacagctccccggtgaagacgacggtctggccgtacagggggtggcccggctcggcgtctgggttgggaagcgggttcgctccctcttccggccagcccgcctggaagggccggagcggcgcagacgtgccgccgccggcagcggcaagggccgcgatgctggacttggacagcccgtccgtgccggggtcgaaagcctgctggcgcggcatcaccagccccagcgaaaggtagagttcggcgatgctgttggcctggttccgccgggcaatgtcgatcaggattcccgcgcacgcccgggcgtcctcagcggcatcgtggtgcttcaccaacggcacgccggcttcctcggcggcgaacggcagggagttggataccagggaatagcaccgccgggaaagcatcacggtgcacacatagtcataggcaggccccggaaggccggagacctccaggcccgaccggatcacgcccaggtcgaaggcggcattgtgtgccgcgaggatgtcatcgccaatgaaggcgccgatttcggggaagagttccccgaagcgggggtgcccggccacgtcgtcagcccggatgccgtggatccggacgttgtggtagtcgaagtggtcgtggttcggcgggggccgcatcagccatgaagcctcgtccacgatctgcccgccccgtaccttcgtcaggcccaccgcgcagggagagccccggaagccgttcgcagtttcaaagtcgatcgccgtaaagtccaaacccacggcccaaccttaccgccggaatgctgcccctccatgcaggcacagctctgtcaagtacccttggagggtgaactttcctgtgatgaatgacctcgccgtgtccatgctgggcggggcaggaccggtgcagccccagctggcctccttcctgcccgactggctgaacccccaggtcttcctggccgatcccgccttggctccctgggtggtcctgctggtttgcggcatcgtcttcgcggaaaccggcctgctggtgggcttcttcctgccgggcgattccatgctgttcaccgccggactgctggtggccacggacaccatcaagttcaacgtgttccttttcgcgctgctgatcatcatctcggccatcgtggggaaccagacgggctacctcatcggttccaaggccggccccgccatcttcaacaagcccaactcacgcctcttcaagcgcgagaacgtggagaatgcgcacgcgttctttgaaaagcacggcggcaaggcactgatcctggcccgctttgtccccatcatcaggacgttcgttcccgtcatcgtgggcgtggcccaaatgaacaaaaagaagttcttccttttcaacgtcatcggcgcagtgctgtggggcggcggcgtgacgctcctgggctacctgctgggcgaccgcatcccgtgggtccgcgagaacctggacatcatcttcatcgcaatcgtcctggtttcggtcctgcccatcggcgtggaggtcctccgcggcatctccgccaagcggcaggcgaaagcctacggcaccgatcccgtggacgagttcatcgaagagcacgcccccgacgacgaacagaagacaccccgccttccgtaaggcgccagatgcaaacaaaaaggtgtgctccccgctacggcgggaagcacacctttttggttaaccggccgttgttaagcctttgcgtccgtcaggcctctgcccggcgcagcgcctcaacgatggccggcagcaacgcgcggaatgccttgccgcggtggctgatggcgttcttttcctctgcagacagctcggcgcagctgcggtcctcccccgccggctgcagcacgggatcgtagccgaagccaccgctgccccgcggttcgcgcagcagcacgccctccagttgcccgtattccaccacctcgtggccgggcgtgccgtccgtgtccggcacagccaaagccgccgcgcagacgaaggccgcaccccggtggatgtccggcacgtcggaaagctggctgagcaggagccggagattggcggcgtcgtccccatgcgtcccggcccaccgggccgagaagatcccgggtgctccgcccatcacgtccaccgcaaggccggagtcgtcggcaatggccgccaggccggtggcctccgccacggcgcgggccttcagcagcgaattctcggcaaaagttacaccggtttcgacgacgtccggggcacctgccgctgccgcgtccaccacctgggtgtcgacgtcgagccccgggacctgcccccgcagaagctcgcggagctcccggagcttgcccttgttgtgggttgccaggaccaggcggggagctgggccgccggccgggttcacagcgtgtccgccagggtctcccgctggatggcggcaagctgcgtggtgcccagcagcgccaggtccaggagctggtccagctcggtccggtcaaaaggtgcgccctcggccgttccctgcacttccacgaacttgcccgacccggtgaccacaacgttcatgtcggtttcggcccggacgtcttcaacatacggcaggtccagcatgggcacgccgtcgatgatgcccacggatacagcggcaatggtgtcgatcaggggctgggcattctttgcgatcagcttgttgtcgcgggcgaagcggatggcgtctgcgagcgcgacgtaggcgccggtaatcgctgccgtgcgcgttccgccgtcggcctggaggacgtcgcagtccagcacgatggtgttttcgcccagggccttggtgtcgatgatcgagcgcagcgaacgcccgatgagccgcgagatttcgtgggtgcggccgccgatcttgcccttgacggattcgcggtcggagcgggtgttggtggcccggggcagcatggcgtactcggcggtgacccaaccgcggccttcccccttgagccagcgcggtacgcctgcggtcagggatgcggtgcacaggacccgggtgttgccgaactcgatcagggcggatccctcggcctgggtggaccatccgcgggtgatgctgatgggccggagctggtcgggggcgcggccgtcggcgcgcacgatgggtactgcagttgcttcagaagtcatgcctttagcttatcgactgcacacccagccgacgccggcaccctgatcgaaggcctggcagagacagaagactagatggtgtagtgcactccggcaaccgccaccgcaacgtcgccgccgaacaccgggcgggcctcggccatcaccgtggtctgcgatgtccacaccggaatgtgcgtcagcaggagccggcgtgcccccgccgccgcagcggcctccccggcacgctttccggtcaggtggacgtccttgatgccgtcgtcgcggccttcctcgaaggctgcctcgcacaggaacaggtcggcgtccttggctgcttcctcaagcccggcgcaggaatcggtatccccggaataggtcagggtccgggagacaagtgtgccttccttgtccggctccaccacttccacccgcagggcataggcctcttccacggggtggttcactgcaaacggcgtcacggtgaagggccccacggtcacggattcgcgttccgcccagttggtgaagtcgaattcctcgtgcatcccggggtccagctccaggccgtacgccgtggccatccggtctgccgtggccgcaggtccccagacggggatccggccgcggccccagccgccgggcttccagcggacggccacgtgcaggccgcacaggtccatgcaatggtcggggtgcaggtgggtgaggaagatcgcgtcgatgtcctccaggtcggtgtaccgctggatggcacccagcgcaccgctgccaaggtccatgaccactttccaggtccgctcgccgtcgttcgcggtcaggaggtagcacgacgccggtgacccggggccgggaaaggaacccgtacagcctacgatggtgagcttcactggccggtgcctccggtcgccgacgtgcctacgaagttggagatccgcggccgcgccgcagcgctctgggcggcggcgatcatttccggggtgatccgggccaggcttcccgtggggtactgggcggacacatggtccacgtgccggacggagaggacctcgggccccaggaaccgccgggccagcgcctcgaactggccggcatcgccggtggccacgaagtggtgctccggcggcgttgcctccgtgcgctgcaggttgtgggtggccagggcgcggtagacgtccttggcggtttcctcggcgctggacaccagagtcacgtccgcccccatgacgtaggagatgacgccggtgagcagcgggtagtgtgtgcagcccaggaccaccgtgtccacgccagccgccttgagcggggcgaggtattcctcggcgacggccagcagcgccggcccggtggtgatcccggcttcgacgtagctgacgaactccgggcacgccaccgaggtgatcgccaggtccggcgccgcggcgaacgtatcctcgtaggcgcgcgagccgaccgtagcggaggtgccgatcacgccaacccgtccgctgcgggtggctgccaccgcacgccgcaccgccggctggatgacttcgatgaccgggatgccgtacttggccgtgtaccgctcgcgggcatcccgcaggacagcggccgacgccgagttgcaggctatggtgagcagcttgacgccggagtccaccagttcgtccatcacgcccagtgcgttggcccgcacctccgcgatgggcagggggccgtacggtccgtgcgccgtgtcccccacatagaggatggactcattgggaagctgatcgatgatggagcgggccaccgtgaggccgccaacaccggagtcgaaaacgccaatgggccgcgactccagggcggcggcggggaggtcgctggcgtcggaccccgctgcagcgccggctgacggatccatgcttgaggctctactcatgattattcgaggataggtcttccccgcggctccagtcatgaacctgtggccgggagctcatgtctggtgtgtcacagcggagggacggggagcggtccgcgccgctcatcggcgggagtccagggactgcagcatggcctggaccagtgactcctggagccaggtggcgaagttgtagaccagggcaaggtagctctccacgtcctccgcctgggaccagtcctgcatcaggtggacgtgttcggcgtcctcctcgtcctggatgtccagccgctcggcaaggaccagccggacatcgttcagcgccatggaccagtgccgtgccccgtcgggcgtcagcacgatctcatccttgtccaggtccagggccgcggcccgcagggcgccgatctttgtttcccgcagcgagcgttcggtgagctgccggaactccagggatgcgccggcgtcgtccttcatgacgttgggaagcaggcgcttaacggcccggtcagcaggctctgccacgtccatgtccaggccgatcagggcggccaggggatcctggccgtcgcggtcctccggctggagcatggagatgacgtcattgatgaggctgcgcagcaggtcgcgttccgcgggctcaaggtagccggtgatgcctttgagtccgtacttgaatgccttagccacgtttccccttgccttggccaggccctccggagttgccggagttgtcgttgttcccgccgctggctttttccacggtggcccacagcccaaacccgtgcatggccacggcatggcgttccacctgctccttgctgccggaggcaacaatggagcggcccttcttgtggacctccatcatgagcttgttggctttgctctcggagtagccgaaatagctttggaaaacatagctcacgtagctcatgaggttgacgggatcgttccagatcaccaggttccaggggatgtccggtgcggtcagggaatctgtggattccaccgttccggtccgggtgccctcctgtgtatcagggccgagcgcaacgcttaaggtcatctgcccattctatggggatgatgggcccacgccggcgagggccccgcggcgaagcgaagcgagacgcgggagccggtggggactagagtgactttcgtgagtacctccgctggctgggagcatccccgcacgtccttttacaccgaccactacgagctgacgatgctgcaggcatcgctgcattccggggccgcgcaccgcaagtcggtgttcgaggcttttgcccggcggctgccggatggccggcgctacggcatcgtggccggcacgggacggctgctggagggcatcgccaattttcgcttcggggatgccgagctcgagttcctggagcgcaccaaggtggtcaacgcgcagaccctggagtacctcgcgtcctaccggttttccggtgacatctggggctaccccgaaggcgaggcgtacttcccgaactcccccatcctgattgtcgaggccacgttcgccgaggcgtgcatgctggagacgtaccttctatccgtgttgaaccatgacagcgccatcgcctcggctgcttcccggatggtcaccgcggctggcggccggccctgcattgagatgggctcccggcgcacccatgaggaagcagccaccgcttctgccagggcagcaatcatcgccgggttcgacagcacctccaacctcgaggccggtatccgctacgggatcaaaacggtgggcaccgccgcacactccttcaccctcctgcacgacaccgagcgggacgcgttcgaggcccagattgcctcactcggggaccacacgtccctgctggtggacacgtacgacgtcgaagcggccgtccgcacggccgtggacctcgcgggtccacgcctgggagcagtccggctggactccggcgacctggtggcccaggcgcagtgggtgcgcaggctccttgacgatctcggcaacgaaaacaccaagatcgtggtcacgtcagacctcgacgagtacgccatcgccgccctgcagtccgctcccgtggattcctacggcgtcggcacctccctggtcaccggctcgggcgccccgacggccagcatggtctacaagctggtcagccgcacggacgacgacggaacgttcgtctcggtggccaaggctgccaagaacaaggccagcgtgggcggccgcaagtacgcgctgcgcaagcttaacgagcgcggcattgccactgcggaagtggtgggcgtcggccgccggccggaggatgacggaaatgaccggcccctcctgcagcagttcatgaagaacggggagctgctgccgggctggaccggccacgacggcgtgctccgggcccgccagcgtcatgcggattccatggcggaactgccgccggtggtcaaccgcctgcagcgcggggaagccgccatccctactctctatgaagaaaactgaggagaaccgatgtcccgcgcattgatcatcgtcgacgtccagaacgatttctgtgagggcggttcgctggccgtttccggcggcgcggacgtggccggcgccatcagcgagtatgtggacgcccaccacggcgagttcgaccacatcgttgccacccaggactggcacgtcgatccgggagagcacttctcggacacccctgacttcaaggacagctggccgccgcactgcgtggcgggcacccccggcgctgaactgcatcccgacctggacaccgaatacatccaggcctacttccagaaaggccagttctcggcggcttactccggcttcgaaggcctgctggcgcctgaggatgcggtgcccaccggggaacggcagcccggggccctgcccggtcccgcggacgccgagaggttcgctccggacgacgacgcgatcgggctggacgactggctgcagagccatgacgtggaggacgtcgtcgttgtgggaatcgcgacggattactgcgtgatggcaacggccctggacgccgtccaggccggctactccgtcaccgtcctccgctccctgacggcagggatcgccgaggacctggaagaagcggtggccgagatggaactgggcggcgtggacgtagcctagggcagcaacaggagtggtccggtaataagcaccggccacttctttgtttcccccgcacctcgatactggtgaagagaaccccacccagtcgggaatcgggtactacagtggatgcatggctcccagccgccacccgctcgacgatctgcgcgaaacgatcggccatctggccgatcagctcaagctgcccggttcggagcgcgtcgatgacctggtcggcgatctgatcggtgcgaggcccgggccggcccggccgctgtccgcggtgcaggccgagctcgacgctctggtcggactggagaccgtgaaggaacaggtgcgggccctcgtcgcactgctccaggttcaggcccgccgtaaggcgcacggcctccctgaggtggccacatcacagcatctggtgttcctcggaaacccgggcacgggcaagaccaccgtggcgcgcctcctggccgagatgtaccgggcggtcggtctgctgcagaaaggccacctggtggaggtcgaccgttcgggactggtggggcagtacgtcggcgcgaccgccatcaagacggaccgggtgatccggcgtgcgctggacggcgtcctgttcatcgacgaggcctacgcgctggccccggaggacggccggatggacttcggccccgaggcgatcgaggtcctgctcaagcggatggaggaccaccgccaccgcctggtggtgatcgtggccgggtacccgcggctgatggagtccttcttgctctcgaaccccggactgcgctccaggttcgcccgcgagatcacgttccccgactactccgtcgacgcactccagacgatcttccaccagatgctggcccagcacgagtacacgctggggccgggtgcggaccagatgctgcgccgcatcctcaccgggctccatgcgggcgaggactccggcaacgcacggttcgcccgcacgctgttcgagcaggcgctcaaccgccaggcgctgcgcctgtcgctcgacgaggagcacagcctcgatgcgctcgatcgtgaggccgtcatgacgctcacagcggacgacctcgtcgaggccgcgctggccttgggcgaggaaccggagccggaaccgacgccggaaccggaaccggagcagccacgctggtggcgctggctggtctgacgggatctgcggcggctcaggcgaactttcgcggagcagatcactcagcaccgggccactttttgattccggccccgctatttccggccgatgaaccagtcctggagcttccgcaagcgcgactgcagctgctcctcgttcgcctgggcaacgggcggtccgccgcacactgtgcgcagtttggtgtggaccaccccgtggggggtgcccgtgcgggcagaccaggcggccacgttcttggccagctcgttgcggaggtccatcagcatccggtggtccgggatggccggcgccgggctttcagccgccgcgggtgccttccggttcttacggttcagctgctcgtgctggcgctgccgcagcagcgtgcccacctgctccgcgtccagcagcccggggatgcccaggaagtccatctcgtcgtcggaccccacctcgccgcccgtgccgaactcgccgccatcgaacagcacgcggtcaaatgacgcttgcgaatccagggcctcgaacttgcccttggtgaggctgtccgatgccttgtcctcgcggttggcctcagccatcagcgagtcctcgggattgaacaggccgtccccgtcttccttctccgggcggtccagggcgtggtcccgttccgcctccatggagttggcaagggccatcagctgcggcaccgagggcaggaagaccgacgccgtttctccccgcttgcgggcacggacgaagcgacccaccgcctgggcgaaaaacaggggcgtcgatgttgacgtggcatacacgccgacggaaagccgcggcacgtccacaccttcggacaccatccggacggccaccatccagcgtttctcgctggcggtgaattcctcgatcttgctcgacgccttcgcgtcatcggaaaggatgaccgtgggcgactcccccgtgatcctcttaagctgccctgcatatgcgcgggcatcctcgtgatccgtggcaatcaccaggccgccggcgtcgggaacggtgcggcgcacctcgctgaggcgcttgtccgcgccggccagcacagccggaatccactcccctgccgggttcagggcggtacgccaggcgtgggacgtgatgtccttggtcaccgccgcctcacccagcgacgccgccatttcctcgccggcactggtccgccaacgcatctgcccggaataggccatgaacattaccggacggaccacgtggtcgcgcagcgcattgccgtacccgtaggtgtagtcggccttggagcggcggatgccgtcccggtcctcggcatactcgacgaagggtatgggagaggtgtcggagcggaacggcgttcccgtgagcgagagccgcctgaccgcggggtcgaaggcttcgcgcaggccgtcaccccaggacagtgcctcgccgccgtggtggatctcgtcaaggatcaccagcgtgcgcgcggcttccgtcttggcgcggtggagcaggggcttgctggccacctgcgcgtaggtgacggcaacgccgatgaagccgcggccgtgctgcccgtcggagttcttgaagttggggtcgatggcgatgcccacctttgccgccgcatctgcccactgccgcttcaggtggtccgtaggcgccacgatggtcaccctgttaacggcgccggagtcgatgagggtggacgccaccctcagcgcgaaggtggtcttgccggcgccgggggttgccacggcgaggaagtcgcgcgggctgttgcgcaggtacaggtccagggcttcctgctgccaggcacggagtttcggggcggttccccaggctgcacgttccgggtaggccggaggcagggtggggccgccaaagagcgtctccgtcactacttgttgttgcccgagtcccctccgggacccttgccgccgtcgttgcccgggcggaggccgtcatagacctctttgcacatcgggcagaccgggaacttctgtggatcccggcccggcgtccaaaccttgccgcacaacgcgatgacagggtcccccgtcagtgcggactccataatcttttctttgcgcacatagtgcgaaaagcgctcccggtccccgggctccacttcctggcgcagttcctcgcgctcaatggtggctgtggacgttccagccccggaaagctcgcgcatcgggtcgttttcgagagggtccgtcgtgctagtcatgccaaccatcttagctgttccgccggccggacgttcgacggcggcgcgtcccctgccagccgccgtcggactttgcggcggcgtgcgttggcagcgggcggcgcgggctaaatcccctgccaggcgggcttgttgtcataggtgtgccggtagaaatccgccagtttcagtgcggacgcggcggcctcgtccagcaggactgtggcatgcgggtggaactgcaggatcgacgccgggcagatggcggcgaccggaccctctacgaagtcgcggacagcctgggccttctgcgcaccggttgccagcaggatgacgtgccgcgcgtccatgatggtccccagcccctgcgtcaggacatggtgcgggacgtccgccaggctggagaagaaccgtgcgttgtcccggcgggtctgttcgatgaggctcttgatgcgggtcctggaagcgaaggacgagcccggttcgttgaacgcgatgtggccgtccgttcccaccccgaggatctgcaggtccacgccgccggtagcagcgatcgcctcctcgtaggcgcggcaggcagccgggatgtccgcggcggcaccgtccggaccgtggacattctcaggccggatgttgacccggttggtgaactcccggcggaccacttcccggtaggactcggggtgtccgggcggaagtcccacgtactcgtccagggcaaaaccggaggcccggctgaagtccaggccgtcccgctcatggcgggcagccagctcatcgtagaccggaagcggggacgaacccgtcgccaggccaaggacggaatcgggtttgcgccgaagcaggtcctcgacagcatcggcggcaagcctggcaatctgtgtgctgccgttgaggatgactacttccatgctgtttccttccgaaagctgttcagcggttgacggacacctgggccaacagctcgggcccgcgggcgtccagccattttccgcccagcctgacgcctagaacaaacaggaccaggcccaggaccgtccccgcggtgaggttgatccagccgaagaggctgttgcccgtgaccacctgggcaaccaggaggcccacctggggcaggaccaggaccatgaggaccagcagccctccgaactgtaccgcgagggtctgccccacgttgccgggcggtttcttgaacgggctgtcgccaggcagcgggacggccacggtgtagcgggccgagaccaccgatgacagtcccagcccggtgaacaggatgcccaggctcaggcccagctggccgggcaggcccgcccagtcccctgtcagggcggaatatccaagggcaaacaccagcaccaccggcaacgcgaacgccaggcaggccaaggcgcggcccagccggtctgccactcccctgacgccggtggcaaggtgcagggcgaaggcggtgttgtcgtaggacacgtcggccgaaatggaccaggcgaggatgaacgcggagagcggggcaaggatgccaaggctggtgaagtccccggtctggctgccctggaaggcgagcaccacgggaagcagggggatcaccacgagagatcctgaataccgcggatcccggaaccagtacgtgagggacctcgccatcaccgcaccggccggactggcaggcagcactcccagcagtcccagtctgccgcctttgcgcctgccgctacccgcgtagggaggagttaccagcgcccgttccagcagggatttccatgcccacgcgagcgcggccagcgctgcaacggataccagcagcttcagtgccgcctgtcccggctgcccggcggacacatcaccgcccagggaccacggtgcgccaagcggggtccaggacagcgtccgggcaaagcctggcaggaaacctgaggaggctgagaggccctggccgattccggccacaatgggccccatcaacaccagcggcaccatgaacgctatggcgctgacgtccttgaaccgccgcgatgcagccaggcttgcagttgccgtggtcaccaccttggcgagcaccacgcaggtcagcacgcccagcactgcccccgcgaatgcagcgagagcaggaaggacaccatgggaccaggtggccaccgtggacagcgccaccagcgaggtggccagccccggaatgccgatcagtccgcccagggcgagcccggccagcatctgcttcatgggaatcgcgaaggtggtgaaccgtgcgggatccagggtcatgtccgtggcagaggcgaccaccggtacgatgccccagcccacgatggcggcggatccgccgagcaccacagcggtctgggcaaggtcgtgcggcgcgttgcgcagcatcgccagtgccatcacgagcgttgccaccatccccagtgcgtagagcccggcgaaggccatccccaccagttgccacgggctgcgccgcagaccgttgcgcagcagtgtcagcttgagccttagaaggtgcgcaaccattccagtccttccgtgtggctgcggccgccgaccagctgcacgaaccggtcctccagcgaggccccggcacgcacctcgtcaacggttccggcggcgagcagccgtccgtttgccaccactgccacgtggtcgcacatgcgctgcaccaggtccatgacgtggctggacacgatgaccgtgccgcccgaagcgacgtagctgtccaggatggagcggatgttggcagcggagaccgggtccaccgcctcgaagggttcgtccaggaccagcagcctgggcgcgtggatgagggcggaagccagcgcaatctttttggtcatgcccgccgagtagtccaccaccagtgtgccggcgtcctcctggagatccatggcagcgagaaggtccacaacgcgggtggccactgtttccctgtccattccccgcagcagtcccgcataggtgatcagctgctcgccggtgagccggtcgaacagccgcaccccgtccggcaggatgcccatcagcctcttcgcgtccagcggccgctgccagacgtccacgccgtgaactgccgctgtcccaaagtccgggcgcaggagtccggttgccatggacaaggtggtggtcttgccggcgccgttggggcccacaatgccgtagaaggagccggccggcacgtccaggctgatgccgtccaccgcgatcttgtcgccgaagcgctttgccagcccgcggatggacagtgccggcaccttcggtgccggaccggggcgcgggtcggggttcagcgccggcacggagtgcagtgccggttctggttgcgggaccggttcggagtgcgggaccggatcggagtgcggggcagtcatgatgccagactagtcctcgggtccccgctgcggggtcctcccggaggagtagcgacaaaggcttaggacccgcctccggtgacgctgtcagggatatcgcgccggggtccctaacggaccttgcggatgcggatggggcccttggcggtggcgggatccaccaccgagccgccttgggtgatctggacctcgcctgcgtcaaccagccggcgtgccgccctgcgggcaggctccatgaggtcacgccatcctgcatcgccaacggcacgggcagcctccgacgggcagatggttgacgtggcggcccttccggccaggagttccaggatggcggcttccagctgctggtcgaccccgtcgcccgccgccggcccgccctcaggagccggcgccgtgtcaggagccggcggcggctttggcgcagtacgccggtcccggctggccatcacggggccatcagaaagtgcgcctcggaacggcgcgctcgtactgcggcggccacgcaaggtcgtggcccagttcgaaggctgccctcagccaccagtgcgggtcccgcagcgctgccctcgcgatgaggacgccgtcagcctgtcccgtggcgacggcgtgttcggcctggcctgccgaggtcagcaggccgacggtcccggtagccacaccggcttccttacggatggccgccgaaaatccggtctggtaaccggggccggccttgatctgctggtgggcaacggcgccaccgctggatacgtcgatgaggtccacaccgcgttcggcggcctgccgcgccaggcggacggaagcggccagatccacgccgccttctgcccagtcgctggcggaaatcctcaggagcagcggcatggactccggaatgacagcgcggacggcgtcaaccacagccagcatcagccggttccggcccgtttcgtcgccgccccatgcatcggtccgcgtgttgatcagcgggctttggaactggtgcaggaggtacccgtgggcaccgtggatctcaatggtgtcgaagcccgcgtccaccgcccgcaccgcggcgtcagcgaagtctcgcaccacgccgctgatctgctccgcgctcatctccgcggggccggcgtacccttcaaaggccaaaggtgacggccccacggcggtccaaccgccgtcggactccggaacactgccgtgcttgccggaaaagggccagtaggtggacgctttcctgccggcatgggcgagctgcacgccgatcttggcctccgcggcactgtgccggtggacgaaggaggtgatccgctgccacgcttccgcctgctcaccgttgtagatgccggcgtcgcgggggctgatcctaccttctgcattcacggcggcggcttccgtaaggatcagcgcagcgccgccggcggcgaaggaccccagatgcatcaggtgccagtcgttcgggactcccggggcgtcgtcggggtcgcagctgtactggcacatcggtgacacccagccccggtgctgcagttccagcgaacggagccgcaggggctggaacagcgccggcactagaacagcaccctcgcgagggcctggcgcgccttggcaacccgctcgtccgcggcgcccaccacctcgaacagctccagaagccggacgcgggcagtctcacgctccggcccgaagttcctgccaatgaaggagaccagccggttcaacgcatcctccacatggccgccggcaacgtcgaggtcagccacgcccagctgggccgcaaggttgtccggttcattggccgcgagcgtgcgcagggcctcgccgtcctgggcggaaagcggctgcagcctgcccatcagctccacctgggccagtccggccttggcttcatggtccgcaggcatctcggtcagcgcctggcggtaggcatcggcggcggcagcgtaatcgcccgcttcgatggcgtcgaacgccgcctggtgcagcggcggcaggggtgccggagcgtcttcttccgcagcgccggcacccaggctcccggtcacgccgttcgctgcggctactttcagcagttcgtcaaaaaggctgcgcacctgctgctcgtccgcgctgccctggaagagcggcaccggctggcccttgaggacggccacggcggtgggaacagcctgcacctggaaggcctgggcaagctgcgggaacgcttcgatgtccgcggcgccaaggaccagccggccgccgtagccggcaaccacccgctccaggacctcgagcacggctgccgactccggcgagtaggaagcccacagcgcgaacaccaccggcacctgcgcggagagctccacgagctgctggaagttgccctcggtgacgttgacctttagttcctgggcgccggcagcggcacccggctgggcgccttcctgcggcgttccggtcccggccggcgaagctggcgagaccgggcgctgcttcaggctggaaaggtcgacggcgccgcgcaggttaagcaggttggcagcggcaggagggacagggcgggaagctggcgaactcatgctttccactctagccactccggccgctgccggggctactgcaggaaggggattacttgaagctggcccccgtcaggccgcgggttgccgccacgagcttcatcgggtccgttgatcctgccggcggcacgtacacggccaccgactcggcgaagctcaggaccatgccggtggtggtttccttgccgccggccagtgctgctgcgtcgtcaccgatggtgagcttgtcgcctgcggctttgggggtgccctcgaagccgaagttgatccggcccaggaccagcgcgccgccgtcagccgtgcggaagacaacagtgctttcggggaccaccttgtgggtgaaggagaagttgccgttctcgccggacttcaccacttcagcctggtaggacagggtgtccgcgatgtacggcgaggactccccttccaccagcttgtccttgaaggccgaatcttcggaggtgaggcggtcggccaggccggccatggcttcttcaccgctgtagagcaggcccgtcttgtctgcgggcgccagcgtttcagtgccgtcccggctgatggtggggaacgtggtgccgggctggagcgggttggtttccacgagcttgtagttctcgcgcggcgaggcctggaccagcgtcagcagctgcggaaccacattgccctcaccctgggtcacggccatgacggaccgcggccactcgcggtcgctggtcaccacggtggtgaggagcttggtggagcgcaccggcatgcgcggctcgtaggagcctacctgtgaacggatcttgtagttctgggtgcggacttccagttcggtcccgcccacccggtcggacagcttggcggcatccttggccgcatcgcccgcgtcaacagcgctggagacctgctccaggatccggcggaactgcgcatccagcaggacgggcgaacctgcctcctgcgcggcgggcgacgccgttgccgcatcgggggaaggcgcgggagaggtggcacttgcggcgacgccggtcccggccaccactgcagctgcaaccacgccggcagcagccatggtcacccgtgacgacgactttgcctcgctgcgggcgcgggcgcgccgggcaaagccgctgccctcgccgccgccttcaccgttgcgcctgcgggcagagagcagggccagtacgatcccggcaacaaccaggagggaaccaaggaccatcagtggaacggcccacggtgtggaggtgtcgttcgggaacgtcatggagatggaggcaggtgcgggctgcgttccgtccgaggcgagcagcagggtccagtcgccgtcagccggcggggtccaggagtactcaagctcgccgctggcattctccgtggaaacccaaaggtccgagccggcggggttgggtgcagtggcctcgccgtcggcgtgctcaacctggagcgactctccatcctcggaaacgccgctaatggtgttgtgcgcggcctggccaacccatgcgtccacatcgtccggcctgccggcggccagcataaagttgccgtcgccctcgatgtcgatcttgactgtcccgccgtgcagggtccgcaggttctggtcgatcacggttatcggcgcagcggcagcatcggccggcgcggaagccgtaaaggtctcggagggggcccagatggtcctctggccaatgccggccaaaagtgtcaggaggccgagcagcacgagtgcgactgcagtctttaaacgcaagggaacacctatcatcagcgggggtttggttcaatggtatccgttttgttatcgggagcccggatcggggcatcccgcaggatcgccagcaggccgctgagcaggcccttcagctgttgttgacaaggctgctgatagtctttgcgatgatcatcacaccggcccgcccacgcggcgccatgtacggaacaggcccccaaaaccagtgactgacaagacggacgaatcctccgcggcaccagagaatccggggggtacgcagccgccggcagccgcccccaccggtcctggagaaggtcctggaactgcccgccggaagaggcccgccgcggccgcactcgggatgctggcacagcggctgcgccagcctttgccgggcgcccagccacggcttcgtttcgagatgccgccggagtacacgcgccaggacgggaacggcggcggcgaggacagcggggtgcagccgcagttcggcagtcccggcccccggatttcgccgcagcatcccctgtatctggggttcatgggaaccgtgggcgttgggcttgcactgctggtctactggatcggctccaacaccacgcaactgctcctgtggatcgttgcggcgcttttcatcgcactgggcctggaaccagtcgtcagctggctggaaggccggaaaatcccccgccccgccgggatcctggtgtccgtcacggtgctggtgagcgccgtcgtcggcttttttgccaccctcattcccaccatcgtggaacaggtcacgcagatcgtcgagcaggcaccggtgtggatccgtgactttatcgattccgagttcttccgcagcctggacgaccagttcggtgtgcgtgagcgcgtcacggaagagctggacaagttcgtgaacgaccccgcggcaatggggggaatctttggcggcgttgtcggctttggttccaccgtggccaacggacttttcggcaccctgatcgtcctggtgctgagcctgtacttccttgccgccctgcccgcgatgaagaagtggggctaccggcttgcgccgcggtcccggcggcaccgggtggaggccctgtccgaggaaatcacccgctcggttggcaactacgtgatcgggcaggcggtggtcgccctcctgaacgccacctttgccttcatcgtgatgtcaatcgtgggaatacctttcgccctactgctggccttcgtggtggccctgcttgccttcattcccctggtgggcggaatgattgccgggatcgtggtgctgctggtctcgctcacggagggctggcaggccgcggccatctacggaatctgctacttcgcctacctgcagttcgaggcctacttcatctccccgcgcatcatgcagaaggccgtggccgttcccggggccgttgctgtcatttccgtcatcgccggcggcagcctgctgggcgtgctcggcgccctcatcgccattcccacggcggctgctgtcctgctgctggtcagggagatctacatcgtccgccaggaccagcactaagccgccaggaccagcaccgggccggcgcagtggggccgaacccggagcgggaccgggggtcctaggcggaggctgtggctacgggcccgtcccattcctgcggcagtcccgcggcgcctgatcctgcttcgctgacctcatccacgatttcgttgaggacccgggcagcatacttctcgcccacccacaggtgtttggcgccgtccacgcccaccacgcgggcctgcggcaccaggctgaagcgttcggccgcctcggcaggcttgaggaagtcatcatgttcaggcaccaggaccgtgagcggcttccctgatgcggcccactggagcaggtccttgtctgtggcccggtgcagcggcggtgagagcaggactgctccctcgatccgggacgccaccggctccacggctccatacatcagggcgagttccgtgccgaaggaccatcccaccagccagcggttgggcaggccgcgttcgacggcgaagcggaccgcggcctccatgtcgtggcgttccccgatgccctcgtcgaaggccccgctgctggttccgtgcggggatgcggttccgcgggtgttgaaccgcagcactgcgatgccggcgagcgccggcagccggtaggaagccttgcggtagacatgcgagtccatgaagccgccgtgcgttggaaggggatgcagggtgatcaacgtggcattcacggggccggattccggcagcgccagctcggccaccagggtgtggccgtcttccgtatccagcttcaccagctcgcgtttggcgggcagcacggtggaggcacggatgggagtggggcctgggccctggcggaattcgtacgacgccggatcaaaagtcatgcctgccagcttagcgacagcgggcgcatctttgcccgcccgtcagcggtagcggtaactgcgtgacatccagcagttggtgtgccagtgccggcgctcggccagtccggcggcagcgccgaacaggtggtcgtccttccagaccaccaggtgggccacaccgggcggcacggcagtggagcactcggggcagatataggtcttttcggcattcctggcggtcatggtgcgcaccatccactcgccgtctggggcgctttcccgccgggcaatgccggcacgcgcccgttcgaggtcgagctcgggcacctcccggctgcccttctttccagcgccagccctcccggagacggaaccctttccggacactggacggcggggtcggttggagcgcggcatgcatccattctgccccagccgccgtgctgtttaccgcgggcagacccggcggcggtgggcaccggctgccacctgcatgcgtggcagacggtagtctgtacggcgtgcgacttgtgatagcccgatgctccgttgattatgttggccggctcaaagcccacctcccgcttgccaccaggctcctgctggtgaaggccgacggctccgtcctggtccattcagacggcggttcctacaagccgctcaactggatgagccccccggccaccctcagggtttcctccccggaggacgtggaccttgagctgggggtgatggagcagtggaccgtccagtcggccaagaccgatgaccggctcatcatcaacatccatgaaaagctcgatgagtcgtcccacgatctcggcgtggaccccgggctcatcaaggatggcgtggaggcagacctgcagcggctcctggccgaacagattgaaacactgggaacgggatactccctcatccgccgtgaatacttcaccgccatcggtccggtggatatcctggcgcgcgacgccgagggcgccacggttgccattgaactgaagcggcgcggcgatatcgacggcgtcgagcaactcactcggtaccttgagttgctcaaccgcgacccgctgctggccccggtccgcgggattttcgcggcgcagcagatcaagccgcaggccaaggttcttgccaacgaccggggcatcgattgcatcacgctggactacgacgccatgcgcggcgttgacgacagtgagtcccggcttttctgagtgcggccttttgcgcacggtggccggatgtatatctcactgacgtgcgcattaacctctactttgcccaaaatttatccattttgaagcccaaaccgttgacctgcgggaacgggcatgaaattcttatctcagtctttgtgtaggtgtttttcatgctcgcaagacatgttgcgagcgcggagctcctgcaccgccggttccctttccggggcggcgaaccaggattcttctcgcggagtgaccaaggccggcacgaggtgtgccgatcttaaaaagttccacaatgaggagaaataaatggcacagggaaccgtcaagtggttcaacgctgaaaagggcttcggcttcattaccccggatgattcggacggggacgtcttcgtccactactccgaaatccagaccggcggcttcaagaccctcgatgagaaccagcgcgttcagttcgaaatcggccagggcgcaaagggtccgcaggctaccggcgtaacgctggtctagtccccgcccgccgccgcaaccgcggccggcagcaaaatggcccccggcattcatgccgggggccattttttatgttctgtttccagacgcgggaattgcaggaataaacgtgtgcaaaaccggaagccccctatgcggctggagattcatcacacaatgcggcggtattcactttcctaaactccgcaccagacgcgcgccctgcgcaagtgaaagcccgggaaggtaggcgcgggtcagcgcacggccaatggctggcaggtgcagcgggtcctggtagaagaggtagagtgcccggtactccggcttgaaccttgatttgaacgccgccagggaccggaaaccgtagacaggttcgagcgcgtgccccaccaggtccagaattttcaccaggttctccggccccggctgcccatccgccccgccaccggggttcccggcaggaccgtgccccgcggcccctgcctgccccacgggaacccgtgccagcggagaaccggacagggagatgacctccaccgagccgcgcagctccaggaccgcggaggcgatcaggaactccatcaccccgggaaaaccttcggcgccacggcgcatgacgtccagcgtccggctgaccagccgcccgccgtcgtacacgggaagccagctggtcacgccgtggacggttccgtcgccgtccacggcgaggcagcacagcacctcctcgtcctcaagctcgtccacaccgcccagggtgaagcccatctcggggactgactttcctgctgcccattcttcggacacctcgctcaaccgtgaccggagcgccgccggcagcgagtggtacggcccccacacggcacgcactcccagcttggcggcccggttcagcgctgtccggacgttctgccattcctttcctttgaactcaagctcgcggatcggcaaccgcgtttcctgggcaacggcaacacgggcgaacccctgttcctgcagcgccggccacagtgtggcatcgcacgaatacagcgccgggatcagcgcgtggctccggcagtagtccaggaactccccggtgacgcgctgctgggcttccttcggtccgaaggctccgccgagggtgagggcaacactgccgtgctgctggaaggcgacggcacccttgccgtcggagctgaaccaataggtgttgggctcccacagcgccatccacgagagcgggccgccgccctggcgcagcagcgaccgggccctgtccctgtcctccacgccggagtccgtgccatgggccttgcccaacagcacccaccacactgccgccagcgcgatgacccagaaaaccggtccggaataggcaaacagtacagactccagggcgttgcggtcagcgaaaactccgctgtagtgctgcgggatggggatggggacgtactgcctggccagctcagccagcagtcccagcaacccgccgtcgcgctccagccctcctgaccagaaccaggccatcgcgtaggagccggccagggcaagccacgttcctcccgccactgccgcaagcacccggcgggcggatggcgttgtctgcacccggaactgccgccggttcagccacaggaccagcgccagcagcagcggcaccactacaaggggaagcacgtgggcaaaggcggagcccaccggcccggcatggggcacctggctcctcgagggcaacagggcgaagagggcaaggtagacggcggccagcgccgtaacggccaactggatggcgatggcgatgttcagggcaaggcgccggccgcggcgcatgccgtccgcacagatcagcagcagggctaccggaaccaccgccaaggccagcccgacgggaccggcaaaaccggcccggccctcttccaggcaggaagcgtccaccgtcgcgccgcagttgaacgccagctggccaagcgtcggcaacggattcaggaccacgtcgcgcagcagtgccagcggacccgtgggcgcccgggcgatcccggtcaggatcggccccacggcaaagacggcgaccgtgagggccaggaggttcctggtttcgcgtcccgttgaacggtgccggtggagctgcccctggtccccctggatccaccacccggccagcagccccagcacggctcccagcagtccgatgacagtctcagcgtgccccacgtacaggaccagcagaagcgagacggacagcacggctgtccgcagccggcgctgccacaggaccggcagccgcgcgcttcccgccatgcccgccgtcagcaggggggcatacgggcccatcaggacgtcgtcggccatccggtccagccaaccgtcgcccacgtagccggcaacctgggtcaccagcaggaacagcgtgacggcggcgaactggccgcccagcagcagcgcgatagcggcccgcgttcccagcctgcgctcggcgggacccaggaacaccacgatcatcagcgcggccaccaggtaggccagcggattcgtggcgaagaagaggctggtaaagagggaccaccagtttccgtcccggagagccggcccgctgacacccgcaagacccaacagctgttcgggcgggcctgcagcgaagctgccggtcactgcccccgcggccaggaaaagaccgagcaccgaaagcgtaaagggcgccgacttcagggctgttttcccgtcatggagggcgggcagcaccaccgtggaccacgcgaggcgggcagtacgcacctgcttttccgcagtcacctctccagcccccaccgctcggccaggaagtccagtgcgtcggcaatacgcttcgaggaggtatcccaggagtgaccagtatgctccacttcgtaggcgcgcaccgtaaagccggcgtcctccgccgccgcggccagggtgcggaggtacccgacgaattcggggtcgtcctgcccggcggtcaggtacagtccgctgccttcgaagcgctgctccttcatgatggccaggggagtctggcggacgaaggcctcagggtcccccgggaaggacgcctcgatggtcttgtggcgttccttggcaatcgcgggttccgcctccccggagaaggacaaaaccgagggaaagaggtccggatgcctggttcccaactgcagtgcgcacgtgccgccgaaggagaaccctccggccgcccacctgcggtggtctgtgtcgacggcgagcgtggactttatccagtgcgggacgtcctgcgaaagaaaggtgtccgcgcgtgctatccggctgtccatgcacatggtgttggcggactgggatccgttggggtcggggaccaccaccacgggggccactcccccgtgtgaggcggcaaaggcgtccatgtgggactgcagcgcgccaccggtcagccagtctgccgggccgcccggctgtcccgccaccagcaccagcaccgggagggcgggacggttctgggcaaagtaggcgggagggaggtagatgtaggcttccctggtgtccattccggagtcgtcccccgggatcacggaccggcgcagcgctcccccggccggcatctccccctgcgctgtccacccttggagcgtggcgccgtcgggctccccaggctgacgcatcagctcccgctccagcgcggggacccgcgccaacgccgtgccgaaaagatcgctgactgtgcggttgaggccatagtaggcattgatctgtaccgcagagaaagccgcaaccaggaggactgcggtgagtccggtgccgcggctccgccaactgccgcggggcacccgcaggaccaggagaatgagcgcggcgacggcggccactatccagagcagcacagtgtccgggatgttggcggggaagaccgagaagacgttgatgagggcccagtgcacggcggcgaccagtccgaacgctgcggctgcgcctgccaggacccggaacagccaggggcgggggcggatgccggaaggggccaccaggaggtacaccgccccggcgaggcccaggatgagggaaacccaatagaccggcccgtccacgagccggacatcaaagagccagtccacgtcggctagcgccaggtgcccatgccgatgaccggaccggcctccagccaggacgaaaggcctgtgtaggcgtcgaacttcatggcgaggcgcaggtccttgccttcataccgcagttcgactatcacgacgtcgggctggaccttaacggcctcggcctccgtgggtttgcggcggcccaccagttcaaggctgtggcgcttgaacttgtgtttgggccggacgctgagagagatcaggcggaaccactcgaggtcgttgtcctgataacgacaaacccccatctgccagctgtttccagccatgcaaatggaggcgtccaccgtgccgagggcacgccgcaggttgaagcggcgtacccccgaaaggcacagtgcaaagatcagcaatccaaaaacgattgccatggcgatgaacggaagactcgatgcgtccatcaaggtgatgctagcggatcccagcggtagccgagccgcccagctgggcgttgtcagcaacgatgaccacacggttgttgtccacggagaagaacccgccgtcgacgactaccgcgattcggtctcccgataccggctggatcgccagttcaccctcggccaggatcgccagcaggggcgagtggccgggcaggattccgatttcaccatcgctggtgcgggccttgaccatcttggccgctccggaccacacgaagtggtccgctgcgacaatctcaacctcaagctcagccatattacttggtctgttcctggatcttggcccactggcgctcaacgtcgtcgaggccgccgacgttgaagaacgcctgctccgcgatgtggtcgaggtcgccgtcgcagatcgcggtgaagccttcaacggtgtccttgatggaaaccgtggagccctcaacgccggtgaactgcttggcggtgtaggtgttctgggacaggaactgctggatgcggcgtgcacgcgacacgacgatcttgtcctcttcggagagttcatcaacaccgaggatggcgatgatgtcctggagttccttgttcttctgcaggatctgcttcacacggacagccgtgttgtagtggtccttgccgatgtactggggatccaggatgcgggaggtcgacgtcagcgggtcaacggccgggtacagaccacgggaggcgatttcacgggaaagttccgtggtcgcgtccaggtgtgcgaaggtcgttgccggagccgggtcggtgtagtcatctgcggggacgtagatggcctgcatcgaagtaatggagtggcccttggtggacgtgatgcgctcctgcaggaggcccatctcgtctgccaggttgggctggtagcccacggcggacggcatgcggccgaggagggtggaaacctcggaccctgcctgggtgaagcggaagatgttgtcgatgaagagcagcacgtcctggttctgcacatcgcggaagtactccgccatggtcagtgcggacagtgccacgcgcagacgcgttcccggcggctcatccatctggccgaatacaagggcagtgtccttgagaacgcccgcctcttccatttcaacccagaggtcgttaccttcacgggtacgctcgccaacaccggcgaatacagaggtaccaccgaagttgcgggccacacgggtgatcatttcctggatcaggacggtcttgcccacgccggcgccgccgaagaggccgatctttccacccttgatgtacggggtgaggaggtcgatgaccttgatgccggtctccagcatctcggtggaaccttcgagcgaggcgaagctcggtgccttgcggtggatcggccagcgttcgctgatgtccagttccgactctgcaacgtccaggggctggcccagaacgttgaagatgtggcccttgacgccgtcgccaacgggtacggagatgggggccccggtgtccactacgttggtgccgcggaccagtccgtcggtagcctgcagggagatggcgcgaatgaggttgtcacccaggtgcagggcggtctcgaacgtgatggttttggttacaccgttgagagtaatctcggtggtgagggcattgtagatggacgggattgcgtcggccgggaattcgacgtcgacaaccgggccgattacgcgcgcaatgcggccggtggcaccggacgttgcggctacgtgttcggtagcagtggcagtcatctctctcacttcactcagtagatggcgtgggtttaagtttatctgtggtggtgcaggtccagcggaatccggtctggtgcaggctaggacgcgagggcgtcggcgccggcaacaatctcggaaagctcctgcgtaatttcagcctggcgggccgtgttgcgcagacgcgtgtacttcttgatgaggtccgtggcgttgtcgccggcggacttcatggcccgctggcgtgcagcaagctcggaagctgctgcctgcagcatggccgcgaagatgcgtgactcgatgtagcgcggcagcagggcgtcaagaacgcgctctgtttccggctcgaactcgtacagcggcaacaggtccgattcagaagcggcctgctcttccactacttccaggggaagcaggcggatgaccgtgggctcctgggtgaccatggacttgaatcgggtgtaaaccacgtggatctcgtccacgccgccctcttcgtagtcggtcgcgaactcggccagcagtgcctcgccaatttcgcgcgcggtggtgaactcaggcgaatctgtccctccggtccagacccgtgcgtattcacggttccggaaatcgaagtaggcctgggccttacgtccaacgacgtaagtcttaacttccttgccttcttcgtggagcagctcaatgagaccttccgcctgcttgagcacgctggccgagtaggaacctgccagtccgcggtccgcggtaattaccaggacggcggcacggcggatctgctccggctcagtggtcagcgggtggtcgatttcgctctgacttgcgacagcagaaacggcgcgcgtgatcgcgttcgcgtaaggcagtgaagctgctacgcgcgcacgggccttgccgatgcgcgaggtagcgatcagttccatcgccttgaagatcttgcgcatcgacgtggtcgagctgatcttctggcggtagacccggatctgggctcccatacttatcctttcctagcgttccgtaggccgggtgtgccgggtcctggggacccggcacacccggccggtggaactagcgcttctgcttgacgatcttttcctggtcaacctggccctcgtcgatggcggcatattcctcatgccccgcaccaaccaggtggttgtcaccttcgccgaagaagcccttcttgaagtcgacgattgccgacttaagagctgccgcggtgtcatcgtccagcacgttggtctgcgccagcgtggtgaggatcgaggacttgtgcgtcaggtgctccaggaactcggactcgaagcggctgatgtcctcaaccggaacgtcgtccaggtagccgttcgtgccggcccagatggagacgacctggttctcgaccgggaacggtgagtactggccctgcttgagcagctccatgaggcgggcgccacgggtcaactgctggcgggatgcggcgtccaggtccgaggcgaacatggcgaatgcctgcatgtcgcggtactgggcgaggtccagcttcaacgtaccggagaccttcttcatggacttcacctgtgcggcgccgcccacgcgggacacggacacacctacgtcaacagcggggcgctggttggcgttgaagaggtccgactgcaggaagatctggccgtcggtgatggagatgacgttggtcgggatgtaggcggacacgtcgttcgccttggtctcgatcagcggcaggcccgtcatggaaccggcacccagttcgtcggacagctttgcacaacgctccagcaggcgggagtgcaggtagaacacgtcgcccgggtaggcttcgcggcccggcgggcggcggagcagcagcgacactgcacggtaggcctcagcctgcttggagaggtcatcgaacacgatgaggacgtgcttgccgccgtacatccagtgctggccgatggccgaaccggcgtagggtgccaggtacttgaagcctgcggggtcggatgccggagacgccacgatggtggtgtactccagtgccccgttgtcctcgagggtctggcggatggcggcaatggtggacgccttctgaccgatggccacgtaaatgcagcggacctgcttggtcacatcgcccgaagcccagttggccttctggttgatgatggtgtcaatcgcaatggccgacttgccggtctggcggtcgccaatgatgagctggcgctggccgcggccgatcgggatcatggcgtcaatggccttgagcccggtctgcatcggctcgtgcaccgatttgcgctgggtcacgccgggagcctggagctccagtgcgcgggtagtttcggccttgatctcgccgaggtcgtcgatcggcatgcccagcgggtcgacaacacggccaaggaaggcgtcgcccacgggaacggacagaacctgtccggtgcggtggacttcctggccttcttcgatgccggtgaagtcgccgaggatgatgacgccgatttcgcggacgtcgaggttctgggccaggcccagcgtgccgtcctcaaagcgaagcagctcgttcgccatgaccgagggaaggccctcaacacgggcgatgccgtcaccagcggtagatacgcggccgacctctacgcgttctgcgtttccgggttcgtaggacgccgcgaactcgttcagcgcattacggacgtcgtcggcgttgatggtcaattcggccatctgcagtccctgctctcctgttttgtgatcaccgttgccgatgaccggggtttctatcagtttgtttgtgcttgtccggctagccggccagctggcgttgcagctcgcccagcctggtgagtaccgaagcgtcgagcacttcgtcaccaacctggacgcggatgccgccaatgagtgccggatcaacgttgaggttgatcttcagttcccgcccgtacatggcgttcaagcccgcctgaaggcgtgcaagctgcgtctgcgtcaggggacgggttacattgaccgttgcaatccagcgctgctgccgcttggccgccagctccgcgaaacgttccaccagccgggtgggcttgatgccgcggggctgggtaacggcctgccggatgaggactttggcttcctcactggcggcgggcatcagcttttcggcaaatgccgacttggctgcagcgctggcctgtgtttcggacagagcacgttgtacctcgtggttggaggcaacagcctggttgaaggagaacagatcgttctccagttcttccaggccagtgattccggaggcagaaacggccgacttgttttcggcaacggaaatgaccaccgttgcggcaagagtctcgagtgcatcgccgatgtcacgggcggttgcccagcgcaggctggccagcccgctcgcgatatctgcagcatcagcggagacttttccgccaaccagctgcctgaccagcgccgacttttcgtcaccgttgcgggacgggtcagtcagggcgcggcgcaagccagccgagctgtccaccattcccagaattccgaagagttccttagccagctgcagcgacgccgtcggaagcttggcttccaacgctgtcagcgctgttgccagcgattcgctcgatacgcctgccattacttagctgcacctgcgttctgggtctccagatctgccaggaagcggtccacgacccgagctgcacgctcatcgtcgttgagcgattcgccgacgatccggccggccagcgtggtggccagggtgccgacctcggagcgcagggacacaacggccgcctggcgctcggattcgatctgtgcgtgcgcctgggccgtgatgcgggcagactctgcagctgccttctccttgagatccgcgaggatctgggcaccttcggcgcgggcttcctcacggatgcggttggcttcggtgcgggcgtcggtcagctgctgcttgtactcttcgagtgcagcagaagcctcagcctgggccttttcagcctttgcaatgccgccttcaatggcctcggcacgctcggcgaaggtcttttcgaacatcgggacaacgaacttgaccacgatgaacatgaggatggcaaagcccacgaggacaacgcccatttcccagatgttgggaaccagggggttgacttcgccctcagtggcggctgagatgatcagctgattcatatttcacccgtccttttctactcggttctgtaagttcgcttcgttctaaggactagagaacgaaggcgaagaccaggccgaggatggcgagggcttcggtgagcgcaaggccgaggaatgcgatcggctgcaggacgcgctgtgcttccggctggcgtgcaacgccgttgatgtaggcagcgaatacgaggccaacaccgataccaccgccgattgcggacagaccgtaacctacgaggttgagattgccttccatttttcttcctttcaagatgccacccatgtggcaggttgtttgggttgctctatccccgcgaggggaagtctttgtgtgccttccggcgcgatgccgtgcggcgggtgcctagtggctgtcggcgtgcagtgcgccttcgatgtagatcgcggtcagcagggtaaagacgtaggcctgcaggaccatgatcagtgcttcaagcatgtacatggcgatcgcgccgccgagaaccaggagcgaggatcccttgagcaggatgttctcctgcatgacgaggaattcgatgccgtagcctgcgatcatcacgatgaggtggcctgccagcatggtggcgaacagacggaggctgtgggtaaccggccggaccaggaagttggagatgatctcgatcgggatcacgatcggaaggatgtaccagggaacacctgagggtacggtggccagcttgaagtaacggagaccgttcttcttgacgccgatggcgatccaggtgaagtagacgatgcccgccagcacgtaggctccgcccacgtgtgagaacgtggggagctggaagaacgggatggcgccgtagatgttgtttaccaggatgaagaagaagaggctgaacaacagcgggacgtactttatgaagtctttgccgccgatgatgtccttggcgattccgttgcggacgaagccgtaggcggcctcgccggcgaactggagcttgccgggtaccagctgctgcttgcgtgcagcgagcacgaagaagacggcgataaagacgacagagaggaggaccagcagcatctgcttggagaatccttctgcggcaccccacggcaggattgccggcaaatgcatttcgttaataccaggaggagtgaactctcctgaatcttgggccgggagcgcaagcgcgatcaacgcgtttcctctctgcagtgtccatcattgggcgttgggcggggatcggcagcctgatggcctgctgttccccctgtgaaattatttggcattagtgtcgccgtcctgggacggcccgctggcagcatggcgctccccagcgttgtttcgagaactggtaaggccatgcatgtgggaaaggtaaaaacctccgacggctccaagcagagcgcctgcgagcacaatccagcgcgttccccacacgtaatccagtccccaccctatcaaactccagacgatgattccgccaatgatgtagctgaatacggccatgccggcgttgtatccgccgctggttccgtcgcctgatacaccgggggcggaaccggtcgatccaccgttgccgttgcggccttcgttgggcttcttcggatcacgcatcggggtcttccttggtttctggatcgttgtagatctggaggcgcgctttgctgaaaccgtagatctcagccgcctgccacagcaccaccgcggtgacggcgccggcaacaaaccagcgcccatccagccactgcggtgttccgacgacgaacaggatgacggcgaagccgaccaccttgacgaagtaggttgccacgaacatgccgatggctccggaaggattggtgcggcccacgaaatgccctacgaggaggctgattccgaagaacagcatcaccagcaggccacctgaagtgctggaaagcgccccgttcacgccgtccagcagcatggccggtacagcgcaaaggaccaggccgcatgccgaagcgatcgagctcagcttaaggaggtgcagccagagcgacggcgtggggccggatgcgccaacgtttccgttgccggacagaggtccggactcggcgttggaggtcattcgatcccaatcgtcggcacctgcggcagatcattaacaggctgtgtggaggggcagctttggctgcccctaaattctacacgagatagaaatatttccgcacggacgttacgcccggctctcttccccccggcgggccaggtagggccacgcagtgatgaggcccatgaccagggtggcgaagaggtcgatggacagcacaatctgccacgggaagatggcgaaggccagtcccccgaaggagaggatggcggtccagaggtacatcaggatgactgccgtgcggtgcgagtagccgatgtccaggagcttgtggtgcaggtggccccggtcggcggaccagggcgagcggccccgggcagttcgccgcaccaccgccaggccgaggtccagcagcggaaggaagaggaccgcgaacggaagcaggatgggaatcactgtggagatgccgttgaccctgtcgtagagccccgaggtgatctgtcccgtggacactacaccggccgaggccatgagcagcccgatcagcatggcgccggaatcgcccatgaagatcttggacggaaaccagttgtgcggcaggaagccaaggcagctgcccaccaggaccgcggtaatcagggtcgcaaggtccgaatagtccagcaggaccgcgttgcggtgcacccagtaggcagtgaagaagaacgcggtgccgccgatgatggcgacacctgcggcaaggccgtccagcccgtcgatgaagttgaaggcattcatggtggtgacgatcagcccggcagttagcaggacccggacggtttcattctcgaggtagatcggctccggaacccaggggacgatggtcatctggactccccagatggccacggtcaggcctgcaacgctttggccgatcagcttcacccaccaccggatgtccagcaggtcatcggcgacacccaccagcacaatgacggctgcgcctgcgaggacaccccatggcgagaagttgttccggtagatgtccttcacgaaaaaggactggctggcaacgatgagggccgccatgacccctaggaagatagccacacctcccaggcgcgacacgggaatggaatgcatatcgcggctgcggatgggcatgtggagttcgagccggtggccgatcacccgcgccccccatgtagccgcgtaggacacgacagcagccgtcagccccatcagcaggtacatgatcatggggcgggttccgtttccggggggacgctgcagccgggcaacggcactggcagcttgtccttggctatggggctcattggccgggaatctgttcttcgataaatgaaacttctccgtcgccgagcgcgcggcaggcagtgcgtatttcctcatacgcggtgccttacagggctgtattacagtggactctagtcaaagatactagcgccaacagcttcatggcttcgcgccacactggcgcattgcgagcggggaaatccctgtcagccatgctgaaaggacccccatgaccccccgcatagcagttgctgccgtgaccttcgaccggccgaaggaactggctgtcctgctggattccatcaatgcccagacggccgcagtggacacaatctgcctggttgacagcggcaaaaccccggcgcgtgaagcagccgcagtgcatccgaacgttgattacgtccgttcggaggccaacctcggcggtgcgggcggcttcgccctggcagcgctcaaggcagtggccagcggggccaagtggatctggatgatggatgacgacgccgaaccggcagatccggaatgcctcgccacgctgctgcgtgaggctgaggcacgggacctggaggcggtggttccgctggtgaccgcgcctggccagccggaccggctgtcctttttcttccgtctggacggcaaggtgacgcacagccgcgccgaggtggagaagcttggcttcctgcccaacgacggacatttcttcaacggagcgctgatccgctccgatgtcttcttcaaagtgggactgccggacatgcggctgttcatccgcggcgacgaggtggacttcaccattcgactgcgcaaggcgggcatcaggtttggcaccgtgaccaccaccgccatcacccacccgcatgcgttctcggaaacccagcatgtgtttggcgcaggctggcacgtcatcgtcccggagtccgcgttcaagcggtactactattaccggaaccgcggctacctgatccgccggtacgtccgcgtccggtccttcgtggcggacgtgggtggctatgtgggctatttcgcgcagcgccgggacttcaaaggcttcctgggttgggccaggtccttcaccgccggcctgcgcggcaagggctttgccccgctggaggaccagaagttccagtaagcccttccggtcctgccgcgcttacttgccgggcctgggaacgttgcgcttcaagcggcggcttcccaggagccacagcagtacccagggttctccgagcacgcggtaggcaacacggcggggatgcagcagcagccgccaggcccattccagccccatccgtcccagccagcgcggtgcaagcttctggaatccggccagctgttcgatggctccacccactgcgcagtacgttgccggcggcatgtcggcgaggcgccgctgcagcacttcctcctggaggggcatgcccaggcccagcaggacaagctgcggctgctgcccgtggagccatgcaacagccctgtcttcgaggtccccgttccagccctctccgggcaagcccgccacccgggcaccagggacaatcaactccagttgcctgacggccgcggcatttgcctcggcgccggctccgatcactgcaatccgctccaaaccgtgcacctggcccaaagccggaagccagtccgtggtacccagccggtagtccatgaccggcccctcggctttgccggtcctcccccacagccagagcacaggagcaccgtccagcaaaactacgtcgctgcgctggtagaggttccggaagccttcatccgaaagcgtcagtgtgacgctgtgcaggttgtgccccagcaccgtgcgcgtggagtcttccgcgacgaaccggctaagttccgacatcagctcgggaacccggagcggtgtcgcatccacctccaggaccggaatccgctggcggtccagagccatcacggttcagggttccgaaccggcgccgggacagctgcgcgctcctcggaaggagactccgcagcggcagtcccgacaaccgaagaccccctggcagggcttgcttcggcaggtgctgcttcgtcaggtgccgctgctgcttctgccggtgctgcttcagccggttcctcttcggccatggggatttcgccgaggcccaggactccaggtacgtgttcgcgaagctggtccagggtcaccgcaccgttccggaccacgcgcaggcgcggacccgtggcgtcgacaatcgtggacggtactgcggcctcgccttccagtggccggaagccgccttcaaggtagacctccacggagtcggccagctgctcgcgggcggcagcggcggtctgtccgggggcatggccggtgcggttggccgaagaaacggccagcgggccggttagggtcaggagctcctgggcgatctcatcgtccggcatgcgcagtgccaccgtgcccttagtctcgccaaggtcccagtccagggaaggctgcgcgtgcaggatgagggtgaggcctcccggccagaaagcctccgccagtttgcgggcgtcggccgggacgtcggtggcgaggccgtccagggcattgatccgcgggatcagcacgggcggaggcatggtgcggctgcgtcccttggacaccaacagcatggtcacggcctggggcgagaaagcgtcggcggcaatcccgtagaccgtgtccgtgggaaagaccacgcacttcttttcgctgatggcacgctgggcgtgctcaagtcccttggcgcgctcgtcgtcactggtgcagttgtaggtagtggtcactcgcctattctttcattcgctgtggtccggatctgcgagcagggcgctggtggcgcgctccttgccgttgaggtccagatgcgtcctgatcccggtccagtttcctgtaccggccaagtgatccgaaatccagcgcgcctggacctcggcatgctccatcacaaagtagccccccggccgcaggaggcgggccgcggaggcagcggccgccgtcggaagttccatgccgtccgctcccccgccgtacagcgcctcgggcggatcatgcagggcgacttccggctcgttggggatggcctcggcgggaatgtacggcgggttggacaccacaacgtcgaacgtcccgttgagctcgggcagcgcgttccgcaggtcccccaggacgagccggacacccagcggggccaggtttttttctgcccaggcgtgggcgaaggggctgaactcgacggcgtgcacctccgcgcccggcacctcgtgggcgatggagcctgcgatggcacccgagcctgtcccaaggtcgacgatccgcgggcgggccatcccgcggacgtggtcgatgaccagctgcgccaccgattcggtctcggggcggggtacgaaaacgccggggccaacagccagttcgaggtagcggaaatgcgccactccggtgatgtgctgcagcggtatgcggctggcgcgctccgccaccagcgccgcatagccctccggcgcgggcgcatcccccagcatcatggcacgcaggcggccgagccccacgttcagcaggtggtcggccaaaagctcagcgtccacccgaggactggggacgccggcgtcgcggagtatgttcgttgccgcactgacagcgtctgcgagcgactggcctggctcgagtgtcatgtgttgaatttaccgaagggactagtcgccgatggcgtccaggcgtgcctgttcgtccatctcgatggccgactggatgacgggctccaggtcgccgttcatgacctggtccaggttgtacgccttgtacccggtgcggtggtccgcgatgcggttttccgggtagttgtaggtgcggatgcgctccgaacggtccatggtgcggatctgggatttccgctgggccgagttctcggcgtcgatctgctcctgctggtgcgccaggatgcgtgcccggagcacgcgcatgcccgcttcacggttctgcagctgggatttctcgttctgcatggccaccacaatgcccgtgggaaggtgggtgatgcgcacggcggagtccgtggtgttaacggactggccgccgggaccggaggaccggtagacgtcgatcttgaggtcgttctggttgatctcaagctcttccggctcatccacttcgggcaggaccaggacgccggcggccgaggtgtggatgcggccctgcgattccgtcacgggaacacgctgcacgcggtgcactccgccctcgaacttgagccgcgcgaaaacgccctcggcgggatcattggagctgccttttacggcaacctgaacatccttgtagccgccaagatcggattccgtggcggaaatgatttcggtcttccagccgcgggactccgcataccgcgtgtacatccgcagcaggtcggccgcgaacagggcagcctcgtcgccgccttcaccacccttgacctcaaggatcacgttgcgggcgtcgtcaggatcgcggggaatgagcagccgccggagtttggccgccgcaacttccagcgcctcctccagctcaggcacctcggctgcgaactcgggatcctcgtccgccatctccttggcagcagcaaggtcatcctggatggcttcccacttgtggtaggcctcaacgatgccattgagctgagccgaacggcgccccagtttccgggcaagccgctggtcggcatagacagcaggatcccccaactgcgcctggatagcatcatgctcatcaagcaggccctgtacggactcaaacatttccaaaacctctttcgacttgtacaagtctagtaacaaacgaagacgggaccgcggctggtgacttaacgacgaagccgcacggattcttccgccccgggagcattcgatgactcccaaccttcgcaagctcaggtcggggccctgtcatctctcttacgggcctgccggagctgggaggctaacgatcgaagatcgtaagcctcccagcgtaggggcgggggcggaaaaatccgtgcggcgtcagctccggggcagcagatcagccgctcaccggagcgttatttgtcgttatccgacttcgcaccaagcgtcgtcttctggacctgcatgaggaactcgacgttgctctgggtttcccggatcttgttggtcagcagctcaaggctctgctgggtctcgagtccggaaaggacgcggcgcagcttccacatgatcttgacttcctcgggcgagagcaggttctcctcgcggcgtgtgccggacgcgttgacgtccacggccgggaagatgcgcttgtcagccagctggcgggacaggcggagctccatgttgccggtgcccttgaactcctcgaagatgacctcatccatcttggaaccggtctccacgagcgcggtggcaaggatggtgagcgaaccgccgttttcgatgttgcgggctgcaccgaagaaccgcttgggcgggtacagcgcggcggagtccacgccaccggacaggatgcggccggaggccggtgctgccaggttgtaggcgcggcccaggcgggtcatggagtccagcagtaccaccacgtccatgcccatttccacgaggcgcttggcgcgttcgatggaaagctcggccacggtggtgtggtcatcggcaggacggtcgaaggtggaggcaatgacctcacccttgacggtgcgctgcatgtccgtgacttcttcggggcgttcgtcaaccagcaccatcatgaggtggacctcagggttgttggtggtgattgcgttggcgatggactgcagaatgagcgtcttgccggccttcgggggcgaaacgatcaggccacgctggcccttgccgatgggagccacaaggtcgatgacgcgggggccgatcttcttgggatcggtttccagccgcaggcgctctgacgggtagagcggaaccagcttggcgaactcaacgcggtccttgagctcctcggcggtcttgccgttcaccgaggtgacgcggaccagtgcgttgaacttctggcgggcggactgctggctgcggtcttcgccttcgcggggtgcacggattgcaccgacgacggcgtcgcccttgcgcaggttgtacttcttgacctgggccagggaaacgtagacgtcgttggggcccggcaggtagccggaggtgcggatgaacgcgtagttctccaggacgtcgaggatgcccgcgacgggcagcaggacgtcatcctcggtgacctcgacgtcatcgacgtccggtccctgggaacggccgcggcggcggtcgttgcggtcgcggaagcggtcgttgcgggagttgtcacggctgtcctggccgccggagcggtcattgcggtcgttccggtcccggcggttgcggcggttccggcggctgccaccatcggagtcatcgccgtcgcgggtgttgtcgcggttgtcatcgcggcgggcgccttcgcgctggcctgcctcgcggctgccggcgttgtcccggccgctgtcggcattctcgcgggcagcgttatcgcgtccggcgttgtcacggccgcgggtgcggccgccttcacggcggtcggtgcgctggccggaatcgccggcctccgcgggagtttcggtgcgctgttccgacgtgcgctgttctgaagtccgctgttcgacgaccgcctgttcagcaggtgcttcggcggcctcggcagcctgcggcgcagcggctgcttcgccgcggcggcggttgcgggtgcgcggctggcggcgttcggtagcactttcgggcgcttcggtggcctcggcagcgggtgcctcaaccggagcggcggtgctcgtttcggcggtggccggctccgtggccgccggtgccacaactccgtcgctgacggcgcgccggctgcgtccgcggccacgtgcccgggttccttccgcgggagcttccgttgcttcagcggccggggaagacactgcggtggcagcggccgggagttccacggccttttcggttgccctggcgggagccttggtcatgggagtaccggcgcggtgggcggagatggccgaaaccaggtcccccttgcgcatccgggaaccgcctgaaatgccgagctggctggcaagtgcctgcagctgggcgagcttgaggcctgcaaggccgctgctcttggcgggagctgccggtgattcggcagcagaagatgatagttccacagctggcgacagctcagtggtttcggtcacgaaggatccttccccctcgacggcgtccagactgggagctggacgcgatgatttgatctgggctgcagttcagatctgcagccggattgctcggccttgccggttggatttcggccagcagggccggatactgattcaccttgcgctccacccatggcgggacgccggactgacgcttcaggggcagtttgagtgctgcagattcctgcgacagacctagcaggcggcaccggaatggattgcgcagtaagagaccaggcggcaactaagtgcaaaagcagatcagataggcggaattaccgccggtgcaactccaccttagcaccttcgacgtccactgccagcttcagtacgcgccaggcaatatccggcgtgttggctgcggtgaactgcccgatgaaagccactgcggcggcggcttcggcttctccgttggcaaggaccagcaccgtgggccccgcgcctgagacaacggcggcgtggccggcggcccgcagcgcaccgatgagggctgcgctgggccgcattgcctcggcacggtagctctggtgcaggtagtcttcggtgccggccagcaggaattcggggttgtgcgtcagcgcgtggatcagcagcgctgcacggcccgcgttcatggcagcggcgtggtgacccaccgatgccggcagcagggcacgcgctgcctccgtggacagttcgtaatccggaaccgcgacgaccgggatcaccgaatccgccaccgtggcgctggtgctgctgtactgctcactgtcctgccaggacagcgccagaccgccgaaaatggcgggcgcgacgttgtccgggtggccttcgatttcactggtcagctgcaggacccagtcccggccccggcggtacgcttcgggaaccatggcgtttgccgccgagactgcggccaccaccgcggaggcggacgagccaaggccgcgcccgtgggggttgacgttgtcggcggtcaccttcaggccgccgtggcggaagcccagccgttcgaacgccgcttccatggccctgatcaccaggtggcttgcatcccggggcagggtttccgccccttcgccgcggagctcgaacagcagttcgtctgtttccaggctctccaccgtcagggtgtcgtgcaatgccagggccaggcccaggctgtcatagcccgggcccaggttggctgtggttgccggcacccggacggtgacgatctggccggcctcgatgggttgcagtccgacagcggccggcgaggtggtttccaaggctatttttcttccagtcccagttcagcagcaaccgtgaccacgtcgttgggtaccttgaccggctgtacgtcgctgccgtcctcggtgcgcagggcccactgggggtccttgagcccgtggcccgtgacggtgatgacgatggtcttgccggaggggacttccccggcggcgtgcttcttaaggagccctgccacaccggcggccgagcccggctcgacgaagactccttcgcgggcggacaaccagcggtgcgcagtgaggatctcttcatccgtgacggagtcgatcagtccgccggattcgtcgcgggcgccgatggcaccgtcccaggaggcggggttgccaatgcggatggccgtggcgatggtgtcgggctcggtgatggggtggccggcgacgaagggcgcagcacctgccgcctggaagccccacatcgcgggggtcctggtggagacggcgggaagggtacccgctgtttcggactcgaacggagcggagtactccttgtagcccttccagtacgcggtaatgttcccggcattgcccaccggcaggacatggatgtccggggcgtcgcccagcgcgtcgacgatttcgaaggcgccggtcttctgtccctggatgcgggcagggttcaccgagttcaccaggaacaccgggtaggactcccccagcttccgggcgatgtccaggcagttgtcaaagttgccgtccacctggagcagcgtggcgccatgggcgatcgcctggctgagcttgcccatggagatcttgccttcaggcaccagaaccgcgcacttcaggccggcggcggtggcgtaggcagcggcggaggcggaggtgttgcccgtggaggcacagacgaccgctttcgcgccggaggcaacggccgccgtcatggccatcgtcataccgcggtccttgaacgaaccggtggggttcatgccctccaccttgaggtacacctcggaaccggtgagctccgaaagcttctgcgcgtgcaccaggggggtgccgccctcacccagggtaatcaccctggtggattccgtcacgggcagacggtcagcgtattcgcggatgacaccgcgccattggtgagccacttagactccttctacccgcagaacggatgtaactgaattgataacgtccaggcccttcacggcctcgacggtggccgcaagggcagcctctgacgcgcggtgggtgacgatccgcagctcggcggattccacgttggactccgcgtcgcggtggatggtctgccgcatgatctcgatggacacgccatgctcggcgaagagctgggcaatcctggccagcacgccgggctggtcggcgacgtcgagcccgatgtagtagctggtgacggccgcgtcgatcggcagcgccgcaacctggccggtggtggtttccgtccggccggggccgcccaggaccaggctgcgcgcggccgagaccaggtcgcccaggacggcggacgccgtgggggtgccgccggctccctgtccgtagaacatcagttcgccggcgttctcggcctcgatgaacaccgcattgaaggcgccgtggacggcagcaagcgggtgctcgcggggaagcagcgtggggtgcacgcgcacggacacgccctcgccgccgcccgtttctgtgtctgcaacatgaagcttttccgcaatcgccagcagcttgatgacaaagccggcgtccttggcagcggcgatatccgccgcagtcacggaggtgattccttcgcagtggacgttttccagggcgaaccgggtgtggaaggagagcgaggcaaggatggcggccttcgcggcggcatcgtggccttcgacgtcggccgtggggtccgcctccgcgtagccaaggcgctgcgcttcagcgagggcatcggcgaactgggctccggtggtgtccatctggtcaaggatgaaattggtggtgccgttgacgatgcccaggacgcgcgtgatgcggtcgccggcgaggctgtcgcggatgggccgcaggatgggaatggctccggcgacggcggcctcgtaggacagctggacgcccgctttgtccgcctcttcgtgcagggtgggaccgtcctgcgccacgagcgccttgttgcccgtgacgacgcaggcaccgttgcggagggcagaaaggatcagcgtgcgggcaggctcgatgccgcccatcagctcgatcaccaggtccgcgtccttcaccagggtgtcggcgtcggtggtgaaaaggtcctgaggaaggtccacgtcgcgcttggcgtggacgttgcgcacggcgatgccgctcaactgcagcttcgcgcccgcgcgggcggcaagggtgtcggcgtcctcgatgagaatccgcgcaacctgggccccaacgttgccacagcccagcagggccactttcagggttcgcaattcggtcattcagactcccatgtcgcggttcagcagatcttcttcggtttccccgcggacaatcagccgggcagatccgtcgcgcaccgcgacaacgcccggccgggccagatagttgtagttgcttgacagggcccagcagtaggcgccggtacccggtacagcaagcagatcaccggctgccacgtcctcgggcagatatacatctctaacaactatgtcgccgctctcgcaatgtttgcccaccacgcgggacagctgcgggccggcggcggacgtgcgggacgccaggattgccgagtaatccgcgtcgtacagcaccgggcgggcgttgtcgctcatgccgccgtccactgaaacatagcggcgcggatacgtaacgttgttgccggcgtcactcgcgtccggaccgggcgcatccacgcgcaccgtcttgagcgttcccacctcatacagggtgaaggtggtgctgcccacaatggcgcggccgggttcgatggagatgcggggagcgtcaatgcccaattcagcgcaggttgaacgcacgacggcggccatcgcctccgcaatttccgttgcagggcggggggtgtccaccggtgtgtacgcaatgccgtaaccaccgccaagatccagctcgggcaggacgatggagtacttctcctgcatcgcggcgaggaaacggaggagcttctgggcggcaagggcaaaaccgtccggttcgaagatctgggagccgatgtggcagtgcagccccagcagttcgatgcccggatgcgccgacgcagccgcgacggcctcctcggcagccgacaggccggcctgttcggtggtgtccgcggtcatggagaggccgaacttctggtcctcgtgggcagtggcgatgaactcgtgggtgtgggcgtgcacgccgggcgtcagccgcagcatgactttggcctgttccccccggcgttcggcgatgtcaccaacccggaccagctcgccgaggctgtccaccacaatcctgcccagcttcatgtccagtgcacggtggatctcgcggtctgacttgttgttgccgtgcagagcaacgtccgcgccgggaatgccggcctttgccgcgaccgccagctcaccgccggaggcagtgtccagccggaggccctcttcctcgacccagcgcaccacggcggtgcacaggaacgacttgccggcgtaatagacgtccactcccccgcagatatcggcaaacgcgttgttgaaggcatcgctgaaggcgcgtgccctggcgcggaaatcgtcctcgctcatgacgaacagcggtgtcccgtactgctgctgaagctcactgaccggaatgccgccgaccgtgagttcacctgaatcgttccgggctgcgtcctgtgcccacatcttgggcaccaaggcattcaggtcggcggggaccgaaagccattcgggtgccagcggggacgcctggccttgggaatcttcgcgctgcggtgccatgggggtcacatccgttccggcgcggaaacgcccagcagatcaaggccgttggccagcacctggctggtggcgtcgttgagccacaggcgggtgcggttgacatccgtcacggcttcatcgcccatgggcgcaatccggcaggcgtcataccagcggtggtaggcaccggcaatcacttcaaggtgccgggccacccggtgcggctcgcgcagctcagcggccttggccacgatcgaggggtagctgcccaggtatgagagcagctcgttctccgtggcgtggtccaacagggaggcgtcaaaggagtcttggccgtcaacctggcgttccacacccgcggccacggcgttccgggcggcgccgcgggagcgggcatgggcgtactgcacatagaacaccgggttttcattgctgtgcttcttcagcagctcgggatccagggtcaacggcgaatccgcagggaaccgggccagggagtagcggacagcgtccttcccgagccagtcgatcaggtccttgagctcgatgatgtttccggcacgcttggacagcttggctccgttgacggacacgagctgtccgatcagcacctcgatgtggagctcgggatcgtcgccggcgcaggcagcaatggccttgagccggttgatgtaaccgtggtggtccgcgcccagcaggtagatcttctcggtaaagcccctgtcttttttggacaggtagtaggcggcgtccgcggcgaagtaggtgggctcgccgttggcgcggatcatcacccggtccttgtcgtcgccaaagtccgtggtccgcagccagaccgcaccgccgtcgtcgaacacgtggccctgctcgcgcagccgcgccacggcactttcgatggcgccggcgtcgtgcagttcctgctcggagaagaagacgtcgaactccacgccgaagtccgcaagggtggccttgatgtccttcatctgcgcctggtaggcagcggcgcggatgaccgggagggccgctacttccgtcagttcgcggatgtcagggtgctcggtaagcacctcgtggccaaggtcggcgatgtactgcccggggtagccgccgtcgggcacgggaagcccgtggagccggttgtagacggagtgggcgaagacgttcatctgcgtgccggcgtcgttgatgtagtactcagcggtgacctcggcaccggaggcgcgcaggacgcgggcgatcgaatcccccaaggccgcccagcgggtgtgcccgatgtgcaggggcccggtggggttggcggaaacgaactccatgttcacggtgtggccggcgagcgcggagttggtgccgtactgctttccggcttcgataatcgccttggcgagggcaccggccgcggcggcgtccacagtgatgttcaggaaccccgggcctgcgatgtccacggcggaaacgccgtcgatggacttcagccgtgcgctgaggatcgtggcgaattcccgtgggttggtgcccgcctgcttggccagctgaagggcgatattggtggcccagtctccgtggtccctgttctttggccgctccacgcgcacctcatcaggcacagctgatgcaggaagggcgatgtcgccggcggcgacggcttccttcaggcaggcggatatggcgagggagagttcttcgggagtcacccctctagcctaccgggggcccagtaacagcaagtaattcggggcgttttgatgccctgggggtccacaggaaacggtgaacgcggccacaggttgaaccaatacgctgtgttcggcgttgagaacaccgtaaccacttagcagttcctgccccgagtccactgacgaaacgagagccctgatgagaccctcagtccgtaaaagtgtttatgccggaatcgccggcctgtccctggcaggaacggtggccgcctgcgccccgtctgccggagactcctcccccgcgcccgcagcccccggcagcagcgcaaccggaagcactccctcatccggcgcatcaacgccggccggcagcggatcggactacaaggacggcacctacagcgcggatggaacgtacgtctcgccgaacggcaccgaaactgtgggcgtggagctgaccctggcctccgggaccgtcacggacgtgcagatcacgcagcacccgtccaacccgaacacccgcaagttccagggcgagttcgccggggggatcgcgggacaggtggtgggcaagagcattgatgagctcaatgtttccaaggttgccggttcctccctcaccagcggcggcttcaaccaggcagtggagcagatcaagtcggaagcgcgataggacgtgccgggcagcggctgggaggattttgcgtttgaggggatcggaacgcgctgggaaatttcaacgctgcagccgctcgattccgccctgcgcacgcgcctgctgagcctggtggagcggttcgacgccgactggtcccggttccgggcggattcccgggtcagtgccatggccaaggaccccggcaggtatgactttcccgcggaggctggtccgttggggcagctgtaccggactctttatgaggccaccggcggggccatgacgccgctgatcggcccaagcctggagcgtttgggttacgacgccggctactcccttcgctcctccggctcagcgctgccggcgccggcctgggacgacgtgctggagtgggccggcagcaccctcaccaccgcggctcccgttgtgctggacatcggtgctgccggcaaagggctgctggtggatctggtggctgccgaactgaaggcgggcggcatggaagcgttcatcgttgatgccagcggagacctgctggcgaaagggccggatcccgttccggtggcactggaacatccgtacaacccaacacaggccataggggtggtgcagctggcgggccgggcgctgtgcgcttctgcggccaaccggcgcgcctggggggacggcctgcaccacatcctggacggaaagaccggccggcccgtcaggaccgccgtggcgacgtgggcgctggctgacaccacgatgctggccgatgccctggcaacggcactcttctttgtccctggcgcccggctccagcaaaccttcgacttctcctggctgaccgttttctcggatggaagtgcagcccactccgccgagtttgaagggacactgttcacatgagccctgttgaaaccccgaaggcgccgccgggcgcctccttgggcgcgcggttggacactgcgctgggccggttcaccatgtaccggctggtcctttttgtccttgcagtcctggctgtgtacagcctggtgctcgatgcccttgggtggctgacgttcggtattcccgaaatgctggcgcacctggtgctgtgcctcggcctgacgtacgcgtcaaacagggcgctggcgccactgttccgtgtccggccgcactccgaatcctcgctcatcaccggcctgctgctgtacttcctgttctggccctcgttcgccccgctggacgtggcaggtgtggctttggcctgcgtgctggcgtcggcatcaaagtatgcgctcgcgtggcgcggccgccacatcttcaacgccgccgcggcgggagctttcgtggccgggctcaccgggctcaacattgcaacctggtgggcagccactcctgccatgctgtgggtgctggtgcccggcgtcctcctggtcctgcacagaacccggaagttcctgatggcctccgcgttccttgctgtggccaccgccatcatcactgcggaactgctccaggccggaacgtcctttggcggtgcgttgtggcagtccctggctcagcggccgctgctgttttttgttggcttcatgctcaccgaaccgctcacgctgccgcctcggaggtggcagcagcttgcactggctgcggtggttggcgtggtgttcgcggttccctacaacttcggtttcctggccaactctcccgaggcagcgctgctgctgggcaatgtgatcgcgttcctgatggggcagcggggcagggtgaccctccgcttcaccggaaccaggcctttgacgcccagcaccaccgagttcagtttcgagccgtcccggcctgtccgctttgtgccggggcaatacatggagctggaccttccgcacgcaaaatcggacggaaaaggacgacgccgggtgttcagcctgacgggatcccccagtgaacgcctggtcaagtttggggtgcggaccgcggagcccctgtccgcagccaagaaggtcctcctgtcgctgaacccgggagacgaggtgacagccacgtcggttggaggagactttgtcctcccccgcgatccccgcaagcctgtcctgctgattgccgccgggatcggcgtcacgccctacctttcacacgtgtcgtcaggaggcttgcgggagcgggatgcagtgctgctcctgcttgccaggagcgcggacgaggttgcttatgcggatgagttgcgggcggccggcatccgcgtcctggtccgcgtggcggacggttccgtgccgccatcgggattggccagcgcgtcctgggatggcacgcgggtggacggtgaggccatccgcgccctggtccccgacgtcgctggccgtgaggtgtatgtctcgggttcccctgcgagcgttgcgtcactgcggcgggccgccaaacaggccggggcagcaaaagtccacgttgactcgttctccggctactgatttttcaaggtttggatgtgcctgaggcagtgcggcagcgccgattttcccttgcgggccaccttactgctaagctctaggacgtcccgccggcaacggcaggaaccccggattgccctcgtagctcaggggatagagcgtctgcctccggagcagaaggtcgtaggttcgaatcctatcgagggcaccaacgagaaccaccaggaatcacggatttctggtggttctctgcatttcggcgggtactgccttgaagtgccaccccatgccctggacccttcgcgtgggaactattggcccgggctgtgaattaaacctttcagcagtgcccactcccatagccggagcactgctacccaacgaaaggtgcgtcatcgtaggccggaacgccgtgaccagcacaaaagctcccgggccggccctcccccgggagctggccagtcccaaccccgatgtccccttgcggcatacaagtgtggtcccgtgctgagccgcggcaggattcaagaaggccggcgcgggccgcttcggctgctcccgtggtttctcgttcttgtgctgctcgcatcagcgctggcgctccttgcgccgggcctgctcagcggtttgcgtggcgcaggcggctcgctggcgtggaacccggagtgcattgtcgagacccctgacgggaaggtagggctcaaccgtgaggaggcgcaacgggccacaacagccgtcgcactcctggcccgcggggtggagtcaccggacacctcaggcatcgacgcggcggcgttgcagcagctggcagccggaccaaccgaggctgcaggacctaccctgagctgccggggctcggccgccgccggcctgctggaagaagagctgggtgacaccggcctgacaccccgcgccgagcggttgcgcgaggccatgaccggggtgttcggcgctcaaagccttggagggttcgccccaggcggcgtcagccagggacatggagctgagtccacgcactacgacggccgggctgtcgatgtcttcttccgcccggtgaccggggagaaccggcgtgcgggatggatgctggcccactggctggtcgcccatgccgacgagctggacatccagtacgtcattttcgacgaccgcttctggagcgtgcagagctcccgggggctatggcaggagtaccgcgcacctgagccccgcaacgagatcctgcgccacctcgaccacgtccatgtggatgtgctggccggggggtcttaacaccgtcagggaacgggacggattcagtcccggttcagtcccggttcagtctgggttcctgccgcaaatcacgtgcggcgtgagccttgccggggattgtcggtgcctcctcgtagtctgaattcaccaagttgagggggtacgccatgcacggtccgttctgttccatcgtcccgccgtacatgctgaggaggctggccaaacggggtgcgccggagttttcgtcggcggccagggcagccagggaagccttaggccatgtcgagtcgtttcgttcagcgcgggcccagcccgtgcccggcgttccggcaggcgtccgccaggccaagcccgggccaccacaccggaccgtcttcgacgcaaacagcgcggagattctccccggcacgctggtgcgcaaggaaggcgaggcacctgtcggcgatgccgcggccgacgaagcctttgacgggctgggccacacgcaccggctctacgccgacgtgttcggacgcaactccattgacggacgggggctgcccctgaacgccacagtccacttcggccagctttatgacaacgccttttgggacgggaagcaaatggtcttcggcgacggggacggtgaagtctttgagcggtttacaaaatccctgagcgtcatcgggcacgagctcgcccacggcgtcacgcagtattcagctgcgctcgtgtaccggaaccaggccggtgccctcaatgaatccatgtccgatgtcttcggcgcgctggtggaacagtacgtcaagaaccagtccgccgctgaggccagctggcttattggcgagggcattttcactcctgaagtggagggccgcgccttgcgctccctgaaggcccccggaacggcgtacgacgacgacgtgctgggtaaggacccccagccggactcgatggacacctacgtgaggaccagcgcggacaacggcggcgtccacatcaattccggcatccccaaccgcgccttctacctggtcgcggagtctcttggcggaaacgcctgggactcccccgggcgcatctggtatgaggcgctcaccggcggatcgcttccccctgctgccaccttcagggtctttgcccgcgccacggctgcatctgccatggaactcttcggttccgggtcaccagagcatgacgccgtacagctggcgtgggaaactgtgaaggtcaagctttaacggacgcccggccggcgcttttcggccgcccgggctgtaggggaagcccaaggaccaggccatgaagatcagcgttgagcgcaccggaggaatcgccgcgataccaagggtatggacagtggaagcccactccgagagcgctatcaaccagtggcagccgattgttgaagcatgcccctgggattcggtacccaggactcccagggccgctgcggagaagttcgccgggcagcagcccgacaggttcatttatgccattcgggccgggcagcaccgggctgcacttccggagcaggcggtcaccgggccgtggcgggtcctggtggacagcacccgggaagcggccgaggcatcgcgcgcccagcggcggcaggacgggacgtcccccggctgagttgcgcggaagaaccgggctgcggccagagtccggaccgttcctgccgggcaggcgctaccccaccccagccagctggccgcggaaggcccggcggtatgactgcggactggtgtccaggaccttggcgaagtggtggcgcaacaggacaggatgcccgaagccggactccctggcgatctcgtcgatgttgaggtcagtggattcaaggagctcctgggcccggagtacacgctgcgagttaagccaggcggcaggggtggctccagtctcagacctgaaccgccgagcaaatgtccgcggcgacatgtggacccgtgccgccagttcattcaccgtgtgctcgtgctccaggttttccaccatccagcggagcagtttttccatgggggctgaaccgcaggtgggcatgggccggtcgataaactgcgcctggccgccgtcgcggtgcggaggaaccaccatgtccctggcgatcgcggcagctacgtgcgcgcccagttctacgcgcaccaggtggaggcaggcatcgatccctgcggcggtgccggcggaggaaatgatgttgccgtcctggacatacagcacgttttcgtcaacccgcacgagcggatattcggcggccagctggcccgaatagtgccagtgggtggtgcagcggcgcccgtcgagcaagccggcccgggccagggcaaacgccccagagcagatggacatcacccaggcacccctggcatccgcagcgcggagcgcctccagaaccggttctggcaaatcgtcgtcccggccgtagggagccatgatgaccaggtccgcatccttcgtggcttcgagccccaggcccacgttcatggacagccccgacttcagcggcacgtttccgggatagggcgtgcagacccggaaatcgaaagcgggaaccccgctgcccctggccgatctgtcgatgccgaagacctcgcacgctgtaccgaattcgaacatcgagaagttgggaaccacgatgactgccactgatttgagcatgattccattgtggcaggaattttagctttttgggcatttctgccacttttttccggctgctgaggggagcagcatgaaggcatggaaacccttcttaccgccctcctcatcgtgatcctcctcgttgccgccgccaccgtttcagcgcttctgcgtgacggaaggggacatacgcctccagtcgaatcccacgaagcgtggtcagcgctggaccttcccagcatcaactacacgctccgcattttctaagccgccaacgcccgctccgggcagcaaaggaagcaactgcagacagtcgaaacgggatgcccgggctcccgcagtagactgtcagcagacatgacacttcacatcgcctatcccgctgagctgccggtctccgaacggcgcgaagacctgatggcagccatcgcagcaaaccaggtcaccatcattgccggcgagaccggctccggtaagaccacgcagattcccaagatgtgccttgagcttgggctgggcgagaatggcctgatcggccatactcagccccgccggctggccgcgcgcaccgtggctgagcgcatcgccgaggaactgggcgtggacatcggccaggaagtgggcttccaggtccgcttcaccggagaagtcagccgcgccacaaagatcaagctgatgacggacggcatcctgctggcggaaatacagcgggacaaactgctgcgcaagtacaacgcaatcatcatcgatgaggcccatgagcgcagcctgaacatcgacttcatcctggggtacttgaagcggatcctcccgcagcggccggatctcaaggtgatcatcacctcggccaccatcgacccccaacggtttgccaaccatttcggcacacccgacacccccgcccccatcgttgaggtctccgggcgcacttaccccgtggagatccgctaccgcccgctctcgcagccgcccggtggagcgggccccgatgatgagaatggttccgacgacgaactcgaggaagaccgcgacccgctcgacgccgtgtgcgacgccgtcgacgaactcgctgccgaagcacccggcgacatcctggtcttcttttccggcgagcgcgagatccgggatgcggccgacgcactgcaggcccgcatccagtccaaccggaggctggccggaacggaagtccttccgctcttcgcccggctgagcctgcaggaacaacacaaggtgttccacccgggcaacaagcggcggatcgtgctggccaccaacgtggccgaaacctcgctcaccgtgccgggcatcaaatacgtgatcgacaccggaaccgcccgcatctccaggtactcgcaccgcaccaaggtccagcgcctgcccatcgagcgggtctcgcaggcgtccgccaaccagcgttcggggcggtgcggccgagtctcggacggcatcgccatccgcctctactccgaggaagacttcgaatcccgccccctctacacggacccggagatcctgcggaccaacctcgctgctgttatcctgcagatgaccgccatgggagtggcccgcggccccaaggacgtcgaaaacttcccgttcgtggaaccgcctgacacgcgggcaattaacgacggcgtcacactgctccgcgaactcggcgcgctcgctgccgcccggccccaaaacggcacggacggggcgaaaagcggcggcgggctgaccgccgtcgggcaacagcttgcccagctgcctgtggatccccggctgggccggatgatcgtggaggcgggaaaacgcggctgcgtccgcgaggtgatgatcctggcagctgccctcaccatccaggacccgcgcgagcgccctacggacaagcaacagctcgccgcggagaagcacaaccggttcaaggacgagaactctgacttcactggtttccttaacctctggaactacctgcaggaaaagcagcaggagctctcgtcgtcggccttccgccggatgtgccgggccgaattcatcaactacctgcgggtgcgggaatggcaggatctgtttgcccagctgcgccagcttgcccggtccctgggcatcagcctcgacaacaagcgccttgccgatcccgtgggcaaccacgagggcatccacatcagcctgctctccgggctgctgagccacatcggcatccttgatgaacgtaagcgcgagtatgcaggtgcccgtgggtcccgattcgcgatcttccccggctcggcccttttcaagaagtcgcccacgttcgtgatggccgcggaactggtggaaaccagccggctctgggcaagggtggctgcaaagtttgatcctgtctgggcggagcaggtggcgccggacctggtgaagcgcagctacagcgaaccgcactggtccacccggcagggcgcagtgatggcctacgaaaaggtcaccctctacggcgtgcccatcatcgcccagcgcaggatcaactacggcagggttgaccccgtcgtcgcccgggaactcttcatccggcacgccctggtggaaggcgactggaaaacgcaccacaagttcttccaccgcaaccgtgccctcctgcatgaggtggaggagctggaggccaggatgcgccgccgggacctgctggtggatgacgagacgctgttcgagttctacgatgcgcggatcggatctgacgtggtgtccgagcggcacttcgacaagtggtggaaggaggcgcggcagaagaacccggacctcctggactacgacaaatcgctcctgctcagcgacgacgcggacgacctcgacgactccgcctaccccaaaacctggctccacaagggcttcgagcttccgctgagctacgagttccacccggtggccccgggctcaccgcccaacccctccgacggcgtgaccgccgaagtgccggtcctcttcctcaaccagctggatgacaaagccttccgctggctgatccccgggcagcgagtggagctggtgacggccctgatcaagtcactgcccaaacagatccgtaagaacttcgttcccgccccggacgtggcgcgccaggcagtggcagtgctggaagccgactttgatccggcggccgatgacctggagccgtcccttgagcttgccctgcgccgcatccgcgggcacatcgtcccgccgggatcgtggaactgggatgccgtcccggcccacctgcgcgtgtccttcaaggtggtggacagcaagggcaaggtcctggatgagggcaaggacctcgcagcactgcaggagaagctggctccggccacgcggcgggccattgccgaatccctcggtgcgacgcccgcctccactgcgcccggcgccggcagcggcaacggcaggaaagcggcacaggcgtccgggacggcgttcgacggcggatcccccggagcacagcagtcggccacgttcccgggaaccgcagccccagccggtttcagggagcaggacggcctgacggaatggaatttcgggacccttcagcggcaggtgagcagctcagtcaagggccacaccgtcacgggatacccggcgcttgtggaccagggaacgtcggtggcgctccgggtcttccagacggcggcagaacaggccgaagcgatgcgtggaggcgtcatccgcctgttggccctgcgcgtcccggcaccggaccgctacgttctggaacacctgagcaacaccgagaaactgaccttcagccagaacccgcacggctccgtctcagccctgattgccgactgtgcgctggcggccatcgacaagctcacgccccaggagctgccctgggaccgggcgtcctttgaccgcctgtatgaggtggtccgggccgaactgatcgatacggtgttcagcgtcacggccgtggtagagcgcatccttgccagcacccggcggatcgaaaagcagctgaaggggaccaccagcctggcgctcatttctgccctcaatgacgtcaagagccaactggagcagctggtgtatccgggctttgtagcacggacgggctatgcacagctcagccagctccccaggtacctttccgccattgaaaagcggctggaacgcctgccgggcaatgtccagcgggatgccctcaacatggccgtggtgcagcggctcgaggacgactacgatgacgccgtgtctgccctgcttccgggacgcaaggccggacctgagttaacccaggtgcgctggatgctcgaggagctccgggtgagccttttcgccgtcgaacttgggacagcgtattcggtgtccgagaagcgcatccgcgccgtgctcaacaaggcgctggccccggcgtaggagtccccacccgcggtgccgcggcgcggacccgcgggtgggtccgcgccggactggatgtcaggccgggacgaactccccgtaccccgccaccctcaggccctcgcgaagcttttcggcgttggcgtcgaggacgtccgggtccgggttctggtccgcggtggcgaagttgaactccgccatgctccgggaaggccagacgtgcacgtggaggtggttgatctcgtagccggccacaataaggcctgcccgtgccgcctcgaagacctccacctggaccgcgccgatccggcgggccacttccatgactttggccaatgtctccggggatgcgtcggtccagcggtccacttcctcggtggggaccaccagcgtgtggccgtccgcgagcggcccggtggtgaggaaggcagctacctcaggctcccgccagacaaagcggccggggatttcgccgttcaggatcctggtaaagagtgtgctcatgcgtgtgcctccttggcgggtgcctgcagggtgctggtgtccagcacaaaacggtatttcacatcgcctgccaccatccggtcgtaggcttcgttgagctggtcggcgcggaccatctcgatctccgcggccactccgtgctccgcgcagaagtccagcatctcctgcgtttctgcaatgccgccgatgagggaaccggcgtaggcaatccggcgccggatcagggcgcccgggctgacgggcggcatcggctccgaggggagccccagctggaagagcgcaccgtcaacgcggagtgtccggaagtaggggttgaggtcgtgcggagctgccacggtgtcgatgatgagatcgatggtgcggttggctgcggccatcgcgtcctcgtcccgggacaggacaacctcgtctgcgccgagcccaagggcggccgcaaccttggcctccgacgtcgtgaacaccaccaccgtcgcgcccatggccttggcaagcttaacggccatgtggcccaggccgcccagccccaccacgcccacaacatcgccgtcttcgacctcgaagtgccgcagcggggaaaaggttgtcactcccgcgcagagcagtggcgcagcggaggcagggtcaagcgattccggcacccgcaggacgtagcgccggtccaccacgatggacgaggagtagccgccctgggtgacggcatcaccgttccggcggtccacggctccgtaggtgccggtcatgccgttttcgcagtactgctcgaggccgtccaggcagctttcgcagtgacggcacgaatcgacgatgcaccccacgcccacccggtcacccacggcgaagtccacaacagcggaacccacccggctgacggtgcccacgatctcgtgtccgggcaccagcggccaggtgctgccgccccactcgccgcgggtggcgtgcacatccgagtggcacaggccgcagaattcgatggctatttcgacgtcgtcggcctggggggtgcgccgggcaagggtgagcggcaccagcccgctgtccggggacgttgcgccgtaagcggcggccggaacgccgccgccggacgctgccgtcaaaggggtggcaaggtgtgcaaggggcggaggtaccgggcgtcctggagtcatagtgcgacgctacccttgcccggaggcgtgtcgccacccggccgtccgctgccgcggcccggctcagccccggtggccacgggcagtgccgggttgttggaccactccgagaatgagcccggatagagtgcagcggggaatccggcgatttccagggccgcgacttcatgggcggcagtgacgccggatccgcagtacaccgcgacctgcactccgtcgcggacgcccagcgactcgaacctgcggcgcagcgcgtcaggggccaggaaccgcccgctgccgtccacgttttcggaggtcggcgcactgatggccccggggatatgcccggcccgcggatcgatgggctcaaactcgccgcggtacctctcccccgcccgcgcgtccagcaggaggcccgcgtccggccaggcggcggctaaggtggcgtcgatgaccggcatcttcccgtctgtcagatgcacaccgccggggtccggaacaacctgccccgcttcgagcggaagccccgcggcacgccaggcggccaggccgccgtcgagcaggtatacctccgccagcccggcgtgacggagcatccaccacacccgcgccgccgccatgttgccgctgtcgtcgtaggccaccacgacgtcaccgtcgttgatgccccagcgccgggcgcccgcttcgaaatcctccgccgccggcagcgggtggcggccccgttcgggaactgcaggagcagcaagttccgtctgcaggtcaacaaacacggcgcccggcaggtgctcctgcaggtagtggcggtggccgtgggggtcgcccagcgcccaacgcacatccagcagtaccgtgcgccggtgatccgcaaggcgggcctgcagaccggcaacgtccatcagggggttcacggcactcctccagcggtggtttggccaacggatccactgtatcggcagcccttcccgccgcgggtaggctggtgcggtgaagatcgagcgcagcgccagccggtacaccgcggaccgggactgggcggaccaggcaatccgcaagatcagggcagaaaacaaccgctccgcggacacccatctctacgctgtcccccttccggagcactggggcgtccacctctacctcaaggacgagtccacgcaccgttcgggcagcctgaagcaccggctggcccgctccctgtttctcttcgggctggtgaacggctggatccgggaggacaccaccatcgtggaggcttccagcggcagcacggctgtgtccgaggcatatttcgcgcagctcctgggcctgccctttgttgctgtgatggcccgcaccaccagtcccgagaagatcgcgctgatcgagcagttcggcgggtcctgcctgctggtggagcacgcgtccgaggtgtacgcggccgcgcaggaggtcgcggagacctgcaacggccactacatggaccagttcacctacgccgagcgggcaactgactggcggggaaacaacaacattgccgagtcgatctttggccagctggcgctggaggaacatccggttccccagtggatcgtggtgggagccggcaccggcggaacgagtgccaccatcggcaggtacctccgctaccacagctacccaacacggctgctggtggtggatccggagaattcggcgttcttcccgggctggctgggcacctccggcgcgccggcaggcctgccgtcccggatcgaggggatcgggcggccgcggatggaacccagcttcgtgccgtccgtgatcgaccgcatggtgcaggttccggacgccgcgtcagtggctgcgatgcgccacctccaaggccttgcggggctccacgccggcccctccaccgggaccaacctctggggtgtgtggcagctggtggcagggatggtggcaacgggcagcaaaggcagcatcgtttcgctgatgtgcgacggcggtgaacgctatgcgggcaactactacaaccaggactggctggctgcccagggtctggacccggcgccgtacgaagcggtcatccggcggttcatggatacgggcacgtggaccggagacctggcctagacctccacagactcccgggccgccaggtgggtgtattcggtgccgtacttagcgccgatccgctggacatggccttccaccaccttcaggccgttctcgttgagcagtccgtcgtggatctggaatgcccgcggcgccctgacagcgatcacgaagtccagcacctcggcggccttgctccacggtgcatggaggggaaccagcagcgtcttgacgctgatgccgtccgggatcacgaaggagtcccccgggtggtaaacattgtcatcaatcaggtagccgatgttggccacgatggggatctgcgggtggatcagggcatgctggccgccgaagctgcggatggtgaagccggcagcctggaaggtggagcccgggttcacggcgtgaatgcgggcggcttcgccggtggccttgtcctgcagctggccggtaacacgcgccggggcgaagaccgccagtcctgcgttggcgcgcaaagcatccaccacggccggaacgtcaatatggtcggcgtgctcgtgagttaccaggaccgcttcagcggactgcagggcctcagccgattccgagaagttgcccggatccaggaccaggaccctgccgtctttttccagccggacacaggagtgggtgtacttcgtcagcttcatagcgccagcctagggtccgccccgggaccatgtccacgaagctccggctggtaatctggatctttgccaccatcctgaggaagtgagtccacccatgcccgtcggcgccaaggctgattccaccacgtcgtccccggggacgggcgggggcaaggagcagcgcgtcacgaagcagcgcagggccgtcagcgcagccctggatgaactggacgatttcgtcagcacccaggagctttaccggatcctccaaaaccagggcgtttctgtctcgctggcaaccgcctaccggattctccagtcgctcgcggacgagggcctggtggacgtcctgcgcaacggcgacggcgaggccgtgtaccgccgctgtgccgttaccggacaccaccatcacctgctgtgccggaactgcggaaaggcagtcgaagtggaagccccggctgtggagacatgggcggcgcgcacagctgcagagcatgggttcacagaggtggcgcacaccgtggagattttcggcctgtgtccggattgcacggcgcgcaaggccgccggtagcctctaagccgttcccgccagaacccgcccgttgattcccttgcgggcccgcaccgagccaaccaccctgcacaccacgtaaaccaggaaggacagcgtggtgacgtaggggctgatgggaatgcgtcctcccagcgccagcaggatcccgcccacggtggcggtcatcgcaaatgccacgctgagcagcaccacggcagccggagaggacgtcacccggagcgcggccgcggcaggcgtaatcaacagcgccagtaccaagagggctcccaccacctggatggacagggccacgctgacgccgagcaggaccataaagacgatggcaagcgtccgcacgggaaccccgcgggcctcggcaagttcgggatccacgctggcgaaattcaggggccgccagatggccaccagggccgccatcaccaccacggccgttccggcaagcgcctgcagctggaccgtgtccacggagacgatctgtcctgtgagcaggccgaacttgttggcggcgcggccttcgtacagggacaggaacaggatgcccagccccagcccgaacggcatgatgacgccgatgatcgagtttttgtccctggcccggacacccatcaggcccagaagcagcgccgcggtgacggatccgatcagcgatccaaaaacgatgtccgcgccgatgagcagcgcaaaggcggccccggcgaaggagagttcggagatgccgtgcaccgcgaacgccaggtcgcgcttcatcacgaaggtccccaccaggccgcccaagaggcccaggacggcaccggcccagatggagttctgcaccaggaccaggagttcgccgtagttttcgaagctgaagatggcgccgagaatgctgtccgcgtccatcaggctgcctctccggccagcacatgcgttggtgcatggtggtgggtggtggcatccggcaggcccaccaccacgatgcgcccgttggcgtggatgacctcaacatggcttccgtaaaggtcggaaaggacttcggtggtcatgacctcttcgggcgtgcccaccttgaagcggccgccagccaggtacagcacccggtccacgtagtcgatgatggggttgatttcgtgcgtcacgaaaaccacggcactgttctgctcacggcactgcttgttgatcagggcgctgaccgcctgctggtggtggaggtccagggagagcaggggttcatcgcagagaaggacctggggatccgtggcaagggcctgcgcaacccgcagccgctgctgttcgccgccggacagctgacccaccggaactttcgcgtactccgtggccccaaccagttcaaggagctggtcgatcttgcggttggccttgcccggggacaggcgcaggccccaccggtggccgtccacgcccaggccaacgaggtcccgggcgcgcatgggggtgtccggggcgaacgatttctgctggggtatgtagccgatgaggctgctgccgcgttccaccgggcggctgccaagcacggcctgcccccggtgcaggtcctggagccccagcaggaccttcaggaaactggtcttgccgcttccgttgggacccagtacggcgaagaactcgccgggcatgatgtccaggtccaggtcctcccagagcgcccgcttaccgaacttcagggacgctccggtgaggctgaccacgggtttcaactatttgtctccagaacgttggtgatgttgtccacattgtccgtcatccactggaggtacgtcttgccctccgggagtgtttcactgaagtcgaccacaggaacccccgcagtttctgccgccttcttcagcgactccgtctgcgggccttcggtctggctgttgtaagccagcaggcgcaccgacttcgaagccacaaggtccgtggcggccttgagcactgccggcgggacgtccgagccttcttcaatcgcagcagtgtagtcctcgggcgtagcgttcaccagcccggcatccgccaggaggtagaccggcaccggctcagtcaccgccacctgggcacctgccgaagcggccttcagtgcgtccagctttccgtgcagttcttcaatgctggctttgaaagcggcggcgttggactggaatgtcgaggcagaggcgggctcgagttcggccagcttgacggcgatctgatcggccagctgttccaccgccgggaggctgtaccagacgtgctcgttcaactcgccgtggtcgtgggcagcttcgtcctctgccgcgggttccgtcgccggggcttccgcagtggtttcctccccttcagggtgcgccatgccggaaagttcgacggcgttcagtagcttcgcgtcgtcaaggccactatcctccgccagggtgtggatgaagtcgtcgtagccgccgccgttttccaggacgaggtcggctttcgagaccacaagccggtcctgggcggtggcttcgtaggaatgcgggtcctggctggtcttggtgatgatggcggtcacgttgaccttgtccccgccaatcgttttggcaatatcgccgtagacgttcgttgaggccacaatgttgattccgtcggcggcgtctgtcgcgggttccgcctgcgggctgcagccggtaaggagcaggccgagcccggcaagggcagcgagggacgatcgggcagcggcggcacggcgcacggaaacctcattcaatggggaggggcgaaaacaaccattccagcttatacctaaatgggaatgattcctatttagaacagacgggtgccatcgcaacggtgccctccgcccgctggagaagggcaccgccccgctatcccccgttaggctgccccagccgccggattccggtggcctgggtcgcatcccggatctcgcctacgagctgctcgatcacgtcttccaggaacaggacgcccttggtgttgccatcgggaccgatcacccgcgcaaggtgggatccggtgcgctgcatgacggacattgctttctcgatctcatcgtccagcgccaggttggccagggagcggatgcggctctcggcgatgggccgttcagaagcctgctcggggatggacagtacatccttgacgtggaggtagccgtacagcatgtcgtcctcatcaagcatggggaaccgggaaaatccggtgcggctcacggccttctcgaactccacgggggtggtggcggcccggagcatgaccagcctctccaggggaaccatgatgtccgcggccgtgtattcggagaactccagcgcgccggtgatgagcccggcgtcgtcatccaccagcccgtggcgggtggactcctgaacaatggactgcacttcctccagcgtgaaggatgaattcacctcatccttgggctcgatgcgaaggagcttgaggatgtggttggccgaccagttgaggaccgagatgacggggtggaccagccgggcaatgaacatcagcggcggggcaagcaggagcgccgccttgtcagccacgctgaccgagatgttctttggcaccatttcaccgaaggtcacatgcaggaacgtcaccagcatcagcgccaccgcgaacgcagccacatcggcaacttccttcggcaggcccagcgtctccagcgggacggcgaggaggtggtggatggccggttcggccaccagcaggatcaggagggagcagacggtgatgccaagctgggcgcatgcgagcatcagcgacacgttctccatggcgcggagggtggtctgcgcccgcttcgaccccgactcggccagcggttcgatctggctgcgccgtgcggacatgactgcgaattcagcggccacaaaaaaggcgttgcccagcagcaacacagccagccagaggattccggcccagtcgctcatcgttcggccctgtcgtcgcgttggttcctgccgttaggtgtggatttgtggtcgcgcctggaatggtcgtcacgcggggagctgtccggccggtccatgtcatcagactcggcagccggccggaaacagatccggtcaatgcggcgcccgtccatcctggtgacgctcagcgtgccgccgccaacggtgacagtatccccaacaacggcaatccggcccagcttgctcatgacgtatccgcccaccgtttcgtaggcggcttcgtccgggacgctcagccggggtatctgctcggacagctcatccgggcggagcagacccgggaaataccagtcgccggaggcactctgcaggagtcccgggcggaccttgtcgtgctcgtccgccacctctcccacgatttcctccaccaggtcctcgagcgtggcgatgccggcggttccgccgtactcgtccaggacgacggcgagctggaggttgccctcgcggagttccgcaagcagggcgtcgaggtggatggtctcggggaccctcagcacctccgtcatgatggcaccggcctccaggttctgccggcggtcccacggcacagccacagcctttttaacgtggaccagcccccggatgtcgtccgcggaatcgccaatcaccgggaagcgcgagtatccggtccggcgtgcagcaccgaggacatccgagacgggctggtcggcatcaatcgtttccacccggatgcggggcgtcatgacgtccgccgctgtcctggtggagaagttcagggtgcgggccacgaagttggcggtgccggcgtcgagcgttcccatggctgcagaccggcggaccagcgatgcgagttctgccggtgtccgggccccggaaatttcttccttcgcctccagtccgaagacgttcaggaccttgttggagaatccgttgagtagcacgatggccggtttgaagacggccgtgaacatcagctggggccgggcgagcgcccggccaaccgggaaggacagcgcgatggccatgttcttgggcaccagttcgcccaggagcatggagagcagggtggcgagcactatggccaggaccagggagacggaagcgacggcgacgtcgggaagtccgacggcggccaggggggcttccaggaggcgtcccaccgagggctccatcacgtagccggtcaggagcgttgtcagcgtgatgcccagctggcaactggacagctgtgtggacagcgatttcaggcaggtgagcaacgggacagcgccggtgtcgccgtcgtcaacggcacgttggaccgtgggctggtccagggcaatgagggagaattcgacggccacgaaaaatcccgtgccggcgatcagcagcaggcctgctgcaaggagaagccattccattcagcatcccgcctggaaggcggtggtgaaaggcatggcaaaggaaggggagatgcggagactgggaggtcgtcccggcggaggatggtcggcggaaaccggcgcccgttccccgggggctctggccggctgcgctgccggcggatgatgggctcgtgttcggggtttgccggctctgcgggtggactgcgcggcgctgctcttcatgctccgctgacagcccccaggccggcacctagatttactgtccataagagcttcagtctacaggaggcacctgcgcccgcttcacctgcgctgccacccaccgggtgctgcgccggcggtctttccgccccctcgcaacgcgccgataatgacgccgtttcccgccatattccgcgatccccgcgtcacttcatgatttgggtcacccttattggcagttaacacacgatgctcactagacttgcaaaggtctgggttcagaggacgcagaaatcgggtcgaacgtgttgctgaagcaccgtggggccggggagaaatcaaactcatggaagaggcgtatttcaagtgccagagcagcctagccaccgtctaccagaggaatttggcggaaacgagtggctcgttgacgaactgtacgagcagtaccagcaggacaagaacgccgtggatgccaagtggtggccgctgtttgaatcgttcgggtcgggcagttcttcttccaacggaaattcggcccatcccgctaccagggaaatgccttcagtaaatgcagccccggcaccgtcgccggcagcagcacctgccgtaccgccggtgccgtccgctcctccggcgtccgcgcccgcaccggcaaagaaggcccccgccaccgttgcccgcgacggcggcaagaagaccgaggccggaaccggctcccagcccatcccggctcagctgcccaagaacgtcaaggcacccaccgctcctgaggaagacgtcgtctccgtcctccgcggacctgcaaaggcaatcgccaccaacatggtcaccagcctccaggtgcccacggccaccagcgtccgcgccatcccggccaagctgctgatcgacaaccgcgtggtcatcaactcgaacctggcccgcgcccgcggcggcaaggtttcgttcacgcacctcatcggctacgccgtgatccgcgcgctctcccagttcccttccatgaacgtgtactacgacgaagtggacggcaagcccgttgccgtccagccggcccacgtcaacttcggcattgccatcgacatgccgaagccggacggcacccgcctgctcatggtgccgaacatcaagaaggccgaaaccctcaacttctccgagttctggcacacctacgaggacctgatcaagcgcgcccgcaacggcaagctgacggccgaggaccaccagggcaccaccgtgtcgctgaccaaccccggcggcatcggcaccgtccactctgtgccccgcctgtccaagggccaggctgccatcatcggcgtcggcgccctcgactacccggcagaattccagggcgccagcgaaaagatcatcgcccagaacgcgatcagcaaggtcctcaccctgacctccacctacgatcaccgggtgatccagggtgccggcagcggcgagttcctcaagctggtccaccagttgctgctcggagcacagaacttctacgacgaaatcttcgagtcgctccgcatcccgtacgagcctgtgcgttggagcgccgacaggcaggtggacccggccgacgaaattaacaaggtggcacggatccagcagctgatccactcctaccgcgtccgcggtcacctgatggcggacaccgatccgcttgaatacgtccagcgcaagcacccggacctcgacgtcctgacctacgggctgacgctctgggacctggaccgcgaatggcccaccggcggcttcggcggaaagcccatgctcaagttccgcgacatcctgggcgtcctgcgcgatgcctattgccgcaccaccggcatcgaatacatgcacatccaggagcctgccgaacgcaagtggttccaggaccagctggagcacccctactccaagcccagccgcgaagagcagttgcgcatcgtttccaagctgaacgcagccgaggccttcgaaaccttcctgcagaccaaattcgtcggccagaagcgcttctcgctggagggcggcgagtccttgattccgctgctggacgccatcatgtccgacgccgccgacgacggcctggacgaggtagccatcggcatggcccaccgcggccgcctgaacgtgctcaccaacatcgccggcaagacctacgcacaggtcttccgcgaattcgaaggcacccaggacccccgctccgtgcagggatccggcgacgtcaagtaccacctgggcaccgaggggaccttcacctcggacaacggcaaggaaaccaaggtctacctcgccgccaacccctcgcacctcgaagcagtggaccccgtcctggagggcattgtccgcgccaagcaggaccggctggaccagggcgagtccttccccgtcctgcccatcatggtccatggcgacgcggcatttgccggccagggcgttgttgccgaaacgctcaacctgtcccagctccgcggctaccgcaccggcggaaccatccacgtggttgtcaacaaccaggtgggcttcaccacggcaccgtcatcatcccgctcgtccacgtactccacggacgttgccaagatgatccaggcccctgtgttccacgtgaacggcgacgaccccgaggcagtggtccgcatcggccagctcgcttacgagttccgccagcggttccacaaggacgttgtcatcgacatggtctgctaccgccgccgcggacacaacgagggcgatgacccctcgatgacccagccgctgatgtacaacctcattgaggccaagcgctccgtccgcaagctctacaccgaatccctgatcgggcgtggcgacatcaccgaggaagaagccgagcagctgctccgcgactaccaggagcgtctggaacgcgtcttcgccgaaacccacgcggcccagacctccccgatcccgatcgtcacggcagatactgccgccgtctcggacatcgagcgtcccatctcccagcagtccgactccggcaccaccgctccggtttcaacggccatttccgcggacaccctggcccggatcggcaaggcccacgtggaagtccccgagggctttaccgtgcatgcgaagctcaagcagctgctcgagaagcgcgagcagatgtcccgcgagggtggcatcgactggggcttcggtgaagtcgcagccttcggttcactcatcatggagggcgttcccgtccgtctggccggacaggactcccgccgcggcacattcgtgcagcgccacgccgtgttccacgaccgcgccaacggcaaggaatggctgcccctcggcaacctttccgacgaccaggcgaagctgtggatctacgactccctgctttcggaatacgcggccatgggcttcgagtacggctactctgtggagcggccggatgctctggtcctgtgggaggcgcagttcggcgacttcgtcaacggtgcacagaccatcatcgacgaattcatctcctcagcggagcagaagtggggacagcggtcctcgctggtcctgatgctgccccacggctacgaaggccagggcccggaccactcctccgcaaggatcgagcggttcctgcagctgtgcgccgaggagaacatgatcgtggccaaccccaccacggcggcctcgcacttccacctgctgcgccgccaggcctacaaccggccgcgcaagccgctgatcatcttcacgcccaagcagctgctgcgcctcaaggctgccgcatcatcggtggaggatttcaccaccggcacgttccgccccgtcatcggcgaacacgagcagctggcgggagacgccgtcgaacgcgtcctcctggtctccggccgcctgtactacgatctcctgtccacccggcagaagacggacgacaagaccaccgcgatcgtccgcgtggagcagctctacccgctgccgcacgaggaaatcgcaaaggaactcgccaagtacccgaacgcagaagttgtgtgggcgcaggatgagcccgccaaccaggggccgtggccgttcattggcctgaacctgccgggcgccctggagcgcaacgtccggctggtttcgcgtccggcgtcggcatccactgccgccggttccatgaaacggcacgccgcggagcaggatgttctgctgaagcaggcatttgcacggaagtaagtactaaggctgcccggccggacgtcgaaatcccagactccggccgggcggttctgtttaatggagtgcacagcgctgatggaaatagacagcgctgaatgaaaaaccccaatcgcatgcactgcccaaccccgtggccggaaccaggtccacggtggcggcggcaaggcaccgacgtaaagaggaacgcgtggaagacaggaagctgcggattgcagctgtaggagatgaactgctggccggactgggtgacccccgggccctcggctggctgggccgcgtgctggcccgcactccccgggacagcatgctcctcgaaagctacgccctcccctgcccggaggaaggaacggaaggccttgccgcgcgctggctcgaagaggccggccggcgcttcagcgacaaagcagagaaccgtctggtaatcgggctctccggacgcgacattgagttcgggctctccactgcacgcagccggctcaaccttgccaacatcctggattcggcgtcgcagaaccgtatcgaggtcttcgtcgtgggcccgccgcccaccctggaccccgcgcagaataggcgccttgacgagctcaacactgccttcgccgacgtcaccacccggcgcaagcacctgtacgtagacaccttctccccgctcctgaaccacgaacagtggcgccaggacctggcagcccagggcggcacgcccggccaggccggctacggactgatggcctggctggtgctgcaccgcggctggttccagtggctgggcctggacgctccggagtaatacaggctcgcgatatatcttgacctgccccccacggcgggggtacgttggggaaggtcaacacgatatatcgcctggagggcccgtgaccgatcaagaatggactgtcaccagtccggagaccatcgacgtcgacggcgtaacgtccctgaaactgggcatggtgcagggacgcttcgacgtcgtcatgcaccaggaacccgtcacccgggtagagatctcggatgtgcacggcgatccggtggccgtctccctgagcggcggcaggctggaggtccgccaccagctgcacggcccccagggctggttcaagaacctcatggggacggtcaaccacaacagtgaaaactcggccgtcatcagcattgccgtaccggcccacgtcagcgtggaggccggcaccgtcagcggcgatggactggtatccggcatagccgcgaacacccgcctcagcacggtctccggttcggtcatggcggacagcacaaccggggaactgcacgtccagacggtcagcggggaagtcgccatccgtaaccacaccggggtcctgacagccaagagcgtctccggtgaagtaacggcgtccggccgcctcagcaatatccgggcgaacaccgtcagcggggacatgagtttcgatctcctgggcttcacccaggatttcggggcgaactcagtctcgggagacctcaccatccggctgccccacgatgtaggcgtggacatcatcgccaagtccgccagcggtgcggtggtgatcggggaccagcgctacacggtggtggggggcaaggtggagaccattgcgggccctgacggccagctgatgctggtgcggaccaactcagtgtccggaaagacctccatcttccacaggaccgtggcaggaaacgcagaagcagggacctgatggcaccggtctttgcccatggcgcgctccggctgtaccttttggcgcttcttgagtccggacccaaacacggctatgagctcatcaaggcgctcaaggagcggttcggcggaacgtactcccccagcgccggcaccatttacccgcgcctgggcaaactcgaggaggaaggcctggtggccaccgaatccgccggccgccgcacgaactaccacatcaccaccgccgggctggctgagctcaaccgccgccgcgacgagctggcaggcgtggagagcgagatttcagcctctgtccggcggctggcggacaaccttcgcgaggacatccgcagcaacatgagggggctgcgtgcggatcttgccgccactgcggaggcagcccgcgccagcgccctgtccacggacttcagggtccccggacggctgccggtcgaaagccagcggaccctcaaggaagccgaaatgatgctccagcagttccgggacgacctcagggcggagctgcggctgcaggctggcaggcaacccctcagtcccctggcactggaaacagtaaggaccgtactggaacaggccggcatctccatccgcaactcactgaactcctagcaccaaggcgcgccaccgccgtcaagacgcaggtcatcctgctgttcctggttcgcgggccgccccgtgatgtgggagacttgagggcagctcttttgagtaccaacattaaggaggccagctatgagcaagcgtgcacgcaagcgtcgtgaccgtaagcgtggcggcgcgaaccacgggaagcgccccaacacctaggcacatgccaggaactacggttcaaacaaaggaccccgggagccacatggcttccggggtcctttgttgtcagctgcggtgtggtcctaggcgtccaccggccggatggtatggatccggtcaagaatagcgttcttcaggttctccggagcagcttcggtgcaggagcgtttaaccatgttgcggatcacgcactcaaggtcgtactgctccgtgcattccgggcagtcatcaaggtggtttttgatctccgagatgtcctcgcgggtcagggcaccgtcgaggtactcgtaaatgcgttgcatccgggtgtcgtcgcagtcgcccaatccctggcagtcgctcatttcctgctctcctgttgtgtgcttcctgccgcatcctgtgaagtagcggccgtcttgaacccgcgctccgcggcgtactcccccagcatgtcccgcagcatcctccggccacggtggagccgggacatcaccgtgccgatgggcgtgttcatgatttctgaaatttccttgtaggcgaacccctccacatccgcgaagtagaccgcaaggcggaattcctcggggatgtcctggagcgcccttttgacgtcggaatccggaaggtggtccaacgcctctgcctcggcggagcgcagtccgctggaggtgtgtgactcggcccgcgccaactgccagtcctcgatggtgtccgagttggactggagcggctcacgctgccgctttcggtacaggttgatgtacgtgttcgtcaggatgcggtacagccaggccttgaggttggtcccgggccggtactggtggaaagcggagaaggccttcgtgtaggcctcctggacgaggtcctcggcgtcagacgggttcctcgccatgcgcatggcagccgagtacagctgatcgacgtactgcatcgcatcgcgctcgaacctcaggcggcgctgttccgccgattcagtggaaacatccaccaggtccccgccggtttcggcaggcgccgggaccacagctgagcccgcagcctcaggcactgctgctgcgctgctcttcgcttcactttgggaagcctcatacatggccgcgacggccggatccagggtactcattgccttcaagtctactgggcggctgcgcgcacgcggcgagccatagctcggcggttcagcctcaaatgcgtccatcgccaccgggcctgctgtttcaattccgtccaacacccgcgccaagggcacaactccgctctgcttgtccatccgtatatctgcacccggcgatctgtgcctgccggcagttccatgctgtagccatgatttccctgcggccgcgcattcctggatgcgtcatgaataacctcatgccttcggcaaatattccccaaaagtgcaagactagaacggactccgccgctttcgatgcggttcgtccatccaggaggaaatccatgtcctttttccgcacgctcgcccgccccatgctggcctccagtttcgtcattgccggagtggataagctcaagaatgccgatgacacggcgcagcagctttcaccgctgcttcgcaaggctgccgcatccttgcccttcaagtcggatgagaaaaccctggcccgcgtcatcggcggaacgcaggtgggagccggcgtgcttttcggactgggcaagttctccaggctgtcggccacgctgctcacggtgatctctctcctgaacacctttgttgagtggcgcagtgcggatatcagcaccaaggaagggcgggaaaaccgccgtaaccagctcctcaagaacctgtccctgagcggcggcgccctgctggcatccgttgacacagccggcaagccgggcctggcctggcgggcggagcacctggccgccgatgcacgcaagggcgcctcgcatctggcggccgacgcccggaagaccaccaacaagaagctccacaaggcggacaaggttgtgcggcgcgctgtggaacaggccacgggggcttaacaacgcatgaccgcagcagccgccgtccgggatgactccggaatgccccttccccactggcccgcgcccttcgcgtcccggcccgttgatgccaccgtcacagtgcccggttccaagtctcttaccaacaggttcctggttcttgccgcattggccgacgggccgtcccgcctgcgggcgcccctgcattcgagggactcagcgctcatgatcgaggcgctccggcagttgggtgccaccatcacggaagttcccggggacggtgccttcgggcccgacctggaagtggttccgctggacccggatgctgcgtcacccctcacaaggatcgactgcgggcttgcgggtacggtcatgcggttcgtcccgccgctggccgcgctgcggaacggcgaaagcgtgttcgacggcgatccccatgcccgcaaacggccgatgggaacaatcatcgaggcgctcatagcgctgggcgtggccgtctccgcagaagggggcgggacgccgtcgtcactgccgttcgttgtggagggcaccggtgaggtccgcggcggccacctggtcatcgacgccagcgcgtcctcccagttcgtttcggcactgctcctggtgggcgcaaggttcaccgagggcctgcaccttgaacacgtgggcaagccggtaccgagcctcgaccacatcaacatgaccgtggcagtcctgcgcggggccggggttgctgttgatgactcggtgcccaaccactgggtggtcagccccggccccatccgcgccttcgaccagcggatcgaacaggacctgtccaatgccggccccttcctcgccgccgcgctggcctcccgtggaacggtgcggatccccggctggccggacgaaacgcagcaggtcggtgatctctggcgcagcatcctggccgcgatgggcgcggaggtaaccctgcacgacggcgtcctcacggtcaccggcggaccccacatcaagggcggagacttcgccgacaccagcgaactcgcgcccaccgtggccgccctgtgtgcgttggccaccggcccctcccggctcagtggcatcgcgcacctgcggggacacgagacggaccggctcgccgccctcgtcaccgagatcaaccgccttggcggtgacgcagaggaaaccagcgacggcctggtgatccgtcccgcacagctacacgccggcgtcgtccacagctatgccgaccaccgcatggcaaccgcgggagcaatccttggcctcgccgtggagggcgtccaggtggaggacatcggcaccaccgccaagaccatgccggatttcccccggctgtgggcagacatgctggcgcagaatggccctgccgaaacggtgtcggaaggttccagcggtggcgcggagcactgattcctgggatgagtcggacgtccggatccggcccagcaagaagggctcccggccccgcaccaaggacaggcccagccatgatgacgccgtcacgggacgcatcatcaccgttgaccggggcaggtacaccgcagtggtgggagaagactccggcaacgagcgggtagtcattgccgcccgggccagggaactccgccggaacccggtggtcgcaggagactttgtctcgctggtcggcgacgtctccggggagccggacacactggcgcggctggtgaagatcaaggaccgcaggaccctgctgcggcgaagcgccgacgacacggaccccgtggaacgggcagtagtggccaatgccgaccagttggtgatcgtggtggcagcagccaaccccgagccgcggaccggcttcatcgaccgtgccctggtggccgcctacgacgccggcatcgagccgatcctgctggtcaccaaagcggacgtcaaagatccggcggaactgctgtccaactacactcacctggactttcccgtgatcatcagccggacggcggattccgccgcctcgggcattgacgcccgttccgacgacggcctgtccgcccggctggacagctctgccgtggccgaaatgcggggctacctggacggcaaggtcaccgtgatgctggggcactctggcgttggaaaatcaacgatggtcaatgcgctgaccggcgcggaacgggccaccggcggagtgaacgccgtgacgggccgcggccggcacacgtcgtcgtcggcccttgcgctgaagctggcagacgcgccttccggaagctggatcatcgacacccccggcatccgctcgtttggcctggcgcacgtggacccggaccgcatccttcgttccttcccggacctttcccccggcattgacgactgcgagcgcgggtgcaagcacaccgccaccgcagtgaactgcggactggacgcatgggtgggcgcggggcacgccggccccaccggggcagcaaggctcggctccctgcggcgcctcctcggcacggacccgcggatggaagcccaggaggcaaaggaactgggcagcgtcacctgacgggcccgcttcccggcagaacggcgcgcagacggtagtttggaaccatgatccaacccgcttcgagctacaacgatgacctgcgcctggcccatgtcctggccgattccgtggatgaccagaccatgagccgcttcaaggcccaggatctccacattgagaccaagccggacctgacgcccgtcaccgatgcggacaaggcagccgaggaagccatccgcggccagctgtcccggtcccgtccacgcgatgccgtgctcggcgaggagttcggcagcacgggccacgggtcgcggcggtggattatcgaccccattgacggcaccaagaacttcgtccggggcgttccggtctgggccaccctgatcgcgctggtggatgaaggcgagccggtggtgggcgtggtcagcgctccggccctgggcaagcgctggtgggccgccaagggcatgggggcctacatggggcgttcccttgccgcggccacccgcctgcgggtgtccaatgtgtccagcctgtccgatgcttccctttcctactcgagccttggcggctggaaggaacgcggaaaccttaatgaattcctgggccttaccgaggacgtctggcggacccgggcgttcggtgacttctggtcctactgcatggtggccgaaggttcggtggacatcgcctgcgagcctgaactgaacctctacgacatggccgccctggtgcccatcgtggtggaagcgggtggccgctttacctcgctggagggcgaggatggtccgttcggcgggaacgccctggctacgaattccatcctgcactccgaggtgctgcgccggctgaacccgaacctggacgacctcctctagccccttcagtacgaacattcgacggcgggtgcccccgaaaggaggcgtccgccgtcgtgatcttcggtacaggcgcccattttcaaccatgcgtaacaaagcccttaacatttccgcgggcttttaacctacgagccccatgttctacgctcttaaccaggtcacgagtgccagcgcaaaaccccggtttgctggccggcaaccctccattcgcggtggggtgccccgggtgacgaccaggccggtccggaagggatgcggcaagcgcggattcctgcacggagtcctgttgtgaagtgaggtctctgtgacaactgccaccgtctcccccgaagccgctgtccagcataaggcggccgccctgccgggttcgccggcgctctttgaccagtgccgggccgccgccggccgtccgctcgcagcggtcagcggcgccgaaatccaggctccgctgatccatggcggccacgtccggtacgccaacctggactatggcgcatccgcccccgcactctcggtggtttcggcctacctcaacgagatcctgccctactacgccagcgtccaccgcggtgcgggctacgcctcccagatcagcacctcggtctatgagaacgcccgcgccatcgtccgcgacttcgtgggcggccgcccggacgattctgtgatcttcacccggaacaccactgactccctcaacctgctggcgggctgcctgcccgtcaccgccggacgtcccgacggcgacgtcctgtacctcgacattgagcaccacgccaacctccttccgtggcagggtgtcccccaccgcagcatcgtggcagcggacaccattgcggcaaccattgacgccgtccgtgcggaactgcagcagggcggcgtcagcctgctcgccgtgaccggagcttcaaacgtcacgggcgaaatccttccaatccgcgcccttgccgcgctggctcacgagcacggggcacggatcgcggtggacgcagcccagctggcgccgcaccggcgtgtcgacatcgccgcggacgacgtcgactacctcgccttctcgggccacaagctgtacgcaccttttggtgccggcgtgctggtgggccggccggactggcttgatgccggaacaccgcaccttgccggcggcggcgccgtcaaggaagcaaggctcgacggcgtgagctgggcaaccggcccggcccggcacgagggcggatcaccgaacgtgctgggtgcggcgaccctggcccgcgccacgcaggtcatcgcggaactggaccaggaccgctggcatgcccacgaatcggccatccgctcgttcctggtggaaggcctgcaggagatcgacggcgtcaccgtccaccagatcttcaaggacacggaatcggacatcgacaccatcggagtggtcaacttctccgtggaaggctacgacgccggcctggtggccgcctacctgtcggcagaacatggagtgggcctgcgcgacggccgcttctgcgcgcacccgctgctgaagcggctgggccttccctccggttcccttcgggccagcttcggcgtcggctcaaggctggaggatgccgaacgtctgctggcaggcatccgggacctaaagagcaagggcctcggctgggactatgtggtggacgcaggccgctgggttcccgccaatgacaaccgcacgtacccccactgggcgccgaacaccccgggaacggcaggcgccgcgccctgcagcgacgactgacccgcggcggcctgccggacggtgccctgctgctgcggctgatgcggtaaattcggaggacaccaaaggaaccggatgaaggaggccgcgcgtggcatggggtggcccacggctggatcacggccggcgccgggagctcggccagagcttccaggacggcggcaggcactaccagcaggtgcggcccggctacccggccgactcagcgcgatggctggtaccccaaggggcccgcgatgcactcgacgtgggcgccggcaccggaaaattcaccgaactgttgctggacctgggactgtccgtcatggcggtggacccgtcagcggacatgctcgggcagctggccgcgcattatcccgccgccacagctgtccttggcaccgcagaggcgaccggcctgcctgacgcggctttcgacgtcgtcaccgtagcccaggcctggcactggtgcgatgccctgagggccagcacggaactggcccgcgtccttcgcccgcacgggacgctgggactggtctggaaccagctggacacgtccgttccctgggttcaccggctctccaggatcatgcatgccggggacgtctacaagcccggccaccgcccgctcataggacccgagttcgaggcgctggaggaccacgtcacgcactggcaagactccgtgacaaccgcggacctgatggaactgacaaaatcccggagctattacctgcgcgccggcgaggccacccgggcgaaagtgctggcgaacctggactggtaccttcatgaccacttgggccacgggccggacgaggaactggcactgccgtacctgacgctcgcatggcgggcggccagggcatgagcgcctgccagtccgcgtgtggccaagggcagccggtaggctggatcctgtgaagaccagcgcgccctcctcctccatagaggactacgtcaaggtcatctattccttcaccgaatggcaggacaaacccatcacgtcctcccagctggcacagcgccttggggtggccaattcgtccgtctcagagatggtccggaagctgaaggaccagggcctggtggaccacaagccgtacagtgccatcaggctcacggaggccggcctgcagcttgccctcgccatggtgcggcgccaccgcctgatcgagacctacctcgtccagcagctggggtacagctgggacgaggtccacgacgaagccgagcttctggagcacgccgtctcggacacgttcatagaacgcgttgcagcgaaactgggcaacccgcagcgggatccgcacggcgatccgatccccacggcggacggccaggtctttatgccccgcgcgcaccttatgggcgagctggaccagggccacaccggcaggatcacccggatcagcgatgacaacccggacctgctccgctaccttgcagctgagcagatagacctcgacgccgaggtggaggtggtgggccgcaggccattcggaggcgcgctggtggtgcgcgtccgggactcaggccgtacgcgcgactatgacctggccgatgagatcacgtcggcgctgtgggtccacagcgaccgcccccatccaggctgcctactcggggacgccggatttcccgcaaacttgcccggggcatgagcggcaataagacatcgtgggcgcccagggcaggcgcctggctggccgttgccgcaggcggcctggcggggacagaactccggtacggcctggggctggcctttcctgagctccccggatcctttccctggaccaccctctgcatcaacgtggccggcagctttgtcctggccgccctgaccaccgtctggatggcccgcccgcacacccccttctggttgcgggcagggctgggcccgggtcttctggggtccttcaccacgttctccgccgtggtcttttccctggaccagctggtgcgggcgggtcagcacggagtgtggactgtgtatcttggactgtcggtggtgctggggctggctgcggcgggccttgggtggcggactggaaagcttgttggccgcccgtccgggagccgtcagtgattgccgcggtcctggtgggaattttcggggtggcaggcgccctcctccgcttcggcattgacagctggttcgcccatcacagctccaggcggactgtccgtgccggcggctctgccggtcccgcgcggctgcactggccctgggccaccctcctggtcaatgtggcggggtgcttcattattggcgctgcgcacggagtcactgcgggactgggactgggcgcggagtggcaggctgggttggcgacaggcctggccggcggactcaccactttcagttcctggaccacggccacggtgcggctgctgaccgaagaacgcctcggatcggctgcggcgaacattgccgccaacctggtcctgggcctcgctgcggccgcggcaggaatcgccctggtgtcctggggataggaagcgcggccccggccgggaagccctgatttggtgggctcccgtattgtggatggtgatgattagcagacgcgacgcggccattgcccttgacgtaccgatggagatggcacaacgccacggccttccaaaatggctgagcgaggccgagctgggcgaaatcctggacaaccctcctccttggctcgtgcagtcccgtgccaaccgcacgggcaagcgcccggtctgggtccacctcgaatgcgcggtctgcggctacgaggaagcggcccgtcccaagaagtggtggcccgacttcacgtacgtgatctgcggacaccaccgcccggacgaggtgcctgcggtccgcccggggttcgtccggagcgagctcgacggcgtgggcacgcgtttcgtgggcatcgcggacgtgcctgtcccggactgagttaccgcacttccaagccattacattcagggctgaaaaggcgtagcttacgagaagggacgcagccagtcccctgctgtaaggagcacgccatgccggacaaaacaccccaccagaacctggccaaaaagccggtcaagaccatcaaggaaaaacgcgcagagaagaagtcgaagcaccctgaggctgcccaggacccggttgcgcatttgaagaagcgccggtagccctactgcccgtttgcctccatttcttcccgggcggcaacgaggtccgcttccctgccgtgcctcagcaccctgatctgcggctgcccgatcgcatcggcgaacaagagcttctgtgcgccggcgttcagcagaatcggcgtgctgaccacaccaggtatgccatcctgacccgcccggtgatggggacggcgagtcccagaccggcgcctgccactgccgtgttggtgcccacgatcctgctgtgcgtgtctgccagcccgagcggattcccgactgcgatcacgagccaagcggaaccgtccattccggcgggcgctggtcatttctatggccgcaacgtacggcctcaccagcccagccacccacatgaccgttcgtaagtacgggtccacggcatcgtcgtcgtcgtactcatcaggagtgggcccgggcacccgggccatggcgctgctcctaccgcctcctgcccccaaccggggactgcaacgccggatcctatagaggacaatccacggccagcggccgctagtcccggacccgctacgccgtgggtgaacagctgttaagcagcgaaagacccggacgggatgtccgggtctttcgttgtgcctcgcggcctttcaaaatgtggagatggggggaattgaacccccgtccgatgtcgtgttgtcagggcttctccgggcgcagtttgcgtcggattttctcggccccagccatgctgcaaacagctggctgatccgggcccagtcatctaagagtcccgttcaccccgatgacggaggtggacagcagtggctatctaaatgacgccaggatccggggcgatagcaacctcgggctgacggactgtcttactgcttaggcagcaagagcgaagtcagtgcgcttagattcggcacttattggtttgcagacagcgtttacgagataattctgcatcctcggcccgcttcacctgtcgcgactaacatcgtcgaaaccgatcatccccatattcttttatcaaaccggcaggctggcccaccggactattcatcataacgcacgctcgcgccaaaacattcctagcggcgccggttgcgctcccgcatctcacgctgcgcctcgcggttgtcctgctgttcgcgcagggtctgccgcttgtcgtactcgcgcttgccgcgggccacaccgatttccaccttggcacggccgtccacaaagtagagctgcagcgggacgatggtgtagcccgattcgcgtaccttgtgggagatcttgatgagttcctcacggtgcagcaggagcttgcggcgccggcgggccgcatggttggtccagcttccctggttgtactcagggatgtggatggcctccatccacagctcgtcgttgtagaaggtgcagaagccgtccaccatggaggcgtggccctcgcgaagggacttcacttcggtgcccatgagcgcgattccagcctcgtaggtatccagcacgtggtagtcatgccgggccttgcggttggtggccaccactttacggccactttctttaggcaagggaaagctcctcaggtcagttcggttgtcctccgggccaaccggcgcggagtcataccagtgtacggcagggtgcagacggtgctacagcaaccccatcgggtccaccgggttgccgttcagccaagtttcgaagtgggcgtggcagcctgtggagttgcccgtgttgccggagtaggcaatcagctgtccctgagaaacccgctggccgttggacacgacgatgctggcgttgtggtagtagatggtgttcagggtgttgccttcgatgaggccgtgggagatcttcacccgccagccgcctccgtcaccagagttccagccggagctgaaaacttccccggctgccgccgcatagacgggcgtgccacaggccgcgccaaagtccagcccggtgtgcatgtacccgccctgaccgtagaagtcgatggtgcccggcggggtggcccgccatccgaatccggacgtgatggaaacgctgccgtcaaagggatgccggaggccaaatgccgacggcgacccgacaggcggcatgaatgactgtgccgggggcgctggcggaggcggctggttcctcgccgcggcttcggctgcggcagctgcagccgctgccgccgcagctgcttcagccttcctgcgctgctctgcttcccaggcttcccgcagtctgcggtcgcgctcctggatctcggctgccaccgcattctggctcgcctggacgccagccagctgggactggatgccgggcttggcagcctgcagctccgcgtccaggcgggtggtgtcggcgatcagtttatcaacctgttccttcttcgcggccgcttcatcgcgtgcggctttttcccgttccaaggctgcatccgctttggctttcaggtccttgatctctgcctcgaccgcctgcaggcgcgcttcagagttcacgttggtggcgctctgctgcgacagtttgtccatggcagcgttctggctccgcatggcctggtccgcgaggtccatggtttcggtcaggctgccgccgttgttggacccaaagaaaagggacaggttggaaggcacgccgccggacttgtacgcctgggtggcaatctggccgatcagcttcttggtatcggcaatcttctgcttgtccgtctcaagctgctgggtaatcttggccttgttctgctgagccatgtctacccgggcagagagcgcttcgacttccttgacggcaccggctacgcggccctgagcctcaagcagcgcctgctgcgcaccgggaagttggccctggtaaatcaccaggtccccggctgccttggcgatgcgcgaatcgacgaattccagggactgctggacccgcgatgcctcggcctccagggctttctgccggtcctcaagctcgtcagcgaaggccgccggggtggaggaggccagccctgcggcgaggacaacggccagcacaccactgagcaggctggtgcggggcgccgcactgcgcgcgccgtttcgccgggcgcgggaagcgtttttgtccgatgcattcatgggcattcctagattggtttgcatacctagacgcgaaggtatctgcgtaaggtcaagagagacgaaattccagccaaggatgcaccaaggattaacagcgcgggaacaaggatcagcgtctggccggaggatatgaacgcagtgtccggatactgctgggacatgaattcgccgaggaagaagtgtgccacggcccaaagcgttgcggacgccagggcggcgccgatcaccgcggcgatgaccccctcgaggatgaacggcagctggatcaccgtcttggacgcgcctaccagccgcatgatccccgtttcgcggcggcggctgaacgccgagagcctgatggtggtggcaatcagcaggatcgcacagacaatcatgacgccggcgatgctgactgccaccagggaggcgccgttcatcaccgagaacaggcgctcaagcagctggcgctggtcgatgaccgtctcaaccccgggctgggaggaaaaggtctcgctgatgatctggtacttttccggatccttcatgttgatccggaaggacgccggcagctggtcgggggtcaccgagtccacaatgggcgaattggagaactggtccttgaagtggttgtaggcctcttccttggactcgaactggaagtcgttgacgtactgcgccacggcgggagactcgagcagtgtattgaggcttgcctgctgttcggcggtgacgggcccgctggcgcaacctgccgccgtcgagccttcactgcacaggaagatggccacctggactttgtcgtaccagtagcccttcatctggttgatctgcatctgcagcatgccggctgcgcctacgaaggtcagcgagacgaaggtgaccaggatgaccgagaccaccatggagaggttgcgtcgaagtccgctgccgatctcaccgaggacaaatgcgagcctcatcgctgaccctccccttcgccgggaagtccggcttcgggggcctcccgcccgctggcgtccttgagcctgcgggactggcctacgaccgggatcatcgaagtgtagagcgcccttgcctcatcacggatgacgatgccgttcttgagttccaccacgcgtttacgcatttcgttgacgatgtcgtcgtcgtgcgttgccatgaccacggtggtcccgttttggttgatcttgtccaggacgcccatgatgcccatcgaggtggtggggtcgaggtttccggtgggctcgtcggcgagcaggatccctggacggttgacgacggcgcgggcgattgccacgcgctgctgctcaccgccggagagttcgtgcggcatgcggtgttccttgccctcgaggcccacggttttcaggacctcggggacggtgtcgcggatgacgctgcggcttttgccgatcacctgcatggcgaaggccacgtttgcgaagacgtttttctggggcaggagccggaagtcctggaagacgacgccgattccgcggcggagccgtggcacacgccagctggaaatctttgcgacgttctggccggcaacgtagacggcaccggacgtggcccggtcctccttgaggacaagccggaggaaggtggatttgccggagccggatgcgccgaccaggaaggcgaattcgccgcggtcaatctcaaggttgacagcgtccagcgcgggccgggctttctggtcgtagaccttggtgacattttcgaatcggatcatggccctaagtaccctgcagggcatggctgattctgatgcagcccagttctgcagccggtgcgcgggtttcgtgtgggggaagtagggccccggcccctcgactatacgcaggagttcccgcgtatcacactggtttcagggggcgtgtcgccggatccacgcgcctagcgccgttggcgggcctatttttcggcgttgcggttatccgtgcgccagcggatgccggcgtcgatgaagtcgtcaatttcgccgtcgaacacggcggaggtgttgcctacctcgtgctccgtccgaaggtccttcaccatctggtacgggttgaggacgtaggaccgcatctggtcaccccaggacgccttgacgtcgccggccagtgccttcttttcggcgtcctcctgttccttcttgagcagcaggagcctggactgcagcacgcgcatggcagcggcgcggttctgcagctgcgatttttcgttctgcatggagacgacggtgccggtggggatgtgggtgaggcggacggcagagtcggtggtgttgaccgactggccgccggggcccgatgagcggaagacatcgacgcggatctcgttgtccgggatttcgatggagtcggtctgctcgatcaacgggatgacctccacagcggcaaaggacgtctggcgccttccctggttgtcgaaggggctgatcctgacgagccggtgggtgcccgcctcgacgctgagggttccgaaggcgtagggcgctttcacttcgaaagttgcggacttcaggcctgcttcttcggcgtaggacgtgtccatgaccgtagtgggatacccgtggcgctctgcccagcgaaggtacatgcgcatcagcatctcggcgaagtcggcagcgtccacgccgccggcccctgcacggatggagacgacggcttcccgctcgtcatactctccggagagcagggtgaccacttcgagttccttcagggcctttttgacggactcgagttctgcggccgcctcccccatggaatcggcgtcatcctcgtcctgtcccagctccaccaggacttcgaggtcatcaatccgtgacgcgagcttgttgaggcgctcgagttcggactgcttgtgcgaaagcttcgacgtgattttctgcgccgctgaggggtcgtcccacaggtccggctcgcctgcccgctcgctcagttctgcgatgtcttccttgagcacgtctacatcagagacccgctcaatggagtcgtaggtggcgcgaagggcgcggatttcagcggaaaaatcaatattggccatggttgtttaagcctacgctatccggcacaagcttcggcatgcactggttttcctggcttgcgccccctcgacgatgtaggccgcaggtatcactcacgcgggcccgtcagcgggtcaggcgcgagcgcgccgtcgacgtcgcttcgatctttatgccgtccggcaccaggaagttaaccacaggagggtggacagcagccgtcagcacgacgacggcggtggagccgtcggggctgcccgttgaccccgcgacggcgagtccgctgaagcgttgggcagcggggctccttgagacgaagtccgccgcgacgttcctgacgcgggccgggttaagtgttgctgaaggactgccgcccagtgtgtccacgtcccccagggtgtagctgtctgctgccgccagggaggcaccgtcagcgagtgaaagcaaccgcttgtgttccaggtacacagaggaaatgccaattaccacagtggtgacaagcagagccaaggtcacgtaaccgaggatcatgaccatcatctggccgtcttcgtggtttgtcctggcggtcatctgaatctgcccaccagttgtgttgcggaggcctcaacctcgcttgcggccaaccggaggtcactgttgaagggcacaaacggcaggggcaccgacaggctcaccgtgatggtcaccgcggtgcccggagcttggcagtcggcggggtcgcatctcgttgagatgcttgctttgtccggccggtgcccaaagtcggccagggcgatggacaccgcttgttcggcggcagcctgcgccgtcggttcgtcgggctgggcgacgtagaccttggctgcctggtccgctgcccccaccacggcaaaagagccgccctggatttgccccacggtaatgacgaagtaaaccagcggcaccataagaatgagtgcaagaaaggtgaactcgacaacggcgcttccccgctcgtgttcttccctggcttcccgtccgtgagctgctgaggtcggtcgcaggcacagtgcttggaccattctgcgtttcaggaacagcgccccaggcctacggttgcactgcggcatgccccttcacctccagcatgtcccgggggcctatgagtccgatgaccggcatcggcgcacgcactgtcacttcgagggtgcggaggccttgaacagtcacttcgctggtgctcacctgttcggcaaatccggcagtcaaggccgagccgatcaggctgcgggtccgttcctcggcgtctgctgcgccccggtccgcgagggtgccgtaccttgcgcctgaggccgcggcatcaatcaacgtgttgcgaacgtgcaggatcaaggtcagctggataatggccaggaagaacatcgtgaggagtcctcccaccaggacaaaatccactactgccgagccctgctcccgcgtcgcggccaggcagcggactctgccggccgggcctggcgggtgggaggacctcggcaccggctagcttccgaccgtatccatcgcctggttgaacattgactccagcgccggtccggcaagggcaagcagcgccgccaccagcacagccgacatcagggtgatcatgacccagccaggcacgtctcccctttccttgtagtcgcagccttcactatggtcgccgccgcgacgggcggccgtgcaaagggcagtgcccacggcggtgttcacgacaaagagcagggatgcccagcgatgtcccatttttacttcccgtcctattcctgattcggttcttcgatcgttatgcattccggcgcccaccattggtgtcttcacatgcccaggttgatggcagcgaggcccgggaagacggcgaacaccacagtcagcgggagcacgccgaaaacaagcggcaccatcatggcgatttctttcttgccggcagcttccatcaggtcgcgttttgcggtatcccgcacgtcctgggcctgggcacgcagaacatctgccaacggcgtgcctctttggacagcgacaatgatgccgtccacgaacctcaccagcggtgccaggtccgtccgcgcagagaattcctgcagtgcctgcacgaggggcttgcccgcccgggtctcggcaagaatgtccgcgaactccttagtgagctcccccttggcactgcggcagaccctgtcgagggcgcccgtggcgctctcccctgcgctgacggcgagtgccatcagttcagccaggctagggaattccgccatcatcctcgattcacgccgtttgatttggacaccgagccagtagtcccgcagcatgaagccgcccacggcactgcccaggatggcaacagcggcgagcagtgggttgaatctgccggcggcggctcccattgcggtaacgccaagggcggcaacaaagccggcagccgaccacaaaagctgttccgcccggaagtcgatggacgtcttgttgattcccgcctgcgcaagtcgtcgcgaagtcgcccccggcgacgggttcagccttcccaatgcggccatgccgtcacggaacaccggacgcagaatccttccgagcgggccgaaaggcgtcaggttggcttcccccgggctcaagagccgtgattcgaggttctgggacttcaactgcggctcaatgcgttctgtcagggtggtcgcgcgcatcagcggggaccggaagatgacgagccacagaccgagtccctggacaattccgcagacgacggcggcaggagcgatgtcgatcatctgagcaccctctcatcctgaggcagggccccgatcctcagcatgatggagtagcagaccaacgaaactaccaggccgccaagcaggactgcggcacccatggcggtgttgtacgcctgcaccgcctccggtcttgttgccagcaggagcataacgatccagggggcagccaccgcaaggcgtgccgcgttgacggtccaggactgtctcgcctcgagttcgctccgggtgcgggcgctctcgcggaggaactcagccaacgttccgagcaactttccgaggtctgagcctccaacttcgcgggtcaggcggagggcttcgacgatgcggtcggcaaccgggtccgcgagccggtgtttgagcttgttgagggaggcatcgaactggcctccggcgcggtagtcggcaccgaactcccggaatacgtgccggagctcttcaggacccttgtcccccaactgaatgagggcttccggcagcggcaggccggcccggatcgcagagcggaggtggtcaacgacgtcgggccacagttggcgcaacaatgcgcttctcttccttgccctccagcgcaggatgctgacggggaaccccgctgcgaacagcgcaaagcagccggcgataggccaggatcggctgacggcgtaaaacactaatgccacgaaaaggccgagacccgcgcacgttccgatgaggctgcctggggataccttgtcgacgccggcggaggcgagaaggtcacccaggcggctgaccttccgctccttggggccctgtgcaggtgtctcccagaaggaccaccagatcaggaagaggcccgtccccgtggtaatccccagcaaagccgccgtcatcgcggatccagcagcgccgcgacgtcgtaccctgcccggctgaatttttctgtggccggcatcgagttggcccggggctgcagggcaccgtccaccatcgcaaagaccggggacgactcgatgatgccgttctccacccgtcggcccagcgagaggatttcggttacctccctgcggccgttggcctgccggctgcagtggactacgagatcaatgcacgatgcgacggtggggacgacaaaggctgacgagatgttctcgcccgcgagcaggggcagcgtgcaaatcttggtgactgcgtcatgcgctgaattggcgtggacggtgcacatgcctggcaaaccgctattcaaagcgatgagcatatccaggctctccgcttcacggacctcgcccacgaccagacggtccgggcgcatgcggagcgcttccttaacgaggcggcgcagcggtatttcgccttcgccttcaagatttggctggcggcactgcaggccgacgacgtcgcgcaggggaaactgaagctcgaaaatctcctccacggtgatcacacgctcccggctgccaatgctggccgccaggcagttgagcatagtggtcttgcctgcttgggtggcgcccgagaccaggatgttgagcccgctggatacggccgcgccaaggaagcgggctgactggggcgtcaacgtgcccaagtcgacgagatgctcaagacggctggccttgaccacgaatttcctgatattgaccgcccaatgcttgcgcgttacatcagggataaccacgtggagcctcgacccgtcgggaagggcagcgtccacgaacggagaggacatgtcaagccggcggccagaggttttcaacatccgctccaccaggtcccggacctgctgctcagtgaggcttagcgaagtcagctcggactcaccgttccgggccacaaaaatttcattgggagcgttcagccaaatctcttctatggctggatcgtccagcagtggctgaaggacgccgaacccggcgacggcgttaaagaggaagcggcgtgccgcatccaagggcccaagcggaggaagcggacccatcagcgcccgctcgtcataatccgttaccgctgcctccaccaggcggcggacctcgcctgcctggtgaagcggatcaagccctcgccgacggatgagctcgcggacttcatcctcgactattcccagcgcgtccatatgttccccaatacaactgccgcccccggcggaggcagtgcaactgggataaagcctaaagatggtaaagcacggcaacaagtcatattgcccaagctgtggacaaccattgttgatgcggccacacggcatgagccaatgaacggctgcgacgaattggcgcaacgttggacctggcgagctcgctgagtggagctgatcctgactgttcttgagccggtcgcccgcacttgggtgggtattggcacataaaccctgcgggcacccacatacttccaccgttttgtctttatcggagagctcgtctccataggattcctccatgtggaccaaacagagccaaagcttctgccccgcatgcggcaggaccacccaccacgtgactcactttcacaaggacgacgccggcgcgcttgttgccagcgcacgttgtgccgagtgcccgcaaccgggcgttcccgccgaaaaccacatgcccgccccgctgaggaaatttcatggcgttccagcggtctgacatgagtaccggaatcaggatctcagtgccctacctggcaaaggtgagtaaggggtactcgggcggcatgtgttgcacaagaggttaataaatcagcgggggcaccagcttccacagggacctgcacgcgacagcgttggggcggaacgtttaaggagaaccgtgaagcgaccattattacgagccctaggccatggactggcaacaatccttgtgctcaccgggctgggagcagcagcaggggggcaggcaagcgcggcaaccgcgcctgactacggcacccccagcatcagttacgagggagtccccaatccgcctaccgaggacaagccgcaaagcaagctgtggtggaatggcggcttttggtgggccaatatgtggaccacagaaggctggcgcatccacaagctggaccgcgccgccaagcagtgggtggacaccggagtggccgtggacggccgggaaaataccttggcggacacgctgtgggacggcacgcacctttacatcgcgtcccacgtggtcaacatcaacgcggaaagctcgccgaaagcgtctgcgcccaactctccggctaggctttaccggtacagctatgccagcggtaagtacacactggacagcggctttcccaccgtaatcaccacgtacagcagcgaatcgatgaccatagacaaggacagcgagggaatgatctgggccacctggacgcaggtgtcaggtgtctcaaccggtggttacacaaataccgtaatggtgaataacgcgaccgccaacggaacctcctggggcacgcctcgagcccttcccgtggataaccccaaccccaccccggatgacatctcgtccgtcgtggccttcggcaagaacaagatcggcgtgatgtggtccgaccagaaaacgggctcagtctggtgggccacacacattgatggccagcccaccggcgactggaagctgcagccagctgtccgcgggacaggacaggccgatgaccacctgaacctcaagtcgctgcaggcggacccctcaggccgggtattcgccgcggtcaaaacaagcctggatcagacctccacgaacaaggacgacccgcagctgcggctgctggtcttcaagccgggcacgggagcgttcacgcaatccaccatctccgcgcttcgggactgccaaacacgtccccaaattgtcctggaccccgaaaacaacaagatccacgccttccagacaggacccgcaacatcggtgaccggctgcccgtacaccggcgtttcaggtgccatctaccagaagacagcctccatggacaacccagtcttcccggccggccgcggcacgcccgtcattcagaacggcgccgcacccagcatgaacaacccgaccaccaccaagcagcccgtcacaagcgccagcggcatggtggtcctggccagcgacgatgtggccaagcgctactggttcgctgacatgggcataggcgcctccacgagcgcgcagcccggcaccttcgtgccaatcgcgcccacgcgtttcgttgacacccgcaatacgtcaccagtggcggcaaacgccgccttgaccttcaaagtggccggtgtttcggcaattcctgccggcgtctcggcagtagtcttcaatctcacagttactcaaccgcaaagcttcggacacatccgggcttacccttccggtaccactgcgccgggcacgtccaacgtcaacttctccgcaaaccagactgtacctaactctgtcacggtccccgtaggctcggacggcagtgtcacgctgctgaatacctccagcgggagcacccatctgatagctgacgtgaacggttactacataagcggaatcccaacagtgccgggcgcatttgttgctgtggggccctcgcggttcgtggacacccgcaccagcgcaccgttggccgcgaattccactctttcattccaggtgggcggcacgtccgggattcccgcggacgcctcggctgtggtctttaacctcacggccacgcagccgacgagcttcggacacctccgcgcctatcctttcgggacgactgcgccgagcacatcgagcgtgaacttttcaaaagacgagactgtgcccaacctcgttacagtcccgatcggttcagacgggaaggtcacgttgatgaacacctccagcggaactacccatgtaatcgccgacgtcaacgggtactacatcggcgggacgcccactgcggtgggtgctttcgtggcgatgaatccgtcccggttcgtggatacccgcaacagttctccggtaggcgcgaactccgtcctaagcttccaggtaactgggaccagcgggatccctgccaagatctcggcggtggtgttcaacctgacggtgacccagccccagagcttcggccatatccgggcgtacccattcgccacgccggcgcccaacacgtcaaacgtgaacttttcccagaaccagaccgtggctaactccgtcaccgtgccggttgggtcagacgggaaggtctccctattgaatacatcgagcgggacaacgcaactaatcagtgacgtcagtggctacttcttaggcggataaagccagccagatcaatgacggtacgtgaaggataggtgggtcaagcctcaccggcccttcgaagacctccgctccatgcgactccaatccgagtccatgggccgggggtcttcttgttcccctgccgtctttcctgatggaatccatcgggatgacgagaatacagatcgccgcgcttagggacgcagatggtcgcagggaacctgcaccttccaggcccctggtgccgttccaacggcatggtcagtcagtgcaggatcggagatgcatgcctccctggctgctgcaacgccacttgcccacaagggtccagactgacggaaggctgcggaaggaaagaaatacaggacctgcaaaaccaggaagcctgcgagaacacctgacatcgccgccgtggacaccttctcccaacacattgccagcaacgggagcaaggcgagcaagaacatagagggcacggtgctgtaccttcccagcaggaagctgtcccattcacccgcatcaaaagatgaatagtcaaaggcgtcggaaaagttcaggatcgtcgctgcggcccataccccggcagaagcagcaacaaagcaaaacgccatgagccgaacctcgcgcgtgcccttgatcagaaggtagacaaaggtcagaaagaacggcaatgcggcgacgacaatgggggccattccaaaattgacaatattgcgggaaatttgagccgatgtgccatatatgacagcggaactgctgttcaggaaccatccttcaacaaccgagacaaggttgggaggttggtagggaactgaacgagggtaggacagcgtcgtgatgatctggcacagaacgcccaccaccagtccgaggcgggcaggccaaaatgacttgtccttgaaccgatagaggaagagtggaataaacatcagtgtcaggatctcggtcagagacgacaggactgcggcactgaagagcaaaacgccctctcgtttcgtttgcgccggctttatgagcagccaaggcatcagccacagcagataccagtggatattggcgaggttaccttgcgtttcaagtggaccgggcgccaccaggacagcaattgatgcccatgccaaccggataaggacatgtgatgtcaaagctctcgaacaatgaaaaaccatcaaggcgatcagggcgatcacaaggcaactgagaaaggagattgcgacagcgaaactatctaccgggaaaagaagcaccacaaggctcactgtcatgcggggaaccacatggagatagccctggtatggcgcaaaaatgtccagcggaccgggacgtctaagtgcgtcgtatataaagactgcgccgtcttctgcccatactgttccctgcgcaacggggctgatgcgggcaaaacttatcaccgcacctgctagcacggccgcgaacgcagcaagagtcttccagccgggccccaccggaaatatgttgccgttgctgtttctactcttcatcgtccctcattgctctcctgcgtgacggacgtgcgacggagccgttttgattcagtcgtactcaggaagctcagcatcaccggcccagaggatactatcccacccggatcctcccctcgaaaaagcatgggaatgcgctggcaacaggacggccgattgatgctgctcatcgggatgcgaagctttgcagtcctgacccgcccacgcaccacaagtaggcagtgaagggagcactagtcacaacagcctcactagtcacggcagcatcacagtgttatggtgagcgcgttaatggtcactatctcctgtccggtagatccctggggggcaccaccggcacagcaacctagatgggcgttcaagcgctcattgtctccggagccaatatgaaacggaacctgtctcagtcccgtcgccccgctatgaaagccatggtgatagtgctgctggccgcatcgctggccgcagggccaggcctcggaagcgttgcctccgccgtcgagcctgtaccctcacccaacacttcctcccctcgggggagtacttcggatccggtcgcgcctgcagtgtcaccgaaccccacgcctacgcaacctgctcaaccccaaccagagcctgccccgctcccagcagaggcagcccagtcaatggcagaagccgttggccctggcggagcagaaatgggacaacgctccaggcgggtgacagccgcggccccctcagactccctgagaaagctcagcgcggaatctttgtccacggaaggtacgtggatgccgacgttcggggtgcagggactggatgtcagcggacatcaacccagcgtggactggcagcagcaatggaacatgggcgcacgtttcgcctacgtcaaggcatctgagggcaattactacaagaacccctcctacagcgcccagtaccaaggttcgcgagccgtaggaatgctgcggggtgcctatcacttcgccattcccaactggtcttccggagccgaccaggcccgctacttcgtgcagaacggaggcggctggtcggctgacggctacacccttcccccggtgctggacttcgagttcaatccttacgagggccgaaccatcaacgggttctacttcgggaacacctgctacaacatgtctccggcccagctccagtcgtgggtgcgggactttggcaacacaatgctctccatgacgggcaggctcccggtcatttacaccaatacgagctggtggaaccagtgcctggggaatccctccggctttggcgactatccactgtggatcgccgcctacccttcttcgccgaccaacaacgccgggcctgtccccactgcgagctggagcacgtacagcatgtggcagtacagcagcacaggtcctttcgccggcgactcaaacgtctggaacggcgactatgcctcattgcagcgctttgccggagcccgtcagccgaccggcagcttcgacgagctgagtctcagccgcggagaaagctcagtttcacttcgagtacgtggctggtctgtggatctggcaaacacgcccgccgccaatgaagcccatatctacgtcaccgctcctgacggtagaacaacaggacatgcatggaaggcaaacgcctacaggcctgacgttaatcaggtctttggcttcggaacctcgcatggcttcgagggaactattcctatctcaatgtccgggacttacaaggtctgcgccttttcaatcggcgccttcggcaatgcatcgctcggctgcaaatcgatggtggcatcgggcgtagaagcccccgtgggaaactttgactccatcggccaggtgcgaagcggccagaacgcatccctgcagctcaaggggtgggctgttgatatggcgaacccgagtgcctcagcctttgccgatgcctacgttaccggccccaacggagccaccaccggctaccgcatgaccgccaacacgtcgcgcaccgacgttcaccaagtcacggggctgggggcttcccacgggttcgattaccaagtgcctctgaaacaagcgggaacgtataaggcctgtgtctatgcgataggccagaacttcaacctgccgctgtcgtgcaaatcgatcacggtcgactccagcccggcgcctatcggcagttatgacgctttgactctcagccatgcgcccaacgccactaatcttaaggttcggggctgggccctggatccgacattgccggcaagcagcatctccgtcagtgtttacacaaccaccaaagacggttccggcggcgctaacccaggcatagtagcgaccgccaacctcaaacgaccggacgtgaacaccgctttggcgacagtcggcgaccacggtttcgaagtctcggtccctgtcaccgctccaggcagctatacgatgtgtgcccaagcgataggcctggctcctttgtctgaaggcccaacgctcctgggatgcaaagacatcacggtgaattcaacccctccaaccatggggcagcttgatggggcctcggtccaggtgacaaacgggcaagcttcgctagtggcccagggctggaccttggacccagcctttccggcttcatcaaatccggttcacgtctacatcaaatatccagatggcagcaccaagggatacccgttcacggccaaccttaagcgtcccgatgtcaacagcgctttgcaaaccgtgggcgatcacggctactcgacatcagttccgatctcaacccgcggccaatacacggtatgcgcgtacggcgtggcagtctccgtgctcagctcgaacaacacccagctgggatgtcggaacctgacatattagaagcagggtcagcagacaccctcccgtggtcatgttccgagtcgcgcagggtaggattcaggacggcacggtgcctgcttgggcccagtggcgacaagctttcatgaatcggatggagcattctcttggctttaaaggccccccctgccttgctgggccgttttggcggatttgccgcttcattggtgttttcaaccgtcgtcaaccttctggcgatcccgttcgttatttccaccctgggtaaggatgtttggggggaactcgcacttgcccaggcaacggcagcactctttgggatcatcgtggcctatggctggggtacagtcggggctgcgatggtggcatcgttgcccgttggagatcgtccccaaatgtacgtggattcgttggtaagccgcgggtatctgtttatgttcgcagccccagttatgttcgtggtcgtactggcgatctcaaggatcgatcctgctgttgcagctgttgcatcggttgcctacgtgctgccgttccttggggcgtcgtggtacttcgtagggcaagcgaagccctggaagctgctgatcttcgatgtcctgccgcaggggcttggcgttatagcgggtgtggttctgaccctgttcatgcctcatgcatacgtgttcgtactctctctgctggtattcaatgcccttgcagtggtattgggcgctgttggtgccgtcaggtcccggagtggacacccagtaaggatcaacctcgccctggtaccagcgatgaaacggcttcgtgaccaaaggcatggcgttatcgctgccggcacaggaagccttaacagcaactttcccctgcttgcggtgaacctcgtagttcaggcagcacttccccaatacgcaatggcggataagctcttccgcttcgctgtcgccgggttcgggccagtcctgcaggtaattcagggatggatccctgaggcaggggcggcagcaagcaggcaccgcatccgtaccgtagcccggctggctccggcagcaggcgttctcgccggttgcctgctggctctcctgacgccctgggcaagctctgtgttctccggcggtgccataagtatcgggctggaattgagtgccccgtttggcttgattcttgccgccgtgatggtcgcacaggttgtgggtctggcttgcttgataccgttgggcaaaggagcagcactcgcgaaatcaacggccattggcgccgcagtcaacatcccgctgatgttcgtgttcgggatgatgctcggcgcccccggagttgcatgggccgttggcctggcggaagtggtcgtcgcaacgtaccaactgctcgtggtaaggaaaacgctaaggaaccttatccctaaagagccggcaccggttgtggaagctccataaccaaccgattcaggcagacatcaaggtatccctcatgccgcgcagcgctagagcgcaggccgcgctccccttttgaacagttccacaggaagtccggccaggaactccacaaaacagggcaatgcgatgtccccgcgtttcagtcctgacacaagcgattttgcagtcgctgcccaacggtgtccgctctcaaacgccgcgatgccctctttgacgcttggatcagccacctggacccgttcccgtaaggcatcggccatcactttgcgccagccgaagctcagctcatgcgcagtcgccaaaatgtccagcgggcgagcgctgccctggtatttttctgacaggccgcgcagatgattaaaggacgccaggacgctcttgcgtgtaccaacctcacccaagacatttccgccatgctggacatagtcctgcacgacatcatcaagcaccgtcactccccccgtggacttggcgcatacagcgagccaatggtcatgcacctgtgcgatcgtgttcaggcgggggaagggcagagccaagtccagcagctcccgacggaatacgcagagactgccggttacttggttctgggccagcagcgcatccagcgccacactcttccgaccggttgaggacgaaaccaattcattgccgggaagacgaactacgcgtgcttgccccgtcactaggctggcgcccgcaagatgcgggatcatcagctccagcttggacggataccaggagtcgtcctgatccgacagcgccacccaggcggcccgttcgggaacctgttgaactgccctttcgaagtttccgtaaaaacccagccgatcatcaaagccagccacccggaacctctcatcgccgcccagttcactggcaacgaagtcgcggatctcttggaacccgccgtcagcagagatcaggcattcaaagttggtgtgggtctggttctggatggatctcaactgagcggcaaacagtgtccagtccggcttgtacgcagcgagggcgatgatgccgaaagatttcttgtcgtaagacatggagcgactaatccaccatcacacgctggccgaggtattcttccagcgctgcccgggcgggcctgggtgcgaatccggactctttgatcttcgtcaggtccaggacgctgtgaagcggccggggcgccacgtccttgcctcggaagtattcctcagtgctgacgccggtgacagccgaccgcggctcccccacgagttcgtaaacgtcccgggcgatgtccgcccaagactggaggtcaccgtcgttgctgaggttgtaggtgccgtagtcagctgcagactccagcaggtgccggatgcctgtagcaatgtccgcggtgaagctcagcctgccaatctggtcgtttaccaccgaaggcttgacgcccctcgccgcgagggactccatcgttcggacaaagttgttgccatcgccgataacccaactggtcctaacgatgtagtgcttcgggaccacgctgacgacggcgtcgcctgcggccttggtctggccgtacacccccaacgggctgacgggttccgtttcgtcatggctctcgcggactccgtcaaagacatagtcggaggagacgtgcaccagagtgaggtcatgttcgacggcgacgcgggccagccgtgcgacggcggcaacgttgacggaccaggctgctggccggccttccgcggtttccgcggtgtcgaccgcggtgtacgcggcggcattgatgatggtcgagtagttcttccagttgcgctctgtgaaagacgcttcgctgcccagatcgaagccggcgcggccggcgaactcaacggttgtgtcgccgtcgtacagttcccgcagcgccttgcccaactgaccgtcggcacctacgacgaggatcttcttgggcggcatcggcacaacgtccgcgaggcgggggtgcgccttgtccttgtcggacagttctgcttcctccagaggcaccggccagctgatcgccgctgtctcgtccgcgaggttcaggaaggtgtattggccttgggcatccgctgaccaatggtcgttgaccaggtaggtgtaggccgtgttgtcttccagggtctggaaagcgttgcccacgccgcgcggaatgaagatcgcctggctggggtccagttcagcggtgaaaacggcaccgaacgacgggccttcgcgaaggtccacccaagcgccgaagatccgcccggtggccaccgagatgaacttgtcccacggctcggcgtggatgccgcgggtggtgccggccttctcgttgaaagagatgttgttctgcacgggatggaagtccggcagccccagggccaccatcttttcccgttgccagttttccttgaaccagccacggttgtcgccgtggaccggcaaatcataaaggacgacgccggggatcggcgtttcgtgtgcggtcagctttttcgagaacgcgatctgcatcgtttactggccctgttccttgtacttggcttcggtctgggccttctgcgggcgccaccagttttcgttctcacggtaccaggcgatggtgtcctcgatgccggcgtcgaaattggagaacttcggttcccagccgagctcgtcgcggagcttggtggagtcgatggcgtagcgcaggtcgtggccagggcggtcgacgacatggtcatacgcgtccggggcctggcccatgtgcttcaggatcagctcaacaacatccttgttgttcttctccccgtcggcaccgatcagataggtctccccgatcctgcccttggcgatgatggccagcaccgcagaggaatggtcgttggcatggatccagtcgcggacgttctcacccttgccgtaaagcttgggccggattccgtcgatcacgttggtgatctggcgcgggatgaacttctccacatgctggtacgggccgtagttgtttgagcagttgctgatggttgcctggagcccgaaggaacggacccaagcgcggaccagcaggtcagagccggccttcgtggacgaatacgggctggaggggttgtacggggtctgctcggtgaaccgctccgggtcatccagttccaggtcgccgtacacctcgtcggtggagatgtgatggaaacgcttgttgtgcttccgcgcggcctcgatcagcgtgtaggtgccgatgatgttggtatccaggaacgggcggggatcgtgcagcgagttgtcgttgtgcgactccgccgcgtaatggaccacaacgtctgcctgcgccaccagtccgtccaccaggccggcgtcagcgatgtcgccctgcacgaacatgaaccgctcctctggcagcccccgcagcgactccaggttccccgcatacgtcaacttgtccaataccgtgacatggtcgtcggtattttccagaacatagtggacgaaattggaaccaatgaagccggcaccgccggtgacaaggagattctgcattgtgccagcttaccggttgctgagtgggcggttggcgggatcccgtcacgcggtccagggttggattacccttttagccgccgctttgcctccaggatcagccgcgcgagcatgattcgtgctgcaacgattcggccaagcgatcggaatccggctggggtttcattgctctcgtgcagccgcctcaacaaggtgggtctctccaagtgcgctatggaccctgcgagattgccgcagatagcaagccacaggtcgtgcgactcgcgcacatacgggggaatgggagtgaagacgggcaccatgtcccgccggaacgccatcccgcatccgtagtaagcccggtagccgaccatgacaccaagcagattcgcaaccggtttcctgtcccatgccgaacgcagctgcgggatccagggccgtggaccgccaccgagcatttcaaaattcgaggccacgacacgggctgacttcagggcttcgaccatggctgcgacccttcccgggatccagacatcgtcctggtccgaaaggaagatgtactcgccccggcttgcagcgaccgccgcctcgaaggaccggacgtacccccggttttgcgggctctcgatcagacggatccgcggatctgggatggagcggatcacgtcaatggtgttgtccggcgacgcatcgtcgacaatgacaacttcgtcgttcccgccaagctcctccagtatggattggagttgctccgcgatgtataaagctccgcgatagctcgccatgcagacgctgactcgggtgctattcggtatcggggcctggccactcgtcatgcaactgaccctaacggatttggggattgattcattactggagggattgcgcccgcaccttccaggcgctcggcagcaaggctgctgccgtagaccgagtcgccccgaccgccaggctcgcgctaggatgcgagacgctgggacgctggatccgcttagatgacagcccaagatgcccgcactgtccgcgcggggcccggcacgggccccaatcgctgcgttgatatagttgggataatatgcgcaatttggaaaacaaccgtgtgctggtcatcatgccggcgtggaacgaggctgattgcgtaggggcaactgtggccgaagtgctgaccctcgatgaaccctacgatgtgctggtggtgaatgacgggtccacagacgaaacccctcgtatagcggcatctgcgggcgcgacagtcctgaacctccctttcaaccttggggttggcggcgccatgcgggctggcttcaagtacgcccagcgacttggatacagtcaggttattcaggttgacgctgacgggcagcacgaccccagaaatatccgagaagtactcaacggtctggaatcagcggatatctcgattggtgcccgtttcgccgaccgcggggattacacagtgaagggtccacgaaaatgggccatgaggcttttggcctcagtcctctccaagctggctaaaaccacgcttacggatgtgacttcgggcttccgcgcaggcaacagcagggccattgtccagtatcttgaccactacccggcggaataccttggcgacacgatcgactccttggtggtagccgtacgttcgggactcagtgtcacgcaagtcccggtagaaatgcgcccacggcaaggcggaactcccagtcaccatccaatcaaggcggcggtttacctgggccgctcgttctttgcgctagcgtttgcgctgacacgcaggcggtcccacgtggcattgccacttcagacaatggcaggacagaaatgatgccgaacatcgccgcttttcttctggctctggcaattgtcgggctggtagccgagatgctccgccggaagaaactgcgcgaaaagtacgcgatatggtggcttgtcgttggaatcgccactctggttctggcggcgttcccccagcttctggtcttcatagcacgggtcgttggcgtccagctgccttccaacctcttgtttatcctcagcatcctcatgcttctcggtgtctgcctgcacctttcgtgggaaatatccgtggtggaagaggaaacccgtgccttggcggaggaggtggcaatactccgcatccaggtggagcggcttaccggcctattgccggtcagcgggagtaacggcagtcaagatccggaaggtcagtagtagtgactgagacctacttggatatttttgttccatattggggcgaccctgactacatgaagctgacggtcgacagcgtcttggcgcaaactgacccgcgttggttcctgaccattgtggacgacgcctacccggatccaaccattgaggaatatgtggttggaatttcggaccctcggatcacgtaccttaagaaacttaaaaacgaaggcatcactgaaagtttcaggacgtccattcagatggcgcggcaagaactggttgcggtggttggttgcgatgatgtcctactgccgaactatgtgaaaaccgtactggaggcacacgacgcctatccggaggccgacattatccagccgggcgtgcgcgtcatcgatgccgcaggccaacgcgttaagacccttgtggacactgtcaagcaacgggttctcaagccccggtctacgtcaccgctcctgctttcgggcgagaagctggccagcagtctcatgcacggcgactggctgtattggccctcgctcaccttcaagaccgcctcggtgcgaacagttgatttccgtgacgaatttcccattattcaagaccttgccctcattgtggacatgatcctgcaaggaaggtctctgctactggtgccgtcggaaagcttcgcataccgccgacatacggaaagcgcatcctcgcggctcattgtggatgggtctcgctttaccggcgaaagagactatttctctttggccgcgcggcttgcccgtgcccaggggtggcgtcgggcggagttggctgcgcggctgcgtctcacttccagactgcacgccttgtcgctgatacctgccctgctgaggtcccgcgacagcggcgcctttcgcatcatggtccgacacgggctgggaacatgatgggtagggctataagtcgggtgacggctgccgtcatgagcacctttaatcctcaggacaacctcattcaaaactgtcgcgcgctccttgaacagtgctccgaggtggtggtggtagatgatggaagtacctccccagacgaagctgtctacgatcagctggccgcgctcggttgtgtcgttctgcgtctcgagagcaacatgggcatcgccgcggcactcaacaagggcgttgaattggcccggtcgcgcaatgccgctcttgaatacgtactaacaatggatcaggattctctcgtaccgcccggcttcgttcatgctcttgaagacgctgctgccgctgctgccgccgttggactttccgttggaatggtttcgcccggcaaagtcagcggattgccaagccggccgctaagaacacatagcggtgtggtcatcggtgatgagccagtccaatcaggactactgataccagttgcatccctggacaaagtgggccaatttaacgaaaagctattcatagatggcgtcgacagtgagttctacctgcgggcaaaggccagcaagctgttgtgcatcattgcccctggagccgaactgctgcattccctgggagccatggttccggctagcatcggcaggtggcagctgaagcggggccgcaaaccgctgctggtgagaacagcagcgtcttggcgctactacttcatcgtccgtaaccgcgtcttgctggccaggaggtttgcgcttcaggaaccctactggaccatgagagggctggtgctggacttacgccaccttttactggtgagccttctggcgccgggtaggcatgaacggctctcatgggcccggcttggtcttcgcgacggccttctggggcgcagcggcccaaggccaaaaccttaggcctcatgcaacagccgttttggcactggatgcagagtggtgaatgattgaagccatgcgtggaattattctggccggcggaaccggatcgcggctgcacccgatcacccttggcatcagcaagcaactcgttccggtgtatgacaagccaatgatttactacccgctgtccacactcatcctcgcggggatcagggatattctcatcattaccactccccatgatgcagaccagtttcagcgtctcctgggcgacggatcgcagttcggcatcaatctgacctacgtgcagcagccctcgcccgacgggcttgcccaggctttcattttgggtgcgaaccacatcggcgacgaaactgtcgccctcgtcctaggggacaatatcttctacggccaagggatgggcacgcagctccgccggcatgcgaacattgacggcggcgccgtgtttggctactgggtaaaagatcccaaggcctatggagtcgttgaatttgacgacgacggcagagccctctcgctcgaagagaagccggaaaagcccaagagccattacgcggtgcccgggctgtacttctacgacaacaacgttgtggacatagccaaaagtctccagccttccccgcgcggggagctcgaaattacggacatcaacaggatctatcttgaacggggcaagcttcaggtcgagatcctcccacgcggaaccgcgtggttggacaccggaacgttcaacgacctcagcgacgcgtcaaacttcatacgcactgttgagaaccgtcaaggtctcaagatcggggctccagaagagatcgcttggcgccagggcttcttaacagatgatgatctgcggaaacgcgcggagccacttgttaagagcggctatggaagctaccttttgggccttctggaggactaggaacctgcgctgcccgccaggacgcgccagtcgcttacctgccatccttccgtggagtccttatgagttggttttctgttctacccacagctgttgtgtgcctagctctagtgttcctgcccggaacgctggtcatcttgtcgctgggcctccgaaaccccgctttcctggcgattgcaccgctgctaacagtcggcgtggcggcggtcgttgctatgctcgcaccttatttaggggtgggctggtcactgttccccgtgatgatagggacaattgcccttgcgtccgccctctttattgcccggaagattccagctctgcgtcagcctgttagagcttgggcgtcggctctaggccccaacaagcagatggttttgctagccggcaccggtctcttgatcggcggcggatccatcgctttacagctccgcgccgcctttggccgacctgagaacatttcgcagactttcgataacgtattccacctcaatgccatccggtacgtgctggaaaccgggaacgcctcatccctcactctcacaggcatgaccaatggggataatcccccgtacttctacccggccgcgtggcacggcttggtctcactccttatccagctgactggcgcgtctgtgcccgtcgccgtaaatgtcttcaacctctgcattgctgccagcgtatggaccattgggtccatgttcctcgttcggtcgttggtcggctcaaacccctttgctgtcggtgcagcaggtgtcgtggcggccggctttggttccttcccaatcctcctgcttgattttggtgttctctaccccaactttttgtccgtcagtatgcttccagcagctctggcatgcgtaggcttgttctttggaatcggtcaaatccacgacgttggtcctgttgcccgatacagcctggctcctatcgcagcgaccgccgtggcaatcgcccaccccaacggcgtgatgtcactgttggcgctttcgataccagttcttatcgcatcctgggcacgccttgctctgtcccgtcgtcgggcgggcgtggggccgggactatcagtagtcgctggagttggcgttgtagccatgctcgctgttatcgcagtcttgtggaagttcatcaggccacctgctgcggccgcgacgtggctccccgtgcagactcagggccaggctgtgggcgaagtcttaactaactccgcgatgcagcgacctgttgcatggaccgtaagtattttggtggtcctgggactggttttggttctgaagcgttcctccactatatggatttccgggtcatttctgattaccgcgggattattcgtcgtcgtttcggcggggcaagccggccactttcgggatcagctgaccggggtttggtacaacgacagctaccgtcttgcggccctgttgccggtggcaggggtagcacttgccgctgttggtgctgcctgggtcattcagactcttgctgcgaggatggaagcaagagtggagaacccgaaggcggcgccagagaagctagcccgcccaagtgttgcctttggagtagtgcctatcgcactcctcgccgttgtcgccctgctccaggctccccctatggtgacccccgtacggtccgcgcaggccaactactcaacaactcctgactctcctctggtgagctcagatgaaatgaccctcatcgcggagctggacaagtacgtaccggccgatgcaacagttgcagttaatccctggaccggaggtgcgatggccttcgcgatagcggaccgcaataccacctccaagcacaccctcaccacgtacacaaaggctacggaagtcctgaacgacaagttccgcgaggcgaacacggaccctgcagtctgcctcgcggcccgagctgataacgtccgctatgtactggatttcgggacccgcgaggtccatggcggaaaccacggtttccaagggctgcagattcccgatgcaacaccggggttcgagcttctcgcccggcatggcgaggcgaggttgtttgaagttaccgcctgcgactgacgccgaaactttgcggtgcaacagactgccgggacagtacagcaagccggactgtcccggcaggttgatgacatgggccctggtcagcgtggacccccgagccatcacggcccaaaatcgagcttctctatcaatcccatccttcttcgacaacaagcacaacacctcacaccatgaccgcttgagctcaccttcgtccttggggacaccatggtgcggtattgagcgcgtggccagcgggctgaggtcgatggccctctccggcagatccgttaccccgatcggtcggatttttcgtgactgatctgcttcaacacgtcgacaagctcgtcgcgcacgaacgcgcgttcaatctgcgggtggtcggcgggagctgcagctagctcttttggttcgcagaggccgacgtcgaccatttatcttcggcgaggccgttgacgaacttgaactcgttcttgtgggggtccggtggcaatcgccatcgtccgccctcaacgcgaggggagacgcttcgttcggtggcgataactgtcaacattcgtgctttaggatctaccagggacaagggtaggaaagggacaacgcatgcacaatacacagcgtcaaatcgagagcgggttgcgcagggatgaggtcgatctgcgtgggcggcgtgtttcacgattcctcaaccgctcgttgctcacgaggcttcccacgctcgcgggtctgcttctatgcgcattggttctcggagcgctgctaatcaacctcgtccagccgcattacggcgtgtcccgatataacactggatggactctagctgcagccgtcgcagtgttggcgctgatgatcggactgtactggctactactgaaggccgcaccgatggccgcccgccaccgcaagtggatgtttgtgccttggatagttctgtggtcgttgctgttcaccgtgcagatgcgggtggcctatgccgttcggcttccagcggactgggatgcatacgcgatctacggaaccgcctccagccttgcactcggagctaccgaatcagtcggtgattacttccagatcaatccgaacaatctactcctaacgcttcttgtcgcggcgtattacgagttggtcctgtccctgggattctcggatctgccgatggcaagcgccttcctgaacgcgcttgttctcttcgcagggacggtactgacctactgtgcggcgcgaatgctgggcggacgaaagatcgctgccttcacgctgctccctgcatcgattttcctggtggtatccccttgggctggtgtcctctattcagacacggtgggcgttttgttcaccgcctcgatcctttgcctacttctcgctgcccgtcgctcgcccaagaatgctgtccgcatcccgctctggatcgcgaccggagcggtcgcggcggtggggtatggaatcaaacccacggtcctgatctgcctgatcgcagcaggaatcaccgccatctgcctgcttcctcgcaggaggaatcccgcagtcctcgtcgtagccctgattgtcgtgggagggagcttcgccctgagcaaccatctgatcacaaaagcccagcagcgaagttcggccgtgaacttcgatttcgaaacgaatccgaacgggatgaacccagggcacttcctcaaggtaggttctcgttccactgagggcccgcacgggcccttctacggagcgtacaacgaggaagactacgcaagcacagtagctatcgtgggtgaggaagagaagctgcgggcaggcctgaacgaatacaccgaacgggtatctgagatgggcccattgggctatctttctttcctcacccacaagctcgcctgggtaaccggagatggctccttcttctcatggggagaaggccgcatgaacggtgacaccttcctctcccaagacccgaaggaccgcgccattcaggatctattcgggaacacccggccgcacttccagtggttgctttcaatatggcaaggcacgtggttcgtagttctggccctcgtcgcagttccgctggcgttgcgcgtgccccgcctgctgcgtcccgaggtgaccgccatgcgcattgctctgctcgggctgattttgttcctcctatttttcgaagctcgggcccggttcctgtatctctatgcgccctatttcatcgtcctggcctccctgtctatgcagtccattttcgagtggagatggtggcgctcattgcgcatcgacaggttatgggaccggccctcctatgaagttgcgcgcaaagcctgatactgagccctgaccctcccaaggatggcggctttttgttgttcccgccgctaccgaaggaagatgaggggcacgtctgctggcgccgacctcttggatgccatggtgcaggctctacggcggccatcaacggccgtggggcgggcaggagtgaggcgtgcaagaatatgaggcggctctcatacggagggcgtgacgacggggcatctgtacggtcttacgatgagaaaaatatacaaaacgaaaacacgacaacacgccacagaatcagaaagcttgctgccggaggccggcccaaggaccccggccaagtgcgggcctataccttcctgcatcccgcagtggatgaccattcccggttcgtgcacttcgagatcctgccggacgaggcaaaagagaccgcgtctgcgttcgtgggcaacgccaccgccgcgttcaccgcacagggcgtcagaatcgcgggtgctgaccgatggcggcttctgctgccgctccggcgccgctgtcttggccgaatccgggatcaagcgtaaacgcagtaggccctagaccccaaaccaacggcaaaatcgagcgcttcaaccgcgtccttcaagaggaatgagcctatgcgagggcccacagctcagaagtcgaacggcaagcctgttacccgatcggacttcatcgagtactaaaacgagcgcaggccccacaccgcgctcaaagccgcggggcaatcattgcataatatgctctcacttgtgggcgccctggctccgccaggacgtacctgagcaagctaaggccccagggctatagcgcgttctgagccatagattagggttctttgctcctgcggctggatcaggaccgcagaatagcaactgcttcatgaatggaaccatcaaacttgacgttgccgtgctccaacagaattccacgctcacaaagctgcgagacgaggtcaagatcatggcttaccacgaccagggtcttgccatcgcgtgccagttgttggattttatcgatgcatttgcgctgaaagggttcgtctcccaccgcaagaatctcatcgatgaggaacacttcggggtcggtgtggacggctaccgagaacgccagacgaaggtacatacccgaggagtagaacttgacctcggtatcgatgaactgaccaatttccgagaactcgacaatgtcatcgaaccggtccttgacctgctgttcagtcattcccagaatggccccgttcaggaagacattgtcccgaccggaaaggtccgggtggaagccggccccgacctcaatgaggccggctactctccccctcgtcttaaccgatcccgtatccggcagcatgacacccgagatgtgtttcagcaacgtagacttcccggatccatttagccccaggagtgccacagtttcaccggtcttgatctcgaccgtcacgttcttcagagcatggaacttctccgaaaggtcgcccttgcggcctttcaccagccataccactgcttccttgatggagcgggtatggcgcagcacgaattgcttgctgatatccgagacttctattgcgttgaccacttacagctcctgcgcgaaacggccctcaaggcgccgaaaggtgaattggcccaacgtgactactgccagggcgaccgcgaggccaaatggcagccacaggctaaagagatcagggggcatcgcagccgagccgtccgtggtggggaaccagaaggcgtaatggaacagttcgaccccgatggtgatcggattggcttgatagatggcgaaccatcctgggcccaacttctcgtgcaccatggtccaggcatacataacgggcgacgcccaggtagccaccatcaacaacatgtccacaaggttttccgagtcgcgaaagtagacgttggcggctccgaagagcagccccaagcccgtagcaagcagccctacgatgaggaatccggcaacagcggcaagcaactgaacgaagttaggttgccagccggcgatgacgcagccggctacaagcaccaccaactgcgggaaaaagtggactgctgatacccagaccgaagccacaggaaagagttcccgcggcaggtagatcttcttgatcaggttcccgttgttgacgatcgaccgtgctgcatttcccagagcttcagagaagaaattgatcaagactatgccggagaacaggtaaacggcgtagttggccagcccgtcgggatttcttgggctacgctccaaccctagaaaaacgcccagggccacatagaaaacgacgaattgcactccaggctttacgtacgaccacaacagtccgagaaccgaaccgcggtagcggaccttgagttccttacgcaccaacagcttgagaaggaagctcgactgccgtatgtcgcgcagaccgctccccaacccaggcgtggtcagttcgcttggagaaattgcgctcacttgatctcgttctgggtgtgctgctcgaacgtcttcctccaggactcaatggaggtgaggtcgtgcagggcagccttgtacttcttgctgagcgcgggccactccttgaggagggcagcgtgaacccgggcgctttccgccaacattttccggagctgctttggatcgcgccggtaccaggacgcacctgttccttcagcgttcgagacgacggcactgtcgtactgtgccatgcgccaccagcggttgtcctgatgggcaaccgtggtttggggccgttcggcagtgctgcctttgacagggcttgccaactgccggacaacggtcttcgctgcccatggcaacagggtgatctttgacggctgcgaaggtccatgaccgcggcggggcggcttgtccatcttcggcgagggaaagtcctccggatccggacggaaaacagagtccgagtgtcccgacatcatctcgcggatcttgggcagtttcgtgtcaagcaagtccggcagagccgacgggcccttaaggacgtcttccagcgcccattgacgtccctctgctgttgcgtactgcatcgaaaccagatgcttcacgtcggcgtactgggattccttgatcacacggccaccgaattcgtaggggctgtgcaggagagccgccaccacccgattccgggcgtggaagtacgcctgccagccgacaaggtcgtccttgtcaatccaggaaacatgccagacggcggagccgggaagcgaaacagtcggataaccgtgggccttggcgcgcaggccgtattcagagtcgtcccatttgatgaacagcggcagcgaaagtccgatctcccggatcacctgggtggggatcaggcacatccaccagccgttgtaatcaacatcgcagcggcggtgcagccaagacgtttgacgcaaattcgaggacatgaagtcgtgaccgagaatcatgtcctcgctgggcagggacggctggaacctatacgggttcacgatctcaccgaaggtgtgcagcacagttcggttgtacaggtcaaacatgtggccgcccacgagcgtgggcgtcttgcagcgatcggcaaaggtcaggagtcgaatgatgctttcaggttcgacgacgacgtcatcgtccatgagcaacacgtagtcgctgccgttttccaccgcttcaaacatgccacgggcgaacccgccggacccgccgaggttggtctggttgataatgcgcagttttccgttcagcgactttttaacgtcgtcgaagccttctgcctctgcaagcttctgggtgccttggtcaacgatgagaatctcttgaacatgctcgagcgcttcctcgctctcggcaagcaggcggagattgttgagacaaaaatcagtcttgttaagagtggtgatctggagcgtgacagatcccggcttgctctccgcagccggcccttgccactcggcgtccagcataacgagcggctccgtgccggcgagaaggtcaaaccaataccagccgccgtcaccgaagggcgcaagggaaagctcgaagtggttgtctgcaatcccctcgacacggcgcgtgtccacccgctgcagagagccccgggcattggacttgtacacgataactgaacccgtgccttgagtccggacctggagacgaatcttgtccacggtcgtccagcgccgccagtagctggcaggaaatgcattgaagtagctgccaaatgatacccgctcgcctgcacggacggacgtcgaatgccgggaaaggaagtcctcgacgtgggcttccttcgtcgggctgctaacagtccgggcactcgcaggcttcccgtcgcgatcacccacggtgggcaattgaataccggtagcagtccccatatccatgtagagggggacggtgtccatctggcttgcactcggtagaatcacccgctgcagcgtgtcccatcgttcagaggcatccttgtccgcagcagccgtagagttcttcgggctttcggttgagacactcatgcgtccacgcctccactttccagctttacgccgctttcaaaatgcggccggattttgttgtcgaacatgctcagtgccgcgccaatggccatgtgcatgtccaggtacttgtaggtgccaagccggccgccaaacaggacatttctctctgcggcggcgaggtcgcggtacttgagtaagcgctccctgtcggcggaggtgttgaccgggtagtacggctcatcgcccttctcggcaaagcgtgagaattcacgcatgatgacggtcttttccgtctggtagccgcgctccgggtggaagtggcggggctcgataacccgggtgtaggggacgtcgtcgtcgttgtaattcacaactgacgtgccctggaagtcctcgatgtcgaggacttcctcctcgaagtcaatggtgcgccacgagaggtcgccctcggcgtagtcgaagtaacggtcaaccgccccggtgtacacgacggggacattgccgacaaccttgttcttgctgtactcgtgcgactcgtcaaagaaatcggtattcagccgtacctcgatattcgggtgttctgccatcttttcgatccaggccgtgtagccgttcgtgggcaggccctcgtatttgtcgttgaagtaccggttgtcgtagttgtaacgcacagggagccgggagatgatgccggcgggcaggtctttgggatccgtctgccactgcttgccggtgtagtgcttgatgaaagcttcatacagcgggcggccgatcagctggatacccttgtcattcaggttctgcgggtcggtaccggcgagctcgccggcttgttcctgaatgagctccctcgcctggccgggggtgaggttggcgcggaagaactggttgatggtggccaggttgatcggcagggagtagacctcgcccttatgtacgccgtacaccttgtggacgtagttcgtgaaggtggtgaaccggttgacgtattcccacacgcgctcgttggacgtgtggaacaagtgtgcaccgtaccggtgtacctcgatgccggtctgctcttccttctcgctgtatgcattgccgccgatgtggtggcggcggtcgatgacgacgaccttcaagccgagctcagtagcggcctgttctgcgattgtcaggccaaaaaagccggaccctacaatgacgaggtcagcggtcacaaaatctcctggtttgaatgcgggcagcgcaatggtgcgcattgtctgctgctctagcctacccgagggactgtggcgcccgtcgaattgggctgcctgtcaccctcggctcgctcggcagtggcggggtccatgctgcgcaccgaggcggtccacagcatctctgccggcgcaccaaggaacttatccacataggacagacggagtgacgcgtattcggcgcccctggctagcgtgagtgtaacggcacaaaggatctgcacccatgacgcttcactgcaccctggtccgaggcccgcagtcgtcgcagcccggaccgcccttggaactcactgtcacggcccctcccggcacgtccggtgagcggatccacgctgagcttgtaaggacgttcggcacgggagctgtctttgttggcggagaggacctgtgttccctgagcctcggaacggcgcccttggtcccgggcgccgtgctggtggacggaggaagccggtccgctggccggagatcccggagtcggcccgcctccgatagcgctgcccccatcgccttggctgttcacagcggcgccggagccggcaccctgatccccctgcagcgcggaacgtacaccatcggcagaagcaatacgcgcatcgtcatcccggaccctgagctttcccgggaacatgcccgcctggtagtgaccgaaaagaacatcacgatcgtcgatctggacagtgccaatggcacatacatcgacggcgaacgggtccgccatgcactgatctccacggcttcctccatccgctgcggcagttcgatgatgtccctggtctttctggaagccccggacaaagcacttgccgacgccggcacttcagtccaggatcccctcaccgttagaggctgtccggagtccggcaaccgcgggatccttttgcttaccgcagtgctccccctggccatcggcgtcggactagccgtcctcacgggcatgtggatgttcctggctttcgcggcagtttcggcagtatctgtgcttatcccgctgacctccgggcgccgccagcggcgcgaattcacaaaaaggatcagcgccgcggtcgaggaggaccggaaacggcggaagcgcgccggtccgtccctggcactgctggtgcttgctacggcccacgctcaggttccgccttcggcagcacgcggggcgggcggggtgtggctgcggcttggacaggctccccaagctgccaacctgaagattgaatcagggaacgctcaacaagccattccgtctgtcggggaagtccccgtgatgttgaacccggcgcatagccccaccaccttgcggggaccccgcaccgtgctggagggaatgctgcgatcactggtcatgcagctggccgggtatccgggaggctgcaaaacacgcatagtgatctgcgggcgtccagacagccttcccctgcctgcccgtttcctccatggtgtgaccttcgccgtgtcccagcaggcgtgcctgcgcgcgattaccgacggcttcactcgtgactctgaccatggcgtcctcctgctcacggccgccgtgggcaaggatgagggaaggctgcgcgaaacggcagctcagcagaactggcaagtgcttgagttttctccggctgacagcccgcccggtgtctccgacgtaaaactgaccgaacggcaatcgtgcctgcaggaaccgggcagggaggttacgttcgtcccggatctggcacctgatggcgtgttcagcagctactgcagaaagctggcggcctccccgggacggcttaaccgcgcggagaactcagttccctccgcctgcacccttgacgaactgctgccgccttcccccgcccacactgctgctcgctggaactcgactgccggcgcagaggctctggcagtccccctggggatgcaggcaacgggccccctggtcctggaccttcacaccgatggtccgcacctgctggttgcagggacaacgggctcaggcaaatcggagctgctccgcactctggtgctggcactggcactcacgcatccgccggaccgtgtcaacttcctctttgtcgacttcaaaggcggtgcaggtcttggccccctggccggactggtccactgcgtcggcgtcctgaccgatttgtcggtccatgagctcgaacggacgctcacctcgctcaaggctgaaatcaggctccgtgagcaggccctcgctacggcacaggttccggaccttgccgcctaccggctgacgccaacctcccgggacaatccacttccccacctggtcatcgtcatcgacgagttccgtatgctcgtggacgacgcccccgaagcgctccgcgaactgatgcgcatcgcctccatcggccgctcccttggcctgcacctggtcatggccacccagcggccccagggcgcactgaccgccgatatccgggcaaacgtcacctccagcatcgcgctccgcgtccaatccgatctggagtcccacgacatcctcaacacaaaggccgctgccggaataagcctgagcacgcccggccgtgccttcattgccaggggtacggagccgcccctggagtttcaatctgcatccaccgggatacctgccccggacacgggcgaggacgaggtcaaggtgcagctcaccactgattacctctcggccagcgaccaaaacagccctggaggaacagatgctgcggcccgtaccccggcacaggcagcagcccctctcgttgcaatggttcgggatctttgggccgcacaggcaggatcagcaccccggcttccagccgcccctccgctgccgctcaagcccgcacagcccgaatcaggtctggccgtggcgccttcggaatacgacgggataatagggccggctgttgctttgggcctgctcgatctaccccatcagcaggacatcagatcgctggtctggaacccatcaaaagacggccatcttgctttgataggaagtcaggcatccggagcatccgaagccctcgagctggcagtccacggcgttgcagacaacgcggacgaaacacactgctacttcctggacgccgctgcggtcttcaatgggctggcagtgcacctgcggaccggagcccacaccgggctgcatgagctgcggcgcggcgcccgcgtcctcgaacggctgagccgggaaatgaccgcccggctgagccggactgaccacgggggcgtgccgctgcttctcgccatctccgggtggggttcctgggtatcggcttttcgggccggcccgttggcctgggccgaggaactggtgcaggatcttgtccgggacggcgccagggcgggtataaccgtcatcatttccggggaccgggaactcgtcaccgccaggttctgcgggtccctgcccaaccgcatctatttccccaccggttccaacgaggacagcaggatagcgtggccaaagatgccgtccacggccgcggtcaagggcagaggagtagcgtttggttccatcgcctgcggcaccgcgtccgtgtgccagctttacgagcccgctcctgacatttccggaccctccggcgccggtaggaacgggacccagcaatccgggaagcggcccttccggattgagccgctgcccgccctggtaacagccgcggaggtcacggcagcagcgcgccgaacggaggatccccgaccggaagcagacccgggagagcctgggctcaggaatgcagtggccttgacgcaggaggcggggaccgggacagtcgacgccaaggaagtcgggaccggtgtgccggtaggactacccacgcccgctgcgcctaaggttgccgcacagcgccgggatgcatgtccttccgtgccacgggacgtgcttttcggtgtaggcggcgacgagctggaccccgtctttgcgcacgtccctttagggggcacctttgccgtcctgggagggcctgggtccgggaaaacgaacttcctgcgggcagtgcaggcgctgaatcccggcgctgaccgctggattcaccctggcagggtgagagaccccggcgaattctgggaaggagcccttgagcaggcgagggcaggaacactttcaagggcagcagtgctgttggtggacgacatcgacctcttggctaccggaccactgagaggcatctctgacttgcacgcgttgggccatacagtactcttcacggccaactacagtcctttgctgatccagcgcgttcccctggccatggacgcgcgcgccgacgggaatggactcctgctgtccccgcaatcaacgtcggagggcgacctttatggagtccgcttcgagatagaacccaatccgcccgcaggcagggctgtactgattgcccgcgggaagtcctcggcggtgcaggtggcgtgggcaggtacgtagtgaccctagggtgcagccggtcacagcgccggggtggcgcctcctgtacgggaggcgtagctgatcactttgttgtgaaacaggagcacgatcgcggtgaccgcaggaagcagcattgcaaggccggcgagcacgagcccaccgccaagggcggggaaccctatggtcaaaacgaacagctgcgccacgagggcagcggcacgggtccagcggtagccccggtaaagatagacggcgaccgcgtacagccacgccgaaaaggccaacagtaaccccagggtgaaaaccgcgccccaaaaggacaagaccgggctcccgacggccaactggtacccgtaccagcaagcagcgagcagaagagccgtggcttccgcagcaaccaccagagtcacgacgatcaccgccggcggccggagaccctggtcacccccatcagcaggttgcggcccctgaccgggttcttcggaggaggactgggggttcgtggggtttatcgggggtcttgacacactggcaccataccggacatagtcggacagtggttggggccatcagcgccagtgtgatgtatcgctcagcgttccgcggatatcaagcgttattacctcttgtttacacgtcgttaacatgacaggcttgattcagatgaccaagggggccctgccgggcccttttcctttgtagctactagtgaataatttcacaagggctcttcccagaaatggagcaactgatcagcatggattggcgtaaccgcgcagcgtgcctcgaaaaggaccctgaactcttcttccccgttgggaacaccgggcccgcccttctgcagatcgaagaagcaaaaagcgtctgccgccgctgccccgttgtggatacttgcctgcagtgggctttggagtctggccaggacgcaggcgtctggggcggcatgagcgaagatgagcgccgggcgctgaagcgccgcgctgcccgcgcccgccgcgcctcctaggcacacttcaacccacacaacaacagccccggccgcaacctcaatggttgccgccggggctgttgttgttccacataccaccgtggtggccgggctgaccaactgctcctgcgccggaacctacttgcctgccaggctgatccggatctccactgcggtgccgccaccttcccgggggcgccaccggatagtcccgcccagctcgcttgtcaccagggtccgtacgatctgaagcccaagtccctcaacgtggggcgtatccggaagccccacgccgtcgtcggcaatggtgacggtgagttcctcaccgtcgtccccctcggaccggtcggcgatcagccaaaccgtcccggccctgccctcaagcccatgctccaccgcgttggtcacgagctcgttgatgaccagggccagcggggtggcaagatcactcggcagctccccgaaggtgccggaccgttccgttctgacctgctgcgagggggatgcgacttcggccgacaggcggaactggcgcccgatcagctcgtcgaaatcaacgctctgggtgaggccctgggacagagtctcgtggacgagcgcgatggtagccacccggcgcatggcctgctccagcccctgctttgcttcgtcgctgaccatgcggcgggactgcatgcgcagcaaggccgcgacagtctgcagattgttcttgacccggtggtggatctcgcggatagtggcgtccttggtcaccagctccatttcacgccggcgaagctccgacacatcacggcaaaggaccagcgcaccgaaccgttgctgctcatcccgcagcggaatggcgcgcagggacaggctcacgccacgggattcaatctcactgcgccagggcattcgcccggtaaccaccagaggcaacgtctcgtccaccatccggcggtccttcagcaagctggcagtcacctcggccagtgagcggccttccaacgactccccgtcaccgagccgcctgaacgcagagacaccgttagggctcgcgtactgcacaattccctctgcatccagcctgatgagcccgtcccccacccgtggtgcaccgcggcgggaaccggtgggcgaagcgaagtccggccacagccccagcgtccccatccggaggaggtcgtatgcacactggcggtacgtcagttcaaggcgcgacggcatccgcgaactggaaaggtccatgtgggtggtgaccacagccagcgtgcgcccgttgcggaccatgggaacggcctccacgcggagggccatatcactgctccagttggtttcgctggatcgctcgatggaacggctgttccaggccttgtccacaaggggctgcaggtccgagcggatgccctcccccacgaaatccccgtggaacacggtgtgcgtggtggagggccgcacgtgggcgagcgccacgtagccaagatcagggtggggaaaccacagcgccagatcggcgaacgcaaggtccgcaaccatctgccagtcccccaccaggaggtgcagccattcggcatcgcccggcccaaaatcagcatgttccctgatagggtccgtaaagattgccactgcacctccattttcgacgccggacttgctagcgtcggacgattgacctcaagagcctcaatgctaccgacagtgacgccatatcgtcggcctcgagcgaattcacctcgtcgaacatgctcttcgcccgggtgagctgctcggcattccgggcctcccagtccttcagccgcgcctccggcgagtcagcggcagcagtggcttccagcaccgccgtcgtcatatccgagatggtggaatacaggtcatcccgcaaggccgccctggccagcgcctgccacctgtcctgccggggcaggctgctgatccgctccaacagtgaatctgcatggaaccggttgaagactgtgtaataaacggcggcaatctcctcgacggggtccttgcgcacgtgggcaatcttggcgatgtccagcagcacgaagctttcgaaaagctctgcccagcgcaatgccagaccttccggcagctcccactcgcgtgcgttctccagccagctggccacccggtcccggtcatcaccgcgcaggtattccaggaggcgcccccgcattggctccatcacgggtttgaactcggagaccacatccgcgatgggccgcgacattgttccctgtcccaggagccagcggacggcccggtccagcagccgcctgatgtccaggtggacggtactccagtgctccgtggggaaggacgccgggaggctgttcagttcccccaccatggtgtcaagatcgtagacctccctcaacgcaacaaacgccttggccacggcgacctcgctggcggacgtttcctccatcacccggaaggcgaacgtaatgccgccgaggttgatgatgtcattggcaaccaccgtggcgatgatttcgcggcggagcgggtgggtatccagttcggcgtcaaagcgctcgcgcagctgtgccgggaaataggcgcgcaacgtctgcctgaaccaggggtcatcggccaggtcgctttcccgcaacgccgttgccagctcgatctttgcgtaagcggccagcaccgaaagttccggtgacgtcagtccctgcccctgctgcagcctctcgtgcagggcttccgtggtgggaagcgcctcaagatccctcttcaggtctgctgtcttctccagccagtccatcagccgctcgtagctggggctccactcggcaaccctggtccggtcattcagcagcaggatgttctggtcgatgttgtcttcgagcaccagctggcccacttcgtcagtcatcgacgccaggaaacctgcacgttcttcgggcgacagctttccggccgccaccatccggtccacgaaaatcttgatgttcacttcatggtcggagcaatcaacgccggcggagttgtcgatggcgtcggtgttgaggatgacgccctgcagcgccgcttcaatgcgcccgcgctgcgtcatgccgaggtttccgccttctcccaccaccttgacgcgcaggtcccggccgtcgacgcggatcgagtcgttggccttgtccccgaccatcgcgttcgtttcggtgctcgccttgacgtacgtaccaatgccgccgttgtagagcaggtccgcaggggccaggaggatcgcgcggaggagttcaggcgggctgagttcggttgtttcagccggcaggcccagcgcggcacgaacctggggtgataccggaatggactttgcctgccgggcaaaaacgccgccgccctcactgatcagggacttgttgtagtcatcccacgaggacctcggcagctcgaacagccgctgccgttccacgaacgaggtctcctcgtcggggttgggatcgaggaagatgtgccggtggtcgaaggcggcgaggaggcggatgtggcgcgagagcagcatgccgttgccaaacacgtcgcccgacatgtcacccacgccgaccacggtgaacggctgggtctgcgtatcaaggtcgagctcgctgaagtggcgcttcaccgactcccaggcgccgcgggcggtgatgcccatggccttgtggtcgtagcccacggagccgcctgacgcgaacgcgtcccccagccagaatccgtactccgcagccagtccgttggcgatgtccgagaaggtcgcagtgcccttgtcggcagctaccacgaggtaggaatcggcgtcgtcatgcctgacaacgtccgacggcggcacaagcctttcgctgtcaccctcggtaatgaggttgtcggtgatgtccagcaggcccctgataaaggtcttgtagctttcgattccttccgccatccaggcggcacggtctgccgtcgggtccggcagctgcttggcaaagaacccgcccttggcccccgtgggcacgatgaccgcattctttactgtctgcgccttcaccagcccgaggatctctgtgcggaaatcctcgcggcggtcggaccagcgaagcccgccgcgggccaccttgccgaagcggaggtggacgccctcaacgcgcggcgagtagacccagatctcgaacatggggcgcgggaacggcaggccctcgatctgtgatggatcgagtttgaagctcaggtgcgtcctgttctggtagtaattcgtccggagcgtcgactcgatcaggttgacgaacgtgcgcaggaccctgtcggcgtcgagcgttgccaccttctcgatggacacgtccagatccttacggacggaggcctgggcttctgcccgctcgtcgtcgctaagggaggggtcgaagcgcgccgcgaagagcgcgttgagccccttggtcacccgcgggttggccagcagggtgtctgccatgaacccaaacgagttggtattccccatctggcgcatgtagcgcgcataggcccgcagcacggttacctgccgccagtgcaggccctccctcaggaccagccggtcgaagctgtccgattcggctgcgccggtgactgccgcgccgaaggaatcggccagcagttgcccggttgagagcggattcaccttggccgggtacttcaggccgaggtcgtacaggaagaaatcgcggctgtccgcggtctcaatttcaaagggccgctcatccaggacttccaggccaaggttgtggaagtacgggaggatctggctgaggctcttgggttcaagcatgtagagcttgacgcgtgcgtcttcctccagcgttgcgcccgccccttccgggaggtagacgtggacgccgggccgctcctgaacagcaccttcggaccgttccgcggcggcgccgtacttttcaaagcgcgcaatgtcttcgagggcgtcctccacttcgtagtccacgcggtaactggccgggaatgcctcggaccagatggccgcaagctccttcgcctcgggaacgtcccggctctcacgcagcacctctgcgatgccttcgctccaggaacgggcggcacggacaaggcgcgtctcgagttccacggtatttacgccgctgaagtccgcattcttgggcagccggatgcggaagaacagccgcgccagcgccgactccgtcatccgggcttcgtagtcgatggaaacagcctggaacgtttcgcgtagttcctgctctatgcggagcctgacgttggtggtgtacctgtccctggggagatacaccacggcggacatgaacctgccatagatgtccggccggaggaagagcctggtgcggcggcgctcctgcagcttctgaatcccaagcgccgttgcggccaggtcctggatctcgatttggaacagctcatcccgggggtaggtttccaggatcccgagcaggtccttcccggagtgggagtctggcgggaagccggcgctctgaagcaccgcatcgaccttttcccgcacgatggggatgtcccggacggagccggtgtaggcactggtggcaaagagtccaatgaagcggcgctctccattgacgttgccctcggcgtcaaagctcttgaccccgacatagtccaggtacgccgagcggtggacggttgacctggagttggccttggtgatgaccagggcacgcttttcccgggcctttttccggcctgtatccgtcaggtgctggatgtgcggcgagtcctcggagtcccgcagcagtcccaggccgctgttgtcacgcagttccaggacgtcttcgccgtcgacgttgaccaggtcatactcccggtagcctaggaacgtgaagttcccgtcgtcgagccagcgcagcaggtccttcgcttgccgcagctccgcaatctgcgcaggatttgcgatctggtccaggctttccgcgatctggatggccctctgacgcatcttcggccagtcctcgacggcagcgcgaacatccttgaggacacgttcgaggccctcgaggagggctgcctttgcttccgtggagactcggttaatttcgacggcgatccaggactccatgtgggaggcatccccgccctgggcaatcaggtgcgaaaggttgggcatggcagccgtgtcgccgctggatatcccgaggtgcgcggggaccctgtttaccttggtgagtccgccgctctcccggttacgtgtcgccacgaatagtgggtgaattaccagcttgatggcggcatgctgccggacaagctcggcattcacggaatcgaccaggaacggcatgtcatcggtaacaacgaagacgacgctgctgtcttcctcgtccatgatggcgattttcgcctgaccccgctgccggaccgaggcaacgtcccggtggtggttcgcccgtgccaccagcacgttccgcgggtaggcccgggcgtcctcttcggctaggtgctggtagtagtccccgatgaaactctcatcgccttcaatggaaaggggctgatcctccacgctggatccagacgacatcgacaaacgcctccatcacgaaatatttgctgcaccattgcagctcttatggcgagcctagtccttcacccgacgccttgctgtggaagaaaagacagaggattttcgtttttgctgggcaggtgcacaaacgagttcgcggatggcgtgtcggagcgccgaatccggggcagcttcaagcagcagtgagcctcccaggagagcggcgtctgccgcggcagcgtcgtggggcaggaaccctttcagttcggatgccgggccgtaccgttcccacgcgtccctcaactgccgttccggccccctgcccacggatgaagcacgcaccctgttcatgacaacaatgggcgaaacaccgggaacagcctcttccagttcggtgagaccgcgcaccagcctggggaccccgaccggatcggcggcgccgaccgcgtacaccgtatcggccagttccagggaccgcagcgttgccgcattccggcgcggcgccatcgtgtcgaagctgagttcctcatccgcttcaaggcaaaacccggcatccaccaccaccacttcagctatttcccgcgcgcggttgaggacgagcgcgagggctgaggcgcgaagttccgtccagcggtccgcgcgggtgatgcccgtgagcaccctgaaagtaccggactttgttgccaccggagctgcaatcttttcaagggcctccctgtccaacaggccctggtctgcgagccggcacgcctgcgccagcccggcggactcgtcgaggagccctagcacggctgcgatgctggcgccgtagctgtcagcgtcaacaaggaccactccttttccatccaccgccagctcgcctgccatgttcgcagccagggtggtccggccgggcgcgccagccggaccccacacggcaatgatcctccccggcccaggttcccccgggcctggaggcggctccaccgggaccggcttcagcgcatcgccgggatcagccggactactccttggggcagtgcgcagtcccgatcccgacagttgggacacggcctcggcaatccggtccgacaacgcagcggactccacgccggtcagcgccgaagctacccctatcgcccgcagcctggccgcttcatcggcgttgtccgtcaatgcaacaatggccaccccaacggctgagagccggtccaccagggaggacgtcaggccttcggaaccttccgctacgacggccgccctcgccagcccgctttggcatgcggcaagaagttcgggaagttccgtacacctccggaccacagtgaccggcccgtgcagccgttccagcccaccgaccaggtcttcccggctctggccaacggtgaccaccggtatgctcacttggcgccgccgcccgggttccagaccaccgagatcttcgccccgttggcttgggctcccagcagcgcaggcatgtggctgtcctccaccagcaccatcaggacggctttctttgacgatcccaatgccgtggagccggtcgttacctcggcgatctctgcaccggacaggagaagcttcggctcgctgaagccgttgcgggcgtccggctgggcaacccagacgtccaccctggctccggccactgcctgcgccgggagcgtttcatcgatggagagcgccaccggctttcggtcgagttcgtccaccgcgccaagactggcacggggaaccagctggttctttccgatacgctgaaccgccacgaccccctcagggagccccgactctgctgtgacgtactggctctcggtgtcccccaggcgcactttcgcacgcaccacattttcctgagttagccgctcccctacagcgataccgtcccgtgccgcgaaaacttcggttgtccggtccgcgctgccgacgaggaaaacgacacctgccacagaaaccaggaccaggaggatacccgccagcagccggggatccttccaggacggacgcttcagccgtgccgctgtggcagatacttcaggcaccatctagtcatctccccatgtaagccggccctgctcgccgtgtcaccctcattgttaccgccgggacgccggaacaaaagtcataactgcaaacaacgccaatctgtggataacggcagcacttgcggccattcgatggcaaaatggaggcatgcccaggttccttacgctcgcagatgttgccgagcagctccagatcaattctccggccgcgtacgcactggtccgcagcggagaactgaaagccattcaggttggcggcaggggtcagtggcgcgtagaagagaagatgctggagcaatacatcgaggagcgctacgcagaggcaagccggatgatccaggagtcgaagtccaagtccgtctgaagcccgcgtcgatcaatggccgtcccggtggacgaggcctttagagttcgccggaccgccgggacctgatggctgccagggacgcgaaggggatgaccgatacctggttgacctgaccactgcggcgcgattccccgggagcgtagacggcgaggtccaggtagtccttccccaccctgtcgatcactcccgtgagcctgacaggtccggaatccggcgccctcaatgtgactgacagttccgcgcggtccctggcaagagcgcgcagggcatgtgcaagtccaatacccctgcgcacctgtgacggctccgccaccgccatccggcctagtcctgcgtaccacataaccgacgcgtacggaataagaacctggtgctgatcctcgtccagtaccaaggcatccgcgcctgcatggctcagtgtgccccggacaacttccccacaatcgagatgcgccgcgagccggcagccaagcgctccccgcagccgatccgcgagttccgtagccaccatctcagccctggtgcgttcattgacttcagcgtcaagcgccaaccgctctgactcggcaaattggctttccatgtcgttgaaaagggaatcccagcgcattgcgacagcgtaggacccagcgggagaccggtcaacccaaagaaacttctctccagcgtatggacaaatctcgaccaccggccgcaaactgagtttatgagaaccaaactgcatcaaactgcatcaagcggggtaattgccgcccgggccgcgactcccggacaatccgctgacctcctgacagcactcggcgtgctgttcctgggacttcttctttgctttaccgggtcaggcatccttgggcagctcagggacgcctccgcccggcagcaggagatgggcctcgaggaactcctcggtgtgggggcagctgccgccggcgccggcattgtggtgtggtggatcctgtcgctggcatgtgctgccgtcacggccgtcctggagcgcaagggccgtccccgcgcggcggcagccacccgaagactttcacccgcgttcatgcagagactggtactgggcgcactgtccgtcaaccttctggcgggaccggcagcccatgccgcagtcaccggcccggggcctgagtgggctccgacgcaagaacaatcctcttcggctcctgccatccctgccaccgaaggagccacaggaggggaatcgggcgcacccggcgcagtcccgacgcagagccaaaccccgcgggccagcggcgagacgctgaccacagcaccggacaacgccactgcgccggagccgtctaccgcaccaaagcaggccgctgtaccggacccggctggagcgatagaagcaactcccccgtcatccttccaccccggctggcagcctgccacacctgttatagacccgggaatactcgcctctccggcccaccgtgcagctgaaggggaacacggtcagcaggacgagggtgtcaccgtccaggcaggaaacaccctgtgggacatagcggcccgacatttgggacccggcgtgtccgacctggacatcgcacttcagtggccccgctggtacgaggccaaccggggagtcatcggacagaatcccgatgtgttgctcccggggcaaattcttcagccaccgcaggctggacggaaatagcccagcccggacccgtcgccaaacaaagtaaggggaagacccatgactgcagcaacaccactacacgccgttcgggacaggactgctcccggagcagcagagccggaccaaccaccccacgcgcagtatgtaactgcgcccgtggtgcctttccgtgacggaggtccggcgcctttacgcccggtggaccccatggcggaagtccgcgcaatcacccgcagcacagtacaggcggcaatggaagtccttgccggtatcaggcccatccatcagctcgcacgacgtcttgacccccgctgccttgccgcactgcagcaccgcgccgcgttaatcaggcgggaaatcacccggaccggcaatccggcgctcgtccggctccaccgcaactccgcggtccgctcggtccgcatctgcgaggtgggcgacggcgtctacgaagccagcgcggtggttgtcgacgacgtgcgcgcacgagcagtcgccgtccggcttgaacggagcaaacaggtgtggagggtgactgaacttgtcatcggctgaaaaggcaccagtacggggcagagccgggaacactgttcccggctctgccctccctaatctttatccccaagccgcgactggcagctcagaacatcgtcagcggcgcttctttttcgcgggacgtttggccgcgtcctgtgcggcggccttggccgggttgcctgacctgcccgatgagcgcgtctccacccgggtctgcgtttcaccgctttcgctgggggcggtgtactgcagctgggccggcttctccggcgcctcgagcccggcagcgtgaacctgcggctgcacatgctcggtgtgttcgccggcgtcgtccgcaactacaacgtcctgggctggtgtgacctcaacctcgagattgaaaaggaatccgacgctttcttcccggatggcttccatcatgccctggaagaggatgaagccttcacgctggtattccaccagcggatcacgctgggccatggcgcgcaggccgattccttccttgagatagtccatctcatacaagtgttcctgccacttccggccaatgacggagaggaccacgcggcgctcaagttcacgcatgctttcggagccaagggccccctcccgtgcctggtagaccagccgggcgtcggagagcagttcctccttcaggaattccaccgtaagcctggacttgccgccggcctcctcgatgatctcttccggtgtgacgctcaccggatacagggttttgaggttggtccagagttggttgaagtcccagtcgtcgccgttgccctctgccgttgccgcgtcgatgagcgcagtgacggtgtcttcgacgaaaaactgaactttttcgtgcaggtcgtcgccttcgaggatccgccgccggtcactgtagattgcctcacgctggcggttgaggacgtcgtcgtacttgaggacgttcttgcgttgttcggcgttgcggccctcaacctggccctgcgctgacgcgatcgcccgtgacacgagcttcgattccagtgcgacgtcgtcaggcaccgaactgttcatgagccgttccgcggcgcccgaattgaagagccgcatgaggtcatcggtcagcgacaggtagaagcgcgattcgccagggtcaccctggcggccggaacggccccgaagctggttgtcgatgcggcgtgattcgtggcgctcggtcccaaggacgtagagtccgccgaggttcaggacttcctcgtgctcgtccttgactgactgcttggcagcttcgagtgctgccggccaggcggactcgtactcctcggagttctcctcaggatccagcccgcgcttggccagctcggccacggccgtgaattcagcgttgccgccgagcataatgtccgtaccgcggccggccatgttggttgccaccgtgacagcacccttgcggccggcctgggcgacaatggcagcttcgcgtgcgtggtttttcgcgttgaggacctcgtgccggatgccttccttggcaaggaggcgggacagatattcgctcttctcaacgctggtggtgcccaccaggaccggctggcccttttcatgacgcccggcgatgtcccgcacaacggcgtcgaactttaccgtttcgttcttgaagaccaggtccgcctggtcgatgcgctgcatgtcgcggttggtgggaatggccaccacgcccagtttgtaggtgcttatgaattccgctgcctctgtttcggcagtaccggtcatgcctgaaagcttctggtacatacggaagtagttctgcagcgtcacagtggccagggtctggttctcggccttgatttcgacgccttccttggcctcgatcgcctggtgcatgccctcgttgtagcggcggccggcgaggatgcggccggtgtgctcgtcgacgatcaggacttccccgtccaggatgacgtagtccttgtcccgcttgaaaagttccttggccttgatggcgttgttgaggaacccgatgaggggtgtgttggcggactcgtacaggttttggataccgaggtagtcttccaccttctcgatgccgctctccagtacgccgacggtgcgcttcttttcgtcgacctcgtagtccttgtcaggctggagccggaggaccaccttggtgaattcgctgtaccagcgattggtgtccccctgcgccggcccggagatgatgagcggtgtgcgggcttcgtcaatgaggatggagtccacttcgtcaacaatggcgaagtggtgtccgcgctggacaagctcgttcttgtcccaggccatgttgtcgcggaggtagtcgaacccgaattcgttattggtgccgtaggtaatgtcagcggcgtactgctggcgacggaccgcgggatcctggttcgagaggatgcacccgctgctcaggccaaggaagcggtagacacgtcccatcaggtccgactggtactcggcgaggtagtcgttcacggtgatcacgtggacgcccttgccggtaagcgcgttcaggtaggcgggagcggtcgccaccagggtcttgccttcaccggtcttcatttccgcgatattgcccaggtgcaaggcggcgccgcccatcatctggacatcaaagtggcgcatccccagggtcctggaggaggcttccctgacggcggcaaacgcttccggaagcaggtcatccagcttctcgccgtcctggtgccgttcccgcaaccggtcggtttcctcccggagttcggcgtccgtgaacgtcttgaacgaatcttccagggcattgatggagtcggcatagttccgcagttgccggagggtttttttatcaccggtgcggagaagtttttcgataagtgatgccacgtgaagatgctcccagtctttgccgccgaattctggcgtttttagtctacgggagagacaccgccgaggtgcccgcttgttccctcagagcggatagtccgattcggtgcctacggcacgggcgaggccgccagccaggtcgccaacggggaaaacttccacgtcgggcaggcccagccagtcggccatgaggcggagctctgcagcaagttcgacggcggtgtccggcggcgcaccagcttcggaaaacgacgacctcaccagcagtttcccttcttttcggtcagccttgaggtccacccgcgccacgattctgtcccggaggaggaagggcaggacgtagtagccgtaccgccttttgtgctcaggagtatagatttcgatgcggtagtgaaacccgaacagttcctcgagccgccggcgttcgaagaccagtgaatcgaaagggctcaccagcgcacggcccgtggcccgccgcggcaaagatgcgtcgacgtggcggaaaacggcacggtcccagcccggcacagtcaccggttccagccttccccgctggacaagatgcgcgacggcgcccgctgccgctttgacaggcgtgcggaagtagtccgcgaagcaccgtacggttccgatgccgtgggcctgggcggcggcgtcgatcaggcggtgcatcgcctcggcgggagcatcggcgcctgtctgctcgacgggaagaaccggcagcactttggcagccagcgtgtacttgcgctcgaactgttccgtccgcgatgcagcgcagaccatgccctcctcaaacaggtgttccaggacccgcttcacggcattccagttccagccccagttcgccgtctgcgtttcctcgacgtggcctatccgggcggtcaactcagcagcggtgagggggcgggaccgggcgagcgtgtcgaggatacgccgggagatgtccgcacgaagcgcgggctccatgcgggacgcacccacccaggtccgtttctgccacaaaaggaggtccgcatagtgttccggccggatgtagctggcctcgtgtgcccagtactccaccatgcgccgcggatgaacggcggacatccgctggaggatggtgcggtcgtagttgccgagccgggaaaagaacggaaggaagtggctccgggatacaacattgacggaatcgatctggacgagctggatccgggcaaaggtgcggcccaccgtccgtgatgtcacggggccggcgggccgtcctttgtcgagtccctgcgctgccaaagcgatccgccgtgcctggtccaggctcagcgtcgccggcacatcagtcctctctgtcgatggttttcaccagcctaagcgttggccggggtgtcgtccgagcggtaggcaaggactttttcctccaccacggtgtctccgggctcgcactcgtggtccagggtaatgaccccataggtccagccccggcggcggtacacgacggacggcgtattggtggccttatccacgaaaaggtagaaatcgtggcccacgagttccatgttgtccacggcgtcgtcgagggagagtgaagcggcggggaagaccttgcgccggatcagcaccggggaattgccggccggaatgtcgttgtcgacatcgtagggagacttgtcttcgggggcggccagggcctcgttccggtggcttgcctcgacgtagaggggctcgttcgggctggcgggttcgagtgaggcggtagcttcgcggacagctttgggtgtgtgccgtccatggtggaccttcttgcggtccttggcgcgccggagccgttccagcagtttgttgtaggcgaggtcgaatgctgcgaacttgtcagcggcgctggcctctgcgcggatcacgggccccctgcccaggactgtcacctcaacggtcagctgatcgccggtctgccgggcattggtctccttggagactttcgcatcgacccgctggaccttgtcccccagcgattcgatcttcgagatcttttccccggcgtattcgcggaaccggtctgagactgtcaggtttcgtccgctgatcataaactccatggtgccctccaaatgacttcggtgacacgacggcggcgcttccctgggccgatctgcctgacagtcgagcccctctccgagccgccatcgaaaggtacattctgttcttggtacccaccaccgacgttagttcataggcacccgttattcatcctttcccggtttatttttttctaagtcatggtgggttccgcgggtgtgcgcggctgcggcggcgcagccatcggcgtccggcgggcgtgtcgccgcgagcacgacggcgccagccacctgcgccccggccgcatggagggcacgggctgcttcagccagcgtggctccggtggtcagcacgtcgtcgacgatgatgcaggggtatccggcgaccttgctccggacccgccggcggaccctcatggaaccgcgcacgcgctgtgcccgggcaccacggccgaggcctttttgcccgccgggcagctgcagtcctggcccgcttgccttggagaggacgtctgcaacatccagcccgggcagccgtcctgccgcgccgcgcaggagcaaatggacggggctgaagccacggttcaggtacgcacttgtactggtggggacagggaccaggaggaattctcctgagccttccgtagccgcacggaccgctccgcccagagctcgtcccaggcttcccttgagctggtgctgcccatgccttttgaaggagagcagcgcctgggccagctcttcgcggtacacgccggcggcgaccaccggaagcagcaccgtccccgccacgtccatcagcgcgggagctccgctttccgcacggaacggggccgcggtgagccgccggatgtggcggtcgcaccggctgcagagcgcccggtcttcggcgccgcagcacacacagtccacaggaactgccagggaaagcaggtccgccgccgctcccgcgagctgatccaggacacgaaagactgtgctgccgtggtctgcgcggtgccgggcgctgaatccgggaggcggggtgaggtcggggtccagccggacagaagccgatgcgctgtcacgccatccggttctggtggtcactccccgactttccaccctgcggcggtgacatcacagcccccagctgccatatgtggacaacgcccgactgccggacccggcccagcttccgggagagggttttcagccgggaaatgagggatcggtagggcccttgatctgcggagaccatccgttgccgaggcgttggaagatgccctctgctgactgggcataaatgtcctccggcccgttcccggcgctcaaggcgacgaggccaggccagggcgccagctgttgcggctgcccggaggcaagtgacagcagctccggcgtgacgttcgacgccgctgaccctttcatgaccgcgatggtcgtatcggtgacccacgcgccctggtcggggtcactgccggttgccagagtgatcggcggtgtcagctcacggggcgtcccgtcgccgccgcggataatgcccgtcacctgaacccgggtcttgccgttctgttccgaaatcaccagcgcacggacgccttccctcgaaatgcggaactctttgactgtccggccggccagccatgccggcgtcagagtgaccgaggggacggtggcgccctcggcgatactggccgggcggtacgccaccacttcggtgtcccccgaagctcccggcccggctgaccatacccactcgttgaggccgaacgatggccggctcagggtgctcctggtggtgagcgccctggccggttggccgggactgatgctgtacagcgtggtgcggctgtcattgaggaaggcagccgtctgcgacacgggagattctgcaggaagcctggggttgagggaggacacgggctgcatatcgggcagcggtgaaaccctgttgttttcgtagcgcgccaggtcgttgccgctgatggcgatctggcgggacggcacgttcttgtcctgcaccggcggaagcacggacccgtcatcttccacccgcaccaggtcctggttggcgcgcagctcgacgttgacgacgtcgggctggctgcggaacgttaacgtcagctgcatctgcatccgcagccggtcctccggcgacgtctccatgagttccttggccgtcaggtccacctgcgcggctcctgaaactaccgggaccgactcgcgggccagcttgatgccggacgggaaggcgcttgcgacggcgccgcgcaggtagggcgccggtccggccagcaatgcactggtcatcgctttgaccgtcttgttcttgatgaaccagcggacatccgggacggcgaacgtaaaggaggggtcgtagaagtagattgggaacgcgccgtagatgaccttgaaggtttcctctgcgatggcggtgccgtccggaatggcggagatcctccattcgccgtccacctgggtgacggtcacgggaatgttttcgatcgttccctccggcgattgcgtggcaatgccgtcagcatccaccgtgtaggcgacgtccagctggtagttgtacacgttctcggtgccggttgccaccacccgcgcctcccggtagacgagggcacgctggtccggtttccaggacacggaggaggcctgcgtcaggtactggcgcgccacggcgtagtcgtcttcgtaaccgctgccggcccggtagaagtaatcgatgatggtctcgggtgaggcgcccggctgtggcgcggccggcaggaacaccggcgcactgaggttccctgcgctgccctcgctgcttttgcccaccggcccggacgtgggaatcctggcgcagccggccagcaggaggagcaggagaaccagcagggaagcagacagtttcgcctgtcggccggcacactccgtcatgttctctcctcctgggcaggtcccgttccggccggggcgcctgatcccaggaccagcatgttgctgttccccggttctcccggcataacgatgtcctccggctcgagctggaccggcgatttgtcgatttcttccccctggcgcaggggcagcgtcaaccggaagttggccccgctgcctttcttgccccatgcctggagccagccgttgtgcagcttggtgtcctccatggcgatggacaggccaaggccgctgccgccggtagtgcgggcgcgggcggggtcggcccgccagaagcggtcgaagacgcgcgctgcctctgccggcgccattccgattccgtggtcccggacggcaatcccgacggcggtctggctggctgcgacggtgacggtgaccggctttccttcgccgtgctccactgcgttgaggatcaggttccgcaggatcctgtcgatgcgccgtgcgtccatctccacgatgatggcaccttcccgcgccctgaggacaatctccgaaccatattccgcagctaccggggcagcgccctcgatggcatgggcgaccacctgcaggatgtcttccgcttcggcgtcgagcactgccacaccggcatcgaagcgggagatttcaagcaggtccgacagtagtgactggaagcgctcaacctggttgtagagcagctcggcggagcgcttgttgatggggtcgaagtcgtggcgcgcgtcgtacaggacttccgccgccattcggactgtggtcagcggggtgcgcagttcatgggagacgtcggagacgaaccgctgctgcatctgcgacagggttgccagctgggtgatctgctcctggaggctggctgccatgtggttgaaggatgcacccaggcgcgcaacttcgtcttcaccccggaccaccatccgctcctgcagctggccggcagccagtttctccgacaccatggcggcatggctgaccggactgaccacgttgcgggtgacgtaccaggcgatggcgccgataagcaggacgagcacggcgccgccggcccagaggacgctctggatctcatccagggtctgctgcgcggtgttcaggtcgtagatcaggtacagctcatagacagtgccgttgaacgtcaccttgttgcccaccgcaatgccgggccggtcttcggtgcctaccggaatgacggtggaggcccaatactggtccttccccgactcctgcacggccttgcgaagttcgggcgggatgacgctcactgtcagctggtccgaggcccgggattcgacccagcggttcctgggcttggtttgttccggcatggcctcaaagacgtacctgcgctggatgaccgaaccccggccttccaccgcgttgagggtgtcgtacaccagggtgatgacgctggcctggtcggtgacctgcgcgccgtcgaacgtgtcctgaacctgcttaacgtggtagctggtttcggactcggcctgcgccaggcgctcctggaaaaggttgttggcgatctggttggacaggtaggcgcccacaaccgcgaacgaggtgacggccaggaggagggtggtgaggactgtgcggaactgcagcgaccggcgccaccggcggtgaagggaccggccgatgaagcgcagcgccggcaggaaccgccggattccggtcctgaccagccgtgcgacgcgcaggctcacgataagggcgcgccgctgccacagatgggcgcggaacatcaggtcccggaaacgggcactgatggcgtcggtgtgttcggggccagggggcaggccggccccgccgcgatgtccggaggcggaattgcctgcgggagcgggcgcgcccgtaccgggtgcaccgtcttgtgcagcgggttcaggcccctgctttgtagccgacaccacgcaccgtcaatacgacttccggagcttccgggtcctgctcgatcttggaccggaggcgctggacatggacgttcaccaggcgcgtatcagcagcatggcggtagccccagacctgctcgagcagcagttcccgggtgaacacctgccatggtttacgtgccagggccaccaggaggtcgaattccaggggagtcagcgaaatccggtcgctgccccggctgaccgtgtgtccggccacgtcgatggtgatgtcggcaatgcggagggtttccggagccttctggtcgccggggcggagccgggcgcgaacgcgtgccaccagttcagcgggcttgaagggcttgggcacgtagtcgtcggcgccagactcaagtccgcggacgacgtcggacgtgtccgacttggcggtgagcatgacgatgggcacatccgactctccccggatctgccggcagacctcgatgccgtccacgcccggaagcatgaggtccagcaaaacaaggtccggtcgcgatgaccggaaaacgtcgagcgcctgggcgccgtccgcgcaaaagaccggctcgaagccgtcgttgcggaggacaattccaatcatttcggccagcgcttcatcatcgtctaccaccagaatgcgtgccttcatagttatatattcccttatcaggatggctttgtcctgttcaacgccctccggcatggcggggcgctaggatgcccgacgccggaactataggctggtgccacgccggacgtttccagcgccatgccggaaatgcggagccggcgccaggccgacggcggactggatgggggaaggatcatcgtgtcaccaaaggattccgacgcggaggagccagggggcccgggcatgcctgcatgggagcaaactccggagcagcaccagccctcgggagggcgccacccggcgcagcagccgccaagcgggcctcccccgcccgatcagcagcgcccatggggtgcgccggccgggcagcagccgccgagctggccgccaccggcaaatcagcagaactccttggggccaccggcgtggcagcagccgtggggccagccgggtccgtcatatccgggctcccagagcccgcaatctcccagccctgggtatccccaccagggccacccgtacggccagccacggtatgttgctccgcccaaaccgggtatcgtcccgctgcgccccctgatgttcggcgagatcatggacggttcattccagacgatcaggcggaatgccaaggccatgctgggcgcttccctgctggcgcagtccctcgccgccatcctgacggctgtccttacagcagccacagccacgtcgatgggctccatcgaagcctgggcggagagcgccagccccgccgacctcacatcgctcggcctgggcttcgttgccgccattgtgctggttgccgtcctgaccatcttcctcgcctccgtcctgcagggagccatggtggtgccggtggcgcggtccatcctgaaccgccccaccggtttcaggcagatgtgggtcctggcaaagccacgggtcggagcactgatgcggttggcggcgctgctgatggttgccggactgattgccatcctcgtcccggtggcggccgccgtcgcactgatagccagcatggaacggataggcgtactgttgctcatccccatgttcctcggcttcgttgccttgttcgtgtggatctacatcaaactgctggtggccccggccgccgtcgtggttgaggaactgggcgcactggacgccctgcgccggtcgtgggaactgacccgggccaactggtggcggatccttggaatcaccgtggtggtggggatcatggtcggcgtcatcagccaggtggtcatgatcccggtgagccttgtaccgccgctgatggcaggctttctttcgccccacgggggtgccgggcaggacgtggccatcgccgtcgccgttggcatcatcaccgccgtcctcggtgcactggcaggagcgctgggctatgccttccagacgtctgtcatggcgctgatctacatggacctgcggatgcgcaaggacgggctggatatctcgctgctccggatgatggagtccggcgcggatccggacggcatcccgggccgcggccaggcggcggcccggcccggacgttaccccggtggctggaaccccggcaccgggcctgccgcgggggcatggccggatggccgctgaacccccggtgctgcccggggcggaggaagcccgccgctgggcagcagaggaactttcccaacctgaataccgcgacgctgccccgggatggttcgagacgctgtgggagaacttcctggactggctttcgaccctggacgggtccgcggatgcgggcagcaccgtgccaagccccgtcattgggctcgtcatcgccgtgatcatcgctgccgcggtgatcatcgccaaaccccggctgaaccccaaggcgcggcaggtcagggaggtgttcgagcccgagggcgagctggcggccggcgactaccggcagcgcgcggaaacttccgcggcggctggaaggtggggggacgccgtcgtggaccgtttccgggcactggtccgctctgccgaggaccgcaccatcctggacccccagcccgggcggacggccgatgaggtggcccgggacctggcgctccccttcggcaccgaagcgcagcgcctggacagtgcggcaggcacattcgatgccatccgctacgggaacaggacggcggacgcgggcgactaccgggcgatggccagcctggatgacacgctcgaagccctcaagcccgtccgccaaccgggcaatcgggacgaaggccaccaggaccatgaggcaccgcgcccggcggtactgccatgaccggggcggttccggcttccgcggtgcagggaggcattgatgcggaccaggcatccgtccgcgggacagggtggctccggcggcaccgtgccattgtggcttgcgccgccgtggtggctgccgcgctggtcctggttctttgggcgcagctcagccccaaaggggacgccgttccgttgtcggtccacaacgccggccccgatggcgcacgcgcggtcgcgcagatcctgggcagccacggagtggccgttaacgatgcaggaaactacggggaagccatggcagcactggaggccggttcttcgcccacgctgctgctgtacgacaggaacggtttcctggacgggccccggctccgcaacctggcgggttccgccaagcgggtggtggtggtatcgccccggctgcagaccctggacgcactcgacgccggcatccggcaggcaggggtcgtgccggacgcctatccggtgctggagcccggctgcagcctgcctgacccgcaggccgcaggtaccgtttccggggagtccggcttcctgtacgacggcgggacgtcctgctaccggccggacggctccggcgcagggctcgtagccgtcagcagcgatggacagctcaccgtcgtgggcagcaccgccatcttcagtaacggacagctggacagcctggggcatgccgcgctggccatccggacacttggcccgtccccggaccttgtgtggtacatccctacccttgaggatttggacaccgggggcagccccgcaagcctcgacgagttggcccctgactgggtgcgcttcctgggcccgtggctcgccctggttgccctggcggcaatagcctggcgcggcaggcgcctgggcccgctggtgtttgagcccttgccggttgtggtgaaggccgcggagacggccgagggccgggcgcggctctatcaggactcccgcgccgtggaccaggcgagggacaacctgcgtgccgggacgctggtacggctttccgtgcatctgcggaccgggccaggggccaccgccggccaggtcatcgaagcagctgccgaattcctcggcaggcccgcccgggagctccgcgaacttatcaacgaacgtcccggtaccgaggcgaggcttgtggcctggtcccgggaactggacaccctagagaaagaagtcaagagccgatgagcgagcaaggcagcagcccccgggtcctggaccacatggatcatgattccgcccggcaggcccttttggacgtgcggcacgaggtggccaaggccgtggtggggcaggacgccaccgtcacgggcctgctgattgcgctcctttcccagggccacgtacttctggagggggttccgggcgttgccaaaacgctgctggtgcgtgccttgtctgcggccctgagcctggacacgaagcgcgtgcagttcaccccggacctcatgcccggagacgtcacgggatccctggtctatgactcgcacacctccgaattcacgttccgtgaagggccggtgttcaccaacattctgctggcagacgaaattaaccggacgccgcccaagacacaggcatccctgctcgaggccatggaggaacggcaggtttcggtggacggagtgtcccggccgctgcccgcaccgttcctcgttgctgccacccagaaccccgtcgagtatgaaggcacctatcccctgcccgaagcgcagctggaccggttcctgctcaagctgaccatgccgttgcccgggcgccaggacgaaatggaggtcatccggcgccatgctgcgggctttgacccgcgggacctcacagctgcgggggtccgggcagtggcaggtgcggcagacctgacgaaagcccggcaggccgtggcgtcggtggcggtggaccctgaaattatcggctacatcgtggatctggtgcgcgccacccgctcagccccgtcgttcctgctgggagtctcaccccgcggggccacggcccttctgaacacgtccaggtcctgggcctggctgtcaggccggagctttgtgaccccggacgacgtcaaggccctcgccctcccctgcctgcggcaccgtgtggcgctccagccggaagcccagatggacggggtccgggtggatgacgtgctgggcagcatcctggcttccgttcccgttccccgctgatggccatctccgggcgtttcgtgctgctcgtgctgctgggggtggtgccggtcctcctgctgcccggatggggaacggtgctgctggtgtccggggtgctggcagcccttgccgccgtcgaccttctggcatcggcaccgctgcggacggtcagcctgctgcgcacacagcctggaaacgtcaccctgcacgcggcggtggatgctgtgcttacggtccggaacgatggcggccggcggctccgcggcgtcctgcgcgacgcctggcagccctcggcgggagcgcagaatgcggtacaggacattgatgttccggccggtgagagcaggcgcgtcaccgtccggctgcgccccgtccggcggggagacctccgggccccgcacgccaccctccgctcgtttggccccctgctgctcgcggcgcgccagaggacagtgcagtgccccggctcgctgcgggtcctgccccctttccactcccgccggcacctgccgtccaagctgcggaaactgcgcgagctcgacggcaaggccgcggtccagatccgcggcgcgggcaccgagttcgattccctgcgggactatgtccggggcgacgacgtccggtcgattgactggcgggccacggcacgccggtccgcggtggtagtccgcacctggcggccggaacgcgaccgccgcgtggtgatggtcctcgatacctccaggacgtcggcggcgaggatcgacgacgaaacgcgcctggacacgggcatggaagcggcgctcctgctgggtgtcctcgcggagcggggcggggaccgggtggacttcctcgcttttgaccgccggacgcgcgccagggcagggtccgccgggcaggggaacctcctgggccaactggtccaggccatggcaccccttgaggctgaactcatcgagatggactggccggccgtcccggcgcaggtccgcgccgtttccgcgcaccggtccctcgttgtgctgctcacctcgctggacggcggcgcgcccgaggaaggcctgcttcccgtcgcggcccagctggcccggcagcacgtggtggtggttgcggcggtccgggacccgcagctgggaaccatgctgggagaacgcgacgacgccaccggtgtcttccgggccgccgcggccgagcgtgcgctcctgcagcgtgcggcgatcagcgcagagctccggcagcacggcgtgtcagtggtggacgccgaaccccaccagctgccgccgcggctggctgacatgtacatcaggctcaaggctgccggtacattgtgaggtcacagcactttgttccagccgctttcccagcaggaggttccccatgaacgttcccatctaccagcaggccctcggcgcggacttttcgcgcctgcagcccgagctgcaggactacttctccctggtgccgggctcgggccgctacggcgtgggggaaggaacgttcgacgtcgtgggctgccggcaggaatggctccggcctttgctgcggctcaccagcggggaggaagccttctttcccgagtacggcgagaacattccgttccgcatcgagaaccacgcccaccaggaccccttcggccgttccagcctcacggcccgccgcgagatccggttccccgggcgcacccgcatcttccaggacaccacaagcaataccctccggaacggtgcgccccagctggtggattacgtagggcggtaccggcggctggtcaccgacctgaacctgagtgtcacggcagagggccggctccggggcgtatcggaagcatcgcggctccttctgggccccctccgtattccccttcctgctgccctggacgccaaagcatacgcagaacagtggtgggacccggcagaagggcccgccggaaagcaccggatccaggtgaaggtcatccagccacagatcggcctggtcctggtctacgccggcagcttcgactaccggctgcgcccctacacgggcggcagctcagcccacagcttcctgccgcgctacgcgcagcccgaacgctgggaaaacagggtctgatgccgctggcgaaagctgcgccggctagccctgggcgagctggttcagcccgtccgcaagctgggtaagcctgcccaacaccgctgtggcctgcgacggcgagccgccggcaagcccggccgagggtgttacccggatggaagccagggtgtgtgccggaaggcccagctgccgccagggccgccccacggcctccaccgattcagcgaccttgggcagcggcccgccggccgcctccaaggcgccgagccacaggcttgagcctgattccaccgctccagccagctgctcccactgccgggacgtcaaggccttcaggggaacagctatgccgtccgctccggcagccaggatctgctcgaagggcgcttccacctccggaacagagatcactgcttcggcggcgcccgcggcccgcagggcgtcaaggaccagacgccatgattcgcgtgcttcagatgccggcaccgcccggagggtgcggtagccgctggaggtgggaatggtgccggccagcaccgcggcgatatccggctcgtccacctggaccaccatgcgcgcacccggtacggctgccgccacccgggagaggtatccgcccacgccggcggcaagcgaggctgcaaggtcccgccgggcgccgtagtcgaggagggcccgctcgccgttgtgcaggtggagccccgccgccaggctcaggggccctaccagctggaccttgatctcggcggaaggattttcctcggctccggctacatcggcaaggacgttgatgtccgtggccagggctgaggcggcgcggcggacgtccttgccgggacggtcaaccagccgccacccgtagggctggacgtcaacggccagctcggcaaggaggctggccgtacgccccagggcatcggaaccaactccgcggtccggcaattcggcgaggaagggcaagtgcgggctgccgagttcgccgcggatgatcctggcggcctccacggggtcttcgcccggccacggtcccagtgcggtggccgttacttcccgcggcggagcgggtgccggtgaggaggcactgccgcggtgttcgtgcctttcgaccatgctcacgcgagggctgatgcctgcgggtgctggcccgaggcagcctcgtggtcttcggcaatggcctcgtggtgccttatgacttccccgatgatgaagttgaggaacttctcggcaaaggcggggtccaggtgtgcgtcctcggcgaggcggcgaagcctggcgatctgcgcggcctcgcggccggggtccccggcgggcagccggtgggccgccttgaggaagcccaccttctgggtggccttgaagcgctccgccagcagatagaccagggtggcatcaatgttgtcgatgcttgaacggatggagagcagttcagccatcaccgactggtccacctggtccgccagcgaactggctgaggggtcgtagtcatcggcatcaggagtgtgaaggttgtgctgcgtcatggtccaagtctatgggcaggcaccggaatcatccgggtgttaagcgccggtgccggtatccggcaccggcgcttaaggcttcaacactggcctgcggctcaacgctcagatgccaagcagcgcacggtgcgcttccctccgcttcgcctgttcctccggatcgggcacgggcagggaggcgatgagccgccgcgtgtaatcgtgctgcgggtttcccatcacctggctgccgatcccctgctccaccagccggcccttgtagaggacgcccacccacgaggacagcgtgtccaccaccgcgaggtcgtggctgatgaacaggcaggcgaagccaaactcctgctggatgtccctgaacagctccaggaccttggcctgcaccgaaacatccagtgcggacgtcggctcatcggcaatcagcagccggggattcaggctgagggcccgcgccagcgacgcccgctggcgctggccgccggacagttcgtgcgggtaccgtcccgcgtacgacgccggcagctggactgattcgaggagctcgcctacgcgtttgcgcgcctgagccgggcttggcttcgtgtggatgaccatgggttcggcgatgcagtccccaatggtcagttgcgggttgaaggacgccgccgggtcctggaacacaaaaccgatgtccttacggagcggtttaaaggtacgttccttgaggttcagcatctcgtaccccagcaccttcaggctgccgccggtggtcctgttgaggccggcgatggcacgcccgatggtggttttcccggagccggactcccccaccaggccgaacacttctcccctggacaacgtgaagctgaccctgtccacggccttgaaagcgggggttcccagcctgcccgggtactcgatggtgaggttgctggcttccaccaggacctcctcctcctggtgggcccggccggtcagtccctcggaggccgagttccgcccgaggtggggaaccgcggcgaggagcctgcgggtgtagtcctgccgcggttctgcgaacagggtgcgggctgaagcctcctccaccacatccccctggtacatcaccaccacccggtcggcgaggtccgccaccacccccatgttgtgggtgatgagcacaatggatgtgccgtacttgtcccgcaggtcccggagcagttccaggatttctgcctgaactgtgacgtccagggccgtagtgggctcgtcggccacaatcaggccgggattcagcgccagcgccgcggcgatgaccacccgctgcttttgcccgcccgagaactggtgcgggtaatagttgacccggtgttccggatcggggatgcccaccttgcgcagcgcttcaatggcccgggttttggcctccttggctgaaacccgcttcccgtcgcttccggtgtgcgcccggatgccttcggcaatctgccagcccacggtgaacaccgggttcagtgcggtggacggttcctggaacaccatggcaacgtcccggccgcggatctgtcggagccgggcggcgctgacactgatcacatcggccccgttgatcaccaccgcaccggagctgctggccgtttcggggagcaaccccaggatggtcttggcggtgacagtcttgccggatccggactcccccacgattgccagcacctcccccttcccgacctccaggctgacgtccttgactgcctggaccggaccgccgtcagtggcgaacgtgacctggaggtggtcgatgtcgagaaccggacgaccgtcgtcgggctccccgttggggttccgcccggacaatggatcgatgttgacggtcatgatgccctcacttcggttgcgatggcggcgttgtccaccggcgccggggaactgccgcccgtgctcttgcggccgcggaggcgtggatcgttgaggtcgttgatgctctcacccaccagggtcaggcccaccacggtcagcacgatggccaggccggggaacaggcctgtccaccagatgccggacgtggtgtcggcgagcgccttgttgaggtcgaagccccactccgcggccgagctgggctcgatgccgaagccgagaaacccaaggccggcaagggtgaggatggcttcggaggcgttcagggtaaagatcagcggcagggtccgggtggcgttgcggtagatgtggcgggtcatgatgcggatgttggacgctcccaccaccttggcggactccacgaagggctcagccttcagcctgacggtttcggccctgatgacccggaaatactgcggaatgaagaccagcgtgatggccgtgccggccgcgaagatgccgccgatgaggctggactgtccgccgctgatgacgatggccatgacaatggccaccagcagtgagggaaaggcgtacacggcatcggcgatgaccaccaggatccggtcgagccacccgccgaggtagccgctgaccaggccaaggacaacgccgataacgatggacatggatacggcgacaacgatcaccaggatcgccgtctgcgcgccccaaatgacccgcgacaggacgtcgtaaccgcccactgtcgtccccaaaaggtgtttgccgcctggggcctgctgcgtggggaagttgccgtcggcgtcggaaagctgggagaaaccgtagggtgccaacaggggtgcgaaaagcgccgtcaggacgaacaggccggtgaggaccagccccgcgaccagcatgccgcgctggaggccgacgcttttgttgaagtgtgagaccaccggcaggcggcggtaccagggagcccgtggactttccatcgggacgggaacggcctggatgctcatggtcagtacctcacgcggggatcgatcagcgcggcgatgatatccacgatgaagttggtcatggccacgatgatggcgagcagcaccacgatgccttgaacggcaacgaagtcacgggccgtgaggtagttggcgagctggaatcccaggcccttccattcgaatgttttctcggtcagcaccgccccgccgagcatcactgctatctggaggcccatcaccgtgatgatgggtatcagtgcgggcttgtaggcatgcttggtgaccaggcggtattcgctgacgcccctggaccggccggcctcaatgtagtccctgccgagggtgccgatgacgttggtcctgacaaggcggaggaagatgccggctgtcagcagccccagcgccaccgcgggcaggacggcgtgggccgtgacgtctcccagggcagccatgttgccgcttcgaagcgcgtcgagccagtagattccggtgggtgcctccagtgacgtcaaggcaagttcgctggacgtcctggcccgccctgccaccggcagccagccgagccagaccgagaaggtcagcttcagcagcatgccggcgaagaacacgggggttgcgtagcaaagaatggcgaagacccgcaggacggcgtccggcgccttatcccggcggtgggccgccaccatgcccagcggaatgcctaccacgagggcgacgagcagtgcgttgatgctcagctcaagggtggccgagccgtacgttgtcagcatttcgacgacggcgcggttgtccgtgagcgtccggccgaagttgccggtagccagctggccgaggtattcgaagtattggaccaggatgggccggtcgtagccggctgccaggatccgctcctggagctggtccgccggcaggcgccctcccatggctgcggtgatgggatcgccggtgatcctcatcaggaagaagaccatggtgaccaggatgaagatggtggggaagatcagcaggaaccggaccaggatgtactggcccaatccgccgccggatgatttcttggcggccggcagcaggccgtccgcgtcagttggtggcgcctcgatcaatgtagtcatgggtacctcaggtttgttttacggtgcccgcggcgggccggcaccgcatcccggccagcacgcggggcgggacacgtgcacctggctgcaggcgcgccgtgtcccgccccgtgagcggtcaggttcggatggttcggaggacctacttggacatcacgccaagacgggtcttgaacgaggcatcgagggtcttttcgactccctggacatccgttccggccaccatgacctgggcgccctgcagcagaggcagcgtggagaggtccttggcgatggcttcctgggcctggcccaggagatcactccgctcagccttgtccgtggtgaccagctgcttcttcacgatgtccgtcacggcagggttctcgtagtggttgccgaggaagttgcccgggatgaagaacggcgtcaggtagttgtccgcgtcggaatagtccgggaaccagcccagctggtacacggggtaggcgtcggcccggcgttccttggtgtaggtggtccactcggtcgacttgaggtcgacggtgaagagccctgacttttcgagctgttccttcaccagcgcgtactcgtcggccgcggaggtgccgtagcggtccgtgtactgcagcttcacgtcaaccaccgaggtgatgccggcatcggcaaggacctgctttgccttgtccaggctcggcttgccactgccgtcgccgtagaggctcttcagcggctcgcttgcgccttcgaattccttgggcacgtaggagtagaccggagtgtaggtgtccttgaagacctgcgaggcaatgacatcgcggtcaacgaggtgggcgatggcctggcggacggcgagggccttggcagggtcggcgtccggggtcttcgcgccgaacggcatggtgtcgaagttgaagaccatgtagcgcagttccccgcccgggcccttgtggaccttcaccttgtcgtcgccctcaaggtctgcgacgtcggtggcggtgaggatgcgcccggcgacgtcgatgttgccctgctggacgtcaagcttcaggttgttcgggtccgcgtagtgcttgagggtggcgccgtcgttggcagcagcacccagcagcccctggtaatccgggttgggcttgaagctgaccagttcgttctttttgtagctttcaatcgtgtactggccggcaaacggcttggcggcaacgatggcgtcgtcgtccatgatcttgtctgccgggaagacttcctcgtccacgatcggaccggggtttgaggccaggacgcccgggaacacctggtcgtttccggcggccagggtgaacaccacggtgttggcgtccgtcgcctcgatcttttccatgttggagagcagcgaagcgggcccgttggggtcgtcgatcgacttgacacggttgaaggagaacacgacgtcggaggaatccagcgtgttgccgttggcgaacttcaggcccggcttgagcttcacggtgtactcggtggggctggtaaaggaggcggactccgcgatgtccggagtggcctcggcagtgccgggtttgtagttgagcaggaacgggtagatctggttcatgaccatgaacgacccgccgtcataggacccggcgggatccagggtgaccactttgtccgtggtgccgtacgtgatggcaccaccccctgcatcgccggtcgaggtcccgccgcctccgcctgaggggcccgtgcaggcagtcagtgcgagggcggaaatgcctgccagcgcgattgcgccgtgcagtgctttgttgctcttcgtcatctaagaactttctgttcgatgagtgcgcgcccgccgaccgctgatgggtgcatgtgctcaggcgggaagcgcgcggtgctgatgcctagattcaatcagagagtccacactcagaccggaccattttgtgagttgagacacaaaatttacctgattgctccacagcgcacggcaaccggggcacaaccagcaacgccgccccggtgaaaccggggcggcgttggggacatgctggtttagagctcggcgcgctgaagcgagcgggcggcgtcaatggtcgcctggcccagcacccggctgccctggtataggacaatcgtctgtcccggagccactccacgcagcggggtggtgagccggactaccagctggccggcggcgtccgcctggtcgccacccacttccatgcgggcggtcgcgggtacggggtcgccgtgggcacggacctgggcgtggcagtcgaactccccgcccgtctccacctcggcgataggcagtcctgcccaggagaccttgatgccgcggatctcgtcgatggccagcagggcctccgggcccaccactaccttgttttccttgggccggatctccaggacgaagcggggcttgccatcggcggcgggcgtgcccagtttcaggccgcggcgctggcccacggtgaaggcgttggcacccgggtgctcgcccacctttgtcccggtttcgtccacgatgtccccggtggacatgtcgatcttttcggcaagccatcccgcggtgtcaccgtcagggatgaagcagatgtcatggctgtccggcttgttggccaccgagagtccgcggcgttcagcctcagcacggacttcagctttggaaggtgtctcggccagcgggaacatggagtgtttgagctgctcgtgcgtcaggacgcccaggacgtagctctggtccttggcccagtcagcggcgcggtggagctcgcggttaccgtcagcatcctcaatgaccttggcgtagtgtccggtgcacacggcgtcgaaccccagggcgatggccttttccaggagcgcggcgaacttgatccgctcgttgcaccgcatgcaggggttgggggtgcggccggcggcatattcatcgatgaagtcctggacaacgtcttccttgaaccgctcggagaaatcccagacgtagtacgggatgcccaggacgtcacaggcccgccacgcatcgcgggagtcctcgatggtgcagcagccgcggcttccggtgcgtagcgtgccgggcatgcgtgagagcgccaggtggacgccgacgacgtcatgtcccgcctcgacggcgcgggcggcggcgacggcggagtcgactccgccgctcatggctgctagaactcgcatggttgctttccctcggggttttaccggctcctggccggtgctggcgaacgtgcgcggctggtcgcgccggttgatggcgctggacaaggacgctggctcccggcgctgattcccggtgccgattcttgggctgattcttagggcgggcaggctcccggaaacgatccttgcctatctattctacggcctccgcccaaggctccgtcaggcaccttcgaggcagggcgctgtcagccgccgttgagggcccggcgcgcaagcgtccctgcggtctggatgctggactcgtgcccggccatccccgcctgccgggcccgtgcataggcatctggcagcgcggccaacagggcgtcaacgtcgccctccacggaggcgtggcccagggtgaaccgctgcgcgccgcgcgccgtttcctcgtccaggcccatggccagcagaacgtgggaaggcctgggcacgccggccgtgcaggccgaaccggtggacgactccacgccggccaggtccaggaggaacagcagggaatccccctcgcagccgggaaaagtgaagtgcgcgttgccggggagccggccgtttccggcagcaccgcgcaggacggcttccggaacccgttccaggacaccgtcaatcagccggtcacggaggcccgcaatgcgtgcggactcggcgcccagggtggccgcggccttctcagcggcagcggcgaaggctgcgatcgaggccgtgtccagcgtgcccgagcggacgtcccgttcctggcctccgccgtgctggacgggagtgagcttcactgcccgtcccagcaggagcgcacctacccctaccggtccgccgatcttgtggccggaaatggacatggcgtccagccctgaggccttgaaatccacggggagggagccaaacgcctggacagcgtccgagtgcacgggaacgccggcggcatgcgccagctccacgatcctgctgacgggctggatggtgcccacctcgttgttggcccatatcacggtgaccagggcgatggtgtccgggtcacgggatagttcagcgtcaaggacggcaaggtccaccgctccgtcgctgtccaccggcagccagaccacctcggcgccttcgtgccgttccagccactccaccgtgtccaggaccgcatggtgttcgacggcggagcagaggatgcggcgccgcgcgggcatgtcagcaacgcgggaccagtacagccccttcacggcaaggttgtcagattccgtaccgcctgacgtgaagatgacttccgacgggtgggctccggcggcagcagcaacagcctcccgggcgtcctccacggcacggcgggcccgccggccggaaccgtgcagcgaagacgggtttccagtgcgggccagttcacgggtcagcgcggccagcgcctcaggggcaaggggggtggttgctgcatgatcgaggtagacgggcaccccacaattctaccggcccgccctgccgggctggcgccctcctgtgctaggcggacggcggaaccaggggcaggaaacgggcgacgtcggccctcgcccctgcgagcgcggcggcgtccgggcacgagagggagatatagacggatgagccggccgtgccgaacagcctggccagcaccgcagttgcccttccggcaggctgggctgcctgttccagggccaggacctcgacggtcctggccggcccttcagtgtccgcgccccaccgcagcgtctccgtcttcaggtagccgggcaggatggacgggtccagatactcaaaaagtgcaacggtggattcccggtcgtcgccccggaccagggcagcctggttggtgcgcaccctggctgccaccaggcagccgtcttccttcacataccgtgcttcgcccgccacgctgccggcaacgggtttccatcccggcacttccttcagtccgtccgcgatgcctacgggcatgcctggggccaggctgccgccggcggcaaagggcaggtcctgggcagccactgcggcagcgtcgtggccaggcgtaatggtgggggtggccagcgcaggcgtgctggcgacaggttgcggagccgcagggtcgcgcacatccacgctgcagccgccaaccagcagagctccaaggacggctgccagcaccggcactacctgccgcctggcccctccggccattcccgccgtcgtcggcatatccattcctgccccaatactttccgccacagccgggacggccgcgcatgcacgagtctaaatgcacttgcctgcggcgcccgcacccggtccgcggcccacgggggaaccttgggtggccggagcgtcgttgttcaggacaggccgttaaactgtgcggaccgggctacctgcgaagactggccataccaagagaaggatgagggcttgaccgagagcagcagctcctattaccaggtacttcgcgtggcggtaacggccacggagaaggagatcaaggtggcctaccgccgggctgcccggacggcccatccagatcacggcggagacgccgccgcgttccggcaggtgacgcgtgcctacgaaacccttatcgaccccacgcgcaggaaagcatacgaccgctcctacgccgccggcacgctgcgcaacgaggactcggacagagaggcgcatttcgacgcgccgccggcgggcagccgcgcttcggccacagtgcacaggcaaggcaacgcccgcaacaccgccggcgacccccctgtgtacgtcccgccgtatgaggacgcccctgccggccaggttccgctgattcccctggcagccgcccgccagcaggtgcacggcatgccacgcaaacgcggaattttcggggccgaggcacgcatccagcgggagatgcgcacggtccagctcctgacccgtcaggtcctgccggccatcccggccgcacggctgatcaacggcctccaatcccctgcggacaacagccacatcgaccacgccgtcctgtccggttaccggctggcgctgatcggctccatgctgctgcccaagggcgcctatgcctgggacgggcgcaccttgaaccacgggggccgcgccattgccccgccacagctcgcgcacgttgtccgggccatgcaggacatcttcccggaactgaacgtcacgggctggaccgtggtgctcaaccctggcggcaacctccacgagccggtgatagacaaccaccgccgttcagccggagccctcgaggccgtgcaggtggttaacgcggcagggatggtgcgcagcctaaaggaattccttgctgccgggcctgctcccaatacggtgaatgttccggtgctggccaggctgctgcgcggcatgcactgacaacggtggctaggatggaacggtgttccgcatccttttccacgcccccgaaatccccggcaataccggcaatgccatccggctcgcagccatcaccggcgccgaactgcacctcgtggaacctctgggcttcgacttctcggacgcgaagctccgccgcgccgggctggattaccacgatcttgccgtcgtcaccgtgcaccccagcatcgaggatgcgtggaagcacctgcaaccgcagcgtgtctacgccttcacctctgacggaaccgccagctacaccgacatcgcctaccagcccggcgacgtcctgatgttcggcagggagtccgtggggctgcctccggaactgaaggacgatccccatgtgacggccacggtgcggctgcccatgctgccggccctgcgctccctgaacctggccaacgccgcctccatcgccgtgtacgaggcctggcgccagcagggctttgccggcgccaaaatctgaccccgcagaagccggcaacttctttgcacacccggccaatccatccgggcagctgttccgaatcacttccgacaacattcccaggcgttggaggagctgcaggtgacattgctggagtcaagatccaggacctcccgcagcagccacggcggtactgctgaggattcacggccgggagacttatgcttggtagtgatggaaacccccaacgcgccacactccgaggcccaggccgcggtgtcagaccctccggccgacctcagccaccggctttcagtcctgctggaaagcatagggcggggtgaccaggcggcctttgccgagttttaccagctgacgtcccgccgcgttttcggcatggcccgcagggtcctgatcgatcccgaactcagcgaggacaccacgcaggaggtgttcctgcaggtgtggcagaacgcgtccaagttcgatcccaaagcagggagtccgctttcctggctgatgacaatttcgcaccggcgggccgtggacagggtccggtcctcgcagtcctccacggaccgcgaggccaaatacggcgccagcacccaggacatcgaccacgactccgtggcggaccaggtgggaagcaggctggaggcggaggccgtggtgcggtgtttggagacactgaccgaaacgcaacaggagtctgtgcgcctggcgtactacgggggcctcacctaccgggaagttgccgaacgcctgaacgccgcagttcccaccataaaatcccgtatccgcgatggattgatccgactgaagacctgtctgggggtgagttgagatgactgaaaccaacagcggccgcaatggccgttccggttcgtttggcgacaccgttgccgtggacctggcttccggccgggctgtggacctggctgagctctatgcactggatgcgttgacggatgaggaacgccaggcaatcgaacagtacatgtctgccgccccggcagcggaacggaccgaattcttcgaccgcgtgcgccaggcgagggagaccctcgcaaggaccttccgcatcgaggagcagcctccggctgatcttttcgaccgtatcgttgcccaactgcctgtccagggcagcgggccggacgcagggaccccggccccacctgcctcaggacacattgcaggaggacagttcgcgccgcggcagccggcatccgggcagccagccggtgcgcagcctgccggcggagacgagctcgcccaggcccggcagcgccgcgaggaacgacgccggcctggcggcacccgccgctggctcgccggagtcgcggctgctgcagccatagctttgggcggtgtaggcgtggggtcctacgtggctgaccagaatgacccaatgaaccaggtggtgcgtgccggagacctgcgggaagcttcggtggacgtggcaggcggaggtaccgcgaccctcctgatctcctcatcggaggatgccgccgtcgtcaaaatgaacggcgttcccgccccgccggcgggaaaggtctaccagatgtggctgatccccaaggacggttcggcgccggtatcccaaggcctgatggacgaggaagcgctgtccaagcccgccgtggtggaggggatttcctccgccgcagcgctcgggataacagtggagccggcaggcggatcccagtcccccaccctgcccacggttgccgccgccccgctgggggcgtgaggcaccagccaggacgccaaaagcgccccgttccattccgtcaaggaaaggagcggggcgcttttgcctgtactcgtcagaagccggcgatggttccgggcccgttgaccgccaccacgtggaaggcctcagcactgcgcccgcctgcaagtcccgcccgggcagcgtttacccgcatgccctgccggactgttgcctccatggcatccacgtcagggtgctggctgacgtggacgtggatcgccccgagcttggactccacgtggtcggtgacatccacaaagtggttttcccgctcctccggcccggcgtagagccacagccacgggagcttgtaggccttcagtccggcctctgcgagttccgggtaggcgaaggggttttccacggccgggtataccgcgcgggttacggcctcccccaccgcgagatggtccgggtggctcttctggattcgtttccagttccgttccgggtgcatggacagcacgacgtcgggacggatttcccggatcagcttcaccacgcccttaatcacctcgtgcgagggttcaaggaagccgtcccgctggtggaggtagtggatgtccgtgacccccaccagctccgcggcgcggcgctgctcagcgtcgcggagggcgatgatgtcggcccggtgcgccggatcgaagccgcctgcatcgccgtcggtcatgatgcagtagctcacctggacgccggcggccgtccaggcagcgatggtgccggcagcaccaaaatcgatgtcatccgggtgcgccgcaaaacagagcacccgcccaacccggtgttcgtccgggttgaacgggctctgcgcctgctggggaagggcagtcaaagggtcagccttttcgtttcttgatctccgcggtggcctgcggaaggacgtcgaagaggtcgcccacgatgccgaagtccgcgatctcgaacaccggggattcggcatccttgttcacggcaacaatgacctttgccgtctgcatgccggccttctgctggatggcgccggagatgcccgccgaaatgtaaagctgcggggacacggtctttccggtctgccccacctgcgcgtcgtggctgatccagccggcgtcggtggccgcgcgggaggcacccactgctgctccgagggcatcggccagttcctccaccggtccgaagtcaccgtccaggccgcgtccgccggctacaacgatccgtgcgtccgtgaggtccggccggccgctggcgaccttctgctcccgggccgtaatccgggccgcggcgctgacggcgggcacctcgaccgtgacggtctccagcgcagccggggccgcagcgggttcggggagcacattgttagcctttacggtcaacacgctcaccgcagtgccggccttgcaggcggtgttgtaggagccggctaggactgacttgtgcgcagtgccgtccgcatccacggcgacgacgtccgtgatgacgcccgcgttgaggcggattcctgcccgtgcagcgatttccttgccctcgggcgagttgtcgagcaggacgatatcggcaccggcctgcccggcggcagcggccaggtaggccgctttgggtgccaccaggaaatcatcaaggtcctcggcggagggaagcagcaccgtgccgacaccgtactccgcaaaggcggcggcgacgtcgtcgtgcagctttccgttgagggcaaccgcggtttccccgattgaccggcccagggtgagcagctcaaggctgctcttcttgagcgatgtgccggggttgtcaatgaatacaagtacttttgccatgtctgtggtccctcttagagcagcttctgggcggccaggaagtcaacgagcttgatgccggcgtcgccttcgtcggtgatgatggtgccggcggtccggggcggacgttcctcggcgctgagcacgctggtccaggaccctgcgtgtccaacctgcgccgggtccaccccgatgtcagccagggagagggtggtgatgctcttgcgcttggcagcgatgatgcccttgaagttggggtagcgcggctcgttgatctggtctgtcaccgagacgacagccggcagcggggcctcgactgtctcggaggacgtgtcggcgtcgcggcgtgcggtgagccggccgccgtcgacctccagcgacgacgcgaaggtgacctgcggcagatccaggcgctccgcaagctgcgcggggaccagcgaggtttccccgtcggttgatgccatgccggtgaggacgaggtccacgggcgcgccgctgcccaggtgccggatggcggcagccagcgccagcgacgtggccgcggcatccgaacccgccagggcgtcatcggtgaggtgcacaccttcggttgcgccgatctgcagcgccttcttgatggcattgacggcacccgagggacccatgctgagcgcgatgacctggtttcccgccttggctccgccacgggcttcggccagctgcagcgccgcctccagggcgtattcgtcaagctcggacaggatgctctcgtcccggtcagtcgtgtagccctcaccggtgaggtggcggtcgaactgggcgtccggtacatgcttgaccaggacgatgatcttcaatgaatcttccactgtatttacagcagccttccatgcttgtggacagccagccgggtgaggtcatggccgcggaatgccccggcattcgggtagctcctagctaaccatataggcgcgccccggcgccctcttccgttaacgcctgtgtcagcgctccctccggcaactgtccgctgcggatgcatcacgacggcggcgcccgccacgtggggggacgccgccgtcgtctgttcctgcctgttcaccttgccgggccgtgctaactggcggcggcgcccagggtgacgtcgaacgtctgttccttgccgttccgcaggacagtgatcttgacgctggacccggcgggttgttcccggaccgccgcggtcagctgttccggttccccgatggtgaggtcgttgaacttagtgatcacgtcgcccaccttgatccctgccttgccggctgcggaatcggcctccacggtggcgacgtccgcaccaaccgagaacccggaagaagcagtcgacgcagtcttcttcttgacgctgacacccaactggccgtgcgaggccttgccggtgtcaatgatttcctgcgccaccctcttggcatggttgatgggaatgctgaaaccgacgccgatgtttccgctggttgaggaggcgctcgatcccgccgacgcaatggccacgttgacgccgataatctcgccgctgctgttcaccagggcaccgccggagtttccggggttgatggcggcgtcggtctggatgacgttgatggagatctccccctggtccgccgtctgctggctctgtccgccacccgggggcgcgaactggaacccgccctcgtcgtcgccctcggcgttgtccccctcctctggggcggccgcggaggcaacactgatggtccggttgagcgttgaaacgatgccatcggtcacggtgccggtcaggcccagcggcgagccgatggcgatggcggtgtcccccacgttcaatttcccggaatcgccaagggtggcgggcgtcaggccgttggcgttgtccaccttgatcactgcgagatcagacaacgggtctgtgccaaccagtttggcggtaagcaccttgccgtcactggtccgcacttcaagggcagcgtcggccgtctggccatccagggtaacgacgtgggtgttggtgaggatatgcccctggtcgtccaggatgattccggagcccgtcccgccggaaccgccacttgaggcactgatggtcaccacgctgggcgacgccttctgggcagctgccgtaatggcgttgacgttgtccttgttgttgacgatgaccgtcccgggttggctgttgctgcttactgcggcacccgaaccggcgttgccgaacagttccgcggaaccgacggtggccactccccctcccaccagtccggccgcgaggatgctcgccaccagggtaccgacgccgaatgtcgctttccgccttggcgcgtccttggggctgggggcgaaggaagccccgctgtggacgccgttgccaccttgcagggtgttggcgccgtggtcctggcccgcgtactggttttcctgccggccctggccggcgtagccgtaacccgtgtaggacgcctgattcccgggcgcctgaggggcggacgggtcctgcccggccgtgtgctgcccgccgtagaagggctgccgctggggatagacgggacgctgggctccggggagttcctgggtggggttgctgccctgctgctcaatccgctcggtggggtactggcggcgaccggacccattcgctccgggatcacctgccggttgctcgcccacagccggctcctccgcctgtccggcgtgctgcccccagggatcctgccggtcctggccgctgttccgcgaagccggacccggcgtctggttctcagtcatgggacttcctttcatcctcgtctgcattaactatggactccctggctggaacaagctcggatgtttgctgagagcttcctgaggaccgctgctgcccggctgacttgccgcccggcgtttcgctgctggcatattcgcgccgatggacgggctgtggggtgcaccatagaatcaagatgaaatgccacagcgacctgcggcttcacaccaagcgtgggggcgctgctggattctgagacgactgattcgtcccgaatcggtgtcaggcgtgctgaagggttgcacatgcggtcaaagttcaaacgtatattcgccgtgatcggccttaccgccttcctggcgatgcccgccggcgcggcctgggccgaggatccggtcgatctggaccccgcaaccaaaattgtggatgatgccggagtccttggctcgcagaagggcgaggtccaggatgccattaagaagctcggcgcggaccacgccactgtgctgcacgtggtcaccgtcaagaggtttgaaaacccggcagaccgggaagcctggtcggacgctgtggccgaaaaggccaaccttggttccaacgctttgatctttgcggtagctactgagacaaggcagtacgtcctgaacaagggcggcagcaagatcacggctgcccaaatcgagaacattaagagcaaggccatcggtccgcagctcgcgaacgacaactatgcgcaggcagcaatcaacgcagcagcagcaatcggtgatgctgccggtggtggcagcggcaatgttcccggtgacggtgccggggctgcagttctcgtgggaacgggtgttgtagctgcaggtggcgccggcgcgtacctctacttccgcaacaagcgcaagaaggcagccgggcaggcagccaacgccagctacggcccgcagggcgctgagctcgatccgctggcgtcgctgagcatcgaggaacttcgccgcaagggaggctcccttctgattgaggcggacgatgccatcaagtccagcgagcaggaactcatgttcgcccaggcacagtacggcgattccgccgtcggcaatttcaccaaggcgctgaacgaagccaaagcccacctgagcgaatccttcaagctgcagcagcagctggacgatcacatcccggacactgaagagcagcagcggacatggctcggcgagatcatccgccggtcagaggccgcactgtcatccctccaggagcagaaggcggacttcgactccctgcgtgaacttgagaagaacgcaccgcaggccctggcagctgtcaacgcaggagcccgcgaggcagactcgaagatctccagcgccgaagagtccctcacctccctccgcgccaaatatgccgagagtgccctgacccaggtttctgacaacatcctgcaggccaaagaacgcctggcgttcgtccagaacgcaaccgccaccgcccagcagaagctggctgagggcgaggccagcctttccgctgtagcagtccgcgcagccgaagagagcctgcaccagaccaacgtcctcctggacgccatcgccaaggtttcctccaacctggatgaagcccggagcagcctcgagagtgcagtagtggacacctcccaggatctcgcgcaggcacgggccatgatccagtcgggcgcccaccccgaactggctggtccggtagccggagttgaaaacgccctcgcgcaggtcaaggcggagatccagggcgggaagatcgaccccatagccaccctgcagcgcgttgagactgcccaccagtcgctggaccaggccctcaccggcatcagggatcagcaggaacaatcccgccgggcgcaggcctccctccagcagaccatcatgtcggcccaggcccagatcagcgcaacctcggactacatcaccgcccgccgcggcggtgtaggaacagaggcacgcacacgcctggccgagtcgcagcggaaccttgactatgccctgtccatttcacgcaccgaccccgtgacggccctgacctacgcacagcaggcccacgccctggccgcgcaggcagcccagctggcacagaccgatgttgaccactttggcggctacgccaaccagggctacggccgcggcgggatgtttggcggaggcggcggaggcctcggcggcgccatcctgggcggcatcctgatcaactccatcctcaatggaggcggcggcgctggctggggcggtggccacagcgacggcggcggctggggcggcggcgatttcggcggcggagacatgggcggcggctggggcggcgactccggcggcggcggagacttctaggccacggccaagtacaaggccgcacaggccggcgccccctcacaagccacaacacaactgttcactgatttcagtggtcaccacagagcaggacgaaaggtagcaacatggttaagcagtccatctttggccgtatcgcgcagctggctaaggcaaacatcaacactttgctggacaacgctgaggatccccagaagatgctggaccagatggtccgggactacacgaacaacatcgctgaggccgagtccgccgtggcgcagaccatcggcaacctgcggatgctcgaggacgactaccgcgaggacgtcaagaacgcgcaggactggggcaacaaggcccttgcggcctcgcggaaggcggacgaataccgggccagcggtgacactgttgatgccgagaagttcgacaaccttgccaaggtggccctgcagcgccagatgtccgccgagaatgaggccaagggggcagagcccagcattgcctcccagcgcgaagtggtggacaagctcaagtccggcctggaccagatgaagggcaaactcaacgagctgaccagcaagcggaacgagctggtggcccggtccaagaccgctgcagcccagtcccaggtccacgacgcgatcaagagcatcgacttcatggatcccaccagcgaagtgggccgcttcgaggaaaagatccgccgcgaggaggccaaggtccttggccagcaggaactcgcagcttccagcctggacgcgcagttcaaccagctggaggacctcggtgagcaggttgagatcgaggcccgcctggcggcgctgaagtccggcaactcgtcaaagccggccctcggcgccgcaggttcggcagcaacagcctcaacggtggacgaggcagacttcgacaaactctgaacggcaggcgggacgtaccccctgcaccagggaaacgggtagggccggggccatcgatggccccggccctacccgttcctcccagtgtgtagcgtggatgtatggcttcccccacagagacttccatcgtctggctccgcgacgaccttcggcttgatgacaaccccgccctttccgaagctgccgcgctcggactgcccctgacgatcgtctacattttggacgaggagtccgacggcgtccggccgcttggaggagccacgaagtggtggctgcaccattccctcgcctcactctcgggtgcactggaagccaaaggctccagcctgctcctccgccgcgggccggccgaggagatcatcagggaactcgcagccgaaaccaacgcccgccacctgttctggaaccgccgctacggcaggccggagcgtacggtggacgccgccgtcaaaacgtgggccactgagaacggtattcaggcctccagctaccaggcgaacctcctgtttgagccctggactgtccagacaggcgccggcgggccgtataaggtgttcacgccgttttggcgggcctgccttgccggcgctgatatccgcgatccgctccaggttccgggaacgctgccggcgcctccggaccgaaccggcaacgcacaggcgggcgacacgattgatgcctgggacctcctgccctccgcccccgactggagcggcggactcgccgctgtctgggaacccggcgaggacggggcaaggcaccggctcgaagacttcctggacgggccggcagaggaatacgggacgggccggaatatcccgggcgtggaaggtaccagccggctttcaccccaccttcggttcggcgaagtcagtcccttccgtgtgtggcggcagatccgccgccgctatccaagcaaagtgcctgccgacgtcggcatcttccgttcggaacttggctggcgggaattctgctggcaccttctgtacatcaacccggatcttgccacccgcaactaccgtccggactttgaccggttcgaatgggagaagccgggcaaggatgagctggaagcctggcaacaaggccggaccgggtatccgttcgtcgatgcaggcatgcgccaactgtggcagaccggctggatgcataaccgggtggggatggccgcggcgtctttcctggtcaagaacctcctgacggactggcgcgtcggggaagcctggttctgggacaccctcgtggacgcggacgcagccagcaatcccgccaactggcagtgggttgccggctcaggagcggacgcctcaccgtactaccggatcttcaaccccgttacccaaagcaagaaattcgacgccgcgggcaactacctgcgccactacatccccgagctggcggaccttgacgggaaggccatccacgagccctggaaggcgggcgtggaactggacggatatccagggcccctggtggacctgcccgagtccagggagcgggccctcgaggcctaccagaagctcagggacagctgacccgaccagggcacaggcggccggctcccgtcagcggctgaccttacccatcaggaaagcgatgggccgcaggaagagcgggcgggccaggaaccatgcggccaccatgaccacaaccgaggcgaggaaaacccagaacccaaaccacccgtcgtcgtcgcgcacgccgtacatgtggttgaggttccgcagggcccccgtggcgagcaccaggaagacgtgcaccgcgatgaaggccacgaagtaaatcatcacagggtagtggacggcgcgcgcccattcgatggggaatgccttgttgaggccggcggctttcttgggccaggcaccagacatgcgcaggcccgtgacaaacgccagtggagcggcaatgaagacagtaacgaagtatgagagcaactgcagggcgttgtagttgacccagccgttctcggtgggccagtccagggatgcgtactgcagggccgccgaaagggcgttaggaatgacgtcccagctggtggggacaatccgcatccactggccggtggcgaaaagcaggaccgcgaacaccaggccgttcaggatccacaagacatccagcgtcaggtggaaccacagctcaaggctgattttggtgggcgggttcttcgtcttgatcaggcccttgttgttccgggtccagtgtccgctggggcgggtggtagtccgcacctgccaccccgtgcggatgatcagcagcaggaagaacgcgttcaggaagtgctgccatgcaagccaggcaggaaagcccacaggagcgttgtccggaagctctgagtgtcccggatagtccgctacgaaggaagccacggcaggcagccccatcagccacttggcgaccagcaccaccaggaccagccccccgaggacggcaggcaccgcccagtagagtcgcgaccgcttacccgccgcggtacggggcttcttcgtgggtgtggacatcgaacaacattcctctcgagaatgactggccaagtgctcactacgtgtgaggctctgcgaaagagaatactaggaactgcacgtatccacggaaaaaagaagaccccggccggctgtaggccggtcggggtcttcacatagttgcggggacaggatttgaacctgtgacctctgggttatgagcccagcgagctaccgaactgctccaccccgcgtcgctgaaacaacactaccctagttttccggcttcattttccactccgggattttcccgtcggatatccgggaagccccgggcttaaacgaaaacatccggacactctttccagtatccggatgtttccttcagttgcggggacaggatttgaacctgtgacctctgggttatgagcccagcgagctaccgaactgctccaccccgcgtcgcaagaactactttaccggcacgtgaacaccaggccaaatcgcgaaggcgtgatctccgtctcgccaacggaaacggcacctgccccaaaggagcaggtgccgtttaccgccgtcgtaactagctggtggctgagggtgacgggctcgcttcaggtgcaccggtggctgccggcgccggcgtggcctcgggtgcggcgaccgggatcttggcttccgcagccacggccttctggagggcagccgtgatcctcttctgcgcttctccataggctgcgaagtcccctgcggcaagagccgactgtccagcctggatcgccgcattcgcttcatccagcgcggccttcagctcagccttggcgtcggctcccgcaggcgttcctggcgcagccggatctgccggggtctggccgttgttgtccgaatcgcccgcggcagctccggagtctcctccgaagagttgcttcagtgcctcatccagggtgggagcgaagcccaccttgtcgccgaaggccaccaggactcgctgcagtgtggggtacgacgtctcgccggtcgacttgaggtagacgggctggacatacaggatgccgccgcctaccggaagcgtcagcaggttgccgttgagcacttcggacgctccctggcgcagcaagttaagggcctgcgacaccgtgggatccgagttgaacttgttttgcgcctggccaggacctggcacctggatctccggcgggatctggagcagccgcaacttgccgtagctctcagccttcacacccgcttcgttgccggcatccgagtcagcggccaggaagccatagagcacgttgcgtgcgttcccgttgacaatctgcggaatgaacgacgacgtcagctggaaggcgggcttgtcctggtccggcatttggagggacatgtagaacggcggctgcttaacgccgctgttcgattcaacggtgggatctgccggcacgctccagacatccttggtctggtagaaagtggacggatcggtcacgtggtactcccccaggagctggcgctggaccttgaacaggtcctccgggtaccggacgtggctcatgacatcgccggacatctccgagaacggtttgagcgaggtggggaacaccttctgccaggacttcagcagcgggtcctggtcgtcccaggcgtacagggtgaccgaaccgtcgtaggcatcaacggtggctttcacggagttccggatgtagttgacggtgctgttgggcaaggcaacggcgcggccagacgtggtctgggtgtccgccgtggcgtcggagagccgctcctgctgggagtacgggtagtactggctggtggtgtagccgtccacgatccacttgacgcggccgtccaccactgccggataggcattgccatcgacggtcaggtacggggcaaccttctccacgcgttcacgcggactgcggtcgtagaggatctgcgactccgggttgacgccgtccgaaagcagcaggtccgaggactggaacttaatggagtacagcacgcggttgaagaacgtacccacgttggggccgccattgccttcaaaggtgtactggttgtccccctcgccttccctgcccgacggccggtcctgctcacgcgcaggggcaccgtccggcgcgccaacgatcgagtagtccggcgaggattccccgaagtagatccggggctcgtaggttgaatcgtcgcccaggacacctgttgacggaatacccgactgcaggaactccggcttgccgtccacggtgaacttgttgccctttgcagccacgacaccgtagccgtgggtgtacacaacgtgctggttgagccagccctgctggttggttgccacgttggcggggttgagttcacggactgcgatcacggtgtcctggatcttgccgtccacctcgtaccggtccacgttgagggcttccgggaactggtagtacgggcggtactgctcaagctgggagaacgcatccgaaatcaggttcggatccagcaaccggatgtttgccgtggtctgcgcatccggggccaaggccccggtgctggctgtgttggtggcgtcataccggtccacctggatcttatccaggccgtaggccgcacgcgtgttgtcaatattgcgctggatgtattccttttccagcgtctcctccgagggacgaacctggaactgttggatcacccaggggtagacaccgccggccaggatggacgtgatgaccagcatcgcggttccgatgacaggcagccgccatttgccgatgatggcagcgaccacgaacaggatggcaacgagcaccgccgccacggcaaggatggccttcgtggggatgacggcgttgacatccgtgtaaagcgcacctgcccagcgtccgctgttgctctgcactgcagtgaaccgatccagccagaagttgattccgaggagcaccaggaaggaagcgccggcaactgcgatatggatttgcgcagcccggctggtgaagacgccgcgttccatcaggcggatgctgccgtagaggtagtgcgtcaggatgcccgcaatcccggcaatcaccacaacactgatcaggaagccggttacaaagccgaggaacgggagcgtcatcaggtaaaaactgatgtccataccaaattcagggtcttcgtttccgaagggctcctggttgaagaacagaaggaccttctgccactggctggcggcggcactgccggcgaagagcccgaagaggacgggaaggccgatcatcaccacgcggcggacgggttccagctgcgcctggtagcggttcaggttgtccctgatttccgagtcaggggcgtataccggccgggcgttgtacgcgatgcggatcgcgaagaacaccgccaggaacatgatggcgaaacctgcggcgaagataccgatccggaccaggttctcggtgacgaagacctcgataaagcccaactgccggtaccagaggacgtcggtccagacgttggcaaagaagatgaagcccactaccaccagggcaacaacgatcaaggtgggcgtcaacgccccgcgtcgtgaagggggtctgcctgtggacatggtgctggcgggacgggacaaactgggtacctcatagctggtcgtcagataaatcagagcgtgagtgcgggcgacgtccgggaccgatcaaacggccggtttcgtccgtcatatttgccacgagtggcggtggagcttagttcctgtcgagtctagttgcgcccagtctagttgcccgggcacgccggaaggccggacgtgtcctgaccgttacccgcacgttcgacggcgtcgcgcgcctccgccagggtctctacccggactacctgcagcccatcggggatgtgccctgctacttccgcgcagttggcggcgggcgcgaggaacaacgttgctcccccggcccgggccccctgcagtttttgttcgatgccgccgatggggcccacgaggccgtccggggagatggtgccggtccccgcgatgtgcttgccacccgtcaggtctcccggtgtaaccgtgtcgatgatccccagggagaacatcagccccgcgctggggccgccgactttctcgagcgagatctcgacgtcgaaggggaaggtgaacaggtatttgagcattactccgaggatgaagcggccctcgccattgtccttgggggtgatggtctcggtgacggactgcccgccacgctccaccaccacagagaccggcgagccgtttcccgcagccagttcttcctggacgacggccagcgaggtgatgtccttgccgttgatggttttcaggatgtcgccgggctggatcttcccgtccgaggctgaattctcggagaggccggctgcctgaagctgctgcccaaagggaatatccagctctctgagggcagaggctacggcgttctcctgcgaagtggtcatggccacggaactctgttcctcggcctcttccctggtggttcccgttggatagagcagttccacagggtgtacggctttggcagggtcaacccacgcggaaaatgcatcgaggatgctgaccgggccgttggggccgccgtccacgtagaccgtggtcaggtccaggtttcccttggccgggtaagtttcccggccgctgatggtgatgaccgggctcccctggctttcacccagggtgttgtacgtcgggccgggcgactccacgacataaggaacgggaagggtgcccactgcgattcccaggcccagcgccgacattcccgcgagcagcatcgccgacactttcctgtcccggggagcgcgttccggggcgggcgcaccgcccgccgtgccgtcgtcggccctctctccatgggcggacgtgcccggcacgcgtgattcacctgtttgtgcgggcaggccgcgggtgaagagctcaggagcgtggtcctctgaggggtggccgccacgggttgtagtcacccaactaagactacgcggtgccggtggatgccagctctttgcctagagcgaacgacgacggcgtccggcagacagccgaccatggccggggtaccgtgaaggttgacagccataccgacgatcggcgggatcatgacctccaatccactcaatccgtccaacggcgacgacacccccaaggatccgttgaccgaaatgctgcagaacctgatgggcggcaaggggatggagaatttcgaccccgccgaactggccaaggctgcggggcttccgaacgaccccaacctgctggcgcagatgttttcccaggtgcaggcaatgatgagcgccccttcggaggggcccgtcaactggcagcttgcccacgacaacgcccgccgtgttgccgccagcggcagcgacccgtcggtgacgtcccagcagtcgcgcgaggttgatgaggccctgcgcctggctgaactgtggctggaccccgtcacggaccttcccgctaccgggctgatcggccgcgcctggtcccgggcggaatgggttgaagccacgctgggcacctggaaacggctgaccgagccagtggccaacagcatcgcgaatgccctctcctcggccatgacggagcagatgccggaggaaatgaagtccatgatgggcggggcgtcctcgatgctccagaacatgggcggcgcgatcttcggcatgcagctgggtcaggccattggtgccctgtctgctgatgtggtcagctccaccgacatcggggtccccctcgcggacctggagatggcgctcctgccggccaacgtcgcggcgttcggggagggcctgtccctgcccgagaacgacatccggcttttcctcgcagtgcgggaagccgcccacgcacggctgtttgtccaggttccgtggctccgcgggcacctgctgggtgccattgaggcatacgcccgcggcatccacatcgacacctcacgcatcgaagaacttgcacgggaccttgaccccagcaacccggaaggcatccaggaggccctgtcgcagggcgtcttcatgccgcaacggacgcccgcacaggaccaggcccttgagaagcttgagaccgctctggcccttgtggagggctgggtggacgagctcacggccgcggccaccgagaagctgctgccgtccgcgggcgcactgcgggagaccgtgcgccgccgccgggcaaccggcggtccggcggagcatgccttcgcctccctggtgggcctggagctgcggccccgcaggctgcgcgacgccgccacgttgtgggccaccctcaaggaagagcgcggcatcgaaggccgggacgccatctggcaccacccggacctgctgccgacagccgaggacctggacgatcccaagggtttcagcgcgcgccgcaaactggcggaggccagcgacagcgaagtggacgacgccctgcagaagctcctcagcggcggcttcgattccgcaccggaggcggaagaaggcactgacgccggcggacaggacggcactgccgacactgcaaaggacgacggcgggcgtccggacgagggcaaggacaacaaagacggccaggacggccagccgaaaggctaggacgccgccccggcggtggctgtttccaggacggattcagtcggcgtcggggtcggccatgccgcgtccggtggcaaaggagacgccctcaaggaacgctttggcccgctgcgtctccggataagcctcgagcagctgccagaaggcagagttgtgcgcagccaccagcaggtgggcaagctcatggagcaggacgtagtcgatcacccattggggcatgggacgcagcttgtccgagagtctgatggttccctctgccggagtggcagaaccccatcgcgagttctggttgctgacccagcgcaccgacgtcggtacggcccgtccccccaggtacttggcagacagttgggccgcatgttcggcgagggcagcgtccgtggcggggcgcctcttacccgctgccgcccgccgctccccctggcgctgcagtttggccaccatcttgtgtacccattcagcctcctgggcagcagtgaaccggtcgggtatcgcaaccaccgcagttccgttctcccaaaatgcggctacggtgcgggtgcgccgggaggaacgccgaaccacgacaggcgcaccgtcctccgtggtgatggaagaagcagccgccaccggatgcctcgcggagtggccggccattacagggatgtgctttccgtcaggacacgcaggacgtcttccccataccgttccagctttgcagggcccacccctgccagccgggcgagctcttcgagtgacgcgggccgtgcttcggcaatggctgtcagggttgcgtcggtaaacaccacgaatgccggcacctcggcagagagggcaacttcacggcgccagttccggagagcgtcgaaagtttgttcctcgtagcccggcggacaggagttacaccggcccactttgcgttccgcgccggtgccgagcatgcttccgcagaccctgcacatggcgggagcggcggctttcctgcgggtcaccgtcaccttcccccgggtgcttgaactggccacggagtcgggacgcagcccatcaaggaaccttgagggtttgcggttggcccggccgcccggggtccgggcggtggaccatgacagcgacaggtgttcacgggcgcgggtgattcccacgtacaggagccggcgctcctcgtccaccgattccggggagtcggcaaaggaaatgggcatcagcccttcactgaggcccaccaggaacacggcgtcccattccaggcccttggcggcgtggagcgaggcaagggttaccccctggacggtgggggcgtgctgagccagggaccgttcctggagttcgttgacgaagtcggcgaggctgaattgtgcgccccgcacctggaccagttcatcggcaagggcaacgagcgcggccagagattcccagcgctcccggagggcgccgccgctgtgcggggcggaatccgtgtagccgagcgaggagacgatgtcccggaccagttgcccaagcggctgcggggagtccgtttccgcgacagcccgggttgctgcgcgcagctgcaggatggcgtcgcgcacctctttgcgggcgaagaaccgttcaccgccgcgcaactggtagccaatgccggcagcggccagggcctgttcgtaggcctcggactggccgttggtgcggaacaggacagccacctcgctggcgggtgtaccgtcgtccagcaatgccttgatcttttgggcaacagtggcggcctcagcctcgtcatccgcacattccgtaaactgcggcgccgggcctgcgggccgctgggccacaagctgcaggggcgaagcccaggcggcgtcggccacgggaccgccgctgcgcctgcccgccaacaggtcgttcgcgagcttcaccacctgaggcgtggagcggtagtcccggatgagtttgaccacgttggccttcggatagcgggctttgaactccagcaggtgtttgggggacgcccccgtgaacgaatagatggtctggcttgcgtcaccaacaacgcagagctcgtcgcggccgcccagccagagttccaggagccgttgctgcagcggggaaacgtcctggtactcgtccaccacgaagtggcggtactgctcccggacggtggccgcgactttctcgtcctcctggagaattcccaccgtgatcagcaggacgtcctcgaagtcaatgacgttgcggtcggtcttgacgtcctcgtaggactggaagacccgggccacggcggtaaggtcgaagccccccggggcacccctgtcctgcgcgttttccaagtagtttgccggcgtaagcatggacaccttggcccattcgatctccgaggcgaggtcacggatggatgccctgtcggtgctgagccggagccgccgggcggcctcggccagcatctgggctttgtggtccaggaggttgggcagggtaccgccaacagcctgcggccagaaaaactgcagctggcgcagcgccgcggcatggaaggtgcgcgcctgaacgttgcctgctccaaggtcacgcagccggctccgcatctcggcagcagcgcgggccgtgaaggtcaccgccagcagccgctgcggcgagtagacgccggaatggacgccgtaggcgatgcggtgggtgatggcgcgggtcttcccagtccctgcaccggccaggacgcacagcgggccgttcagggtgctggccacctcccgctgctccgcgtccaggcctcccaggatgcggtcctcaagggatgctgccccgtcaaaatgttctgtagtcacttctgctgctctttgtctcgactaccgcgtgctggagtctggtgaattcgtggtgggtcaggcctcggcccggtcctggatgcgtccgccataccagtgctcaatcaacgagcgggcaatggaaagccggctggaaatggtgatatcgccggcgagcacagcctcctggagttcctcccggctgaaccagcgcgccctggtgacctcaacgccgtcgggccttgcctcggcgtcttcggtgacggcggtaaatccaagcataagggaggccgggaacggccacgactgcgatccgaggtactggcatgcggacacgcggactcccacctcctcatagatctcgcggacaacggcctgttcgagtgactccccgggctccacgaagccggccagcgtggaatagttcctggcgtcccgcggaccgccgccgcccagcagcagccgcccgtcagggcccaccacggtgacgatgatggccgggtctgtccgcgggtagtgttcagaggagtctgcaggacaccggcggacccaaccgccggcctcgacgtcggtgggggtcccgcaacgcgggcagtgcgtatgcccggcgtgccagttggtgatggcgctggcctcaacaaagagggcggtgtgcgttgcactgagcccgccagcaacctcgcgaaagccggcccagcgggcaccggccgggatcccggcggtgcccggggcaacttgctccggcaggacatacagcaggagcccggttccagccggcagatccgagtccggaagcgcggagcccaggtaaatgacgagttccggcgccgacccggctgcagtgagctcctggagcagcggctgcgcggcaaccgcgcacaggccatcaccctgcacgaggccctgccgcccggacagcacaactgccagcgttccgggcctggccaattgttcatccacaattccgggggccgtccggacggccgacccgcggtcgaccagcgccggccttacgggaaggagggtgtccatgaggtggttcgcaggcagcgttgccggctgcccctggtagaccggtgtaacagactccgcatggctcatacatccaccgtactgactggggctgacaattgacatttccagcctggctcacggcaacaccaatccccctatttgcaggtatctcaagactcgccgccgccggaccggcttcccggcccgcaggcaatctaccgttgaaaggtgagaagaaaagcgattgaactggcagccgttgcaaccgcggcagtccccgggctgaccccgacggcagttagctctgccccggacgaccccgcggacttcgactcagcgctgctcctcgactcggaagggaagcgctggcgggtcaggtcgccgcgccacgccgaggccagcgcccggctcgaaacagaattcctggtgctgcgcgccttcgccccggccatccgcgccgagctgcccttcctgatgcccactgtcgccgggagcgtgcgcctgggaagcctgagcacgttcgtctactcgcatctgggcgggagtacccgcagcgtcgaggaactgacggcggggccggatgccctggcccgggaaatcggcgtggcgcttgcagccattcacgatctgccccgcgcgatcgtcagcaacgccgacctgcccagctacacccctaacgaattccggcagcgcaggttgaacgagctggaccaggccgccaccactggaaagatccctccggccctgctgctgcgctgggagcacgcacttgaggacgtgtccttgtggcgtttcaatccctcggtggtgcacggggacctgcatgaggacaacctgctcgtggagggctcgcgggtcaccgccgtgaccggctggaccgacctccgcatcggcgaccccgcggacgactttgcctggctggtggcgtccaacgagcaggacttcgtggacgccgtcctgggcgcttacaccgctggccgccgcgacaagcccgacaagcacctgcttcggcgggcagcgctgtcagctgaattcgccctggcccagtacttggtcaagggcatcgcggccggcgacgccaccatggtcgcggaggccgaggagatgctggccaccctggccagcgacattgcagagcacggcgggcagcccatcagcgttgagccccttccgtccgcggcggctgccaccgtccccggcgcggctacgccggtttccatagaacatgctgcggggtcaggggctggccccgggttacgggcggccgacgacggcgtgccggccgcggtgcctccggtcaccgtctttccggtaccggcggtccagccggccgtgcacgtgacgcccattcccgtagatccggcaccttcgcctgcacctgcagctccccctgccggcactgaaggtggcgccggcggtggaagcagcaccggcccggccgatggcacgaagaccgacgcccctgacgcaccaggcggtccggatgatacgtcgacggccgccctcaccattgttgacgccaaaaagcgctagccgcggggcgcgagacagctaaaggacgtccacgacgcgcctttcaggcagaggcgaaggcagccgccaccatctcctccagctggtcagcggatgcgaggtcatgcggccgcacgatctcgttgtccgcgacgtagaagaaggccgcccggacatcctccagtggcacgcctttcagccgcgaccacgccagccggtatacggcaagctgcaccgcccgggtccgcaactggggcccggacggccgccgtccggtcttccagtccaccaggtcccagcggccgtccgcgtcctggaagacggcgtcgatccgtccacggaccacaacgtcccctacgcgggtctccaccgggacctcaacagaggccggggagcggtgggcccatggggaggacctgaacgtggccaccatggcgtccaggtcatacgccgcatcgatgtggtcatcggagcccggcgcctcgccgaggtcgaacatgcctgcactcccgaagtactcttccacccacgcgtggaaagctgttcccttccgtgccgacatgcccggttcacgcggcaccggcctacggagccgccagagcaccgcctccgggtcttcgttgaggtccacaagtgtggatgcggaaatatgggtgggaaggtgcacctcctgggcggacgacttccttgcccggcgttccagcagcagtgctgcttccctcgcccagccggcagccggaccgctgagctgcggagccgggaccatcatggcgttgtcctggccggacagagcattcgcgtgcgctccggcgcccggcaggggcagtgcccttccatggtgcatggactccagggccgctgccacccgggcggacgcccgttccatggcatccctgcggcccgtggcaaggcggaggcgcccaccagtccggggatccaacggcccctccaacggatcgtagggccagccggccacctccacatcgagggtcagcgggctggcctccggcagggaagcttcctcaaccgaccgcggatggatgtctgcctgcactggaagaccttcgcgggccggtgcagccaatggctccagctctgccaggaacggtgacatgtcagcctgcccggacctcgaccctacccaggctgcactggacgaccagaggacgtgcttggcccgggtgtacgccacgtaggccaggcggcgttcctccgactccccgtgcgcctggacggctgccttgaagtccttttccgcgtccagccatcctttttggtccggctggtccaggtcccactggggcaggtccgccctgtcaccgcgcagcggccagggcagggccgcggatccgctgctccagcgtgagtcacggtcgctgggaaaatccttggcattcaggcccggaacaaagacaacatcccattccagccctttggaggcatgcacggtgagcagctggaccgcctcacggttgacatcgcttggcggtgcttccaggccgttttcttcagatgatgccgcttccagccaggacaggaaggcgaggatgtccacgcgctgggaggtgcgcaggaagccggccgctgcatcttggaaggcgtcaaggttccggcgggcctggtggatgctgatgcccggccttgcggctacctcgatatcaaggagcatggccctttccacttcgcccagcagcgtggtgaggtcgtcgcccaggtaaccccggagctggcgcagctccgccgaaagccggagcatccgcccgcgcgcggccggggtgagggacctgccgttcgatgaagtccatccctcccgcggcagccagtccaaggcttccaccaggctggcggcgtctgtcaggtcgccttccaggacggccggttcggaatccgggacggtgtcatcggccgctccagcctggccgcgtcgccgggcgagctggctggaccagtccctcagcgccatcagatctgccgggcctatccgccagcgggcccccgcgagcaaacgcatcagtgcgtcggagcggccagggtcggcgaggacgcgcaaggtggccaccagatccacaatttccggggtatcgaggaggccgccaagcccgacgatctcataggcaatgccgcgggcctccagctggcgccgggtgggttccatttgcgcacggcgccggcacagcacggcgatggcgggcggaaccggggaaccgtcaggcttgagctcaaagtccgtcacacggtatttcaggatgtcttcagcgagcgcggcagcttcgtccacatcgctggcaaacctgcccagcaccacggatccggccgccgcatgcgggctgggctgcagcggcggcacttcgggcgctacggaccctcccccgccggcagggccgcgctgcgcagccgcccggcccagggattcggacatgacgttggcggcggccaggatcgagcggccgttccgccacgcggtcgtcaggtaggacgtcggcgcaggagcccacgtcccggcggcttccgccgccccttcctccgcggcgccgtcctccgccgccccctggctggctgtctccagcctcaccggaaactcacggacaaaatggaagagctgcccggccgaggcaccacggaatccgtaaatcgactggttgggatcgcccacggccgtcaccgcatgtccgccgccgaagagcctcgaaaacagtacgagctgggcgtgggacgtgtcctggaactcgtccagcagcaccaccttgtagcgctgccgctccatccgggcagccagtgggacttcccgcgccactcgggcagcgagggccaccaggtcgccgaagtccagtgcaccccgcgcccgcttggccgctgcatagcgtccaaccatgtcagccacacttgccctggtccgcagcattccggcgagatcggccgccgcctgcggggggttcttctttttgtcggcaaggtaagggagtgattcgaagtctgacaaccgcgccatcagccaggcttcgacgtcctcgggttcctggaggtgctcggcgcattcaccggccagctgcataaccgccttcaccagcgtggacttggcagcccggaaatgcccgtattcgccgtcgtatgcctccacgacctcactggccagctgccaggcctgtgcaccgcccagcaggaccacatcacgctccacccccagccggagcccgtagtcggagacgatgccgctggcgaacgaatggtaggtggaaactttcggttccagggcgtcgctgctgagcagtccctccgggaaaaccccgtgaccgttaccccgggcagccttgtcctgggcaaccaggcgctggagggcagccagctttgcacggatgcgtgacgccagttcaccggctgccttccgggtaaaggtcacgcccaggacttcctccggcctgacccacccgttggccacgagccacaccacgcggtccgccatggtggccgtcttccccgaccccgcccccgcaatgaccagccgcggggtcagcggagacgcaatgatcgccgactgttccggagtcggcacgtttttttcacccaggagcacggaaagctcttccgggctgaaccgcggctggggcggggtggcggcagcggctacctcgcgggcagccacgcccctggcatctgaaggcccggcggcaagggtagcctcctgctcttgcacgtcctgcatcattcagtcacttgccttccacgcacgcacaacggacagacttcggggagccggcagccgtggccgccgtggctgcctttggatggatcgtgccgtgcttcgaaggcactgcctcccattaccgaagctgcatccttcaccatgtccagggcccagttgtcctgctgatcgatcgggtcctgctgctggatggccggatttttcgcgccggttcccagctgggccagcactgccccgccgggtaccgggcccgcctggctgcccggaccgtcgtcgaacccgccggcgagcaccgcggcctggtaggcacccagctgcggatgccgcgccagctcccccttgccgggctggcgtttccccgtcttcagatccacgatcaccagcctgccttcagcatcgatttccagccggtccacctggccgcgcaggaccgcgtcacggtccggggcatcatcaacggggaccgttcctagcgccacctcgaaatcctgctccacgcctacgaggctcctgccctcgctccgcatcaggaggacatactgggccagtttgcgcaccatggactcggcacgctggaaatcaagcctgccctcccaattgtccttcatgcccagcgcgggccagcgccggacgagttccgcgacgtactcggagccggacgcgtccggcagttcctgggcaatcgcatggaccagggtgcccaggcttcgggcgaagtcggtagcagcttcgcctcctgcggcctggacgaaccagtcgagcggtgatttctggactgactccacttttgacggtgaaacgaataccgtaccgccgggtggaaccactgccgcttcggagctcagcggcggaagaccccaccagctctgcggatgcgcgcccggaaccggcggctccgccctggccaggcgtgcaagcaccctggccgcttcttccgcctgcggagcgtcccttccgtccagctgggcgtgctgccgcagttcggcaacaagcgcccggagcgtcatggggcgctctactgcagtgaagccccgggtttcctggcccggggccaacggcgccacatagtcgaggaaagaggacggctggtcgtcttcggaggatacggcggtgcagaccagcagttcgcgggcgcgggacactgctgtggagaagctccggagctcgtcataccggatatcccgaagccggctcaggggatcccgttgcagggcgtagcctgcgccgtgctccaccgcgtcgctgtacagagtgcttcccaggagctcgccgcggagccgggtgttgggccacacgccctcctggaggccggcaacaatgaccaccggccattcacgtccggctgcactggcaggcgtcatcagctcgacggcgtcatccacctgcgcgcgggcggcaagggtgtccatgggcagctcctggttcaggagatattccaggaactgctcggggcctgccccgggcatctggtccacataccgctccgcggtgtggaagagcgccatcatggcgtccaggtcgcggtccgcgcgcgccccgtgcggtccgccggagagagccgtctcggtccaggagccggccagcccggtggagttccacagtgcccagaggactgactcagcgttggcgccgggttcagcagccgcccggctgcctgcctggatcatgcgtgccgcccggcgtgcggcacggccctcgatgccaagggttgacagcgcgccaggctccagcagcgcttcgaccagcagtgcgtcgctggtccggcctccgccgcccaggatttcttcccttcttaacgattgccgcagccggcggagctcgatggacgttgccccgccgatccgcgaggtcaggagcgatactgcggcctcgggggtgagcagtgccgggtccagcgcgatggcgaaggcatcaagcagcggacggacggccacctcgtcccggacagcggactcggccaccgggacccgcacagcgatcccctggccggacagataacgctggaactcgctgacctgggcgccgttgcgcacaatgaccgcgaggtcggccaggtcacggccgtggttgatgtgctggtccaggatccgctgggccacgtaccgcagttcgtgcacggcggacggaacaaggtgtgcttccactgccccttccggtctgtcgccgccgggctgttcgaggcgcctggccagctggccgcccgcccgttgggagatccgtccggcgacgctcagccaggcttcggcaaccgaggacccctgccggtgggcatgccgcaacggacgctccaccacgggcgcccccggcgacagcaggtgcggcagctccgccaccaggtccggccttgccccccggaagccctggacgacggtgtccgggcagaaggccacgaaggagtccttgccgccggctatatcggccagcagttcaaagactgcggggttggcctcctggatgtcgtccaccaggatgacctgcaggcggtcccgctccgcggccaggaacgcaggaacatcctggaagacctgcctggcggccgtgatgatcccggcggggtcgaacgcctcaggcattcgcaggtccaggacgtcccggtactccgaatacagcgcagccgcggcaagccagtccggcctgccacagtcacgtccgagccgcaccaggtcatccggagtgcgccctgattcaatgatccggtcaaacaactgccggacttcctgccgaaaaccgcgcgtttccagcgccccctccatatcggcaggccagggcagttccaggcccgggatccggtgtccttcaaggagttccttgatgatgaggtcctgttcgggaccggagaggagcctcggcggcctggacaaggaaaggagcccttcagctttggcgcgcctgatgacatcgaaggcgtaggacgcccaggtacgcgccggcgttgtgctcaggctcctgtccaaccgtgcggtgaagcggtcacgaagggtgtctgccgccaggcggcttggtgccaggatcagcatgcgctctggatccacgccgtcccggaacgccctgcggacggcggcctcgacgagggtggtggtcttgccggttcccggagctccgggcatcagtaccggcccggatccctgggggacatcaaccgcggcctgctggtccgctgacaggaggggctctgccgcatggatgtggcggggcggcagcagcctcaggcctgtcgcggccgggctcccctgattgcggtccgcgctgcccgctccaggacctgccgttgcgtccgcatcaagtacagggacttccagggaatcatcccggtactcgtcacgtgggccggtgaagggcgttgttactgtcacacagtcattccatcatcagccaccgacaatccatgcagccgccgctccagcgcctcggcaacagcatcaatcacgtccagttcatcttcggcgggcgcccaccgagcggccggaagatccacgcgccagcgtccttcccgggtccgctggtattccgtgtaggcgcccagcaagggtgtcccctcggcaaggtagtggcggagggcctcagcctcgtgcccggcaggtgcatggccgctcgccttgaggatccgccaccagggcacgccgctcccgtagtggctcatgacggcacccacctgcctgggaccgccggagcccaggagctcggcaacgtcgccgtacgccacggcggatgcggcgggcaccagttccaccacggccagcacagcctccacgtactcaatccgcattgatccaatctagctgcagtggcgctccacggaattgtcagtggtgccctttagcgttgagatatgagcacctggaacaccctcccccgcgcagccttcgacctggaaaccacgggccgcaactcgcgggcggcacgtatcgtcacggcgtcggtaacggtggtggaccaccacggcgatgtcatcacggaacatgagtggctggccgaccccggggtggagattcccacggaagccagcgacgtacacggtgtcaccaccgaaaaagcccggcgggagggcaggcctgcacacgaagtgacgcgggagcttgccgcagtcctgcaggacctttttgatacgaacatcccagtcatcgctttcaacgcaagctacgacttcactgtcctggctgcggaatcggcacgctacggcgtgccccagctgagccgcttcccggtcctggatccctacatcatgaacaagcaggtggatcgctaccggaaaggcaagcgcaccctgacggcgctgtgtgaagagtatggtgtggtcctggacaatgcccatacgtctgcggccgatgccctggcaacgctgcgggtcctggacgccatggccgggaaatttcccaagctgatgatgcccgcgagccagcttcaccagctgcaggtggactgggccatcagccaggcggcagacttccagggctacctccggaagaccaagccgactgccgtcattgagggcgactggccggtgcttccaccgaaggacgcgagcctcggcggcttctgacatactgctgccgcgccggtgcgaggcaagtcacagtaacagggcttcatataaccgggcagaaaactacctcccgcattcggcaaacccccgcccatagcattgagtctgagcgtattgccctccaagcactgaataatatttgctcatgagtgcatccggggtgctttcgtttgaatcatcaccgaaaaagtgcagatgagagaataaagttttgcggtcacccctgcctcgccgtgcttgaacagcgccgggcaggtgccaggcgccaccagcgcagcctcgcggccctgttgactaatgactcagatgaaagcgacaacttgatgaaaatcaaagcgatgaagtggctcaccacggctcccgtggcactcgccctggctgtctccctcgccgcgtgcggctcagggtccgccgagccttcagggacacccacggacgccctcgccggcagcgaccagcagacgctggacaagtacaccaccgccgacgtgaccccgatcgaccagattgacacgacccagctgggcctgaataccgagggcaagcttgaggtgggcacgctgtccgacgccccgccgaacatcttcatcgacccctcgggcaagttcacgggctacgacaacgaactgttgcgcgcgatcgccggcaagctcggccttgaggtcgaattcgttgccacggacttctcggcgctcctctcccaggtccagaccaagcagttcgacgtcgggtcctcctccatctccaccacggacgcccgccgccagaacgtcggcttcaccaacggctacgactttggcttcatggccgtggttgccaagaccgacagcgacgtcaagggcttcgacgacctcaccggcgacctccgcatcggcgtggtacagggcaccgtccaggacgattacgtcaccaacaccctcaagctcgagccgatccgcttcccggattacgccaccgtgtacgccaacgtgcgcaacggccaggtggacgcctgggtggcgccgtcccagcaggcaaccggccaggtcaaggaaggcgacggcaccgtcatcgccgaatccgtcgtcaacacgcagaacttcactgcctacgccgtggccaaggacaaccagccgctgatcgatgcgctgaactccggcctggacgccgtcatcgccgacggaacctggtccaagctgaccaaggagtggtacccggaccgcgaaatgccggccgactggaagccgggcagcaaggccgccacggttccccagagctgattgagccgggacgtatatggatctcctggaccagcttgctgacaccttcttcaactgggaggaaatggccaaagtcattcccgccctgctcatggtgggcctgcccaatacgctgatactggctgtagcttccggcatcttcggttccctgctgggactcgcgctggccatgatgggcatctcccggaacgcgggagcccggtgggtggcacgtatctataccgacatcttccgtggcctgcccgccatcctggtgatcctggtcatcggcatcgggctcagccccatcgccagggaaatcaccgggtcccggaacccctaccccctgggcatcctggccctgaccctcatcgcggctgcctacatcggtgaaattttccgttcgggtatccagagcgttgagaagggccagcttgaggcatcccgggcgctgggcttcagctacggcagttccatgcgcctggtggtggtgccgcagggaatccggcgggtcctgcccgcactggtgaaccagttcatctcgctgctgaaggattcatcgctggtgttcatgctcgggctcgccgcttctgacagggagatattccggatcggaaacgacgccatggccaataccggaaacctctctccgctggtcgccgccggggtgctgtacctgatcctgaccgtcccgctgacgcacttcgtgaacttcatcgacaaccggctgcgcaccggcaagccggaaaagaaggaaccggacgagctggcagcgcctatcggcaagggggcacaggcatgacggaattcgcttccggaacccttaccggcaagaacctgcacctttccttcggccacaaccatgttctccgcggcattgacctgcatgtggagaagggcaccacggcctccgtgatcggtccgtcgggatccggcaagtccacgctgctgcgcgtgatgaaccggctgatcgaacccgaccagggcgacatcctcctggacggccgttcggtactgaaggacaaccctgacgaactccgccagcggatcggcatggtgttccagcagttcaacctgttcccgcacaaaacggtggtggacaatgtgtccctggcgctacggaaactgcggaagctgtccaaggagcaggcgcgctccgaagccctggaacagctggatttggtgggcctgaagcacaaggctgactcccgccccgccaacctttccggcggacagcagcagcgtgtggccattgcccgggccctggccatgaagcctgaggtcatgttctttgatgaggcgacctcggcccttgacccggagctcgtcaaaggcgtcctggcgctgatggctgacctggcgaagggcggcatgaccatggtggtcgtcacccacgagatgggattctcccgcaacgtctcggacaccgtgaccttcatggatgccggcgttgtggtggaatccggcccgccggagcaaatcttcacctcgccccggacggaccggctgaagggcttcctctcggacgtcctctagcgctctcccccctgcaaaaaatccccggttgcaccgcaaccggggattctttgtgttcaggaatgtcgtacgactgcggtactagccctgcgccgcggccgcggcctttgcagcggccggcagtgcgtcgaagatccggttcatggcggtgtcatcgtgggcggcggagaggaaccaggcctcgaagaccgacggcggcaggtataccccggactccagcatcgagtggaagaacggcgcgtagcggaagctttcctgcgcctgggcgtcggcatagttgtgcacgccgttggccgaggtgccgaaggccaccgagaagaggttgccggcgaactggatggagtggtccacaccggcggagtccagggcgctggacagtgccgaggaaagttccagcgagcggacatcgataaaggagtagacgtcccgcgtggcatgggtcagggtggccacgccggccgccatcgccaccgggtttccggagagcgttccggcctggtacacgggccccgtgggggcgaggtagtccatgacgtcggcacgtccgccgagggccgccgtcggcattcctccgccgatgaccttgccgaaggtgagcaggtccggggtccacggctcggcggcgtccggcgctccgccggtaagcccccagtagcctgagtagccggtgcggaaaccggtaagcacctcgtccacgatgagcagtgccccgtgttcacgggtaatgcgggacaggccgaggttaaagccctcccccggggttacgacgcccatgttggccggagctgcttcggtgatcacggcagcgatgttctgcccgcgggcggcgaaggcttccttgacggcggcgaggtcgttgtacggcagcaccagggtttcggcggcggtggccgccgtgaccccggcggaaccgggcagggcgagggtggcaacgccggaacctgcggccgccaggaggccgtccaggtggccgtggtagcagccggcgaacttgatgatgaggttgcgcccagtgaagccgcgcgccaggcgaacggcggtcatggtggcctcggtgccggtggataccatccggaggcgttcgacggcgggaacgcgttccttgacgatctcggccaggttcgcctcatccggggtggaggcaccgaaggacaggccgcggtccacggctgcgtggaccgcgtccagcacagcggggtgcgcgtggcccagcagcgccggaccccaggagcagaccaggtccacatattccttgccgtcggcgtcggtcaggtacggccccttcgctgagaccatgaagcgcggcgttccgcccacggatccgaaggcacggaccggcgagttgaccccgcccggcatgagctggcgggcgcggtcgaaaagttcctcgttgcgagggttgctggaagtcatggttcctattctctcaggtggccggcgctgtcttctgccgggtacgtcaggtgccgagcagttctgccacgcggggtgccaccgccgtgcccatcagctcaatggagcgcatcatggtggagtgcggcagcggcccgttgctgtatttgaggtcgaaacggtcaacgcccaggttctgcttaagctggacgattttccgggccaccgtctcgggcgagccgacgtagagggcaccctcgggtgcgcacagggcgtcgaactcgcccctccccgccggtccccagccccgctcgacgccaagtttgttccgcagcttcagccagtgcgggaagagttcctcgcgggcctgctcgtcggtatccgccacgtgtcccggtgaatgggtggccacctgttgcatggggtggccgtacttggccatggcttcccggtacaggtccacgagcgggcggaaggtgcgcggttgcccgccgatgatggcgaagataatgggatagccgtactgggcgcagcgcagcacggattccggtgtgccgcccaccccgatccaggtgggcagcaggtggcgctccagcggcgggtacacgctcagcccggacacggccggcctggtgcggccttcccagtgcacgggcctctgcgctcggaccttgtcgaacagctcgagcttttcctcgaacaagacctcgtagtcggccaggtcaagtccgaacagcggaaaggactcgatgaaggagccgcggcccagcatgacttcggcacggccgttggagatggcgtccacggtggagaaccgctggaacaccctgatgggatcatcggagctcaggacggtgacagctgagcccagccggatccgggtggtgcgggcggcagcggcggcgaggaagacttccggcgcggacaccgcgtagtccttgcggtggtgctcccccacaccaaaggcatggagtccgacggcgtccgccagctgggcttcttcgagcagatggcgcagcacccgggcatgtggctgcgggcttccgtccgggttctcaccgacgtcgccgaacgtgttcaggcccaggagtatccggcctggtccaaccggggcggtgggactctcgggaacagctacggaccggggagccggggtgttggtcatcaggactccttcagccagccggccagttcggccgcccagtaggtcagcaccatgtgggcgccggcacgccggatgcccagaacggactcggtgatggcggcccgccggtcgatccagccgttggcggcagcggcctcgatcatggcgtactcgccggagatctggtacgccgccaccgggaccgggctcatggcggcgacatcggccacgatgtccaggtagctcatggcgggtttgaccatcacgatgtcggctccctctgcgaggtccagttccacctcgcgaagggcctcagtgcggttcccggcgtccatctggtaggtccgccggtcgcccttcaactgggagtcgacagcttcgcggaacggaccgtagaaagcggaggcgtacttggcggagtacgcgatgacggacgtgctggtgtggccggcaccgtccagggcggcacggatggcggcgatctggccgtccatcatgccggaggggcccagcatgtgggcgccggcgtctgcctgggccacggccatgcgggcgtaaatttccacggtggggtcgttgtccacgtaaccgtcggcgtcgagcacgccgcaatggccgtggtccgtgaactcatccaggcacacgtcgctcatgaccaccaggtcgtctcccacctcggcgcgcacgtcccggatggccttgttcaggacgccatcggggtcaagggacgccgtccccgcggcgtcccgggtttccgggatgccgaacagcatgatgccgccgagcccgagttccaccgcttcagcagcagcacgcttcagggtttcggtggtgtgctggacaacgcccggcatggagatgatggggttgggttccgtgaggccttcacggatgaaagccggaaggataagttctgccggcgccaggcgggtttcggcggtcagccggcgcatggcaggggtggtgcgcaggcggcgggggcggtggctgggaaaagtcatggtcctgtccttggcgttggttcgggcggtgagtgggtggccgctggcgggcgtcccgcgcgtcagggtggttcaccgcccgcgtcctccgttgtgtggagtgctgccgcgacggctgctacaagccccgccggcgacggctcagccgcgatggcagccaccggcatgccaagcgcggcggcctggtccgccgtcgaacgcccaatggccacgaagcggcacccgagcagcggggacagcgcatggatgcgccgggcggcgctgggggaagcggcaatgacggcgtcgaggcggccgtcggccagctcggctgcggcgttgtccggtgtcagcagggcgtacgacggcggctgccggtccggtcccccgcttaccgccgggatggccagcctccgttccgctgcggcggggtaatcaacggtgcggtatgcggtcactgccgtcacagtgcttccggctgccgacaagccttccgccaggcgcggcgacgcgatgtcggcctgcggcagcagaaccttgccgtcccctcccggccacacagccagcaggcccgccgcagactggtcatccgctggtgccagtgccaccgcaagcccctggtcctccaggagcctgcgcgtcgccgcccccaccgcggctatccgggtggcagccgggatccactgggcaggcaccagtccacgttcggcggctttggccgtgagcacatggactgtggtggcgctgctgaccaccagccagtcgaatgcccccgcaccgagggcatcgcaggcaacatcgagggagtgctggtccggtgcacgctcgaagtcgatcaagggcaggaggagtgcactggcgccggcctcctgcagcgcgtccacgagcgccagcgaccgctccggactgcgcgtgatcaatacccgcgccccggccagtggccggtccagcggcagacccttttcctgcatgtttacccgcgtcccggttggccctgccggacgcactggacaggcaatcgcatggccggaatcaggaagcctgcaggtccgcgatgtccgcggcgccggcggcgagcaggacttcggccagttcgatgccgagcagtgtggcgcccacctcggtgaggccgtcggttgcccgcttgtcccggaccgaggccgtgccgtccaccgcgcacaccacggcttccaggtgcagcaggctgcccttgcggaaggcgtaggcgccaaccggtgccgcgcacccggcctccagccgggccagcagggcccgttcagcggtgaccgcaagccgggtatccggatcgtcgagtgcactgagtgcctgggccaggacgtccctggacccttcgtccgagccgggccgggccggggcatcggccgtgcggcactcgatcgccaaggacccctgcccggcggcgggaagcataacgtccgtttcgaggaactcgctgacggtatccagcctgctgatgcgttccaggcctgcggcggccagaaccacagcgtccaggtcgcaggacttgccgggtaccacgtcggttacggtgttgcccggcagcccggggacacggccaaggcgggtgtccacgttgccgcggatgtcgatgatctccaggtccggccgtgcggcgcggagctgggcggcgcgcctgggcgagccggtgcccacccgtgcagccgcggggaggtcagccagtttcaggccgtcccgggcgcacaggacgtcgcggacatccacccgccgcggagttgccgcgaggctgagccccacggccgcacccgtgggcagatccttgagcgagtggatcgccacgtcgcattcgttgcgcagcagcgcatcgcgcagggcggcgacaaaaacgccggtgccgcccatctgggagagcgagccggtcaggacatcgccgtcagtccggatgtggacgagctccaccggaaagcctccgacggcggccagctggtccgcggtctgctgcgtctgggtgagcgccagcttgctggcgcgggtgccgatccggacagtcactgctgcgccgctcccccggacgcggccggctggctggcgccggcttcgccgggataggagtcgtgcccggtgcccacggtggtgtccgcaccggcaatggtgggcttctcgccccggaagttctggcagcagcccggccggcagacgtcgtaccagggaccgaggtccgtgagcgccgggcggtcagcgatgttgttggccaccgtccgctccgaaatcaggtccaccattccgttgacgaacttgcggtgcgtgccgggtgtggggacccgcgtggcggtaagccccaggttggcgcaggtttccagggcttcggtgtccaggtcccagacaacttccatgtggtcgctgacgaagccgagcgggacgatgacgattcccttgacatcctggccggccagttcctcgatggcatcgttgatgtccggctccagccagggcacgtgcggtgcccccgaccgggactggtacaccagggaccagggtgccgtcaggcctgattcctcttccacgcgctggatgacagcggcagccgtggcgaggtgctgggccacgtaggcggacccttccgcgaattcgcggggttcgccttcggagcggcccgcggcctcggcatcccgggtggggatggagtgggtggcgaacaggatctgcacgggcgcgtcgggggtgcctgcggctgcgagctgttcccggacttccctaaggccggcggccgtgccctcaacgaacggctccacgaaaccggggtggtcgaagtactgccgcaccttgtccacttccagccggccgtccaggccggtttcggtcagcgccatgccgatgtcctcacggtactggcggcagctggagtaacaggagtaggcactcgtggtgatcatcaggaggcggcggtggccggcgtcgtacgcgtcctggagggtttgcggaatgtacggcgcccaattgcggttgccccagaggaccggcagctcgatgccgcgggcggagagttcggcctccagggcggccttgagttcgcggttctgctggttgatggggctgatgccgccgttggcgcggtagtggtgcgagacctcttccagccgctcatccgggatgccgcgcccgcgggtgacgttgcggaggaacgggatcacgtcctcctggccttccggcccgccgaacgaggcgaggaggacggcgtcgtaattcttgggtgccatccgtccggcctcggtgacagggttgacgacgacggcgccgccggcatttgtggggtcaagctggctcatgcgagcacctccgctacttctgccggggaaatccggcgtccggtgtagaacgggacttcctcccggacgtggttgcgtgcctcggtggcgcgcaggtggcgcatcaggtccaccaggtccaccaggtcgggggcctcaaggcccaggatccattcccagtcgcccaaagcgaacgaggaaacggtgttggagatgacctgcgggaactcccggcccaggaggccgtgttcccgaagcattgcgccccgctcttcctcagggaggatgtaccactcgtaggagcggacgaacgggtagacgcacagccattccgccggcgcaaccccgcgggagtatgcgggcgtgtggttcttggcgaactcggcctcacggtgcacgcccatggcggaccagacaatctcggtgcccgcaaacagggtgctgcggcggatgtcgcggatggcctgctgcagtgcttccggcttgggaccgtggagccacaccatgacgtccgcgtcggcccgcatggcggagacgtcgtagctgccgcggtgcgtcacgccggcccgggccagccgttccaagagggcctcgaagtcagcggcggcgtcggcgctgcggatcagggtttcggagcgcttgaataccgtccagagggtgaaaaactgctcggctgattcttcggttttagtgacagattcggcagaagtgtggctcatggttacaagtttgccccttcgtacccgtcaagtcgaaaccaacgacttctacaagccgtagaagtgcgcaacgtcacatccgggggaccatgctgtggctgagggagccagcgaaacctcgaccgccgaaagaactgccaggggattcagcggtccaggttacggatctgttcgatcgtgtcggacaccacagcggccagcccgttgccggccacccagccgccaacgacggccaggttacccaccgcggcacaggctttccggatttccgccacgcgggcgcggtgccccacggcggcgaaggaaagggacccccgccacctgaccacatcccagtccacgacgtcctccccggcgatgtccacgcccagcagtgcctgtgcatcacgcagggccgcggcgaagagctcatcgtcggtgtccgggccgccgggctgcccgccggccccgtccacccggccgtacgagagcctgaccacgtgccggcctgggccggccgcttcagccagccaatcccatttgccggtggcgtgggtcagggccttagcttcaacgccgggggtctggggcgccaccaggatgcctgtgccgcgcggccggcggtccagttcgggcttgttgaccacgagcgtgacgagtttgacgtccggtcctgcagggggccgtcgtcccgccagggcggggactgcggcttccaataggtcgacggcggccggaccgcccactcccacgaccagcgcgccggcgtcgaacgttgctccgggagagctgacccgccagccttcaggcgtccgggccactgctgaggcaggcgtcccggacatgagcgtcaccccccggtcgcggaggtcgcccaccaaagcggtgaccagggtgtgcatgccgcgttcaaggccggcaacggcagagcccgcctttgccggggccataggctcctgcctgaggccgttgttggcaggtgaccctgtggcggcgcgacgctgggcggaaaccgcagcggccagggagccgtgccgcctgattccggcgcggagccccggagccaccatgtcgacatcgagcagtccgggatccgcggagtggacgccgcccacaaccggggcaaccaggcgctccaggaccctgctccccatgcgtgccttcaccagggcggagacgctgatgacgtcgtccgccgtccccaccgacgccggcaggaacctgtccagggcggcccggagggttcccacggggcccaacgacctccggacttccgggtcccaggggttggccgggatgcccaggacgcccgtcttgggcagttcgcgcgggccgtccggaagctggacccaggctcccccgggccggggcggcacaatgctgccggcaaggccaagctccccagcaagccgtgcaacggcgtcggtacgggtggcgaaggattccgcgccgctgtccagggtcaggccggcaacggtgtggctgcccacgcagccgccccattccgttccggcttccaggactgtgacctcataaccggcggaagccagctcgcgggcagacagcaaccccgaaatgccgccgcccagcaccagcgcggtccgggtctctgccggcgtactgcccatgggactactccggggagatggagtggatgagttcaaccacccgcgtgaggacggcgggatccgtctccggcggaacgccgtgacccaggttgaccacatgcccgggggctgccgagcctgcggctatcacgtcgcggacgtgagcctcgagaatttcccacggggccggcagcagggcggggtcgatgtttccctgcagcggcaccgtgccgcccaatcgccggttggcctcatcgagcggcagccggtagtcaacgcccaccacgtccactcccacgtcacgcatggccaccaggagctctgacgtgccggtgccgaagtggatgagcggagcaccgaggtgccgcacatggtccagggcgcgtgccgaggccggcgccacatacctggtgtaatcggccaggcccagggaaccggcccaggagtcgaacagctgggctgcggaggcgccggcctcaagctgtgcctgcaggaacatgccggaagcgtctgcggcccagttggccagggcgttccaggtttcggggtcggcgtgcatcatggtgcgcggacccaggtggtcacgggacggcctgccctccaccatgtaggcagccaaggtgaatggtgcgccggcgaagccgatcagcggagtgctgccgagttcggccacggtgaggcggaccgcttcacggatcggttccagtgactcccaggtgagctggggcagcgctgccacatctgcggcggtgcggaccggagtgtccaggacgggtcccactcctggcacgatgtccacgcccaccccggcaagcttcaggggaatgacgatgtcggagaagaagatgcccgcatcaacgtcgtggcggcggaccggctggagcgtgatttcggaagccagctccgggcgcaggcaggagtccagcatggctacgccttcgcggaccttgaggtactcaggcagggagcgtccggcctgccgcatgaaccagacggggcgtcgggacggcttgcctccgcggtaggccgtgatcagcggggaatcggcggtgcggccgtccagcagcgggtggtctgcggcgagggcgccgacaggggacatggcagggctggaagtcatgcctttgattgtgccgaaaatcggatgcaaaagataacgacaaagtgtcatccggccgccctccggccgcgccgtggcaggaatcacagcctcggcttgcgatggtgcgtgcctggagttgttctaccgagtaacgaaaaagctatgattgtcctgctgtggttcttttttcattggtggctacacacgccgacatcgatcttgagaccgttgctcagttgagcagcggttcttcggggatcgccacatccgccctctccggatcgccggcagtgacgggtgccattgtccttgccacttgcaaccgctacgaaatctatggcgaggccccccatccggacgatgtagaggctgcccgcgccgcgttggtggcccagatcagcgaaatcagcggactgagcgaaccgctcgtctcgcgctccttcagcacccgcaccggtccggaagtcagccagcacctctttgccgtcagcgcaggcctggactccgccgtggtcggagaacgtgaaatcgccgggcaggtcaggcgggcccttattaccgcccagcatgaaggcacggcaagttccggcctcgtccggctgttccaggcggcctccaagaccgccaaggatgtcggcgcgcagactgccctcggctcccggggcctgtccatcgtttccgtcgcgttggatctggcaacggacctgtccgagaatccggactggtccagcaagaaggtagtcgtcttcggcacgggagcctacgccggcgccaccatggccctcctgcgcgaacgcggctgcaccgacatctccgttttctcctcttccggccgcgccgaaggttttgtggcaacccggggcggaaccgccatcgacgccgaatcactccgcccggccgtagcggcggcggacatgatgatcggctgcagcggttccgacaccagggtggaggccgacgaactggcagaggtccgcgcagattccccgcagccgctgattgccatcgaccttgcactcacccacgacttcgaccccggggttggcgagctggacggcgtggagcttctcaccttggagtcagtgcgccttgctgccccccaggagcaggccgagtcgctggcccaggccagcggcatcgtcagcggcgccgccaaggccttcgagcacgagcgcgaggtcaggtccgtggattccgccatcgttgccctgcgccggcacaccatgagcgtcctggacgcggaaatggaaaaggtcagggcacggcacggctgcacggccgccgccgaggaagtggaattcgcgctccgccgcatggtcaagcaactgctccatgtacctacggtgcgcgcccgcgagcttgccgcgaacggccagcaggacgattacgtggcagccctggaagccctctacggcatcaccgtggagcagccggccgccacagccccgcaggccgaatgcccggtggaccacctgggcctcgaaaccgcctgacgcgtctttcccccgagcaacgccctctcagatcctgcgcccttttcgccgacgctctctcatttgacgcgcatttcccggcagtgctctctcacctagcgcaggttttccttcggtaagtgatagagcgttccgggttttccttcggtaagtgatagagcgttccggtttaaccgacatcaagtgagagagcgtcctagtagacgggtttagtgggttccacctcacgcacccaggccaggatcccgccgtcgagatggctgacccgccggtagcccgctttcctcgccgcggccaggacgttggccgaccgcgtgccggccttgcagtggaacacgatgtcccggtcctgcgggagttcttcccacgcctcccccgcgaggatcttgccctgcgggatcagcacagcgccgtcgatccggacaatgtcgtactcacctggttcccgcacgtccaccaggtcaaagtccttaaggcctgccttccgcgaggcgagcatggtggcgagctgcgcggccgtgacggaatgttcggtgtccgcctgtcctgccggcacaatcccgcaaaaggcctcatagtccgtcaactctgtgatcggttccgctgccgggtccttggatacgcggatctcccgccagcttccgcccagcgcatcaaacagcgccacacgccccagcagggaacggccgacgccggtaatcagcttgaccgcttcggtcaccatcagcgaccccacggccgcgcacagcatgccgaacacgccaccctcgccgcaggagggaactgagccggcgggcggtgcctcagggtagaggtcacggtaggtgggcccgtgcttctcccaaaacacactgacctggccgtcaaaccggaagatggagccccagacgtagggcttgcccaggatggctgcagcgtcattcaccaggtagcgggtggcgaaattgtccgcgccgtcgaggatgaggtcgtagcccgcgaacagttccagggcgttggaggcatcaaggcggacatggtgcagctggacgtccaccagcgggttcagcgcggcgatggcgtcgcgggccgattcgatcttgggccggccaacgtccgccaccccatggatgatttggcgctgcaggttgctgaggtcaacgtcgtcgtcgtcgatgattcccagcgtgcccacgccggcggcggcaaggtacaggagcgcaggggatccgagcccgccggccccgatcaccagcacctttgcattcttgagccgccgctgcccgagggcgccgatctcagggatgatgaggtgcctcgagtagcgttccacctcttcggcggtgaggtcggctgccggttccaccagcggatccaaggacacaggtgaaacatttgcgctgaatgtcgaagccatacttcaatgtatgccccgggataccgcccggtcatattaccccgcagtaaagtggaggtaactgcaacgaaagaaggacaaccgtggtccatgaagcacgggctaaccgcccgccggccgccgaaccgcaatcgccctcgcgtcctgcaggccaacggtcagccaggcttccacgggacgagcggcgcgcccagctcctcatggcagcccaggaagtctttgtggccaacggttaccacggtgcagccatggatgaaatcgccgagacggcccacgtcagcaagccggtgctctaccagcacttcccctcaaaacgggagctgtacctggccctgctggagagccaccttgcgtccctgacggacctcatgctgggggccctgaactccaccacggacaatgacgagcgtgtgcaggccgtcatgcgggcctatttccagttcatcgccaacgatgaccaagcccaccggctggtgtttgagtcggacctgatcaatgatccggacgtcagcgcacgtctggaaaccttcaacaggacgtttgccgacgccatagcgcgcgtcatcgccgaggacaccaagctcccccatcttgaagcccaactcctgggccggggactcgctggaatggcgcaggtcagtgcccgctactggcttgaaacggacggcaacctggacctcgatgtggccagcgacctcatctaccgtttagcttggcgcggaatctctcgcttccccaaagggtcctagactacaaataagacataaccaacgaacgtgaatggctgggaggcccctgtggaaattaagatcggcgttcagaatatcggccgcgaaatcgtgctggaatcaaacgaggatgcggattcggtagccaagattgtggaggctgccatctccaagggcagcgaactccgcctgaaggatgacaagggacgcctgatcattgttcccggaaacgccctgggctacgtggaaatcggggccgaagaggcacggcgcgtaggtttcggccagttctagaccctgccgaggaaccacccgtagcccaaggaggaccatgctttcgctgaccatcgttgtgctggcagccgccgccgcaggctttattgtctgggcaaacgacaagcggcatgccaagtacggggccggcgtgcccgccggggtttccgtggccgtggcagccctggtgtggatcatcctgatggctgccggattcggatacctgccgggacgcacctggattccctgggtcctgccgatcgtgctcggagccgcgtctgcaacggcggccgccatctacctgggccgctcgcgtgcgcggcaggacaccgaacggctgactgcaatccttcgggcctgacacctgcacagagaaacccaacgaacacagcaccttatgcagcgcacgtcgaggccaaccggcagtggccgccatccccctcggggtggcggccactgccgcttaaggacccagcggctggtgacgcgggcgctctatgacccgctttttctgctgtgcgggcaactaacgctgtgcagtcaactaatgcccctgcgcatacttcgccggctctgccttagcgcccaccgctgccgcagcttcacttgctttcgcggctgccgcgatgtcccggccggtcacctgtcccccggcgtcgtgggacgtgtagcggataaagacgcggttgtaacgccagtcgaggtccggatggtggttctgttcctcggccaggcgtccgacggcggcaatcagctcgagtgcggcagccgccgttggcatcttgaaaacggtaaccaatccgccgtcgccggcccgccagtcaggcaggccagccagggcttcgtcgatgcgttccgggggaagggcgcctttgctggccactgctgctccttggatcagggcgttggccggcagaaggcgggtcctacaggaactcggcccggccttccatcgccgacgatgccagcgcatgttcacggcggggtatgcgacccgccgctttcgccagcctaccggcgatgacggcgtacttgaaggcctcccccattagggcaggtttctgcgcccgggtcaccgccgtggccaggagcaccgcgtcgcagcccagttccatggcgagggcggcgtcggaggccgtaccgatgcccgcgtccagcaccaccggcaccgaggcccgggacacgatgagctcgatgttgtgcggattgaggatgcccaggccggtcccgatgggcgagccgagcggcatcaccgccgtggccccgaggttctccagccgcagggccagcacggggtcgtcattggtgtaggcgaagaccttgaatcccctgttgaccagctgttcggtggcgtccacgagctcaacggcgtccggcaggagggtgtgttcgtcggcgatgacctcgagcttcacccagtcggtttccagtgcctcccgtgccagttcggcggtgagcacagcgtcacgcgccgtgaaacaccccgcggtgttgggcaggacccggatgccgtggtccaccagcagctggaacagtgaacccgcctcatccggcgaatagcggcgcatggccacggtggtcagtgaggtgccggaggccaggagtgcggcgcccaggccatccaggctgggcgcgccgccggtgcccatgatgagccgggacgccagggcgacgccgtcgatcaccagggggtctcggacgccgggcagctggctgttggtgatggtggtttcggtcatggtggtcagcctccctgtactgccgtgacaagttcgacgtcgtcgccctcggcgagcgccgtggcggaccacaggctccggggcaccacctgggcgttgcgggctacggccacgcccagcttccgcccgtcggtggccctgccgtctgcggccagtggacggccggtgacctcgctgacgagtgcagtgatggaggcgtcggctgccacggtgtggccggctccgttcagggtgatgttcatgctgtctcctgggtgttgggtggggtggcagccgcttcagccatgtggaagggagccggggaaaaccggccggggttgaacggggcccagcgggggtcctcgctgccgtccatgagttcccggcagattgcggccgcagccggggtgagcaggatgccgtggcggaagaatccggtggcaatgatgagcccctgcacgtggcgggacccttgagcgccgggccttccaggggcgggctgcccgcccgcgggtccttcgggcagcggcacccttccgagcagcggggcgttgtccggtgtgccgggccgggcacgggctgtgcactcgagcagttcaagctcagccacggccggaaccagcacctgggcatcgcggagaagctggtacacgcctcctgccgacaccgccccggcgctggagccggcggccccgcccagcgcgtcctcacgctgggttgcccctatgaccacggttccgtcctgccgcgggacgatgtacacggggatcccgcgcaccagtccgcggacagttgaggtcaccaggggcctgaggtgcgccggtaccgcgagccgcaggatgtccccatggaccggtcgcagcggcaggtgcaggttcaccggcagtccggtgagttccgcggcgtgcagcccattggccaccaccgtctccccggccaccacgctcccaccgcccgccaggaccactccggcaacggcgccgtccttccagagcaggccggttgccttgtccggcacggcgaatcccccggcggcgccggccacgccgctttcgtctccgccggcatccccggccaacgcccggcggaggcaggccaccagcagccgggggtccacctggtggtccgccggggtatccagcgcagaggcaatccccgggctcaagaggggctcgcggcgccgcgcctcgcggatggtgagcggttcaaccgagaggccgttggccagctggacggttcgcaggtccagcagcgcctgccggtccgcggagtcggcacccacggcgagggtcggcgtcgtaagatatccgggatccgagcccgcggccgcggcgaggtccgcagcgaaacccggccagcggacggaggcgtcgagcatgagttccaggaggtcttcctcctggtagtgcagctcgctcaccggggcaagcatccctgcggccgcccagctggctcccgagcccggcgcatcatcgatcactaccacggaacggcccgaccgcctcgcctcccaggcgatgccgtggccgatggctcccccgccgatcacagcaacatcggctgcgatcgtggagccgggaacagggcggccgcttacgccatgtgcgtgaggcatcgattgtctccttccctacgccggtattaaccggatcaggtcaagcggtcggctctgacgccctctcagcccggcgctttgtgacagctgccgcggctcccgcagtacgagcccagtgtagaggaactaggctggctcccatgaatgtgtcccacccccctgccgccgcttcccgtccgtccggaacagacgcctttatcaacgcggaagggagtgccgggctgcacagtgcgcgcctttatctctgcacggatgcgcgccgcagccggggcgactttgaacagttcgtggatgccgcgttcgcggggggcgtggacatcatccagctccgggacaagtccatagaagccgccgaggagcttgaactcctggccgtcctgaaggaggcagcggtccgccacggcaggttgtgggctgtgaacgaccgcgccgacattgccgtgctgtccggagcgccggtcttccacatcgggcagaaagaccttcccctcaaggcagcccggacgctgctgaacgggaacgccgccatcggcctatccagccacagccctgaacaggtggatgcagccctggccgcggccgccggcccggctgcgctcgactacttctgcgtgggcccgttgtgggcaacacccaccaagcccggccgcgccgccgtcggcttggacctggtgaagtatgcggccgcggcatcggcggcgcagcggcagggacagtccgacggcggcgtgccctggttcgcgatcggcgggattgaccacggcaacgtggaacaggtggtggatgccggggccagcaggatcgttgtggtccgggccatcacggaagccgatgacccggcagccgccgccgcatcgctgctcgacgcgctggacgctggccgcccgtgacgctgcgccggatctgcggcgcatcccgcgggcggttccgtgcactatttgtgaaattcgggctacgctgattttcgtgtcacatcatcggctggcccccaatgtccacgagcacaccaacgccctcgaggctgcactcagcgccctgcggacggagcttgagctgccgggcgactacccggacgatgccgtgaaggacgccgcggccgcggtgtcggcactgcagctgccgtcccatgacctgaccggcatcgacttcatcaccatcgacccggcgtcgtccacggaccttgaccaggcgctctacattgagcgggacggcagcagctaccgcgtgctctacgccatcgccgacgtgcccgcgttcgtggctcccggcggtccgctcgatgccgagacgcggcgccgcggccagacgttctacaccccggacggccgcattcccctgcacccggaagtcatcagcgagggcgccggaagcctcctgcctgggcaggactgttccgcgttcgtgtgggacttccgcctcgatgcccgcgccgatgtcaccgccgtgacggtcaggcgggcccggatgcgcagccgcgacaagctcagctacaagggcgcccaggcggagctggacggcggcagcccttcagatgtcctggtcctcctcaaggaggtagggctcaagcgcgtggaactggaacgcgccagaggcggtgcaagcctgaacatgccggaccaggagatcgtccagcttcccgacggcggctaccggattgccgcggccccgcagctgcccgtggaggactggaacgcccagatctcgctcatgacgggcatggcggcggcgcagctcatgctggccggcaaagtgggcatcctccgcaccatgccctcaccggacgagcgttcactgcaccatttccggctccagacagaggcactcgggaaaccctgggacggtcaggtcagttacggcgaatacctccgcagcctggaccccaccgatccacgccagctggccattatgcattcggcgggcatgctcttccgcggtgcggcgtatacggcgttcgacggcacggtccccgcggacgccgtccagtccgccattggcgccgcctacgcccataccaccgcaccgctgcgccgcctggtggaccgctttgtcctggtgacctgcgaggccctgtgcaacggcggcgaagtcccgggttgggtccgtgatgcgctgccgtcgcttcccgaaatcatggccggctcggaccagctggcgtcccggatggagcgcttggccctggacaccgtggaggccgcgctcctcatcaaccacatcgggcaggagttcggcgcgatcgtgatctccggctccaagccccagaaggaaaacgggaacggcggcaacggcaagaacggcaagaacggcaacggcaacggcaacggcaacgggggctccggcatcatccagattgccgaacctgccgtcacggcccgctgtgccggcgagctggaggccggcaccaaggtccgggtgcgcctcgtgtcctccaatatcgccacccgggaagtgcatttcgaactggtcccgcccctgtcctgagcggggcccattttcctgtccgcatgcaggcacgaccgccaaagccgggtttccgtgcccgtgcggctagactggaaaggtagaaatggatgcccggtcgttgatttccttgatttgaaaccaacaagcccgcccctacgcgatcttgagaaacacccgttggtcaccagtgccagcattttagatagcccgcgatcggcttccactggaattgcttgcgcgcctgagcgtgctccggaacggccttaggccggtccgttgagcaggcagcgcccttgcccaaatgaataaggaaactccacgtgagtgaattgcatacccaccagcttctgacggacgactccggcaccgaaacgatcgagccggaagaaaccatcatctccgacgagaagccgcacgagattgaggagaagtccttcgcggacttcaacgtccgcgccgacatcgtggaatccctggccgacgccggcatcacccatccgttccccatccaggccatgaccctgccggtggccctctccggccacgacatcatcggccaggccaagaccggcaccggcaagaccctgggcttcggcatccccgccttgcagcgggtggtgggccgggacgacgccggctacgagaaactcgcagtccccggcgcgccgcaggccctggtcatcgtccctacccgcgaactcgcggtgcaggtggccaacgacctgcagacggcctcccgcaagcggaacgcacgcatcgccaccatctatggcggccgggcctacgagccccaggtggaagccctgaagaacggtgtggaggtcgtggtgggaacccccgggcggctcatcgacctctacaagcagaagcacctgagcctgaaaaacgtgaagatcgtcatcctggacgaggccgacgaaatgcttgacctcggtttcctgcccgacgtcgaaaccctgatcgcggccaccccggcggtccgccagaccctgctgttctccgccacgatgcccggccccgtcattgccatggcccgccgttacatgacccagcccacccacatccgtgctgctgatccggatgacgaaggcctcaccaagcgggacatccgccagctcatctaccgtgcgcacagcatggacaagatcgaagtggtggcccgcatcctccaggccaagggacgcggccggaccatcatcttcaccaagaccaagcgcaccgcggccaaggttgccgaggaactggtggaccgcggtttcgcggccgccgcgatccacggcgacctcgggcagggtgcgcgcgagcaggcgctccgggccttccgcaacaacaaggtggatgtcctggtggcaaccgacgtcgccgcccgcggcatcgacgtggacgacgtcacccacgtcatcaactaccagtgcgtggaagacgaaaagatctacctgcaccgggtgggccgcaccggccgcgccggcaacaagggcaccgctgtgaccttcgtggactgggacgacatgccgcgctggggactgatcaacaaggcccttggcctgagcgtgcccgagccggtggagacctactcctcctccccccacctttttgaggaactggacattccggtgggaaccaagggccgcctgccgcgcgataagcgcacgctcgccggagttgacgccgaagtgctcgaggacctgggcgaaacgggcaagaagaacgcccgcggcggccgcgacgccggcagctcccgagaccgcgacggccggggccgtgacagccgggaccgcggcgccaagcgcgaaggcggccgcagcggcgactccgcggcccgttcc

SEQ ID NO: 36 - DNA, 353670 bp, Arthrobacter sp OY3WO11
ccgccgtcgtacgcccgatgcagccgcagcacccgctgctgccggtgacgctccggcagcggccgaggcggagcagccctcacgcacccggcgtccccgcacccgcacccggcgccgcaacggtgaagtggttggcggcgggaacgctgcacagtccggcagcaccgaggcctaacacccttcatgactgacactgtctgggcgccggacggcagcagcctggtggttcacgcggacaacgcggacttcctcccctcgctgccggacggcgccttcacacttatttacgtggaccccccgttcaacacgggccgggcccaaagccgccagcagaccaccatggtggccaacgcggacggcaccggcgaccgcgtgggcttcaagggacgctcctacgacaccatcaaaggggcgctccaccgctacgacgatgccttcagcgactactggtccttcctggagcctcggctcgtggaggcgtggcggctgctggcggaggacggcaccctgtacctgcacctcgactaccgcgaggtgcactacgccaaggtgatgctggatgcgatcttcgggcgtgaatgcttcctgaacgaaatcatctgggcctacgactacggcgcccgtgccaagaaccgctggcccaccaagcacgacaacatcctggtgtacgtcaagaatcccgcgaagtaccacttcgacagcgccgaggtggaccgtgaaccgtacatggcaccgggacttgtcacgcctgccaaacgcgaactgggcaagctgcccacggacgtctggtggcataccatcgtttcgcccaccggcaaggaaaagaccggttacccgacgcaaaagccggagggcctcatccgccgggtggtggcggcgtccagccggcccggtgactggtgcctggacttcttcgccggttccggaaccctgggggcggtggccgcaaagttggaccgcaaattcgtgtgcgttgaccagaaccagccggccatcgacatcatggcccagcgcttgggtgcccacgcccggttcacggcctaccctcccaactaggtagcgccaagtgtcgttttgaaccgtcaaaacgacacttggcgctacctacttggggagtcagcgcgatcagggacggacgacggcggtccctgtccccagttcctcgatccgggcgaggacgtccggctcggtgaggttctcccccagcaggttgggcttgcctgtgccgtggtagtccgatgatccggtaatcaggaggtcgtgcttgccggcgagccgccgcaggaaccggcgcccctcctccggattgtcacgatggttgatctccaggcccgccaggccggcgtcgatcatctcctggtacacccgctcgcctacgatcctgccgcgggaggacgccacggggtgggcgaagacaggaaccccgccggcagcacggaccagttcgacggcgatggccggcgcgggtgcgtaatgctggatgaagtagcgcgaccgtgaggtgaggatggaggcaaaggcctcggagcggtcctccaccactcctgcggccacgagggcgtccgcgatgtggggccggccgagggttgcgccgggggcgacatggtggatgacgtcgtcccaggtgagggggtagtcctccgcaagaagggtgaccatccgctcggcacgggtatgccgcgcgtccttggccttggtgatttcctccaggagtcccggatgctccgggtcgtgcagatagctcaggaggtggacgctgatgccctcctctgtccggcaggaaacctccatcccggggatcagggctactccgtgctcaagggcggcagcagacgcctcctcccagcccgccgtggaatcgtggtccgtcagcgcaatgacgtccaggccggcgcgggcggcagaagccatgacgtctgcgggattctcggtgccgtccgagacattggagtgggcatgcaggtcaatcctcacctgtccagactagttgacccggcgttcacccagcgtatgccctgccgcaactcccccggccaaccacgccggcaccgccgcagggggctccgcctgttcgcgcagccgcggagctggtgagacgatggtgccgtgaaagatgccgaaaacacccccacctctgcttcccagccactggaggagcgtgtcaacaaccgctcgcagcggcccagctccgacgctttcaaggccttcatggctggcaactgggcgccctccagccaaaagctcccggcacgtgacgccgtagccggctacgcctcggcccggcgcagggtaatctccggacagttcaagggcgaacgcctggtgatccccgccggcccgctgaaagtccgctccaacgactgtgactaccgcttccgcccccactccggattcgcgcacctcaccggcctcggcctcgaccacgagcctgacgccgtcctgatccttgagcccgtaggggaaggaaagggcgacgacggcggccaccaccgggcaacgctttacttccggccgctggccgggcgggacaccgagcagttctacgcagactcccgggccggcgagttctggatcggcgcccgtcccacgctcgccgagttcgaggcacgccttggcctggcaacggcacacattgaccagctggagacagccatcaccaaggacgtgggagccccggaaatcggcggcatctccatccgcctggtccgcaaggtggatgagaacatcgacgcgctggtggacaccgcccgctacaacacggcgaaggacccggacaacctggacctcgccgtcctcgatgccctggacgaaaagctgagcgaagccctctccgagctgcgcctgctcaaggacgactgggagatagagcagatgaagctcgcggtggctgccaccgttgaagggttcgaggaagtagtaaaagtcctgccgcgtgcccttacgcatgcccgcggggagcgtgtggtggaaggagccttcttcgcccgggcacgcgaggtggggaacgagctgggatacgacaccatcgcggcctccggcaacaacgccactgttctgcactggacccgtaatacgggcaagatccacgccggagagctcctcctgctggacgccggcgttgaagccgattccctgtacacggccgacatcacccgcacccttcccgccggcggcgtgttcaccgacatccagcgcaaagtgtacgaagcggtgcttgacgcggccgacgccgggtttgccgccgcgcagcccggggcaaagttccgtgacatccacaccgcagccaccaccgtcctggccgagcggcttgcggaatggggactcctccccgtgacggtggaggaggccatcagtcccgagggccagcagcaccgccgctggatgccgcacggcaccagccaccacctggggctggacgtccacgactgcgcccaggccaaacgggagctctacctggacggcatcctcaccgaaggaatggtcttcaccatcgaacccggcctgtatttcaaggccgaggacctggcgattccggaggaataccgcggaatcggcgtccggattgaggacgacgtcctgatgacgaccgatggcccggtcaacctgagtgccgctcttccgcgcaaggccgaagacgtgcaggactggatggcgggcatctaccgtgaagctgacggggcccaggaagcgtaagcaacaacgaaaaaagcggggctgccggaacaaatgttccggcagccccgcttttgttgcccgccaggccgccgcgggctactgccgcggctcgcccgggtgctgctcgggttcgtcctgctggccgtcagcccgctgcccctgcgtggcctgctggccgccctcagcgtggccggcgtcagggtgcccggcgtcagcggcgggctcttgcggcagccggacaccgtactgcggccggccgtccggcagatccgggtaccgtacggcccgggccggggcgggctgctcctgcggcggggcagcagccgggccctggtcctccttgacaggatgtgcctgggcggaggacccggaagactgctggccgtagggatcgttccagcctgagggacgggctggaccctggccgggctggttctgctggtagggctggctctggtagtcgcgctgggtgtagggaccaccgccggcggccgcgtccgagcgggtcatcggcagctgctggagcaggcgccgtgcctcgtgggcggcctccggcgacaccacgacgtcgtagctggtggccaccacctggttggtggaggtgaagtcgcgcttgccgcgctgcatggcgtaggtgacgataccgaagagcataaagaacgccgcgcccatcagcaccgaggtaagaatggagaagtaccctggcgacggcgcgaagaaggacagcatgacaccgacgaacaggccgaaccacatgccgctcagcgctccggagagtgccacccggggatagctcaggcggccggtcacccgctccaccatcttcagctcgttgcccacgatggacaccatgtggacggggaactgctggtccgcaaggtagtccacggccttctgtgcatccaggtaggacgtgtaggaacccacggtatcgccggtgggaacggcccgggcttcatccattccgccgggcccgccggccttgggagcaccaaatatgtttgccatacccccattcttgcccatgcgtatgtgtgctgcctgtaaattcagctaaaagagagcagactcggtagcctgtaggagtgagcacaactcctacccgcgtcttcgtggcgcgccttttgggcctcgacgtcttcgacccgctgggcgaccggctgggccggctgcgcgatgtcgttgtgctgtcccggggaacgcagggcgcaccgcacgtggtaggcatcgtcgtcgaagtccccggcaagaagcgcgtctttgtgcccatgacgcgcattacctccatcgaccagacccagatcatctgcaccgggctggtgaacctgcgccgcttcgagcagcgcggcgcggaaacgctggtggtggccgagatgttcgaccgccgcgtcaccctgcgggacggcagcggcgatgccaccatcgaagacatcgccatggaccagcaccgctcccgcgactggttcgtcagcaagctctttgtccgccgcggccattccctttccccgctgagccggctccgccgcaacgaaaccctgatcatcgactgggccgacgccctccagggcccgcggaccgaaccgcaggccgccacccagttcgtggccaaccatgaggacctcaaacctgcggacttcgccgaagccctgcaggagatgagcgacaaacgccgtttcgaggtggccagtgagctgcaggacgaacgcctggccgacgtcctccaggagctcccggaggacgaccaggtggaaatcctctccgcccttgacgtgcagcgcgcagccgacgtgctggaggaaatggaccccgacgacgccgccgacctccttggcgagctcccctctgcccaggcggaggagctgcttcagctgatggagccggagggcgcggaggatgtccggcgcctgctggagtacgacgaggacaccgccggcgggctcatgacccccgtaccggtcatccttcctccggaggccacggttgccgaggccctggcccacgtgcgccgggaggaactctccccggcgcttgcctcctccatcttcatcgccaggccgccgctggagacgcccactggccgtttcctgggggttgtccacatccagcagctgctccggttcccgccgttcgagccgctcggcaacctggtggacaagaacctggaaccactgtcggaccaggcccacatcagcgaagtggcacgcacgctggctacctacaatttgaactccctccccgtggtcaatgacgccggccggcttgtgggggcggtgactgttgatgacgttttggatcatctgttgccggatgattggcgcgcccatgatggcgaagccccgataagaaggcttggtggccgtattggctgagagcagcgcaccaaagaatcccaaccagcggacacccgcccggaaaaccgcagacaagggcagcctggacacgcccctaagcggacgccagcggatcctgcccaagttctcgccggatcccgacgccttcggccacgccacggaaggcttcgcccgtttcatgggcacgccgcagttcctcgtctacatgacggtcttcgtggtcatctggctggcctggaacacctgggcgccgctcgagtggcagttcgattcccgcgccctcggctttaccttgctgacgctgatgctgtccctgcaggcctcctacgccgcgccgctgctgctgctggcacagaaccggcaggacgaccgcgaccgcgtctcgctccaacaggaccgccagcgcgccgagcgcaacctgtccgacacggagtacctcacccgggaactcgcctcactgcggattgcgctacgcgaggttgccacgcgcgactacgtccgcgccgagctccgttcgctgcttgaggacatgctggaggcccaggaggagctccggacccatgatccctccggccaggggcagcacgaatccccgcgcgacaaggtcaaggaaaagctcaaggaacagcgtgaccggcagcggaacccccgcacccagcagatcccccgggtcaagcccggccattccacccaggaccgttaatgagcgaacccattgccaacaccgcgttggctgaggcagtcaacgctgccctggccacggtgatcgaccccgagctccgccgccccatcaccgaactgggcatggttgaatctgtcgccgttgacgacgccggcagggccagcctggttgtcctgctgaccatttccggctgccccctgcgggacaccatcacggccgatgccacgaaggcgctgctggcagttccgggagtgaccgccgtcgacgttgaactcaaggtgatgacccaggaacagcgcgatgccctcaaggagctgctccgcggcaaaggaggccagcgcgggatccccttcaacgagcccggttccctgaccagggtctacgcggtggcaagcggcaagggcggggtcggtaagtcctcagtgaccgtcaaccttgcctgtgccctggcagcccagggcctgcgcgtcggcatcgtggacgcggacgtctacggtttctccgtcccggccctgatgggcatcacgcagccgcccacccgggtggatgacatgatcctcccccctgtcgcgtacggggtgaaggtgatttccatcggcatgttcgtcagcggcaaccagcctgtcgcctggcgcgggccgatgctgcaccgcgccctggagcagttcctcaccgacgtctatttcggcgacctggatgccctgttcctcgatctgccgcccggtaccggcgacatcgcgatctccgtggcccagctgctgcccaaagccgaaatcctggtggtcaccacgccgcaggctgctgccgccgacgtcgccgagcgcgccggggccatcgccacgcaaactggccagaaggtggcgggcgtcatcgagaacatgtcctacctggaaatgcccgacggcggcaggatggaattgttcggcagcggcggcgggcgggtcctcgccgagcggctgacggcaacggtaggggcagaggtgccgctcctgggccagattccgctggacatccagcttcgcgaaggaggggacaccggcgtgcctatcgtcctcggccaggccggcacaccggcggcggcggcactgtccggtatcgccggccagctggccgcaaaaccccgtggactggccgggatgaaactgggacttcagccgcgctgagccgctggcggccacgtaaggctgcagcagctgaatgcagtgccgtagagacgcgcgcaggcgctgctaggtggcttcggtgtcgaagggtgcagcctcgcccggcggcagtgactggagcacccgttccggccgcctcggcgcggagtcggctgccacggcggcggctccggagactgcggccacggcggccggcgcgccgacgctgacgggtttggagtcgtcgtcgaggagcgcctctttgatgatgcggcgggggtcgtactgccgggggtcgtatttcttccagtcgacatcatcgatgtcgatgcccacttcttccttgatctgctcgcgggcaccggaggccatgcgccggacttccttgaccaggttcgccagcttctgggtgtattcgggcagccgctgggggccgatcaccagaacgccaatgatcagcagaagaaagaactccgggccgttgattccaaacactttaggaagattaccctctccgggctgccagtgacgatttcaacccggggcccgggagatctgcccgcgctacgggacgaaaaaggccacgatccggttggccccgcgctgcagccgcgtcgtaagcggctcccctcccgcttccgcagaggccgggattccggcggcaacaccctcatcagacctggtgcccaggcgctgcaggatggggacggcgtcatcggcccgttccgcaggcaggtcggactcgtaggtaaagctgtgccccggcgtccggtaggttgccgaccacggcgaagactgccacacgcgcaggttgttgccggacgcactggcctccgggtcctcagcccccgtctgtccgccaggatcctgactgtcaccaccctgtgcggggagccgctgttcagtcacagtggcgtagtgcgccccgtcggtcagccgcagctcgaccactggctgcccgttgagcaccgtagcctttgccgactcaaggtggaagcccatcgcttcaagttccgggcaggcccagccttcggagcgcagccggttgagctgttcagcgtttagctgcctcccgtccgccggcgtctgggaggacacctgcgagaaggcggccgggtttcccgtggcctccccgggcagggggtcccctgccaccgcaaaggcacctgcagccaaaaccgccgccgcagcagtgctgccaccggcggccagcgccaggacccggacagccgtgcgcggcggcgcggtacgctgtgcgggaccaggaggcgcggcagccagttcctgcgtccgtgccagcagccgggccgtcaggtcatcgctggcgggaggaatgggggcatcgcggagccgctccaggtactggcgttcccgccgcaacgctgcagagcattcgtggcaggactggagatggctgcgcgtgcgctggtgcctgcgtccgaatggagtccgggacctcatacgccgttcagaggatgccggcaatacgcggcatggacagtttgcggcgtgcttgctggggacgcgggtcccggtgtgccagcttctcccgaagcatggtccgtccgcggtggatacgtgagcggacggtgcccagcttgacgcccagcgcttccgccacttcgtcgtaggacaagccttcgaggtcgcagaggacaacggcggcgcggaaatccggcggaagttcttccagcgcagcctggacatccacgtcgaggttgttgagctcgaagctttgttccggaccgggttcgcggccaggaagccgcgactcggcatcctcggcgagggcatcgaacctgatccgggttttccgccgtgcctggtccaggaagaggttggtggtgatccggtgcagccagccgtccagcgtgcccggcttgaagttctccagggagcggaagacgcggacgaacacctcttgggtgaggtcctcggcgtcgtacttgttgccggtcaggcggtaggcgagccggtaaaccttcgccgagtggttggtgaccacttcttcccaggtgggacgcacccactcagcctcaggatggtttgttgcagggacaggtgccacaactgaagatgacatcgtccactcccctcgtggaatactaacgcccggatactgttgacatctctgattcggcgccggtcaccttttggatgagcggatattaatcatttcaaacttgtctgggaatttcctgattgtggaaaagttcagccataggcgcaaccgcccgcctcccctgccattgccaccggacacagtaggctgtaaaggacattccctgccgcccagaaagcgaaacccatgagcgccgacaagtccaccagctggtcctatgcagaagatcttcctgctgaggatgaggtcatgcttcgggccagggagcgctccttcgagctgggtgtgacgcccatcggcccgggagtgggagcagtcctcaccgtgctggctgccgcgtccaaagcccagaccgccgtcgagatcgggaccggagcgggagtctcaggtgtgtgcctgctccgtggccttggtccccagtccgtcctcaccaccatcgacgtcgacgtcgaacaccttcgggcggcgcgcgaggcattctccgaggcaggcagcccggccaaccgcacccggaccatttccgggagggcgggcgacgtcctcccgcggctgacggaccgcgcctacgacctcgtgttcattgacgccgacaagcccggacttcccggatacgtggaacaggcaattaggctcctgaagcccgccgggctgctgatcatcaatgacgcgctggacaaggacaaggtggccaacccggcaagccgcgacgccaccaccgtggtcctgcggcaggtgggcaaggccctgcgcgacgacgacaggctggcttcagccatgcttcccaccggcgatggcctgctggtggccgtcaagaagtaggttccgaaaaaggcagggcccgcagcctggtggctgcgggccctgccttttcacgattattcggtaacgccgaccaggcattctttgaggttggctgcctcagcagcgttcagctcgaccaccagtcgcccgccgccttcgagcgggacgcgcatgatcaggctgcggccctccttggtgacttccattgggccgtcgccggtgcgtggtttcatagccgccatgaggaattcccctccatttagtcccaggactgatcagcccgggcgggctgtgtccgcatgtagatcaagctgccacggcggagtggttggacaccgcccgggctgcgcgtattctgaatgctttttgtccttgcttacttactattatcgcggaattacccgcacgtagctaatcgatggacatttcccgtgtcttggtatttcagccctgacctgcgcgaaagccccaaaggctagggtggataatccccgccgccgggcaattgcgcccaggcccacagccacacgatccaaacaatctgcagcagcaggaacatgaggaccaccgtcccccggtaagcccgcgacctggaggccagggcagctcccagcgccagcggaaacagcggcagcagcatgcggaaggtactggtctgcgggtgcaggaacaccaccaggtacgccatgtagcaggcacaccacaggcggagttcgacgccgatctgccggacggggggaaggaagagcacggcggcgaagagtgccacgaaaatgaagggcgccagcactcccagcaccggcccgaaaaggttgatgccggtgtcgaaccagggcttgaacggcaccaggtcgtggccgcgccatactgattccgttttggtgtaggcctggatgtccccggtggctgcccaagctgccgcgggccaggcgagcgccatcgcgcctccgacgccggtcagtacagcaaggcccgccagatcacgggtggaatgggttccttcccgctgcccggcaccggatgtggcggcaccggatagggcattgccgaaccgatctttgccgaaccacacccagagacggtgcaggaggagcagccccagcatggccgcaaagggaacgcctaccggacgggacaggcacaggagcaccaccaccggaacggcccagaggtactgtctccggaccaccagcagcaacgctgccgcgaggagcagcagggacagcggttcggcgtacggcacctgcaggacagcagccacggggaaggtagcgaagaaagccacgccccaaagcgccggggcgtgggaagccttgtgccggaacaggacgtagacaaccagcgccgctccccagcccgcaagcatggcgatgagggtcagggccgccgcgggagccatgccggtgagtccgctgagtcctccggccagggctggaaacaagggatagaaggcccacgtgttttcctgcacgttgcctgcggcatcagtcggcagcacggaggggtagcccccggcaatcacctgggcgtaccagcgcgcgtcccagatgttgatgaaattccagtagtcaggctttgccggaaaccatggattgggtccctggtggagggcagcggccatgaagatgcaggcgctgacaaggcgggcggccagatagacggcggtgacctgcagccaccacggccagccccggagagccgttcccgccaacccttgaagcgatgggagcaggcctgagcggcgccgcgccactgtgctcacagcgtgttctttccagccgacgcagtcccgccgggttctgtggtgccggcttcctgcagggccagcaactcagcccgcaacccgtcaatctcctcctgttgggaggcgagctggtccctcagctcatccaggacctggtccacctggtccatcctgtagccacgaaggccgagggagaagcgcacacggtccacatcctccggcgcggcctctgcgggcaggaggacagggggaaggttggcaggcggctgctcgaagccgccgtcgagcaggaaaggcaacggaccgttgcctttcctgccggaacgcagcccgaggccgacccaaaaaaccgccccgaccagcccgatcgccaggaaaaccagaaagaaactcaccattccatcgtgccagaccgggtggcagccgccagcccggacacccggccgggaccggctactccggccgctgctcgcccttgaaggagggggtaacggcaccatggagcacgcggtccacggcctcggcaggatcgtcaaccacctggatcaggtccaggtccttctcggacaccatgccttcggccacaagtgtgcccctgatccactcgatcatcgggccccagaagtcgacgccgaggaggatgatcgggaacgatgtcaccttccgcgtctggaccagcaccatggcttcgaacagctcgtcgagtgttcccagcccgccgggcaggacgatgaacccctgggcgtatttgacgaacatggtcttgcgggcgaagaagtaccggaagttgatgcccaggtccacccactggttcaggccctgctcgaacggcagctcaatccccaggcccacggacacgccgttgccttccacggtgccgcggttggcagcctccatggatccgggaccgccgccggtgatgacggcaacgccggcctccgccagtttccgccccacctccacgcccatctcgtagtacggactgccgggcttggtgcgtgccgaaccgaagacgctcacggccttgccgatgtccgccagggcaccgaacccttccacgaactcgctctggatgcgcaggacccgccagggatccgtgtggacgaactgaccggggcccttggtatcaagcagatgctggtccgacatctccacggccgcctgtttgcggcgcagctcaaggggccccttgcggcgtggctgggaatttcttgccggatctgcactgatgctcattcccctaggctaacctgcccgcgggaggtatctcttgaatcacgatccgcaggaacatggggtgattcgcatcataagccggtgttgttcgctagattcttcctatgactactcatgtgcccggcgatgccctcgtctccctgaacgccgtaaacaagcattacggccagctgcacgtactgaaggacatcaacctccaggtccgcaagggcgaggttgttgtggtcatcgggccttcgggctccggtaagtccaccctttgccgcgccatcaaccgcctggaaaccatcgaaggcgggaccatcagcatcgatggaaaggtcctccccgaggaaggcaaggagctggcgcagctgcgtgccgacgtcggaatggtcttccagtcgttcaacctcttcgcccacaaaaccatcctcgaaaacgtgaccctggggcccctcaaggtcaaaggcgtccccaaggcaaccgcggacaaggacgcaatggcgctcctcgaacgcgttggcgtggggcaccaggctcctaagctcccggcgcagctgtccggcggccagcagcagcgtgtcgcgatcgcccgtgccctggccatgaagcccaaggtcatgcttttcgacgagcccacctcggcgcttgacccggaaatgatcaatgaggtcctggacgtcatgatccagctggccaaggagggcatgaccatgatcgtggtcacccacgagatgggcttcgcccgcaaggccgcggaccgcgtcgtctttatggcggacggccagatcgttgaggacgccaccccggaggagttcttcaccaatccgaagagcgaccgcgccaaggacttcctctccaagctcctcacccactgatccacccgaacaaacactccaagttcgcacccaggccgtgacccacggcctcaatgaaaggaatgtcatgaaggcatttatgacccggcggaagtcattcttcgtggcggctaccgccgccctcgccctgtccctgagcgcctgcggcggtggcggcaccgacgccgggggcgatccctcggttgctgcagagcccacgttcgctgccggcaccaccatggaaaagctctcctcagccggcaccatcaagatcggcaccaagtacgaccagccactcttcggccaggtgggcctcgacggcaagccggttggattcgacgtcgagatcggaaagctgatcgccgcgaagctgggcatcgccgctgacaagatcgaatggtccgagaccgtctctgccaaccgcgagccgttcatcgaacagggcaaggttgacctggtcatcgccacctacaccatcaatgacaagcgcaagcaggttgtcagcttcgcgggaccgtactacgaagccggccaggccctgatggtcaataaggacaatgacaccatcaagacccccgaggacgtcaggggcaagaaggtctgctcggtaacgggctccacccccgcagctaccatcgtggaccagtacggagcggaactcgttccggctgcaacctactccgcctgccttgagccgctccgcaacaaccaggtggaagccgtcaccacggacaacgtgatcctggccggcttcgtggacaaggaaccggacgccttcaagctcgcctccgacgagacgttcaccaaggagccctacggcatcggcctgaagaaggacgacaccgagttccgcaactggatcaacgaccagctggaatccttcgaagaggacgggtcctacaaggaggcctgggaagccactgcaggctcagtcatcaagaccgccccagagctgcccgagattgaccgttactaagtaaccccagtggttgccggggctgctccgcggccccggcaaccgccgtcttcgctcccgtccacgcccacatccgaaggaccctatggacgtcattcttgaaaaccttcccctgtactggaacggttttctccgcacacttttcctctccgccgtttccggggtcatcgcgctggtactcggcaccctgctcgcggcagccagggtctccccggtggcagcgctccgcggcttcagcacggtctacgtggaggtcctccggaacactcccctgaccatcgccttcttcttcgcggccattgtccttccccggctcggagttaaattcgagcagttcgaagtcgccgccatcatcgccttgagtacctacaccgcagcgttcatcgccgaagctgtccgctcaggtgtcaacagcgtcccggtgggccaggctgaagcagcccgcagcatcggcatgaacttcgggcaggtcctgaacctcatcatcctgccgcaggccctgcggacggtggtcccgccgctcatcaatatcctgatcgccctggtcaagaactcctcggttgccggcgcattcttcgtcctcgaactgttcggctacggccgccagctggcaaacgccaacggtgacgccgtcatccccgtcctgctgggcgtagccttcttctatctgctcctcaccgttccgctgggcatcctggccagcacggtggaacgaaaggtggcgattgcccgatgagctcagtcctctacgacgttccaggccccaaagcccggcgcatctcgctgatcggatccatcgtgggttcgctgctgatcctgggcctgctggcctggatcatcatgacattcgcgcagcagggcatctttgaagggcgccgctggcagatcttcacccgtgccgatgtgtggacgctcctggccaacggcctgggcgcaaccctcagcgcggcagccctcgcggctgtcatcgccttccccctcggcctgctgctctgcctgctgcgcatctccgatgcggccttcatccggatccccacccgggtggtgctggagttcctccgcggcatgccggtagtcctcatgatgctgttcgtcctgctcggcttcggcacctcgcccttcattgctgttgtcaccggcctggtgctgtacaactccgcagtgtttgccgaaatcatccgcgccggcatccagtcgctgcccaagggccagcgcgaggccgggcttgccatcggcctcaccagcttcaagtcgcgcatgctgatcgagctgccgcaggcaatccgtcgcatgatgccgtccctggtggcgcagatggtggtgctcctcaaggacacctcgctcggctacatcgtggcgtacggcgagctcctgcgcgccgtacaggtgatggcggacttcctgggaacgcagttcctgttcccgatcttcttcgtggcagcagccatctacattgccatcaacatcctcgtttcgaggatcgcggtgtggatcgagcggcgcggatccaagaaggcggcaggcggtgtggccaaggccgaacccgaagctgccgaagcagccgttccctgatagttctccctgcaacaatggcccggaccaactggtccgggccattgttttgtggttcaggtggccagccacttccgcagcgccgccaggcaggtgcggatcgcctccgcgtgcacgtgttcgttgtccttatgagccagcagggcatcacccggtccgaagttcaccgccgggatacccagttcgctgaaacgggcgacgtcggtccagccgtatttgggcttcggctcggctcccacagcggcaacgaaggacgcggcagccgggtggtgcagtcccggccgggcaccggcggcagcatcggtgcggacgacatgaaagcctgccagcagctcccgcaccacggcctcagcctggtcgggggtcttgtccggcgcgaaccggtagttgatttccaccacgcaccggtccggaatcacgttgccggccgtcccgccgttgatcttcacggcgttgaggctctcccggtattcgagtccgtccaccgtgatggtctgcggttcgtaggctgccagcctggccaggatcggtgccgcggcgtggatggcgttgctgcccatccacgcccgggcggagtgggccgcctctcccacagtggtcacctcgaacctgctggtgccgttgcagccgccctccaccgtgccgtccgtcggttccagcaggatggcgaagtcaccgtggagcaggtgtccgtggttgcggaccaggcgccccaggccgctcttgacggcttccacttcctcgtggtcgtagaacacaaaggtgacgtcccgctttggcgaggcgccgtcgtcgaacattgtggcagccagcgcaagctgcaccgcaacgccgcccttcatgtcggtggcgccgcggccgtacaggatcccctctcccggaacacccggctcccagctggaaggcaccgtccccttggcaccctcggccaggggcagcggcacagtatccaggtgccctgccaggatgacgcgctccgggcggcccagttcggtgcgggcgatgatcgaatcgccgtcccggagcacgctcagctggggaactgccagcaggggcgcttcgacggcgtccgcgagtttcttttcgtggccggacacgctgttgatgtccataatggcggcggtgaggagcgcaacatcctggcggaggtcgagctgcagggtggaaggctggggggtggtttcggcagtcacgaagccagtctagttcggaccctgtccccgcccgtcgatagactggggccatgactgagactgcttcttctgccgtgcccgaaacctcgaatgcatccactgaccaccgctccgcctacggcttcggcgtggccaccgtttccaccgctgacgccagcgtcctggatgtctggtttcccgccccggcgcttggtgtcgccgccgaaaacctccgttccgtcgagaacgcggatgagtcgctgacaagcatcgccaaaaatggtgcggaccaggaccgcggcaccgagcagaaggtggtttttgtccagatccacctcgatgaagccccggccgacactgtcgatgcctaccttcgcctgcacctcctctcgcaccgcctggtccggcccaacaccatcaaccttgacggcatcttcggcaagctgcccaacgtcgtgtggaccaacttcggccccgccgccgtggaaggctttgagctcacccgcgcgcggctgcggcgccgcggtgccgtcaccgtctacggcatcgacaagttcccgcgcatggtggactacgttgtgccaaccggagtgagaattgccgacgccgaccgggtgcggctgggtgcgcacctggccgaaggaaccaccgtgatgcacgaagggttcgtaaacttcaacgcaggaaccctgggcacgtcgatggtggaaggccgcatctcagcgggtgtggtgaccggcgacggcagtgacgttggcggcggcgcctccatcatgggcacgctttccggcggcggcaaggaaaagatcaccatcggcgagcgggtgctgctgggggcaaactccggtgtgggcatcagcatcggtgacgactccgtggtggaggccggcctgtacgtcacggccggaacccgggtgcgcgtaccggggcccaaggacgaggtgggcgaggacaccacaaagatcgtcaaggctgccgaactgtccggtgtgcccaacctgctgttccggcgcaactccaccacgggcgcggtggaggtcctcccccgccagggccagaccgtggagctgaacgacgccctccacgccaactgatcattccatggcacgaagacgcggactgcgccgcctcgcagtactggtgctcaccctggcactggtggcaggcggcgtgtactcggccgtgtttttcctgcagcgctccgaaacactcgtttctgagcgctgcagggccgggattggcgagcgtacgtcggaactcgccccggaccaggccgtcaacgcttccctgatcaccgctgtggcggtgcagcgcgggcttccgccgcgtgctgccagcatcgccctggccaccgccatgcaggagtccaagctccggaacattgaccacggggataaggccggcccggactcccgcgggctgttccagcagcgcccctcccagggatggggaaccgaggcacagatcatggatccctactacgccgcaaacgccttctacgacgcattggtcaaggttccgggctacgagtcactggagatcactgacgcagcccagcgtgtccagcgctccgcctaccccactgcctacgcacagcacgaggagatggggcggacctttgcctccgggctgaccggccagacgcccgaagccgtccggtgcaccctgcgggcagccggtgccggcggggacaccgccgcgttgtccgccgaactgagccaggcctacgggccgctggggacggctgttgagggtgaaacgctggtggtggaggccgccggcagccaggcctggtccgtggcgcaatgggcggttgccaacgccaaaggcttcgaggtcacgcaggtggacatcgccggccggagctggaaccgggaggcgcaggacgggtggcaggcctcggcagcaacggacggacaggtccggatcacggtggcggcggaagggaccggcagctgaagctgcagtaggaatgctgccgggctgctgccgggtggagggtccctacacgaggatctcaaccaccggctgtacgtagctgcggaagagctcaggctccgccatcagacggttgctcataatgatcttgtccggctccaggtaccaggcccgctgctcgttgagcggaagctcgatgatggtcagcttgaagtcacgggaatcgcggccaacctccatcagcctgtcgtccaccatgtcctccagcagctggtccgcgccgctggcagcacgctccgcctcaatctccgcgtattcgctcctgcgctcccgtgcccatgtgagggcggagccgaagtgggcctggagcacccgctgcagggcgggagaatttccaaaggattcaaagtccggcggcgacagctcgggagaagtctggggatgtgccttgagcagctgctcccaccacgcctcccactctgtcttgagggcacccaggccaccaacgtccgcggtcaagtgtgaatgatcggcacggcgtaccttgggcgctgcatgggacagagcggggtgacctgcgccgtcgagccccgcagtatcccggacgaacagggctatcatcattggccccgacgtgtccgcggtgatttgccacctggtaccgcttgtctgatacatccgacgtccttccgtcgcgtgccatagccgggagaggtgatccggcagctcccccggctcccagtgtattccccctaatgcccacgttagtggcagtcatcacatcccgtcgaggtgctgttccaggacgtccacgcacatctcccgggtcatccatccgggctgcagcagggcgtgcatgcacagcccgtccagagtcgcgagcagacgctcggcttccaccacaaggctttccttcggttcgtccgccggcctcagggcgctgacgaccctgcccacgataacggccacctcccggtggctccggtctgcttcagcggccaggaacggacggaccctcgcggcgttccggaacgccatccacgcacaggcctcaagcgcgcggggcccatccaggggcaggactccgcacaggagggttaatatggcggcgcggtgtccaggggtaccgggaaccgccgcgtgcaccccaggcagggatgcctcaaggcggcgcacgatgcggtccaccacggaggcgaaggcgaacgccagcagttcctcactgcctgcaaaatagtggcggacagagcccacagccagcccggcttcgtccgccgtttcccggagtgaggcccgttccagcccgtcaccggcgatgatgcggagaactgcttcaacaacgtcctggcgccgggcttcggcatctacgattttaggcactcctcctatttagcacggatgtgctcttttggacggtccggcatgccgtgctgccggcttgccatgcgcctcctcgcagcggcgcaggtgcggtgctgcccggcatccggaacacggcggcggcagcaggtgtccgtgggatagcgttagaggcatgaaaattctggtcaccgggggcaccggctacattggttcccacactgttttatccctgcaggaagccggccatgatgtggtggtcatcgacaacctggtcaattccagcgaggaatcgctccggcgggttgccgagctcagcggcaagaccgcggagttccacaacgtcgacctggtggatgaagccgccgtcgagcgtgtatttgccgccagtcccatcgacgcagtcatccacttcgcaggactgaaagccgttggcgaatccgtccgtgagccgctcaagtactaccacaacaacctggtggggaccctgaacctcatccgggtcatggaccgccacgatgtccggtccatcgtcttcagttcctcggccaccgtctacggcgagcacaaccccatcccctacgtggagaagatggagatcggggccaacaacccctacggccgcaccaaggagcagatcgaggacatcctctcggacctgggcgccgcggactcccgctggcacatagccctgctgcgctacttcaaccccgtcggcgcccacccttccggccggatcggcgaagacccccagggcatcccgaacaaccttgttcccttcatcgcccaggtggccgtcggccgccgcgagaagctgatggtcttcggcggcgactacgacaccccggacggcacctgcctgcgtgactacatccatgttgtggaccttgcggaaggccacgttgccgccctgaactacgttgcggaccgcaccggcgtcttccgctggaacctgggctccggcaagggctcctccgtcctggaggtgctgcgctccttcgaaaaggcagtggggcagccgatcccctacgagatcaccggccgccgtgccggcgatctccccgccttctgggcggacgccacctccgccctggcggacctcagctggtccaccaccaaaaccgtggaccagatgtgcgaggaccactggcgctggcagaagaacaacccgcagggctacgcttcctgaccccaaaccggaccaacgcaagcggccgcccacctttggaaggtgggcggccgccgtcgttcgtcaccagggcccacaccggcgagggacccgaaccgagcctgcgaggtttgggagccggtggggacttagcggaccgggtagtcccgctccggctcgccgatgtagagctggcgcggacggccgatcttggtgttcgggtcgctgatcatttcgcgccactgggcgatccaaccggggaggcggccaatggcgaacagtaccgtgaacatcttttccgggaagcccatggccttgtagatcaggccggtgtagaagtccacgttcgggtaaagcttgcgctggatgaagtagtcatcgttgagcgccttctcttccaggcgcagggcgatgtccagcagttcgtcgttgccgccgagcttgctgaggatctcgtgggccgtggccttgacgatcttcgcgcgaggatcgtagttcttgtagacgcggtgcccgaagcccatgagccgaacgccgtcttccttgttcttgaccttctccatgtagtcctcaggcttcgtgccgtcggcctggatctggcggagcatcttgagcactgcctcgttggcaccaccgtgggcgggaccgaagagcgcgttgataccggcggacaccgatgcgaacaggttggcgttggacgagcccaccaggcgcacggtggacgttgaacagttctgttcgtggtccgcgtgcaggatcagcaacaggtcaagcgccttggcaatgaccgggtcaacctcgtactgctcggccggcaggccgaagctcaggcgcatgaagttttccacgaggttgtgggagttgtccgggtacagcatgggctggccgatggacttcttgtgcgcgtacgccgcgataaccggcatcttggccatcaggcggatcgtggaaacttccacctgctcggcgttgaacgggtccagcgagtcctggtagaacgtggacagcgcggacactgccgaggacagcacgggcatcgggtgtgcgtccctcgggaaaccgctgaagaagcccttgagctcttcatgcagcagggtgtggcgccggatcttctggtcgaactcctccagctcggtggggctgggcaggttgccgtagatcagaaggtaggacacctcgaggaagctggagtgctgggccagctgctcgatggggtatccgcggtagcgcaggatgcccgcatcgccgtcgatgtaggtgatagccgaagtcgtggctgccgtgttcatgaagccggggtcaaaggtgactgcgcccgtctgcttcagcagcttggaaacgtcgtagccctcgtttccttcaacaacctggatgcgcggcagcttgagctcgcctcctgcgtggtgcagggtggccgcattgttggtctcagtcatggagtccccttcatgaggcttctgggcctctgtcgaaagcttgatccaacatcaggtgagccgcgcacgaagcctgagaacacaggttccaacacccgggctgccttcttgtagaaagccaccattgatagtcacttaaaaagtaccgccccttggcgggtgccactaatccgagacggtcccgaagcccctaaaaccgggccgttgtggcgcgagtcacagtattgttacggtgccgcaacgagccgggacactgctgcatcgatgcgctcgtccgttccggtcagcgccacgcggatgtaaccgttgccggcctcgccatagaaaaccccggggcccaccacaatcccgcgctccgccagccgccccaccgtgtcccaggtgctctccccggcggtggaccacaggtacagcccggcgtcggaatccttgatctcaagtccgaagtccagcagcgccgggaccagccgctcgcgccgcccccggtagaggtccttctgagcctccacgtgggcgtcgtcgccgagcgccacgcgcatggcctcctgcaccggatggggcacgatcatgcccgcgtgcttgcggctgttaaccaggttaggcatgaggccggggtcgccggccacgaacgctgcccggtagcccgccacgttggactgcttgctcagggagtagacggccagcaggccttggtgggagccgccggccacgcgcggatcgaggatgctgggaaccgcctgtccgccgcgctggatatcccagtccccccagccaagttctgcgtagcactcgtcggacgccaccacggcacccagcgcccttgcctgctgcaccagcgccttcagggagtcgactccccggacgctgcccgtcgggtttcccggggaattaacccagatcagccggacgcgcgcacgggtggcgtcatccagttcgtccaggttgtccgttgccacggacgtcacgccggcaagggtggcaccgatgtcatacgtggggtaggcgaccctggggcggacgacgacgtctcccggcttgagtcccaacaggaggggcaaccaggccacgagttccttggaacccacggtgggcatgatgttgcggggatcgagccctgccacgccccggcgcctttcaaaccaccctgcgatggcttcacgcagagccggtgtgccgtgcacggtggggtatcccggggcgtccgccgcggccttgagcgcgtcctggatcagggccggagtagggtccaccggggttccgatggaaagattgacggccccgccggggtgctgcgctgccttggcggcgtacggcgccatggcttcccacgggtagtcgggcaggtccaggccgaacgtcctcgctgctgcggtcacggtatcttcccgcgtcagtggtcttggttctgcggcggcagcgcggcgatcatcgggtggtccttgccggtgttgccgaccttcgctgctccgcccggcgagccgaggtcgtcgaagaactcgacattggccttgtagtagtccgcccattcctccggggtgtcatcctcgtagtaaatggcttcaacggggcacaccggttcacaggcaccgcagtccacgcactcgtccggatggatgtacagcgaacgctcaccctcgtagatgcagtcgacggggcactcctcaatacatgccttgtccttgacatctacacacggctgcgcgattacgtacgtcacgtccctggcctctccacgttggttccggcaacccgccggtacttgcatccggcgctgcggccggacccctgacatctgagcctattatctcccagcccgttcccgcgaacctagccggacaccctagtatgaactggtgagtcagcctgttcctacccccgccgggttcctctcgggcgcaacaccgggaatgcgggtggtggtgcgctaccgcatcgagggcggcctgaccgatgcactgggccatctggtggcatgcgacgccggtgcgtgcaccatccggacccggaaggccgacgtcgttatccagctgccagacgtagtggccgcgaaagaagtcccgccggcaccggagcgccgccgtaccgcgcagtaggcgcggccctcactgcgcagaccggtacgttgcgagggcctggcgcacgaagtcctggggctcgctgagcagcatttcgtaggtcacgcgaaggatgggaacaccccggataacggtcacgttccatcgccgcctgtcctcccggtacgcttccctgctggcgtgatgggcgtacccatctgcctcaacgcccagcagaccgtcaaccagcagatccaagtgacccatgccgggaatctggacctgcaactcgacggtcagccctgcctcttccagcaggtaccgtgccatcgtctcgatgatggacccggattgcgggcggattctggccaccaagcgaacaatcgcctttcccgtgccgccggaaaccggtcccgcagcgccgggagctgaaccagccccttttgactgcagattccgcaattgtcagtccttcaaggggcggcaggcagcgcagggcctgacacacaatgtccagatgcgccggtggcacggggccccggtgcaccacgcaaccactgaccggcctgccatgccgcgcagtcagatgcggtttaccgggcgttctgactacccatagccccgctgcggaggcagccgtgacgcagcccggaaccgcatgttggcggccggcgtggaccagcaagggatctgagttcggcagcgcatacacgccccgcgccactctttggacagcggcgtcaagcacaccggcttcaatactccgccgggatactccggcccgctgcagtgaagtggtgctggctactcccccaagtgcggccagcgccgcagtaacagtccgcatgagagcatgctgcctgcccacgggctcagacacagcggtgaagatcggctatgtggaaaacgcccgggcgcattgaaggggcagttccttgcgcagggagcgttccggcgcaatgaacccgggtattactgcgcaggccgggccgctcaaaggacaaagaaaaagccggtacgacggcgggaatcccccaccgccgtaccggcagtttcagttacgtgctggggtggctagaccttggcgcgggcgcggttggccttggaacgctcgttggtgtccaggatgaccttgcggatgcggatggcttccggggtcacttccacgcactcgtcctcgcgggcgaattcgagggactcttcgagggtcaggtcgcgcggcggcgtcaggttctcgaaggtgtcagaggaggctgcacgcatgttggtgagcttcttttccttggtgatgttgacgtccatgtcgtcggcgcgggagttctcgcccacgatcatgccttcgtagacctcggaggtgggcttcacgaagaacgagccgcgctcctgcaggttgatcatggcgaacggcgtgacaacaccggcgcggtcagcgatcatcgagccgttggtgcggtactcgatggggccggcccacggctcgtagccctcggagatggacgctgcgatgccggcgccgcgggtatcagtgaggaacttggtgcggaagccgatcaggccacgggcgggaacgatgaattccatccggcaccagccggtgccgtggttggccatgttcgtcatgcggcccttgcgggctgccatcagctgggttacggcgccgaggtactcctcggggacgtcgatggtcatgtgctccatcggctcgtggatcttgccgtcgatggtcttggtgacaacctgcggcttgcctacggtcagctcgaagccttcgcgacgcatctgctcaacgaggatggccaacgccagctcgccacggccctggacttcccaggcgtcgggacgctccgtgggcaaaaccttgatggagacgttaccgatcagttccttgtccaggcggtccttcacctggcgcgcggtgaccttagcgcccttgaccttgccggccagcggcgaggtgttgataccgatggtcatggagatcgcgggatcatcaacagtgatcagcggcagcggctgcgggttctcggcgtcggtcagggtctccccgatggtgatgtcctcgatgccggcgacggcgacgatctcgcccgggcctgcagactccgcggggacgcggtccagggccttggtggccagcagttcggtgatcttcacgttcttgagctcaccgttggcgcgtgcccaggcaacggtctggcccttgcgcagggtgccgttgtagatgcggagcagggcgaggcggcccaggaagggggaagcgtccaggttggtgacgtgcgcctgcagcacaccctccgggttgtaggtgggtgccgggatgtgctcgatgatggtcttgaacagcggctccaggtcttcgttctccggagcggtgccgtcagcgggctgctccagggaggcgcggccaaccttggcggctgcgtagacaacgggaacttcgaggatcttgtccaggtccagatccggaacttcgtccgccaggtccgaggcaaggcccaggaggagatccatagactcgtgaacgacttcctcgatgcgggcgtcgggacggtcggtcttgttgaccagcaggatgacgggcaggtgcgcggcaagggccttgcgcagcacgaagcgggtctggggcagcggcccctcggaagcgtcaacgaggaggacgacgccgtcgaccatggacaggccgcgctccacctcgccgccgaagtcggcgtggccgggggtgtcgatgacgttgatggtgatggtctcgccgttggaggacggtccgttgtaggccacggtggtgttcttggccaggatggtgatgcccttttcgcgctccaggtcaccggagtccatcacgcggtcttcaaggtggttgtgctcggcaaaggagttggtctgcttgagcatggcgtcgaccagggtggtcttgccgtggtcaacgtgggccacaatcgcgacgttgcggaggtcactgcgtgatgcagtggctaccgcggtgttggtggtggtttcagacatgcgtaatggctcgattcagtggtgaaagtcagctgttgtatcgcgacatttccaaccggaacgcacgacggatcaggcccttagcacagggcgccttcctccattctagcgccagtgccatttattggcctaaattctcaggccgcgtgcgggcgctgcgtggccccggccatgcgccgccacggaaaattgtgggcaaaatcactggccatacaggacggcatgcaacatgattgctctgacagaccgtgcaagccggaaagacaccagatgcgaaaatccctggccgccaaggcctggacccgatgtgccgcgtccggcgtcgctgcggtttttgccctgtctgccggactctccggctgcggcctgcccgccccgccccccgaaaatcctgcccgtccagttgcggcggcagctgcggcgggaccccaaggggcagccgggaatcctgctgccgtgactgccggttcccgcgtcctgaacccggccaatggtcggctcgaggccgttgtccccgagatcagcagaacggtcctgctgatcggtgattcacagtcggaaccccttgacggctggccacgcctgggcctggctgaggcagggtacaaggtgtacttctgcggccggggcggcaccggttttgtctcctcgaacggcgcaacaggcaactacatcgatgccctgctgcgcggcgactggctgctcccctcgggcacgccggcgctcattgttatccagggcggcggcaacgacgccgccggcggagcgagtgacagacggatagccgccaacgccgaacgcctgatcgccgagctccgggagcgctacccgggcacacgcatggcgatgattggaacgctcgcccgtggcgaggcccacggcggcggccggcggaccgaagtcgatgccctgctggggtcggtggcagcgtcccatgccctccccttcgtatccgtgggtgactggttgacccggtacggcctggtcaaggacctggccgactcggtgcacatgaaccccgcaggccgccagaaattgggaaccctccttgagggccgcctccgggagctgggcctggaccggaagccgacggcggaccagcagctgctgcgcgcctcaggcaccatggacgacggcccgggccaggactaaaacgcagtacggctggagccgcggcccgaaagccccggctccagccgttcccattgtgcgggcagccccgcttatgcaacttccggcggaagcatcagcttggcgcccgggatggcgtggagcagcgcctgcgtgtactcctgctgcggcgcgtcgaagacgtcgtccgtggatcctgtctccaccaggcgccccttctccatcacgcagacatggtctgcgatctggcggaccaccgcgaggtcgtgggtgatgaagaggtaggtcaggccgaggttggactgtaggtcagccaggaggttcagcacctgcgcctggaccaggacgtccagggcggacaccgcctcgtcacagatgatgacttcgggatccaaagccagcgcacgggcaatggcaacgcgctgccgctgcccgcccgagagctcgttcgggtaccgctgcatggtggattgcggcagcgccacctggtccagcagctcacggaccttcttctcgcggctggccttgttcccgatcttgtggacccgcaacggctcctcaatggtccggtagatgttgtacatcgggtccagggagccgtaggggtcctggaagatgggctgcacccggcgccggaacttgaacagttccgagggcttcagcagcgaggtgtccacgccgtcgaaaagtatcttgccgtcggtcggcttctccagctggagcaccatcttggccactgtggacttgccggagcccgactcccccacgatcgccgtcgtggttccccgaaggacgtcgaaggtaacgccgtcgacggccgcgaagtcggatgatttgcccaggccctgccggagcttgtataccttccgcaggtcctggacctgcagcacgttgtcagcggcaagtgcctcggcggccggagccaggaggtccgccgcttccacgccctgttccttggcaacctggatccgtcggctggccagggacggtgccgattccaccagccgcttggtgtagggatgctgcgggttctgcagcagctccagcgacggccccgattcgacaacctgcccccggtacatgaccacaaccttgtccgcgcgttcggcggcaaggcccaggtcgtgggtgatcagcaggacagccgtacccagctcggacgtcatgccttcgaggtggtccaggatctgccgctgcaccgtgacatccagcgctgacgtgggctcatccgcaattagcagccggggctggcaggacaggccaatggcgatcagggcccgctggcgcatgccgccggaaaactcgtgcgggtactgcctggcgcgccggtgggcgtccggaagacctgcctcggacagcaccttcgcgatgtcgtcaggcccgctgggcctgccgttggcgcgcagggtttccttgacctggtagccgatcttccacaccgggttgaggttggacatggggtcctggggcaccatgccgatggtgttgccacgcagctcgatcatccgcttttcgggcgcgtgcgagatgtcttcgccgtccagcaggatctgtccgccggaaacccggccgtttgccggcagcagcccaatggctgcgagggcggttgttgatttgccggaccctgactcgcccacgatcgccacggtctcgcccggcatgatggtcaggtgggcattccggacagcgttcacgtcgccgttgctggtgttgaacgtgatggccaggtcccggacttccaggagcggccggtttgcgggtgttccggcttcggtaatggtgacatctgatgcagtcacgtgtgcctccttcatcgctggcggctcttcgggtcaagagcatcgcgcagggcgtcgcccagcatgatgaagctcaggacggtgatggacagggcggcagccgggtagaggagcactgcggggttggtgcggatggacgactgcgccgcggaaatgtcattgccccaggacatgatgctgccgggaagcccgatgccaaggaacgacaacgtcgcctccagcacgatgaacacacccagctccatggtggccagcacgatgatgggggcgagggcgttgggcagcacatgcctaatgaggctctggatcctggacacacccagcgaccgggccgccgtgatgaagtcggcgttgcggacctcgatcaccgcgccgcgggtcaaccttgccatctgcggccacgcaagcagcacgatgatcatgatgaccgtccacacactcttgttttcgcggaagaacggcaactgggtgaccaccagcgcaccgagcaccagcggcagtgcaaagaagatgtcgccgaggcgggcgatcacggcgtcgatccacccgccgtagaagccggccagcgcgcccaaggttaccccgatgatgagcacgccgatgacggcgaagacgccaaccataacggaggcctgcgtgccgtaaatgacgcgggcgtacacgtcgcagccctggaaagtgaatccgaacggatggccggccgagggcgcgccgtccgaatttgccagctggcagttgtcgttcggcggagtctgggtgaacaggcccgggaagaacgccacaaccaggatgaccaggatcatcactgccgagacgatgaacagcggacgacggcggagcttccgccaggcgtcagcccacaggctcagcggggcctggtcagtcttcaccgcatccgttgccagcagaggggtctcctccaggggggcaacgaagtgcgtggtgtcttggttacttttcatagcgaatcctcggatcaagccaggcgtacagcaaatcaaccagcaggttggcgataacgaagaccagcaccagcacgctcacaatcgcgacgacggtgggtccttcgctgcggagaatcgcctggtagagcttctgccccaccccggggacgttgaagatgccttcggtgacaatggcgccgcccatcaaaccgccgaggctggcgcccaggtaggtgacaacgggaatcatcgagttgcggaggatgtgcgccatgaccacgcggggccgggacagtcccttcgcagtggcggtacggacgtaatcggccgttgagttttcaatgaccgacgcgcgggtgaggcgaagcacgtaggcgaaggagaccagcgcaagcgcgaacgccggaagcagcagcgtgctccagctgacgtccgtgcccactgttggtttggcccagcccaggtacacaccgaaaaccagctgcaggacgaagccgaggacaaagatggggatggcgatgacgacgagcgaggcgagcaggacggtcgaatcgaagatctttcccttgcgcaggcctgcgatgagtccgaagccgatgccgaacactgcctggatgacgagcgcctcgacggccagcataacggtgacggggaagacgcggccgagggtggcggcgatgggctggccggtgaaatcgacgcccaggttgaacgtaaagagattcttgaggaacaggccgtactggacccagaacggctggtccaggttgtactgctggcgaagggccgcgatgacggcttcgctgggcggacggtctccgaagagcgccctgatggggtccccggggagggcaaacaccatgaagtagaccagcagggtggtgcccaggaacacggggatgacttggagcagacgccggaggatgaactggatcacagcagaccctccggggcttgtggagatggggggaatttcatgtaggacagcttcctgccggtatcaaggctatggggcccggctggtgccggacccccactagctatttgagttggacggtctcaggactactttgcggtgatgttgtagtactggatgacaccgttccagccgctgtccacgttggtgacgttctggctccacacgacctggcgtgcggagtaccacagcgggagattgggcaggtcctggaacaggacttcctgggcctcggtgaacttcgcgttggcgtcgtcagtggacttcgagcccagcccttcgtcgaggagcttgtcgaactcggggttcgagtagccctcgtagttggcgctggaacccgtccgcagaagcgggccgaggaagttgtacagcgacgggtagtctgcctgccagccggcccgggcgaagccgggaagcgtctgggacttgcgcaggtccagaagttcagcaaacttggcgaagggctggccttcaacctggatgccgaggttgttcttcaggttgttggcaacagcgtcgatccattccttgttgccgccatcggtgttgtaaccgagctggagggtcttgtctgccggccaggcgctgatggcattggccttttcccaggcttcctttgccttggcggcatcgaacttcaggacgtcagagccctcgacgttctcgttgtagccgtccacggccggggaggtgaagtccttggccgggatgcgggtgccgctgaagatgaccttggtgatctcatcacggttgatggccatggagatagcctgacggcgcagcttgcctgcttcgccctggaactccggcaggtagcccgggatgttcagggtggagttgcctgcgtacggcttgttcaggtggttgtccgggaagtccgtggtgtaagtcttcagggcgttggtcggaaggacatccgtgacgtccaggttgttggcctggatgtcggtgtaggcaggagccgggtccgtgtagaacttgaaggtcacgccgccgttcttggcttcacgggtgccggcgtagtcctcgttcttgacgagttcaatctggctgtcgtgctgccaggcgccttccttggccatcttgtacgggccgttgccaacagggttctcgccgtaagccttggggtcagcgatagcctcggagggaagcggcatgaaggccgtgtagccaaggcgcaggggccagtcggcctccggctgcgtcagcttgacctcaatggtggagtcatccttgaggaccaggccggagagggtctctgccgtgggagcggggacctctgtctcgccttccttcttggtggcgctgacggcgtcgtagccctcgatggactcaaagaagctgctgtttgcctgggcgttggtgctcagcgcggcgaagttccaggcgtcaacaaagctcttggcggtgacttcctcaccgttggtgaacttggtgccgctcttgaccttgatggtgtagttctggccatccggggattcgatggactcggccagcgcgttgaccgactcgccactggggctgtagctggtcaagccttcaaaaagaagctcaacaacgcggccgccatagacctcgttggtgtttgccggcagcagcgggttctgaggttcgttgctgtaagccgtgatgatcttggccggatcgcctgcggcgtcgcttgccccttcattgctgccgcctccagcgccgcagccggtcagggcgagggcggcgattgccaccatgcccagtgctttggaagtgcgcgtaaaacgcattccgcctcctatgagttgtgggagataacgaggggggaatctggtggttccccgcaggcgagacgcagctttcgactgtgacgcaacctacatatacgagtagcctaaccgcacgaagtccagatactggtactccgttgccaaaccgtgaccgcctcgaactgaacgcctagtcggtcaacggaagttgtgcaagtcacatgctactcgccggtagcccctacggcgaatcgggcaggagggaaggttttcgacccgattatcaggacgacgccggctgcgccaggcgccagtcccatacgttccaccagacacccaaggggccggcgctcgtcttgacgcccgccacccgggcgctgaaggctgtggcaccaacggtctggtaaagcgggaggccgtaggcgttttcccagatctgtttgtcgatctcggccaggagctcatcctgcttgcccaggtccgtggtgccggccagctgttccatcagcctgtcggcgtcgccgtccgaaaagccgttgaagttgctgcccgcgccggtacggaagatctggggaacccggctgacccccgctgcggtgccaatccatcccagcagcgcggcgtcgtagcctccgccgccgagtgcccgggcccagtcagcactcccctgccccgcatcgaccacctggaagccggcctgggcggccgagtcccgaatcagggaaaatgctgtggcgcggttggggttgtcccggttgtaaaggatccggatggtgggggtgtcaccatccaggagggcctttgccccgtcgatgtccacctcggcatagtccgacgagccgttgttcttcacggtgtcgttgtatttgggctgggcgggaaggaatacgtgggaatccaggggcgcggcatcgggctgcctgtcccccaccacggcgtcgatgatggcctggcgggggaccgccttcaggaacgcctggcggacgtcctcgtcggcaaaaggcccggagaaggtgaggtcaaggtggtcgtagcctgactggtcgtaccattcaacggtgttcccctggtccgccaggcctgccaggagttccccggtttcggctgagggctggggggagataatgtctgcctggccgttccggagcgcttcgactgccgtaggcacggagcctgtgaagcggacggttatttcatccagccagggctcctgtccccacacatagtcgcggttccggacgagggtcatggagacttcagggacaatgtcgcgcacgatgtacgggccgctggagagatatacggacggatcatcgggcaggcttttggagtcgaacccggagttccagaagtcgctgacccgcttgagggggtcgttgactgcgggctcttcctcattgccgcggggcgagtcccggatcaggtcggtcaggtcttcttcgtcgttcaggccgcttttcgctgcgaccacgtgtgcaggcagtccgacgtcgaaagccacttcccagtcggcgtaggggacggcgtattccagggtgatggagcggccgtccgccccgatttccggcagcacggtaccggcaaggcctctggtgtctgaggctaccgaaaagtatgtggtgcctgtccccgccaaggggtcggcgtcgtcaaaatatcctgacccagccgcccagctcaggaggaggtcgccggcgtcgaccgcctcgccgtcggaccatttgacgccctcattgacggtgtacctgaccttcaacggctggtccgagaccttctcgtagcgcccgaatttttcgttccgcaccacttttgcgccgtcatccaggtagtagaaacccgagtgggtgatgtagccgatcttggagttgatatcggtgttgccgtccgcgctgtacgggttgaaggacgagaacgcgttgacctccgcaacgctcacgctgccgccgcgcttggcctcccccaccaccacaggggtggtggtgccgccgttgcccgagcagcccgacaggaccagggcggccgccactgccgcggtgatgtagtgcaccagacgcctgaacggcatgccgcctccttgttttcttctgcgggaggggcccctggaatcgccaggtcacgccctgtactcaggataaggcgtgcgggccctcgattgccggtgccgtccgcagcagccgtgttgcctcttgtcctgccccgagcagggcttcagcacgacggcggtgctcccgccgcttgtccgggtccatggtgtccaacagggagaccaccatccgcgagcggggattcctttcgaagacctcccggtggtcatcgatgaaggtccagtacagcccgtcccagtcttgcatccattcccctgccggcaggtccgacatcctgcggaggtagttgctgcccgaaacgtagggtttcgtggtgatcgcctcccccgccgcgaactggctcatggcgtacacgttggggaccatcacccagtcgtacgcgtcgatgaacagttccatgaaccactcgtagacgtcgtcgggatggatccgcagcagtgacatggcgttgcccaggaccatcaagcgctcgatgtggtgcgcgtaccccgtggcaagcacacgcgagatcaccatgtccacgggagccagcccggtgtccgcatcccaccacccgtcccccagcccgttccggtggttcaacaggttggcggtgcgcatctgccggccgcgggtccggtaggtggcgcgcatgtactcccgccagccaatcacctgccggacgaaaccctccagggaggcaagcggggtaccgggccctgcaccctcgagcacggcctcaaggacttcccgcgggtccagcagtccgatgttcaacgccggcgtgagcaggccatgggcgatgaacggatgcgtggtggagattgcgtcctcgtacgggccgaagtcgtccagccgttcgcggacgaactcctgcaaatgcctccgtgcctcgtcagcgctcgtgggccaggcaaacagggcgggatcgcccggagcatccggaaactcctccgccacccaggcgatggcctggacgacgtcgtcggacggctcgtctgcggcgccggcggcatgttcggtgagggcttcaaggtcgaaggtcccctgcagctgctggacggggtggcgcgcaaaccggcccaccgtgcggggcgtgtacccccggggaagctttttccggttgtccgcgtcgaaggaccatttcccgcctgccggctgcccgccgccgtcgacaaggacaccgagcctgcggcgctgccacacgtagaagtcgtgcatgcgggcagcgttggcggcaaaccactggtcaatctgcccgcggtcggtgaggaagttcggcgtctccagcacgtcctcgccgcgcatccggtagccgccgtcggccaggccggaataaaggtcccgttcaagccagtcgtccaccacgtcgaaccacgtcacctgtgccgggcggcggcggcggaccaggtctgcgagctgctggcgggagctgcggccggcctcactgcggaagacgacaacctcgtggcacttcgcgccgaggcggcgcgcaaaccggctcatggacgcccggtgcaggaccagtttgtgggagtggaacgagtactggcgaaagagcaggtcatgctcgatcagcacaaacacggtaccgtctgccgcatcgaggtgctcccggaacaactgatgcggcagaaccaggcgcaggtgcggtccggacgtcattcccccaccctagggggtccggcggggcgcacggagcctgtcgaacggtttggagcaagatggctttgacgcctccgccgtcagcaatgaaacccgcttcggggtccattagctcctttggcgctcagttgcaggacctcggccgagcctagaaggcggtgctgggcagatccttctcgccatcgacgatcgcagtgataatccgcgctgcaaccaggtctggatccagccccgcgccgaatcgcggcgctgacccggctatcggatgatcggacagcgcggtgccagtgtggcctgggcgggcgtccacgattcggatgcccgcgcggcggtactcgcgcgccgctgcgacaacgaaggccgcgagcccagccttcgacgccgagtatgccgccagaccggcgacgggtgcttcggcgacaacgccgctcagcgtgacaacgaagggctcccggccctcacgtgccgaggcctcgaggtagggctggctctgggtaatgagctggatcggactggtcgtgttcacagcgaagagttcgtccaccgtggcgggttcaaggtctgatgcggcgccgaaggcgacgaccccggacgcaaccactagcccgtcgaggcgtccgtattgcgcattcgtatcatccaagacctcctggatcacggagggtgcgcgcagatcgtgcccagcagactttgacgaccgggcgacgatggcgccgttactttccagctgggcggcgatgcgcgaaccaagtccgccggtggcgccgactaccagaacaaccgcaccctgaagagtcgtcatgggtagatcctaggtcacgtgctgcaggtagccgagcgtgggtcggttccctgaggctgaacggctgcggtactacgcaggccacgaagcaggcttcactcgctcgtccgggatgaagcgcgccaacagagacgggcccatctgcggaagcagatgggcccgtctcaaaactctgtgggcgttagacgttgaagcggaactccaccacgtcgccgtcggccatcacgtactccttgccctcaatacggaccttgccgcgggacttggcctctgccatggaaccggcttccaccaggtcgttgaaggacaccacctcggccttgatgaagccgcgctggaagtcagagtggatcaccccggctgcctgcggtgcagtatcgccttggcggatggtccaggcgcgggtttccttggggccggccgtcaggtaggtctgcagtcccagggtgtggaagccgacgcgcgccagctggtccagcccggattcgtcctggccattcatttccagcatctcgcgggcttcttcctcgtccagttccacgaggtcggcttcgagcttggcgtcaaggaaaacggcgtccgccggggcaaccatggcccgcagttcctcctgcttttcaggattgcccaagatgccttcatcggcgttgaagacgtagatgaacggcttggccgttaggaggccgagctccttgaggtgttccatttcgagcttgtcgctcttgatggaagagaagatggtgtcgccgcgctccaaaaccgcctgggccgccttgatggcggcaagctcagcagcttcccgcttcttgatcttgacttccttttcgatccgcggaatggcgttctcgatggtctgcagatctgccaggatgagctcggtgttgatggtttccatgtccgagcgcggatccaccttgccgtcgacgtggatgacatcggggtcatcaaacacccgcaccacctgcgcaatagcttcggcttcgcggatgttggccaggaacttgttgcccaggccctctccttccgaggcacccttgacgatgccggcgatgtccacgaacgacaccggcgcgggcaggagacgctgcgagccgaagatctcagccagcttctgaagccgggggtcgggcaggttcacgacgccgacattgggttcgatggtggcgaacgggtagttcgcggccagcacctggttgcgggtgagtgcgttgaagagagttgatttgccgacgttgggcagtccgacgatgccaatagtaagagccacgaggattgattctacccgcagcgggcgcactgggggtccggagccggccggggaaaatgtcgcttcggcaaaatgtcacagccccgtgcgacagtgagggcatggatggtttcgcgttgattcttgctttgttcatgctgctgctgggtgcctttgcaggtgctgccgctgtgtttttggtgctgcggaaaagcaaccgcggcctggaagaggacttcgacgccgtgtcatcacggctttcagaggtcagcgcgcagtttgccgcggccgacgccgagcgaaggcttttggcggcacagaaccgcgagctgggtgaggcccggacgcaggacggcagcgtgctgcgggcgctggccccggtggcggagaagctgacggctgtccagcagcaggtggcgctgctggaacgggaccgggtggagcagtacggccagctcgcccagcagctccaggaagcacggctctccgacgaacagctgatccgctccacccatgcactggagtccgccctgaggtcgaacagtgcccggggccagtggggcgaagtccagctccgccgggtggtggaagcctccggcatgctgcggcacgtcgatttcgtggagcaggtccacagcgccgggcaggattcgggcgtgcggccggacctggtggtgcagctccccggcgaaaagcagttggtggtggacgcaaaagtaccgctgtcctcctacctggaagcccaggaacttggcgctgcgcaggacctccgcccggccgagggttccggtgcaaggcagtccggaccgctgtccgggagcgaccgccggaaccagcagtcgctgctggccgcccacgccaaggcactgcgggcacacgtggattccctgagcagcaagaagtactgggacattccgggcaactcccccgagctggtgatttgcttcattcctgctgagtccatcctggccgccgcgctgatggccgacgccggactcctcgatcacgcactgtcgaagaacgtggtcctggcgtcacccagcacgctactggccgttctgaagtctgtggccttcacgtggcggcaggacgtcctcacggacagcgcccgggagttgttcgaactggcacggcagctgtacgaccggatggggaccctgggcgagaacgtcaccaaactgggctcgtccctgaaatcgtcagtggaccgctacaacgccatggtggggaccctggaagcccgcgtccttcccacggcgcggaagctgaactcgcttgaggaatccggacttgctgcccctccggtcgtcgaggtcacaccgcgggccctggcggcgccggagctgcaaagcgaccacgaagcagcctgacagcaacgccaagaggcgcaaaaaagtgggcccggcagttgccgggcccacttccacaaagatcgggtgcgcagtcactggctgcgcatactacgacttgcgcgttaccggctgtgtgccggtcagtcccgcgagcggcgtccgcccagggcacggctgacgtcgccggcctgcttaagtgttgcccggagttccttgggcagcgagaagagcaggtcttcctcggcggtgaccacttcctccacggtgccgtagccgtactcggccagcaggcgcaggacgtcctgcaccaggacctccgggaccgatgccccggacgtcacgccgacagtggccacgccttcaaaccaggcctcatccacctcgttcgcgaaatcaacgcggtaggacgccttcgccccgtactcaagggccacctccacaagccggacagagttggaggagttcgctgagcccaccacgatcaccaggtctgcctgcggcgagatcttcttgatggccacctggcggttggtggtggcgtagcagatgtcatcgctgggcggatcctgcagggtggggaaccgctgcttgagcaggcggaccgtttccatggtttcgtcgacgctgagggtggtctgggaaagccagatcaccttctccgggtcccggacggtgaccttgtccacctcgtgcgggccgttgatgatctggatgtgttccggagcttcccccgccgtgccctcgacttcctcatggccgtcgtggccgatcagcaggatgtcgaaatcgtccttggcaaaccggacggcttccttgtggaccttggtcaccagggggcaggtggcatcgatggtgcgcaggccgcggtcctcggcggactggaccactgcaggcgatacgccgtgggccgagaagatgaccagggcgccttcgggcacttcgtccgtttcgtcgacgaagatggcgccctgttcctccagcgagctgaccacgtgcacgttgtggacgatctgcttccgcacgtacaccggaggaccgtagtgttccagggccttctcgacggcgatgacagcacggtcaacgccggcacagtaaccgcggggagcagcgagcagcaccttcttggttccggagacgggggctgcggcagctacttcctcaggtgagcggcgcctacgcgggatggtgggcatcgaaagggaaacagctgagggggtcattactccatgctaccggcttgcccgcgcccgcttacgcgtagcgaacccagccaccaggcccaggaacaacagcgcaccgccgccagcggccgctgccatggtccagccccggaaatctgctgcggccgccgccacaaactcatccctgaacatgttggcaacctcatttccgctgtccgcggacacagcggcagcggacgcaatccctgcaccgagggtccacgcagccgccagcagcaacgcgcctgctcctgcgccggacaccactgtccagcgtcggttcgccgccaccagggccaggagcagcgcaatcgccgagcccccggccagaaggtagccggcgggggcataagtggtgagcctctcggtccattccttgtgctcaggctgtccaacgttgatgagggtctggtccggcgggtccaggggcaacctggtggtgcgtgaaatctccccggcccccagcgacaccaagggggcgacgtcaagggtaagggatgacgcaggggctgatccgtcgccgtccgttgccgggccggcgaagctgagccggtggctcttgcgcagcgtttcctcccatgcaaccgaatactccggcagggcggtcagtgcggacgcagcgtcctccagcaccggctggaccaggtccgaaaggaagccgggaacggcgctggtgtcgacggttgccaccgctgccacggccagccgctgctggaactccggatccctgccgagcggggccgccagctcaacgaacccctgctcctggacgacgttacggtccagccagatggcggggactgcgacggcggccagcaggactgccagcacggtggcggcagcggaaacaaaacttcgcacggaggatccttcacgttcgcgggggtcaatccatcctaggcggggcccgggcggcatccttgtcagtccttggtggtagagcttatggataaggttgaatggccgccggacacccaccagcgctattccaaccagcacgattccgaccagcacgattccgaccagcaccatttccagccagcgctgaaacaaccagccgaccaacggacgaaggaccccatgcccgcagccacagcccgccacgagcgtccgcatgtctgaacaggcgtcgcttccggtccccggccagcagctcgcggcgcccaccacgctgcctgccacggctgccgaaaccagcccggacaatccgtggccgctccagctgctgtcacagaagctcaaagcccacattgaccgtacgccgtctgcgtgggttgaggggcaggttattgagctgaaccgccggggcaccaacgcctacctcaccctgcgggacgtcgacgccgaggtttcgctgcccgcctccgtgtggaccaaggtgctggaacgccagaacctgccgctggagcggggctcgcgcgtggttgccctgctgaagccggagttctggctcaagaccggcaggctgaacatgttggtccgggacatcaggccggtgggcctgggcgatctcctggccaggatcgagcggctgcgccaggcgctctccgccgaagggctcttcgcggactcccgcaagaaacccctgcccctgctgccgcaccgcatcggcctcatcaccggccgcgattccgacgccaagaaggacatcctgcgcaacgcggccctgcgctggccggcagtcgagtttgaaatccgggaggttgccgtgcaggggaacaccgcggtagcccaggtggtccgcgccctccacgatctggacgccctgcccgaggtggatgtcatcgtcatcgcccgcggcggcggcgccctggaggacctcctgccgttcaacagcgaagaactgatacgtgccgtggccgctgctgccaccccggtggtcagcgccatcggccacgaggcggaccggccgctgctggacgacgtcgctgacttgcgggcttccacccccacggacgccgccaagcggatcgttccggaagtatccgaggaactggcaggggtccgccaggcaagggtgcagctgcgccggtgcatggaacggctggtggacagggaagcggaccgcctggcgtccctccattcacggccggtgctggcagcgccggaaggactggtgaccatccggtccgaggaaattgagcggcttctccggaggtcctccgccgccgtcagctcctccgttgtccgcgcggccgaccagctggagcacctgaaagcccaggtgcgggcgctgtcgccgcagaagacgctggaccgggggtacgccgtcgtcgaactcgccggaaagcaggccgaagaagcgggcaccgccggccatgccgtggtgcgccgcccggccgaggctccgcccggctcgcccctgtccatccgcgtggctgaaggccgcttcggcgcgacctccaccgggacacttgaacagcccatcaccgaaaccggagaactgaatgactgagcagaaaccagcggccgacatccaggcactgagctacgaggaagcccgtgagcagctcatcgctgtggtgggaaagcttgaggccggcggcgccagccttgaagaatccctggccctgtgggaacgcggcgaagccctggccgcacggtgcgaggaatggctggaaggcgcccggaagcggctggcagctgcccgcgaccagccgctctaggcccgcccccgcaggctgcagcgaagcgtcaggaccgcaccaccagctcgcgttccagggcgacgtcgaactcagctttgggccattgaaggtccatgccgttcagcgcgcccagcagcagctgctgcacggcgatccgggcaaaccacttcttgttggccgggaccacgtgccagggcgcgttcgctgtgttggtttcatcaatggctgactggtaggcgctcatgtagtcctcccagaaagcccgctcgtcgaggtcgccccggctgtatttccagtgcttggccgggttgtccagccgggccagcaaccgctctttctgttcttctccgctgatgtggagcatcaccttgaccaccgtggttccggagccactgagcctggcctcaaactcgttgatggccacgtatctgcgcttgatttcctccgggctggcccagcggtggacgcggtggatcaggacgtcctcgtagtgggaacggtcaaatacgcccaccatgccggcagcgggcacttccttttcgatccgccagaggaaatcgtaggatttttccacatccgtgggagccttgaaggccttgaactggacaccctggggatccatggcagccatcacgtggttgacgatgccgcctttgccggcggtgtccatggcctggaggatcagcaggatgcgcttgcggccgccgaaccgggactctgcgaagagtttttcctgcagttcagccagctcgtcgtccatcgctgcgagcagggcctggccgtcctccttggtgccgtcgaagcccggcgtggagccagggtcgaggtcgctcaacgaaaagcccttgccggcccgcaaagtctcagaggggtcctgatgaaagccaacggcagcggccatgggaagtcctttcgcgaagttccacgggaccgaagcgcccgtgagcacaggctagttgccctggtacctgcttaggaagtcccccattcgccccaccgcttcttcgatgtccttgacgttgggcagggtgaccatccggaagtggtccgggcggacccagttaaacgccctgccgtgggacaccaggatcttttgttccctcagcaggtccaggacgaacttctcgtcgtcgcggatgtggtagacctcggggtccagcttcgggaaaaggtagagtgcgccccgcgcctgctgggtgctcacgccggggatggcgttgagcatgtcgtaggccttgttgcgctgctccagcaggcgcccgccgggcaggatcaggtcgttgatgctctggtacccgcccagcgccgtctggatggcatgctgggccggaacgttggcacacaggcgcatgttggccaggaggctgatgccttcgaggtagtccgccgcatccttcttcgggcccgagatggccatccagccggcccggtagccgcatacccggtacgccttggacaggccgctgaacgtcaggcacaggacgtcgtcgccggtcagtttggccaggttgatgtggacggcgtcctcatacaggatcttttcgtagatctcgtcggcgaagaccaccaggccgtgcttctctgcaagggcgacgatcttcttcagcgtctcttccgggtagaccgcgccggtggggttgttcgggttgatgaccacgagtcccttggtgcggggcgtgatcttggcttccatgtcctccaggtccggctgccagcccgtttcctcgtcgcagaggtagtggacgggcctgccgccggcgagcgccacggacgcggtccacagcgggtagtccggggtggggatcaggacttcgtcgccgtcattgagcagggccatcagggacatggtgatgagttcgctgacgccgttgcccaggtagatgtcatccacgtggatgttttggatgtcccgggtctggtagtactgcgagacggcggtccgtgcggagaagatgccccgggagtcgctgtagccctgggcgtgcggcaggtggcggatcatgtccacgaggatggcgtccggggcttcgaagccaaacggcgcgggattgccgatgttcagtttgaggatccggtggccctctgcctccatctgctgggcagcctggaggatcggtccacggatatcataaaggacgttgttgagcttggtggactgcctgaattctgccatccctcaaatatgccacaggaaggatggacggccgttgagacgtcagccacaggcggcgcgcgccgccaagaagaacggacgacggcggctgccggacttctggaagtccggcagccgccgtcgtactgcttagggccaggaaggcagccctacttgacgatgcccttttccttgagccacgcgtcagccgcttccttggcaccctgcttctggctgccgctgacggcacggttcaggttgatgaggtcctcggtggtcaggatgcgggacaccgagttgagggcctccttggccgtgtcggtcatcttcgcctcgttgtacagcggaacaacctgctgggcgatgaagttgttcttggggtcttcaaggaccacaagatcgttgtcggcgatggacggggttgtggtgtagatgtccgccacctgcacctggtcctccaggagcgccttgagcgtcacggggccgccgccgtcactgaacggctccagtttcttcggttcgcagttgtagttttccttcaggccgggcagcccgtaggcgcgctcggcgaaggtggcgggggcacccaccacgatctcgctgcacaccttggccaggtcttcaagggacttcagctggtacttctcggcggtggccttggtgaccaccatcgcgtccttgttctcggccgcggagggttccagcaccgccagtccgtccggcagcttctccggcagggcggcggcgatgtcgtccgccgattcctcggaagcttccttgtccacgtgcagcaggaggttgccggtgtagtccggaaccacgtccaccgatccgtcctggacggccttgatgtacacctcgcgggagccgatattgggcttggtggtggcggtgatgccggcggcggtcagggcgcctgcgtagagttctgccacgatctggctttccgggaagtcagccgagccgacaacgagggacgtcgcttccccggaggctgccccgctggtggccggtgcgttgctcagcggatcggaggatcctccgcacgcggacagtgccatggccaggcctagccccgcggcgagcccgctgaatgcccgcctgccgaggtggtgtggacggctttccttcatgatttacctccttgtaccacagcctccgccaggacggggtctgtgagatcggccgcagcctgctggctgcgacgggactggccagaggcgcctgttgccaggaacagcctctggaaaagggacaggacgaggtcgacggcgatggcgagcgctgcgatgagcagggaaccaccgagcatctgcgggaagtcgctgaggaccaggccgtcgaaaaggtagcggcccaggccgcccaggttgatgtaggccaccacggagacggtggcgatgacctgcagcacgccggtccggaagccgccaaacatgacggtcagggcgttgggcagctccgcccggaacaggacctgcagttcggtcatgcccatggcgcgggcggcatccaccacgttgcggtccacgctggaaattccggcatacgtgccggccagcagcgggggaaccgtgaggatgaccagcgcccagatgggcggcatcagcccgatcccggcgagcagcacaaagagcgtcagcagccccagggtgggcagggcgcgcagggcaccggccagcgccaccacgccaacccttcccctgccggtgtggcccacgtacatgccaacggggacggcaatggcaacagcgatcagcatcaccaggccggtgtactggagatgctcacccagccgggctggaattcccgcgctcccggtccagtgcagcgggtcggcgagccaggcgaaggtgtcggagaaaacgttgctcatgcccggtccccctcaaccgccggcaccagtgccgggcggatcttcccggcccgctcccacggcgtcaggagccgttccagcaggacgagcaacgcatccatgagcagggccaggacaaggatggcaatgatccccaccacgatttccgttatgaagccccgctgcagtcctgaggtgaacagcatgcccaggtttccgatgccaagcagcgctgccacgctgaccagggagatgttgctgacggacaccacccggagcccggcaaacatcaccggcagggacagcggcaggtccacccgcaggaaccgcgccagcggtttgtatcccatggccaccgcggcctgtcccacgtcctcgctcaccgagtcgaaggcgtccagggcggcgcggaccaggagggccacggcgtagatggtcagggccaccaccacgttgagcgggtccaaaatccgggtgcccaggatcgtgggaaggatgatgaacagtgccagcgacggaatggtgtacagcagcgaggaggccgtcagcactaccgagcggagggcccggttctgccgggccagctgcgccaggggcaaggagatgaccagtcccaggaccatggggacgagggcaagcacaaggtgctggccggaccgttccaggaccatgtcgatgttggccaggaaccattccatcagagtgcagcctgccggagctggcgtgcttcttcgatgagggccagaacttctccgccccggatgacaccctgcacccggccctccgtatccactgcgacgccaaggcccgacggcgaggacagcgcagcgtccagcgcgcggcgcaggctttccccgggacggaacaacgaacctcccgggatgaggccggtggcggtgcccggcgtggaccaacccagcgggcgcatgtcttcgtccaccaccagttgccagccgcttgttgcgtccggatcggttccggagccgctgcggccgcggacgatcgtcggcaccgtatggagggtcacaccgtcggacgcggtgaagccaaggtgccggaatccccggtcccgtcccacaaaggaggccacgaagtcatttgccggggcacggaggatttcctccggcgtggcgtactgcgccagctttccgcccactgcgaagacggccaccttgtcgcccagcacggtggcttcatcgatgtcgtgggtgacgaacacgatggtcttggccaggtccttctggagccgcaggagctcctgctggagttcgtcgcggaccacgggatccacggcgctgaacggctcatccatgagcaggacgggcgggtcggcggcgagcgcacgggctacccccacgcgctgctgctggccgccggagagctgggacgggtaacgcttggcgagcggccgggccaggcccaccacgtccaggagctcctcagcgcgcctgcgggcgtcggccttggacacgccgttcaaccggggcacggtggcaatgttgtccaggaccgagcggtggggcagcagcccggcggactgcatcacgtaccccatcgagcggcgcagttcgggcgccggcacggaggtgacgtccttgccgtccaccgtgatggccccggaggtgggttccaccatccggttgatcatgcgcagcgaagtggtcttgccgcagcctgacgggcccacaaagacggtgatcgatcctttggcgatggacatggagaggttgtccacggccggttgcccgccctggaactgcttggtaacgctctgaaactcgatcatcgcctggtccatggtgcggactcacctgttctctgggacgggcttctggaagcaccgcgacattgtcatcagcacgctgatagttacggtaacccaaaccgggcgcggcaacacctgcagcgccccgaatccgggcaaaggaatccctactgtaatcattcggagccaggaccgcgccggatggaaacggccgttccggccaggaaccgccatggcctggggcgctgttccgccgcgggcagaccggcctaaagtggtggggtgaccaacttggaaatagcgccgcagcaggaggtctgtccgccggcagcccctgagggcagttccggaccctgccttcagctgtggccccaacgcgaggtgccgctcggcggagtccgtgccatgaacgtccagcggacgctgccgcagcgtggcctccccaccatcggagcatggtgtttcctggacagcttcggcccggaccggactgcgatgtctgtacttccccacccccacattggcctgcagaccgtgacctggcccctggccggccacatccgccaccgggacagcgtgggcagcgacgttgtggtccggccgggtgaactgaacatcatgacggcgggccacggcgtctcccactccgagttcgccgtgcttccgcctgccggcgaagcgctgccggtgcagcgcgggctgcagctctgggtggccctgcccggcggtgaacggcaccgggagccggcattcgagcagcaccgcgagcttccccgcgccagcgggcagggcttcgccgccacggtgatggtgggtgaatttgccggtgtcgcgtcaccggcaaccatgtactcaccgatcgtgggtgcggacgtctcgtgtggcgggatggccgtgctgccgctcaatgcagggtttgagcacggcatccttgtgctcgacggcggcctggcggtggacgggcaggaggttccaccgggcccgctgggctacctcggcaccggccgcaccgagctgcaggtgcaggccctccccggcacgcgcttcctcctcatcggcggcgagcccttccaggaagagctgctgatgtggtggaactttgtgggccgcacccacgaggaagtggaacaggccaggagcgactgggaagcccaggcagggctggcggaaacggaaacggcggcggcacggtatggcctggtccgcggccacggtccggacgcggggcccgaggcgggacgcatacccgcacctcccctcccgggcgtgcggctgacaccccggaaacggctctaacagggccaagcccggatcaggcctgctctgccaccagctgcagcacaccgaagactggttcctggtccagcacgcggatatcggtcacgccggcatccatcaggtggcggcggaaggaatgctgcagcggtgccacgttcatgcccaggccgccgcccaggatcacgggacccttgatacccagctgctgcagcacctgcagcgccaggccggcaaggtcctccccggcctggtccagcagcgcctggctttccgggtggcctgctgccgccgcctccaccacataccgggcctgctgggcccagaagcgccggccggtcttcggtgaatggaacagcgcgatgaggcggttggggtcgcccactccgcaggactgcagcagggccgtggtgagttcatcggcgggcagtccgcggttcattcggcccaggctgtgccgcaccgcttcgcgccccagccagtaaccgctgccttcgtcgcccaggaggtagccccagccgcctgccctggcctcgccgccgtcggcattcctgccccaggctgccgagccggtgcccgcaatcaccgcgactcccgtgctcgcgtgcccggcggccagcagcaggcgtgaatcgtgcaccacggtcacccgggcaccgggcacgtggggctggatcagggacgccagggctgcggcgtcgtcttcggtatcgatgccgcccgagcccgcgtagacctgggatacctgccctccgccgatgcgcgagaagaggtcggcgaggttggcggccgcctcgtcgcggctgacgttctgcacgttggagctgccggcggactcatccgcaaccggcacatcatcctcgaagcggaccccgtgggtcttggtgccaccgatgtccagcccgatgatgacaccgccgagcggagttgatgcgggaacctggtgggcgggggtgagcgcggaggaattttcggtgttggtcacgtcacaagggtaatggtgcgggggcggcgggaagcccatccccgcctttcccggccgcagttatcgggaccgctgccgtaccagcccggccagcagtccaggcccctccgtcaccaccatgtcccggaacagccgtaccggcaccggctccgagccaggtttccgcctccgccaggacaggcccacctcgcggaacgccaaggcggagtcaaggggaacttcgacccagcccaggttcccggtttcggggctgacggtacggccaggggcatcacctcccggcggcaggatgctgacgcccaggccggcggagaccagtccccggaccgtgtgcgagtcctggctttcgaaggcgatgcgtggccggtaaccggcctcgcggaacagcgcatcggtgagcgaacgcatgccgtacccgggcccaagcgccacgaaggggtctgccctgatatcggcgagccgggcggagggctgtgcggcgagggggtggctgtggtgcaccaccaggcggagcggctcacggtacagcggggccgaggacaggttccggccgggcggcgctacgggagccgtcagtgccaggtccgactcacccgaggccaattcgtcaaggcaggcattccgcgcgccctggctcagcgtgaaggcggcgccgggatggcgggaccggaaggcactgatcaggagcggcagcgcagcctcgccgaacgtgtgctggaacgagagggaaacccttccccgcaccacgtccgactcgtctcggacgaggtccagccccgcctggaacgccgtgagggcctgctcgatgtatggcagcagggtgcgggcggcgggtgtcagccggacccccctgccgtcccggaccaggagttcggtaccgacgacggcgctcgcccgggccagcgcgcggctcaccgtggactggggtactccgagcagttccgcggtttccgtgacgtgctcggtccgtcccagctcagcgagcacgggcagcagcggcagcagctgcacgagctgtttctggtccggttccacgggcaggcctccttcctgctccccgccggcccaactaggtagcgctaagtgtcgttttgacggctcataacgacacttagcgctacctggttgggaaaaagctcccgagtgggggaaagcatgtgaaattgctatcagttttacacaaagcatgcattggaggcatctattggccaaaagctaggctggccggatggcccacatcgtccgttccgcaggcaacagtccttcccctcgctgggacggtcatgccaaaggctcgacggcgtacgcgaggatcctcgccggcctgtccttcgcaggcgttgccaccttcgcccagctttactccacccaggccgtgctgccgatcctggcgtcagacctgcaggtcagagcggcggatgccgcattgaccatctccctggccacggtgggccttgcagcgacggtgattccctggtccttcctggcggacaggatcggccgggtccgggccatggcgtggggcatttcgatagccaccgtccttggcctgctggttccgctgtccaccagtttcggcatgctgcttgccctgcggctcctcgaaggaatggcgcttggcgggatcccggccatcgccattgcctacctcaacgaagaagtcaccaaagcccacgcggcgctggcggcagggagttatgttgccgggaccacgctgggcgggctcgccggccgcctggtggccgggccggccggcgaactgtggggctggcgcgcagcggcacttgcggtgtccgtcctggccaccctcgccgccgtcgccttcctcattctggtaccgaaggcccagggttttgtcaccgcacccgccgccgggcttcgcggggcgttccggaccctcggcggccatctgcggaacgtccgactgctggtcctctacggccaggccttcctgatgatgggcgggtttgtggcggtgtacaactacctggggttccggctttccggcgagcccttcggccttccgggaacattgatcagcctgatcttcctggcctacctgtcggggaccgtcacgtcgcgctggtcggcggggctgacccttcgctttggccgccggactgtgctgctcgcgggcctggcgctgtccactgcgggccttgccctgacgctgacgcagtcccttgccctgatcctggccggcctggtggtgttcaccggcggtttcttcgccgcccacagcatcggggccggctggaccggtgcccttgccagcaccggcagggcccagggcgcctcgctgtacaacctggcctactacctcgggtccagcatcatcggctgggccggcggcctggtgttccaatcccttggctggaatgccctggctgcggcagtcatggtccttgcctgcctcactacggcggctgtcgccgtcgtccatcccgggaaggaacacgccggggcatagaagccggcggcactgtggttccatacctcaaggtgctcccgtgaacattctgctttcagcccgggaagcggcagcgcgaaattcggcggccggcccgcaacgtacccggtaccgcagccgggcgaggctaggatgaaacccaggatcgtcacgaggagctgcagtgagcacgaatgccaggaacgccaggccgggagcgcatctggaaccgctggacgcgattgacgagcggctcctggcggccctcgtggccgacgcccggatctccaacaagcagctcgcggaactggtggggatcgccccttccacggccctgatgcgcacccgcgccctgtcggagcggggaatcgtccagggctacgaggcgaagctcaacctgtcagcgatagggcgctccgtgcaggcgctggttgcggtgcggctccgggcccacgaccgcgaccagattgaccgtttcacgggcagggtgccgcatctgcctgccgtgctgtccaccttccacacctcgggctcggtggattacctgctgcatatcgccgtcgcaacaaccgaggacctgcgggactgggtgctggacaacctggctacggaccccgtggtggggcataccgagacaacgctggtgttcgaacacatccagggcaaccacggtccgttgccggattagccgcacggcagcaacgtgccgggcggaacgttccggggcaggttacctgcgccgcccggtgagcgcgagccggagcgtcactgcggacaggatcagcgccgcaccggcgcacagccccacgaacccggccacggcaacgggcaggccgaagacgccggcggcccagccaaggccgaggaccggcactgcgctgccgaggtaggtgatgacgtagacggtgctgacaatctgtgcgtgccgcgatgcctccaccctggccgcaacgtcgttgaagacggtgcggaacgcgatcccctgccccatgccggcggcaagggcggaggccaccagcagcacgggactatgccacgctcccgccacccccaggagcacgacggacacccccaggaccgccagtcccgccggaaccgtgtagcgtccgcggagggtcagcagctggctcaacgccgaggacgccagggcgaggccggccaagacacccaccagggggcgggaatcggtatgcagcacctgcgcaaagtagccgggagccagcgacagacagaagccgaagaccgcgaagctgaggaatccgacgccggcggcgagccagaaggcgcccctcgcctcgcgggacacggaagggcggcgcggcgccagggccttcagcggccgggaaggcgcggggaggctgatcgcggggcgggcacgcagcaggaacagcggcaccaggagaccggccaggatcagtgaatggacatagtacggggctgtggtggcgcccgggaggagtgacagcagtcccccaatgaccggccccgccgccactcccccggatgaggccagcaacgtgaaccgggaggcccactccgggcgggacggaaggagttcgcgcagggctgcggcactggcacccgtggccagcgcaaccgctgtcccctgaagggccctgcccgcacacagcgcggcgagcgtctgcgcttcagagaagagccacccgcctgccagtcctgcaaggactgccaggatgagcgcagcccgccggccaatgtggtcagaccagtgcccggccagcatcagcgtggcaaccagggacaggacgtagctggcgaacgcggaggtgactcccagcgtggacagccccagctcggcctgcaggaggggatacaacggtgttgccaggttggcgcccaccaggagggtgaagattacggttcccgccataacgagccgggttgtggtggacgcatcccacccggcggaggcagcagccggggtagggcgcatgcggagttcactgaagaccgtcatcgtgtgccgcctctggttcataccgcggcgggggtccttgtgggagtccggcgcggggtggatatccgatgcctcaagagtgcgttatcgctgctcctttgatcggattttcatggaagaattgcgcaggatcatcaaaactgccatcgatgtgtgattgagagtgactatatgaaccagttggaccccaccgacctcaagattctgctggcgatgatccgcgaccccaggatccagatcggcgaactgagcgaatctctgggcattgcccggaacacggcccagacccgggtccggcgcctcctccgcgcaggcgtgctgcggcccggcggccgcgaggtggatctggatgcggtgggctatgacgtggtggcgtttgtgaccatcgaggtgtcccaccgcgaactggacggcgtggtcgctgcgctccggttgattccccaggtcctggaggtccacgagatttcgggccgtggagatgtctggtgccgtgttgtagccactgacacccacaacctccaagcctccctccggcaggtcctgaggatcaagggcgtgatccggaccgaaacggtcctggcattgcacacccacatcccctatcgcactgagccactgatcagcggcctcgccaaggcgtccaacacctgaggccatggccgggcggataggatttccagaatggattggctctcatacgtttcacagatcaactggcttgccgtgctgctcgccttcgtcgcaagcatggtcatcggttttgtctggtacatgcctgcagtgctgggcaaccgctggatggccgcgatcggcaagacggaggacgacctgaagaacatcagcggcggcgccggcatctggttgccgatgatggtggctgcggcgctgacggcgatcctgctggctgtcctgatcgccagccttgggctggacaacgccctggccggcggcctgttcgccctggtgatgggcctcgtcttccgcgcaggcggccacgtcatccacaacggttttgcaggacgccccgcagccgtcaccctcattgattccggccacgacctggtggccatggcggtctccggttcaatcatcggaggaatgtcctgatggccgcactcccttcgcccggagcccggcgcccatgaccatcatcgacaatgccgtctacgtggacggcgtccgccacgtggaacccgagagccttgagcagacctttgacatgctggcgcaccacggcggaatggcctggatcgggctgtaccggcccacgccggaggaaatggcggcggtggcaagcgagtttaagctccacgacctagcggtggaagacgccatctccgcgcaccagcgccccaaactggaacgctacgacgacagcctgtttacggtcctccggcccgcccgatacattgacgactccgaaagcgtggagttcggcgaactccacatcttcaccggcaaaaactatgtcgtcacggtccggcatgccgagatggccggcgtggcccgggtgcggcgacgcatggaggcccggcccgaccttctgcgccacgggccggaagccgtcctgtacgccctgctggaccgggtggtggacgactacgcgcccgtggtagccggactcgaaaacgacatcgacgagatcgaggaccagctgttcagcggcgacaccacggtgtcccgccggatctacgaactggccagggaagtcatacagttccagcgggcgatccatcctttgccggacatgatgcaccagttggaacagggattcgagaagtacggcgtggaaacggacctgcggcacagcctccgtgacgtggaggaccacgttgagcgcgtgatctcccgggcagattcctttcgggacctgctgcagaacgcactcaccctggacggcaccctcaccgcaaaccggcagaacgaggccagcgccgaacagaacgaacaggtgaagaagatctcctcctgggccgcgatcttcttcgcgccgtccttcgtggccggcgtgtacgggatgaactttgaccacatgcccgagcttcactgggaactgggctacccgttatccatcggcatcatgatcgcgatggcgggcctcatgtacggcatcttcaagaagaagggctggctgtaggccatggccgccgagccggaaccgccggccctcgccgagggccgcatcctggtgcccggcagcagccggcaactggcggtgtacggcctcttcccgccgccacccggacggcagcggacggccggcgccggatcccgcgtctttgccgccaaggcccgcgaaccggaactgctgtggatcagcttcgatgaactgtgcgcaccgggtacgttcagggaggactactccctcctcgcatcggaggcggaactgtgggtcatcgacggtgttccggcgccggatccatcggatgccggtcctcgggcggaagcatgggaactctttgctgccgcacttgctgcagcggcggcccgcggaacaaccctgttcgtggccggtaccgcaccgttggactgggctgccgcgtctatgtctgctgatgacccgcggctgcggtccgccctggcggaggccgcccggctccttgcacagctgaaacgggtcgaatccgatgagactgttgctgtagagggcgtgtcaggaagttagccgatcgcggccggtgggccgccagaatggagcgcacgccaagccctcgccaccggtacctgcagcatctcctgttgacagcctcagttcgtgggcgcacgattcacccacgagcgccttcccactcgaggtctcgcccgctcacaatgaaaggcgctcagatgtcccacttacgtttccttacgccagtcgccgttgccggattgctgtttgcaaccgccggaacagccgtggccgcgccgcctgagcatttcggcccgttcgagcaattgggctccggtatagcggtttgtgatgacttcgacgcgttggtcgtcgtgaacgagtcgactcgctacacgttattccgcgatgaagcgggcgatgtgaagagcttcaagcaacacgtctcagcgccggctaatacctggatcaacctgacgacgggcaagaccatagtcgtgagggcacacttcgtccagacctgggatgcgaagagtggaaatctcacggtggtagggttccgccacctcgtcaacgagcaaggtgacggtgtgactgttcaggatgtcggtcggatcgtttacgccgatcagacacaggaggagattctgagcatggccggccagcatgacatctccaactgggggctgataagcccggccttgtgcgacgcgcttgagtaggccggcccacgggcgattgggcgcagttcggaaacgtacttgagctgcttgcacgggaaggccgtacaaaggcttaataccctggactctgtggagctaaggagattcgaactcctgacctcttcgatgcgaacgaagcgctctaccaactgagctatagccccggatggatccgcccctgctggggcggcaccggtgaccctaggctacaaattttcccggcttaatgccaaaccgcagcctcgaacccgcaccagcgtgccggcgggagacgtaggggatggcctgacggcaccaacctgtcaggcgcggcggcgctgcaggacgtcgtcgaggttactgagggcactctgcgccttggacagttcctggccctcggtggctgccggccccgcagggggcgcggcggcaacgccctgtttgagggacggcttgcccatggccttcggtgcctccgggagctccagcggctcgggcgccgggcgctcggccttggctgcctcaacatagacaggtttgggaacctccaccggttcccacgtggacggagcggccgggctggctgcggacctggccgctgccgcgcttgaatctcctgcggcaaccgccacagcaagggcggcctcacgcagttccatggcagtcagcggcttgatcctgggctcgtgcgcctcggcgtcgaatagagggttgtcctgcttcgccggagctgtttcaggctttggcgggacaatggcagtggcttcgggctgccgggccggcgcggtcatagcggcccgaaaggctgcgttgacctttgccctccggtcacggacggcgagccagcgcaggaggacgacggacccggcggtaagcccgaggcacgtcagggcaaaggcaggagcacccagtccgaagatcaaaagcacaccggaaacgaacgcggtgaccagcgacagcaggcccaccagggcgatgcccgtgcggccgtagcggatacggaacgtacccccggttgtggagccggcagtggcggtcgcgggtccggcactcttcctggtgtccatggctttctcctgctgggcggcgacgttcattaccaaagcggctggcgggtccggtgtttcatctgctgcggagtccgccaggaaatcgccggcgggctggaactggtgcctgcggttccggaggacgtagggcgcaacccacacaatccagagcacgacggcaaccacaaggatcactgagctgctaagggggaagtccacactcaaaaccgtatgagcatcctgtccgctgcggcagcattagctgcggtgtgtcgcggcgcagcggacaaatcagtggatttatgacgcccgtgaggcgagccagggccggagcagcccgtccgggacctcttccgcggtcaacgcgaaggaccggtggtcagcccactccccgttgatgtgcaggtagcggggccggtatccctcgtcccggaagcccagcttttccaccacgcgaaggcttggtccgttctccggccggatgttgatttccatccggtgcaggccaagtgtccggaagcaatggtccgtaaccatggccacggcagtgggtgcaattccatggcccgcacggccctggtccacccagtagccaagggtcgccatcatcgccgatccccacacgatcgatgaaacggtcaactggccaataatggcggggctcccggcggtgggaatacgctctgtgataacgaagggcaatgcagtagcctgagctgcctgcgacttcaatgaccggaccatctgccggtagtccgggaggcctccggcaggatcggggttggaagcttcccacggcgcaagccactcgctgttgcgggacctcacctcggtccactccttcttgtccctgtagcggataggccggaggaccagatccccgcactccagagttacgggccaaatgggaccagcgcgcacggcgctacttggacaggccggcggtgaaccccggcagccactcccgcaagcccggcccaaggtcctcgctgtcaatggccagctgaacgcaggccttgagatagctgagcttgtccccggtatcataacggcgccctcggaacacaacgccgtatactccgtatccctcgccgtcgccggtcgccagctcctgcagcgcgtccgtcagctggatttcgtctccgcgcccgggggcggtgcgttcgaggacctcaaagacggcagggtggagcacgtaccggccgatcagcgcaaggttggacggcgcctcgtcgacgctcggcttctccaccagccggttgacgcgcacgtaggattcgccgtcgatcggctggacgtcagcgcagccgtaggcgctgatctcggacggttccacttcgatgagcgcgatgacggaccctcccgtttccgcctgtacgtcgatcattgtgcccagcagttcgtcccgggcatcgatgaggtcatcgcccagcagcacggcaaaggcctcatcaccaacgtgctgctttgcgcgcagcacggcgtggcccagtccgtgcgggtctccctgccggacgtagtggatatcgcccagcttgctggcggcctggacggatgcgagtttttccgtgtcccctttgtcctcaagggtggattcgagcgacggcacccggtcaaagtggtcttccagtgcccgtttgttgcgcccggtgatcatgaggaggtcgtggaggccgacgttcacggcttcctcaaccacgtactggatggcaggcttgtccacgacggggagcatttccttgggcatcgccttggttgccggcaggaacctggtaccgagtccggcggcaggaatgacggctttgcgaactctcgggttactggtagtcaccggactaatctaacgtcagcgtcaagcattcagtaacaaccgggcccgcgacacccgcggaccccggacggatggaccacacggataacccgccgcacatgcggcagttatggaggaaacacatgacgctcgaggaaacgaaagcagccaaggaccggatccgtgccgcccatcgccgccgaagggctgcaatgacatccttggaacgggacgacgccggcaccgccctggccaaacacggcgcggcatgggcggcttcgataatcccggcaaaggaggccacggtgtgcgtctacctgggcgtcggcgcggaaccgcccacgctgccgctgatcgcagcactgtacgacgacggccacagggttctgcttcccgtctgcgaaccagggcgtgaactgggatgggccttctgggcgccgggtattgagctggcccggagcaggttcgctccgatcctggaaccggtagggatccgccatgaaatcgaggttgcgggggaagccgctgcgctgttcatccccgccacggccgtcgacctcgcgggcagcaggatcggccaaggcggcggctactatgacaaattcctgggccatcttgcgtccgccgggaagcatattccccttgccgcagttatttatgacggggaattactgcccgccggctccattccggtggaggaattcgaccgccccgtgcctggcgtcgtgcttccttccgggttccgggacctggcgaacgccttctgaccgggaaatcctggtgcagggaaatgctagaattggcactcaggccctgtgactgctaatgggacatccagctggatcaccaagcggcagtccgggacctctcgtttgcccaagaggaggagcaccagtgccaacgtatgcgtacgcctgcaaggattgcggccatgcctttgacatcgtccagtcgttctcggacagctctttgacgtcctgccccgagtgccagggtgcgctgcgcaagaagttcaacagcgtgggcgtcgtcttcaagggttccggcttctaccgcacggactcccgggactccaagggcagcacggtttcggctgctcccgcagcagcgccggcacccgcatccgcgccggccgcctcggcccccgcttctgctgccagctgactcaccgtcctccactaaggcctgcctggcggttgggcaacgttgtccacatacccgccaagggcactgccgcaactctttccggcgcctttagcgtgggcgcatgcctgcataccgccagtccagccggaacacatcaagcgcgccccaccccggactcttccggaaaccgcggctgcgacgccgcgccggcagggtccgcggctccggccgcatcacaggcaggcgtcctcctgcgcgcttcgcgggctggctgagccgcaacaggcgcctcgctgtcgcgctgctcctctgcgccgcagcggccatcacggtgcaccagctcacccctgccccggttcatacggtgacggcgctggccgcagcgagggatgtccccgccggcgccgcattatctgaggcggacctcgccgctgtacaggttccccccggcatgatggccagcggattcctcaaggaaccgggtgaggcggcgggcaagcagctcgcggcgcccctgcgcaaggggcagctgctcacggatgcccagctggtcggtccaggcctcctggccggcactcccccgggatcagccgccgtcccccttcgcatggcagatccgtcgtccatccagcttgtctccccggggcagctggtaaacgtggtcctcacctcagccaacggcttcgaccagcagcaaccgcccgtgatcctggcctccggcgtgcccgtgctgtggacctcaggccagggtggccagactggtcagtggctgggcactgccgagacagacggcctgatagtggtagctgccaccgcggagcaggcagcccggctcgccggggcctccacccagggcaagctgtttttcgtcctggtggggccgtgagaacctcagccccagtgcggcggtttctgttccttcaaccaggcgtcatggtcgtcttcccggtcaccccaggcgcgggggtcgtcctcggaggctttgttgggcacggcgggtcccgcgggcaacgcaggactgtcgggaccggtgccgggcgtgccgtcctggtcctgcccgggttcattctcggcgggctgcccggcgtccggagcgttgtcttcttcgcggtgctgggccatggtgcccgcctccttgctgtcctggtcttcggccggtgtgggatcgtcattgggcgcagcgggccggccttcacgggcaggtccggagtcgccgtggccatcaccagccatggccagccgttcccgttcgccccggctttcggcgtcgatcccgttgagcgcctggtccacgtcgtcgtccaggaaggcgacggacgtggcggcaggtccggaaagggccatcttctcgagtcccaggtaaccggcgatcctgtcagcgcaggcagagggatcggtgaacacctcgatggtccacagcggcatgtagcgccatcccaggcgctccagcagctgcgggcgcagccggctccgctcccgcacactcatggtgcggtactgctccgtgccgtccgattcaatcgcaaccggccacggcaggtccgcgtgctcctgacccatggtgctgaggggatcagcggcggcaacaacgtctatggcgccgtcatactggtgccacacccgtgcgccgcgggcacgcaggcggtccccgaggtcggcaaccaggggatcggcccccagcgcctgctcgctggccgccgcccgcgatgcgggagttccgagatcagtattgcccgcaatttcacggtccagcagcgagtacaggtccacggcgccgtggctcagcctggtgtggtccaggtcctcgggccggaaacaggtgaggacgtgcatggaccggcgtgcccgcgtcatggccagggcgaacttctcccggccaccctcggcggaaagcggcccgaaattgtgcagggcgcggccatgcggggtgcggccaaaaccgggcgagaagatgacgtgatcgcgcaccagtccctgcgcccgttccaggtcaaccacccggaaggactcgggcccggcgccgaagaacccggccaggccggggtagttgggcagctgcagccggatggactccccaatccgggccgcgtggcggagactggccgtgaccacggccagggacgtacgcgggcggaggcgtgcgtgttcaaagaccagctggacaacgcggttgacctccgccaccacggactcgacgccttcgtggtcggcgctcggcagcccggtgccgtccggaaggtattcaaccaggagggaacggtccagtccggtggcggactggccttccggcagccgccgcaggccgccgtcgtaaaaattcttgctgagctgcagcacaaggtcctcgtccaccgcacggtagacaaagttgagccgccacacgggaagcacctgcgacagtgcgctgaaagcactgtccacgcggtggtgcgctgattcgccgggcgcgagcctttccactcccaccgtgaaagtccgggggctggcgatccgcgcgtcaccgaacgcgatgacctgtttggcccgggcaacggacggcagcacagcctggagggacgtcgcttctgcgtccaggatgaccaccgcgtcgaagcgctgttccgccggcagcaggccggtcatcaggtaggggctgacggaccagaccgggaccagcgtgccgatcagttccggcgcctgggccgtcagcgacggcagggaaaccctgccatccttgagcaggctccggagaagatccgcctggcggggatgggccgcgacggcgctgcgccagcgctctgcgaggtcccagcgaaggcgcgcggcaccgctggcgatgtgggcgttgtcagccaggcggtactcggcctccagcctgcggagggcgtcgccgtcggacattgccaggtagtcgtcgccgctgatcattgcctcgagcgcagactgccaccacgcgagttcaagctcggcggcaaccgagccggccggaacttcccgctccgcgaggtcggccaggagctcgcccaggccgtgttcacgcatgttctccaccagcagcgtgcgctccggcagcgtcttcagggtgtcggtgtccgccaccagccgttcaaggcgctccatcagctcctcgtaccggaccgtagcgagcgagccgccggcctccgtgtgccgaagggcctcccccaggcgggccaggtcgctgtccagggacctgtacatcgcattcatttcggccagccccgacggaacggcgggatgccgctgggtggtggcatagcctgcccacagcgcccgctgctcctggaccaggagcagcgacgtgtgaaggtcggcgatgtggactccgggcctgacgtactccttggccaccctgcgcagccttgagcgctgcatggacgtcatgtcgatgccgcgttccttgcgccaggatgagggcgcggtggcggaaatgaggtcggtgaccggacggtcgaagatgtccggggtgaacttgtccaggcttccgcggaccgccaccaggagctcgagctgctcgccccactcggcgaaggaggcaccgagccggatttcggcgtgctcggcaactgccttcatgcggtcccggagggcaggcaggctcttctccacggagcggaccagctcctgggcttcctcggtctctttccgcgtcagcagccgggcgccatgccaggggctggtggtggatgccttgctgaagctgcccagctccgccgcacgccggagcctgcctgcgagctcctcacggtccctgatgttgtccaggacgctccgcttcagccgcaccgtggtggcgggcgcagggtggatagacgtcagctccgcgagcgactgcatggcctggtacggcgagcatccccaccgctgccggacgttgtggagcgaggccacatggtccatcagggcgtggcggtgctcggtcaaggtggtgtggaggtttccgagctggggttccagcgacttttcgctgcggacaatcgcacggacaagctgggccttgagctgctgggcggtgacgttcccggacagctggaacaggatggattccaggcccaggccttccagctggccggatacttcattgaggctggcgcggcggtccccgaccaccaggacagtctttccggcatccaccagagcaccgatggtgttgatggctgtctgcgtctgtccggttcccggcgggctgctgacaaccagggagtcgcccgcacgggcagcatcaatgacgtactgctggtcggtgtccgcgtccagcaggagcagttcgtccttggggtgcctgctgtccagggaagggaagcgggaggggtccggctgctccacgtccaccatttcgccgccgcctgcagtggccagggcggaaatgagcgggttggagtcgttgatccaggggtcatccaggttgccggagaggtcggcgaaggtggataccagcaggttgtgctgggcttcggcgccatggatgggcctgatgagggtgcccagccggtccaggacgggctggggatcgaaacgggcggtgctgtaggccagccgggtgacggcgttgacgtcgaagacgatgccgtggatgttcttcaggtgccgcaccagcgcggggttgatgtgcgcctgctccgtgagctggagttcgtagtcatcctccccgggccttacggtcagcgagatggcggtgagcatgaccggggccgagatgcgctgcggcttgccgcccacggcggatgtccacacaacggtgccggcggagaggtagccggcgtcgatgccgcggtcgttggccagttcgaagatcttcgagcggatgttccgggaggcccgggctgccacaacatattgctgccggtcccggatcagggtggagaggcgcgtcttgcggccggccatcagctgggccaggccggacgggtgcgcgtgcgtcaggtcgatggaaccttcaggcgttttggtgaagcgcagcatcgtgtctgccccggtaacgggtttgagccctgacagccatttgcggagctcctcggagccctccgggtggccttgaccaactgacacttctgccttcttttctgcgtttgcacgtgacgtcctggaccataccggcataggttcgagcgtagccgctaagacggcagtactgagagaccgcaacacgtgacgggcctaaattgcggaggtttttgccccgggaacaccagtggccggcccccctttgtcgggaagccggccactcaggatgttattcccactcgatggttcccggcggcttgctggtgacgtccagcaccacacggttcacgccctccacctcattggtgatccggttggagatccgggcgagcaactcgtaagggagccgtgaccagtccgccgtcatggcgtcctcggaggagacgggacggagcacgatcgggtggccgtaggtgcggccgtcacccatgacgcccacgctgcggacatctgccagcaggactacgggcatctgccagacttcgttgtccaggccggctgcggtgagttcggcgcgggcgattgcgtcggccttgcgcagcaggtccagccgttccttggtgacctcgccgacgatgcggattccgaggccggggccggggaacggctggcggccaacgatctcctgcggcagtcccagctgggctccgacggcgcggacctcatccttgaagagtgcgcgcaggggttcgacgagttcgaactgcaggtcctcgggaaggccgcccacgttgtggtggctcttgatgttcgccgcaccttcgccgccgccggattcgacgacgtccgggtagagggtgccctggaccaggaacttgatcttctcgccgtgggctgcagcttccgcgatgatggcgagttcagcttcttcgaaggcgcggatgaattcgcggccgatgatcttgcgcttggtttcgggatcgctcactccggccagggcggacaggaagcgttcctgttcgttggcgacatacagcttcacgccggtggctgccacaaagtcgcgctccacctgttcggcttcgccctcgcgcagcaggccgtggtccacgaacacacaggtgagctggtccccgacggcgcgctggacaagcgcggcggcgacggcggagtccacgccgccggagaggccgcagatgacccgggcgtcgccgacctgcttccggatccgttcaacctgctcttcgaggatgttgcccgtggtccagttgggttccagcttggcgcccttgaaaaggaagttctccaggacctgctggccgtaggcggagtgcttcacttcggggtgccactgcactccgaacaggcctttttcctcgttggcgaaggcagccacttcagcgcccgccgtcgtcgcgaggacctcaaagccctccggcgccgtgtggacggagtcgccgtggctcatccaggtgttctggtgctggggcatgccctccagcacggaacggccatcgccaaggatggtggtttcagtggagccgtactcccgcagaccggtcttgtccaccttgccgccgagggcgttggccatcgcctggaagccgtagcagatgccaaagacggggacgccggcttcgaagaggtcggcaccgacgcggggggcgccatcggcgtagacactcgaggggccgcccgaaaggatgatggcggcggggttcttggccaggagctgctcggttgtgtaggtatgcggaaccacttccgaatacacattcgcttcccggacgcggcgggcaataagctgcgcgtactgggcaccgtagtcaacaaccagcaccggcttctgggaagtctgggatgcagtgggagtagtcaccgtactagcctactgggcgccgttgcaccagcgcatcttgagaagccgggctgtgacggagcgaactgtcagcgcccggattaccgcctggcagccgcttagtaccgctggggcgcctgggggttcgccgcgagctcggcctccacctcggcgtggaacttcttttcgacgatgaaggagaggaaggggaccacgccgccgagggccagcaggatcagcttgaggaacggccagcgcatcagcgcccagagccggaagttggacatcaggtacaccacgtacatccagccgtgaacgatcaggacagccacggacaggttgacgccgccgaggactcccggaggttcggcatctgcaaaaccgaacccgaagggctggcccgtgacggcattggttcccccggcgaagaggtactgcccgaagccgtagcgggcaaccagttcggcgcacagcagcagcagcatgccaccggtgaggtaggccagcaccttgtagaacttcagtgccgagcggatctgggcttcggttccgccaaaacgtcgcttcttgccgcctgttttgctgcctgcgttggtggctgcattagtggctggattagtgcctgaatttatgcccgcattagtgtctgcgttggtgcccgcggcggctgccgggtttgccggtttagggtcaatcatggctgtaccttttgctggttgtgttctgggtgctggttgtcttcatcactgtcctcgaggctttcctcaaggtcgcggtggtagtcgtccttcacgagccgccaccagatgaagagtgcaaagccggcgaagaccacccactcgagcgagtagaagaggttgagccagttgatctgctgggcgggcggctgcgggccgatgtccaggggaagaagttcgcccggcaccgcggcggcgctgaggtccacgccgttggctacttcggcggtggcggccacgaacccgggatagctgctgacctcccagaagttgatcagctctgccacggacaccgccgtcgcctcacctggactgggtgccgtccccgggacgggcgcctcggacggcagcaggcgcccggtcagttcaagggtgcccgacggcggtgcgggggcgtcgccgggctccgccacccagccgcgggccaccgggatccaggtctgcggtgaggctgcggcaccggtcagggtgggtgcgccgtcgacggcgaacgcggacaccacccagtagcctgtcttgccgccattcagccgccccggcaccaggagctgttttgcggggtcgtaggacccctgcgccgaaaccatctggtccgcatcggttccgtggaagaactcgcccggctggagggtgtcggtcagcggctggacctgctcggtggccgggttcgtgggcacctcaggctgggtggagcgcccgaactgccactggctcagcagcacgaagaccccggaaacagcgatcgcgaagacaaaaccggcgatccatcggggcttaagggctgttttccacacgtcttaaccgtacttcgtagcgctgtagaacaactaaacgcgaggccagggccggggtcctgccccctcgccggaccagtcctgcagcccggtcagtgatcgaagaacaccaggctggagttgatgagttcggcgatcatgtcgggatcgtaggcccggcgcagcgactcccggaacgattccttggacagggaccgggccagcgtcgccaggacctcaaggtggtcggagaaggagctcgccggggtggcaatcagcaggatcaccgtggccggaccgtcggcggcaccgaagtcgagagcgtgcccgtatttggtgattccgacggcgatggaggtgcgggagacgaactcgctgcgggcgtgcggcaggccgatgccccccggcagtcccgtagccaactggtgttcccgggcgttcacatgcttgaggaacccgtccaggtccgagatgcgcccggcggcgtgcagccgcttggcaagctgggtggcggcgtcggccttgtccttagcctccaactccaaaatcaccatatcgggcgtggtgagctcagcgtcgtaccggtcaagtggttccgccaaggcgtatcccttcagtcagcgttgctggtgccgtgaatccctcagcgcaaaggcacgatgtcttccacgcccaggcgggcggcgtctgcggattcgtcgtccggctgttgctggctgaggcgttcggcctccacccgtgcaatgtagtgccgcacttcgttttcacgctgggcgtcactccagccaaggacgtcacccattagtttagcgacaacgggcacggcggacactccacggtcccaggcctcgatggaaatccgtgtccttcgcgtcagcacatcatggacgtggcgggcaccttcgtgggttgcggcgtagacggcctcggcctggaggtagtcgtcggcgcccggaaggggctctgcgagggccggattctcctcgatgatggacaggacctcggaggtcatggatccgtagcggttcagcaggtgctcaatccgggcaacatgcacgccggactcctcggcggtacggttgcggcggttccaggccgccctgtaaccctgcgcgccaagcagggggatcgtctccgtgcagctgggcggcacgcgctcatccatggtgcgcgtggcctcgtccacggcgtccttggccatgacccggtaggtggtccactttccgccggccaccaccaccaggccaggaacgggatgggccaccacgtgttcacgggacagcttggcggtggagtcgttctccccggcgagcagcggacgcaggcctgcgtacacgccctcgacgtcctcgcgggtcagcggacgcttgaggaccttgttgacgtgttccaggatgtagtcgatgtccttgctggaggcagccggatgcgccttgtccaagttccagtcggtgtcagtggtgccaatgatccagtgccggccccacggaatgacgaacagcaccgacttttcggtgcgcaggatcaggccgacagtggactggaaccggtcccgcggtaccaccaggtgaatgcccttggaggcacggaccttcaactggccgcgatcggtcaccatggcctgggtttcgtccgtccacaccccggtggcgttgatgacctgcttggcgcggatgttgaactgcgtcccgtcctcgtggttgaccaccttggcccccaccacccgctccccttcgcggaggaagtccaccaccctcatctggttgaccgcgtgggcaccgtagtacgcggccgtccggaccaggttggcgcagtacttggcgtcatccacctggccgtcgtagtaccggatggagcctacgaacgcgtcattcttgaggctgggggcagcgcgcagggtgccccggcggctgaggtgcttgtggaacggcactcccctgctgtgcccgctggagacggacattgcgtcatacagggcgatgccggctcccacatagggccgctcgatgaagggtttggtcagcggatacaggaagggcacgggccgggccaggtgcggcgccagttctgagagcagcagtccccgctcctgcagcgcctctttcacaaggccgaaatcgagcatctccaggtaccggaggccgccgtgaatgagcttcgaggacctggaggacgtaccggcagcccagtcgttcgcttcaacgatgcccacgctgaggccgcgggtgacggcgtccagggctgccccggtaccaacgatgccgccgccgacgatgaggatgtccagttcctggccggggtccgccgtggcgcgcagccgttggatggatgcttccctggcttccgggccaagggctccgccgctaacaggaaaattcttcattgaacgcctccagtgcctcaagtgccggtagtaaaaccaccctacttgcttgcggcacgcttgggcaggagggtggcggcgggataccgccgccaccctcctggttccatgagtgaagagagcgtcagtttccggagtacggggaaaccacgacgtcgacccgctggaattccttcaggtccgagtagccggtggtcgccatggagcggcgcagcgctccaatcaggttggaggttccgttggtgtggtggcccggcccgaagaggacttcctccaggggtcccacggtgccgacgttggcgcggtctccgcggggaagttcgaggtggtgggcttcctggccccagtgccatcccttgcccggcgcttcttcggcccgcgccagggcgctgccgagcatcacggcgtcggctcccattgcgattgccttgacgatgtcgcccgaggtgcccatgccgccgtcggcaatgacatggacgtaacggccgccggactcgtccatgtagtcgcggcgggcggcagcgacgtcggaaatggcggatgccatgggcgaatggatgcccagggcccggcgggtggtggtggtggcgcccccgccgaagcccaccagcacgccggcggctccggtgcgcatgaggtgcagcgcgggcgtgtagccggctgcgccgcccacgatcacgggaacatccagctcgtagatgaactgcttgaggttcaggggttcgtggtccttggagacatgctcggcggacacggtggtgccgcggatgacaaagatgtcaacgccggcggccaccacggtcttgtaatgctcctgggtgcgctgaggagtgagggatcccgccaccgtcacgccggcctcgcggatttcggccaggcgggaggtgatcagttcaggctggatgggcgccttgtacagctcctgcatccgtccggtcacggccgggctgttggtttcatcctccagcgcgccgatctcgtccaggatgggctgcgggtcctcgtaccgggtccacaggccctcaaggtccaggacgccgaggccgccgagcctgcccagtgcaatggcagtctgcggggacatggccgaatccatgggcgccgcaataacgggcatgtcgaacttgtaggcgtcaatctgccaggagacggagacgtccttggggtcgcgggtacgacggttagggacgattgcaatgtcatccagggagtaggcacgacgcccacgcttgccacggccaatctcgatctcgtaagtcactgctctaggttatcccagcggccgtgttgtccttgtctgggaaggacgtgcggggtcaggggccggccgggatgggcagcggtgcccatggcaaggaaccgaagaagtccgtagcctagggccgggggcttcggtgaacgctcccgtgccccattccaaggagaaccaaccatggcccctggcctttacggtgccgacattgaacagttgcggtccttgtccaaatccatggaccgctcctggtcgcgcctgatggatacagagcgccagattacgagccttgtagcgggcattgactggaagggcagcgacgctggcaacttccgccgcgagtggggcagcaacctgcgcccgatgctgaacaaggcgtcccagtcgctgatcgacgcctcacggaccctcttgacgcaggccgatgaacaggagaatgccagcacgaacgggggcacggccggttccggaccgcgagccgcaaccagtccggcagggcctggaactccgggggcaactccgacgaccggtcttgaaggcgtcctctccgtcgccggaagcccggaatggtgggccgccaacgccgcagtgaccggggcaggcctttatacggacagcctcctggccacgatggccaaaggagacctcctcacgaaactgaccaactggccatggctgaccgcgcagtacggccagacccccggagttggctatgtccgtggaacacagctcctgaacggcacttccatgctgggacgcctttccggcggcctgggcgtcgcgaccggcgcgcttcagatcgtgcaaggcgctgccaccggcaacaccgggatggccattgacggcagcatctccacggtcctggcggcgggaagcttcatccctggggccggccctttcttcgcggtcgccggcatcgcctggggcggcatgggcctccttgcttcgaacctcggctatggttcagcctccgagatggtcgcagatgcaaccaggaataccgtcaacgctgtgtccaacgccgccagagagaccgtcgatgccgtggctgacggggccaagaaagtctggggctggctcacgtgacaccccggcttccctagaataaaacccgagatctgtctacccaaaggctgctgtgaccattcaagacgacgcaccactgctcatcaccgaacacgaactcattgccctgatcgccctggcaggaaccacgggggcgctcaaatgccagagcctgttcaggcttgaccacgctgccggtgcacccctcgaacaggccggtgtggctacgctcctggaacgcgggctcatgaaagttgaagaggaaagcctcctcccggtgggtcctgccgccggcgttgcagctgtcctcgcggactccgatgcgtggctggaggtcgccctggtgacgccgaaggccgagcatgtctatttcctgttcggatcaggcaacggcgccctgctcctcagcctcagcaagtacggcgtccacgagctgcgtcccctgaccgatgctgacggcatgttcaccaccgccgtcgagatggtcagcttctacctgggtaccgcaccggacgggcgccccgccgcgggcacgctccgccggcacgttgcggacggcacgttccactccgtccatatcaaggccggggcggatggttcccttgagatcgttaacggcgacgacgcacacccagcccccgttgccctgcgtccggaggacttggaagaccgcctgcgccaaggtttgggtcttcagacggcatgacacaccccgttcccttccccgccaacctgcccgcgtactccctcgatcactggctttccccggagctggcccgggtcagccccccaaacgctccgtcccgtttacggcaactggccgatgcccagggcacgctggcggcaggctggagcagcgcgatcgccggcggacccgtcctggccctggcgggtttgttcttctcagtcgtgtcaggaaaccctgccgcgatgttggtgctcggcccactgggtgccgccctcacggtgctgggcttgatctcgtggaagcgggttcgtggccggcttcccaatacgaacaagctgctcatcacccgcggccccggtaatgcccgcggcggcatcgccatggtggccgggctggccggcctcattggtgcggccatggtcatggcacttccgacggccgccgaacgcggcacaacagtttcgcttattggtgcctacctcctcgttgtggctgttcttgtggcttgcattgtggtcccgtcggcagtgctgggccgcgcccgggagtcgttccggctgcggatccagtcgaacccggaactgcgcagggctgtggaacaggaccttgcagtctggcgcgatccccacggcagcgcaggctacggcccgctctgactttcgggacaaaccggaatcccgccatccttacaggcatggccgtacaccaatagctacagttgccatatgggttcacggtgggtatttgacggccacattgccggcatcggcacggcctccgggcttcgcgccgtagtgggcatctggcaggagtcgcccttcgggccctttgccgacgtcatggtccagcacccctccgggcaccggcagctcctggcacccggcacggaggtggcagatttcatcgcagccacgtacacgttcgacgacgtcacggaggttgacctgtcggcgcggctgggccacggggcgctggaggttgacgccggtcccctggcgatcagcgcccgcctcggcgggcggggcctcctggggaggatgctgcgggcagtcccccggcgccttgccgtgcaccccggctggctgcacgccatcagtccggtcgcggggatcctcagcaacggctcccggacctccggcaccgcgggcagcggccggcgggagtactacggggtgagcgacctgcacaccatcacatccgccgtcgtaagctgggacggcgttgatgccggcgcgctggcgccggtccgccctgccgtgacgttcgggttcagcagcgtcccgccgcggccgggcgttgcgcgcgtccgcacgacggtggcggagtcctaggccccttctgcttcctccaccgtgagctgggattcaaacatcctgaagtagcggccgcgaagcgcaacgagctctttgtgcgtcccctgctccacgaccctgccgtcctcgagcatgtacacgatgtccgccttctcgatggtggcgaggcggtggctgatggcgatgatggtgctgctgcggtctgcgaagaggcgggtgaaaatccggtgctcggccagggcgtcaatggcggaggttggctcgtccatcaccatgaacgaggcgtcacggtagaagttccgggccatggcgaggcgctgccactgcccgcccgagagtccgctgcccttccgtccgcgcgggtcctccatccagttgctgacgtggttgtccaggccgttggggagtttgttgatgaagtccagcgcctccgcgtccgccgcagccgtgcggatgcgggcgtcgtctcggggcgaatcgacgtccccgaagtagatgttctccgcggccgtggcgaactcgtacttgaggaattcctggctcagcaccgccaggtgccggtgccaggaggtgacgtcgacggcggcgaggtccacgccgtcgagcattacctgtccggaatccgggcggtagagcccgcccaggatcctgatcagcgtggacttgcctgcaccgttctcccccacgatcgcgatgtgctggccctcgcggatggtcaggctgatgccgcggatcacctcgatgtcgctgcccgtgtaagtgaagcggatgtccttcagctccacggtcttcggtgcctgcagcagcggcggggcgtgctccgaatgcacgggcatggccatgaacagctcgtaatccttgaggttcgccaggtcctcgtcgatggagctgagggaggacaccaggttgttcgccgtggacagcgccctgctgacgatctgctgcacgtagaggaactggcccaccggctgcgcgcgggcgatgatctgccccaccacccagatcagggacaccacttcagccccgtactggagcgcatcggccgcaagctgcttggggatgtaccgccgctggtagtccaggcggcggcgctcgtccgcatcccgcagccgggagcggaggtccatcaggaagccaacgattccgtagagccgcatctcggcgatgtgctgcggccggaggaggttggtttcgatcatcctccgctggcggcgcgagtccacctgcgtgttccagtgcgcaatctgctcccgggacagcttgaactgcaggtagacgctggggacaatcgccaccaggacgatcacggcgatccaccagctgaccagcagcagcgcccccacagccaggatgacggacaccagctgcgtgaagatggcggcgatccggtcaagcacccgggcgtaggagtcggagaaccgtttggcgcggtcgtagaggtcaacggtttctttgtcgtcgtaccgccagaattccagggccaggaaccgctcgtacatctggtcgcccacaatggcgcccaccttgaagctcatcagctgctggatgtagcggtccacgctgctgaacgcgccccagaagagccccagggcagcggtgatgatgacgtagacgatcgcctgctggccggcctcggcgtcacctgcataggcggcagccagcgccgtggtggtcagggcggcgaagtaggtggtgaccagcggaagcacggccgagatcagcgagccgagcaccttcatgaccacggcgcccggcgaggcccggaaactgacccgcagcacctgggctacggcccgggcatacggacgaagggccagccgccgtggcggctggcccttcgtcggggtgttcaccccttcaggatgcgttgtcagcgggaaccgtagttgggcgcttcgacggtcatctggatatcgtgcgggtgcgattccttcaggccggccggggtgatccggacgaacttgccgcgtgccttcagctcggccacggtgggcgcgccggtgtagaacatggtctggcgcaggccgcccaccaactggtaggccaccgaggacagcggaccgcggtaggccacgcggccctcgatgccttcggggatgagcttgtcatcgccggagacgtcggcctggaagtagcggtccttcgagtaggacgtgttcttgccgcgggactgcatggcgcccagggagcccatgccgcggtaggacttgaactgcttgccgttgacgaagatcagctcgcccggcgattcgtcgcagccggccagcagggagccgagcatcacggtgtcggcgccggcaacgagggcctttccgatgtcgccggagtactgcaggccgccgtcggcaataagaggcacgccggcggggatcgctgccttcgcggattcgtagatggcggtgatctgcgggacgcccacaccggccaccacacgggtggtgcagatggagcccggccccacgcccaccttgatgccgtcggcgccggcgtcgatcagggcctgggccccttcacgggtggcggcctggccgccgatgacgtccacgtgcgccgccacgggatctgacttgaggcggcggatcatgtccagcacgccctgggagtggccgttggcggtgtccacgaacagggcatcgacgccggcgtccaccagtgccatggcgcgctcccagccgtccccgaagaagccgatggctgcgcccacgcggagccggccttcgtcgtccttggtggccagcgggtactgctcagccttggtgaagtccttggtggtgatgaggcccttgagccggccctgctcatccaccaggggaagcttctcgatcttgttggtggccagcttgtgcgaggcttcctcgcggctgatccccacgtgcccggtgaccagcggcattttggtcatgacgtcgctgaccagccgcagcgggaagtcggactcgggcacgaagcgggtgtcgcgattggtgacgatgccgagcaggcgcatgtcctcgtctaccacgggcaggccggagacacggtactgcgagcagatctcatccagctcagcaagcgtggcctgcgggccgatggtcagcgggttggtgatcatccctgactcgctgcgcttcacccggtccacctggtccgcctggtcctggatggacaggttgcggtggatgacgcccaggccgccctggcgtgccatggcgatggccatccgtgattcggtgacagtgtccatggccgcggacagcagcggcgtgtgaaccgaaatccgcttggaaatccgcgaggacgtgtcagcctccgacgggatgacctcggtgtgaccgggcaggagcaggacgtcgtcgtaggtcaggccaatgaagccaaaggggttgtgttcgggctcggtcatgagtgcgcctcttaccttggttgctggacgggtaggggttgcagccgatgaccagcccgtcattacgggactggcctgtgcagggaatgttccaggacctccgcggcaggcggggacccggaggccggaaagtattgagtaaatattagaacctcagcgccaatccccctattccacgcgtggaatgtgagcaaccgcaccctcccagccgctccttgccacccgctgctgctgttggctgctttcagctccagcccgcagcagccagcagccgctgctcgaacatggggatcatgctttccacgtaggtccgcgtgaggtggttgtcgtccttatagacgtagacgttgcccaccacgccgggacagatgccccgcgcgcagatgaaatcgctgagatccatcaggtgaagtccgtccagtttgccccggtagctttccagcggggacgcttccaccagggactcctccagggacacactgcactccggtgcgtccgggccgttgcgctggatgcattcgggcatgttgaacgtaaagcgcgggttgtcccggatgccgatgacctcgatcccggcttccgcgaacggctggaccccctccaggtaccccgggacctcggtttcgaacggggcttcctcatgcgtcagcgatgccacggtgaacactgcgtccggctgatgctccaggacgtaggcggcgctggcctggttgtaggcgttgcactccgcattccgttctgcggactccgccccaaagcggcacgccggcatcagcagcgtcaccagttcccagctccgcttggcggcaatcggcgccagcgcacccaggtactgctgggagtgggagtcgcccaggaccacgatgcgcttggtcaccgcgccgtccggaacctcctgccggcatccttcgaggatggggttgctggtggcgttggcaccggtgcagggcgcgtggattccggcccagtcgttgtccagcgccgaggggccggggatgatcctggcatcaggggtggtcaccgcggcgttctccgggttgagcgcggcggcccctggcgtgagctcccgcggctgggccgccgtcgcgctttcctctgcggtgagcgtggtctgccagatggccacgggtccggccaggagcgcgccacaggcggcaatgacgacggcggtgcgccaggcccggcgctgcggccagtgccagtcgcgcagcggcttttcaacaaagcgcgtggtaaggacggcaagcacgacagaagcgccaacgaccgccaggccttgggccaggttgggtgcctccacgccggtggcggcaagcgccaggaccaggaccggccagtgccagaggtagagggcgtaggaattgtctccgagcgccaccaggggcttgctgctgaggaacctgtccacgccgaagcggctgccggattgtcccgcgacgatgatggcggcagccgccagggtgggccacagcgccacgaagccggggaacgagcggtccaccgtgagcagcaggccgcaggagaccatggctgccaggcctgcccagcccagaaccacccggagcgcccggcccgggttgaggtagggcaggcccagcgccaggagcgagcccagcgcgaattcccagagccgtgtccgggtgtcgaagtaggcgtacgcctggttgccggcggtctgctccacggagtaggcgagggacacggcgaagactgtgccaaagaccagggccagcagaccgcggtaggtgacccggttgagcgcggggatccggtgcagcagcaccagcagcgccgcggtgccggcgaagatgaggggccagaggatgaacacctgtccttggatggacaacgaccagaagtgctggagcgggctggctccggcgtggtcctgggcatagtagtcaacggcagtgtctgcgagcagccagttctggctgtacagcagtgacgcccaggcctggtccagcacctgcggccagcggctctgcggcaggatcagccacgtcccggcgaggactcccaggatgaccacgacggcggcgggcagcagccgcttgaacaggtgcagccagtgcccaaggaggccgaacgggcgccctgcctcggctttccggacgaaggacagggtcagcaggaacgcggagatgagcaggaagatgtccactcccccggacaccctgcccagccagacgtggtaggcgaccaccatgagcacggcgagcgcacggagcccctggacctccggccggaaggtcggcttccggtttttggcggccgcttcgggcaccgggcggggcgcggccgcggttctcgctatcgacacaaaagaccttccagcggcgggcaaaacatcaattctaccgaggcacagggattttccgggaaaggtaacgggcatcacggactgaaccgggaagggtggcggacgctgccgcgtagaggaattcctgcccgaggaagaacaggcccggcacatcaagcgccacgccccgccgctgccgtggcatcgcgccggcgtccagcaggtccggatccatccaggaaaagtcttcccggaacccggtgcaccagatcacgttcgctacctcaagcgccgttccgtccgccaggaccggcttgccgtccgccactcccgcgacccgcggcacgaaaggcacacctgcctctaagagatcctcgctcttggtccggatcaggggtgccgcatgtgctttgaaggccggagccactttgcggcctatgggcgtgccgagagtaaggacgtgcataccgaggaaacgcacgatgggcaggaagtacctggccgccgtccgtccatgctttacggggagctcgccgcccggctttcctgcgaccgcagtgggatgcgttcggctcacttcaagcgcaatctccgcaccggagttcccgagtccaaccacgaggacagggccgtcctgaagctggccgggattccggtagacgctggaatggaagtgcaccgtggagggcgccaggccggccgcgaagccgggaatcctgggaacctgttctgcaccggtggccacgaccgcgttacgcgcttcccagcggctgccgttcgaggcggcgatgaagcggtcaccctcccgccagagccgttccacacgggtttcatggagtacgggcaggctgttcctggcggcgtagacctccaggtagccggccacctcatccttggttgggaaggacaacggatcggcggggaaggcttcgccgggcaggccgtcatactttgccggcgtgaataccctaagcgagtcccaccgccggcgccaggcgtcgccggttcgcgggttcgcatcaagaatgaggaagttccggttctgctcttttaggtggtggcccagggcgaggcccgcctggcccccaccgatgatgatcgtgtccagcatgccggtcacgttgctgctgctcatggctgcgctcctgcttcgttggttgggtatgcctgcgagtgaaccttccggcgggctgctgccgttctgctccccagggcgcccggctccctgtattgcagccaccaggcaagcatcagtgcagatgccagaacgtaggcaacgtgcagcacccagatgggaccggccgggaggtcgaagacgtagacggagtggacggcgttggcaacgttgctcaggaccaggtttcccagactgtaggaagcaaggtcccgcgtgcgtgcggctttcaccagcatcggcaggattcccagtgcgaaaagcactgtggaaactgtgcccgcaaggactggaaggttcatgcttcgacgctacgtgcgggggcaccgggcccgcgtcggcaaaatcgtgtaactgcacagccgggtggatgggtaattttgtgcagtgtttggctagcccgcgagcccgtgttcgaaggcgtaccgtgtggcggcggccctcgaagagagcccaagcttcaggaagatgttgctgatatggcgggcgactgtcttttcgcttaggtacagttcagcggcaattttccggtttccctggccggaggccaccagtcggaggacctccgcttcccgccgcgtgagcggtcccgcgacgccgccgccttccccgtggtccatgagcgaggctgcccaagccgcagcgggggcggccttcagctccaggaactcggcatgcgcggcttcaaattccatcagggccgacgtttcgtcgcccaggtcccggcatgcccgcccaatcaagacccggcagcaggcagcctggaacggcaccccaagctccagccacagctgccaggcttgccgcagaacttgcgcggccgcagcgggatccctttcctcaagggtgacggcgccgtcagcctggcccgccactgcccggatcatgggtctggggcattcgcgggcaaaagtggccagttcctccgcagcctgccgtgcagccgtcaggtccggcacggccagttcgatctgcaccagcgcaggcaacaggtgccggcgggtggcgatgtcagccagaccggccgcccggcggatcatcgactgcgcctgatgggcgtctccccgcgccagcgccaggagagcaagtcctggctggggttcgtggccgctgcgcgccgcgtgacggtaggaagcttctgcagcatccaggttaccggtcagccgctgcacttcggcctgctggtaatagccgccgtaaagggcccaggggtcacccttcgttgagcgcccctgggcgaccgctgccgcctccagcgcttcggaccatgctccgtgcagcaggaagagctcggcgcggtgcgcttggcattgtccgctgaacgccatggtgtccggacgttcacggcaccagctgtcgagtgccgctgtccattccagcgcccgttcaaggtcgaaggcaacctggcagttgcctatgactgcgcagtagatgattccggacgggacagccgagagttctcccgccgtgacggccaccatgacctcgtcgaacataccgaggccttcctccgcgcggccaagcgccagggtcgactggcctgctccgagaaggccgaaagcggccaggtctttgtcctggaacctctggccaatatcggcaacctgggagaacatctgcagggcagcctgcggatcgccgccgtacagctttcccaaggccatggggacgaggatgaagccctgcactgggtccggtgcagggagttcgctgaccagcttctggccgcgcgccaaccaccccccggcccgtgccatctcgccaagattggtcaggtgcatcaccatccaggcggcgcatctggcggcgccagccaggtcgccgaccatgaggtattcctcatgcgcacgggtaagagtatccagacccgcatcagtgttgccggtcaggatctccgccgtggccaaccgttcgaggtccgccgccggcagtccgccccgctggtccgcatcccggaaattctggaaggcatcggtccagcggtgctcgcggaatgccgaccggccctggtccatgcccgtctccgctgacaccctggcctccttccggataccacccaagccagcctgccgccgtcgcgcactgcacgcaacggtacttaagcgtcaccgtacgcccgcggcacacccggcacaagcagtccgcaggtacattcgaaccccccatcccggcggcgtgtcctggcgccgcaagggcggccgcctaaggcgttcctcttcctcctccggctatgaacgaagcagtccgcgcagcgtgtgtatggtgtccgcttccgcggccgttttgtcgtcgcggtaacgcttgacgcgggcgaaccggagcgctatcccgccgggataccgcggggactgctgcacgccgtcgatggcgatctccacgacggtcacgggctccacccagacggtgccggccgtgcgccgcacctcgagcccctggaaacgttcggtctgccactgcagcagcgcgtcggtgaggcccttgaaggttttgcccaccatgacgtagccgccaggttcaccgaactccccgtgcgggtccaatgctccaagatgcaggttggagaggagcccggtgcgccgtcccgacccccattcggaggcaaggaccaccaggtcgtaggtaaggacgggcttcaccttgatccagttggagccgcgccggccggcggcgtaggccgatcccaccgccttcaccaccacgccctcgtggcccgcggcgagcgcatcacgggagaccccttcggcaatcccagggtctgccgtgatctggccgggaatccggtactccggggcgatgccctcaagcactccgatgcgcgtggacaggggttcgtcaaggaggtcgcggccgtcgatgtgcagcacgtcgaagaaccagggatgcagcagggtggtgcgcgccgcgtccgcgccgaaccgggacatggtctcctggaacggacgggggccgccgtcctcatcgagggccagggtctcgccgtcaaggatcacatcccgcaccggcagtgcgcgcaccacctccaccacctcgggcaggcggtgggtcacctcggccagggtgcgtgtgtagatgcgcacgtcgtcgccggcgcggtgcacctggatgcgggcgccgtcgagcttgtattccacggacgcctcaccggtaacctccagggcggcgccggcgctggccgccgtggaagcgagcatcggctgcacggggcggccgacgacgaggccgacggcgtccagctgcgccgcggtgcccgtgatggccagcagggcggtttcgccgaggtccccggagagcatggccgcgcggcgtacggaggcgacggggcggtccgaggcacgggcaacggcgtccgtcagcaccccctcaagcgcaccggtgcgcagctcccccagcagcacgccggagatgaaggcctgctccctttccgtagctgccgccgtgagcgtccgaagagtcgcggcgcgttccgccgcagacccggcccccgcggtggcgagcagccggtccaaagcggcgtcgaggtccgcgagggtgaggctgggttcctgggcaggctcccccatggccgcagacatgccgcgccagcccacccccacccggccctggcgcggcctggcggtcagcaaacccaccgccgtcgcgatttccgctggctccagccgcagcagcaggtccgccaacgcgtccacctttgcgagccgggagcgcgtggctgcgaccgtatccgtagttttcacgagctcgtcgagcagcatggcatcagtctgccacgcccgccccgtccactatggacagctccggacggcagttccagactggacgcatgggaatcatcgtcgcgaacctgttcatcaccctcgacggcgtgtaccaggcgcccggcgggcgcgaagaggacaccgagggcagctttgccttcgggggctggcaggctcccgtgtccgacgacgaggcggaagcggccatcgaggccggcatcagcagcatggacgccctgcttctgggccgcaggacctatgacatcttcgcggcctactggccccaccagtccggcgacgttggcgccgcgctcaaccgggtgccaaagttcgttgtctccagcaccctgtccggtcccagttgggcgggaacgacagtcctgcccaatgccacagccgcgggccggctccgtgaagagtacgggcaggtccacatgttcggcagcggcgtcctgatccgttcactgcttgcggcagaggtgcttgaccgcctccacctctggctctatcccgttactttgggccagggcaagcgcctgttcgacgccgggaccgttcccgccacctaccgcctcgcggagccggcgcgcaccttcccgaagggggcggtgtcgctggcctacgagcgtgcgggcgctgtggagacgctggacatgccggccacgcagggcacgtaatggctaaggtcatcgcagcaatcacaacgtcggttgacgggcttatcaccggccccgacgacggtcccgggtacggcctgggcaggggtggagaacggctgcactactgggtgatgggcggcccgtggacttacgacggcggccacgactttgcgatgcacgggccggacaaggaattctacgaggagctcgttgcggggctgggtgcgagggtcgtagggcgcgggatgtatgacgcggcgggagcgtggggaggtaccaacccgttccccgggccgctgatcgtgctcacccaccgtgtagaggaccagcccgcggctgcgtccggattcacgttcgtgtccgggctcgaggaagctttggcccaggccaccaaagcggccggcggcctcgacgtatcgatcggcggcggcgcggacgtgatccggcaggcactggccgccggtctggtggacgaactggcgctgtcaacggcaccggtggtcctgggcgccggcaagcgccttttcgacggcttccagcatgacatcgacctggagatcctgaaggccgtcagttcaccgttcgccacccacgtccgttacgccgtgaagaagtaggcgactgctcctgcgcgtttcccgcaccaaaaaaccggcccagcggatgctggaccggttttttgtgcgtgcaggactgggcccacaccatcagggagacggtggctgggcccacgccggcgaggggcccaagtcgagcgaagcgagacttgggagccggtggggattagtggctgtggcctgcgtgctcgtcctcttctgcaggcttctccaccacgagggtctcggtggtgagaaccagggcagcgatggaggccgcgttgcggagggccgcacgggtgaccttgacgggatcgatcacgccggcagcgatcaggtcctcgtactcgcccgacttggcgttgaagccgttgttggtttccaagtcggcgaccttggacgtcacaacgtagccgtcgaagcccgcgttctgggcgatccagcgcagcggctggaccagtgcgcggcggacgatgcccacagcagcggcggcgtcaccttcgagtgccttgacggcggggtcctcatccagtgccttcagggcgtggatcagggcggaaccgccgccggcaacgatgccttcttcaagggcagcgcgggtggaggacacagcgtcctcgatgcggtgcttcttttccttgagctcgacctcggtggcggcgccaaccttgatgaccccgatgccaccggccagcttggccaggcgctcctggagcttttcacggtcccagtcggaatcggtgcgggtcagctcggcacggagctgggctacgcgtgctgccacgtcttcggccgaacctgcgccgtcaacaatggtggtgttgtccttggtgaccgtgatgcggcgggcggtacccagcacctcaaggccaacggtgtccaggctcaggcccagttccggggaaacaacctgcgcaccggtgagggtggcaatgtcctgcagcatggccttgcggcggtcgccgaagcccggagccttgacggcaacaacgttcagggtgccgcggatgcggttgacgatcagcgtggaaagggcctcgccgtcaacgtcttcggcgatgatgaagagcggcttggagctctgcagcgccttctccagcagcggcaggaattcctggatgttggagatcttgccctggttgatcaggatgagggcgtcctcgaggactgcttcctggcgttccgcgtcggtgacgaagtacggggacaggtagcccttgtcgaactgcatgccctcggtcaggaccaattcggtctgcgtggtggaggattcctcgatggtgatcacaccatccttgccaaccttgccgaaggcctcggcgaggagttcgccaacctcgtcgctctgcgcggaaatcgctgcaacgttggccacctgggtgccttcaacggggcgggcgttctcgagcaggcgggcggcgacggcttcaacggaaacctcgatgccgcgcttgatctggccgggtgcggcgcctgccgctacgttgcgcaggccttccttgaccagcgcctgcgccaggacggttgcggtagtggtgccgtcaccggcaacatcgttggtcttggtggccacttccttggccagctgtgcgccaaggttctcgtaggggtcgtccagttccacttcgcgggcgatggtgacgccgtcgttcgtgatggtgggagcgccccacttcttgtccaggacgacgttgcggccgcgggggccgagcgtcaccttgacggtgttggcgagcttatcgatgccggcttcaagagaccggcgggcagcgtcgttaaacgcaagctgctttgccatggttttgtcctttcaagacagaaccccgcgcagctgaccagcagagagcatgaccagcggcacggggatccggagagttactttacgacgatcgccaggacgtcgcgggcggagagcacgaggtactcggtgccgccggtcttgacttcggttccgccgtacttggagtagatgacgacgtcgccaacggctacgtcgacgggaacgcggttgccatcttcgaagcggccggggccaactgcaacaacttcgccttcctgcggcttctcctgcgcggagtccgggatcaccaggccggaagccgtggtctgctcggcttcgagcgggcggacaacaatacgatcctcaagaggcttaatagagaccgacactcggacctctccttcttcgtcagcaaattcgtggactggaaagctttccgccgtggctggcaaaccgtcgtcgcggtgccggcagcagcctggctggcagctcttcatgtattagcaccctcctagggagagtgctaatacagactgtatgcaagggttagcactcggtcaaggcgagtgccagagtttcgtcacgggcggaacatggggacgtgtagatttgccgggtgcgagccgctgtttacctgattcttgccaccctcttctgggcgggcaactttgttgtaggacaggctgccatggagaccatggagccgctccagctgacgttctggcggtgggccctggccgctgtgccgctgctggtcctggcgcagctggtggaaaaaccggactggcgcgccatcctgcgccactggccggcgctgctggtcctgagctgcctgggcatgagcgcctacaccctgctgctgtacagcgcgctggggcacacctcggccctgaatgcttcgctggtgaccgctgcaaaccccgccctgattacggtcctggccgtagtcctgctccgggacaggccgcgcccgctgggctgggcagggattgcgctgggcctctgcggagtcctgctggtcctcaccggaggcgatctgcagcggctcctgaccttctccatcaacgctggcgaactgctgatcgtcggcgccatcaccgtgtggggcatctacacgatcaccgcccgcaggctgtccgtcccggcgatcacctccaccgcggtgcaggtggccatggcggctgttgtcctggttccctttgctgtgggcacgggggccgggctgccggccacggcatccgagggctggtccctggcctacatcgtcctcttcccctcgctgggttcctacctgctgtggaacctggcgctcaaacgcaccaccgctgcgaacgccggaaactacctcaacctaatcgccgtgtttaccgccatcatcacggtcgccctgggtcagcccatcaccgtcccccaggtcctgggcggcatcctggttatctcaggggtcctgctgaccagtaccggaggcaaagcacctcagcggcccaggtcctcgaagtcgacgtcctccccgccgtcgccctcatcctcgcctgccgagttccgcccgcggtaaagcagcaccgcggcagccgcggccgtcatgagcgatacaaccaggaagaagatgctgcccgcgcgggctccggcgtacagaccgcggatgtcctgggcctcctgcgtgtcgtcctggatgctgctgccgcccaccgaatagactgtggcgttgaaggcatccaggaagaagatgatcaccagcagcgcgatgcacaccacggccaccacggcactggcaatcagtgccgggcgggcgaaccgcgccaggcctccggggtggtgctggcgggactgcggggaacctgcactgtctttcatggcttcaacactatcggcccgccggcatgccgctcctccattaggctggaacccatggctcaagctccccaggaccagattgcaccactgctcaccccggaaggctgggagcttctggcgtccctgggcccgtaccaggaggagaagtccttcgagctgaactcggccctccgcaaggccggccactcccctgaactggtctccgccgtcctgacccagtcccggctccgcaccagggctgccgccaagttcggtgagtttgcccggagcatgctgttcacccaggctggcctggaacaggccacccggctcaacgttgccgcacgccacgcccagcggttcgcggaggccggaatccgccacgttgcagacctgggctgcgggctgggcgcggactccctgacactggcttccatggacatcaatgtcaccgccgtggagatggacgagaccacggcagcctgcgccaccgtcaacctgatcccgttccccaacgccaccgtgatgcatgcggacgccatggcagtgccgctggacgggatcgacggcgtctggctcgatcctgcgcgccgtgtcacctccacgtcgggcaccaagcggatctgggacccggaggccttttccccgcccctgtccttcgttgaggacctggcggcctccggcctggccgtgggggtcaagatggggccgggcatgccgcacgattccgttcctgcaggctgcgaagcgcagtgggtctccgtggccggggatgtgacggaggtggcgctgtggttcaacgcagtgcgccggccgggagtccgccgggcagcgctggtcctcggtgcgcagggcgcggctgagctgaccagcggcgaagacttcggcgccggccccacggctccggtgggcccggtggaaggctacctctacgaaccggacggtgcggtgatccgcgccgggctggtggccgacgttgcactgcagctgggcggacacctggtggatgagcacatcgcctatgtgtgcgcgccggaactggtggacacaccctttgcccgcgcctacaaggtcctggaggtgatgccctacaacgtcaaggcgctcaagggctgggtgaaggacaacggcatcggcgtgctggacatcaagaagcgcggcaccgccgtcacgcccgaggagctccgcaagcagctcctccccagcgggaagaacgcggccggcaagaaagccggaaccaaaacagccaccctggtcctgacccgcatcggggaggaccgggtggccatcgtggtggagcccgtccagtaaggctactgggcccgcatgaactcctcggcagcgcgcacctgctcagcggtgggccgcacgccggtgtagagcacgaactgttccagggcctggatggtggcaacctccgcccccgtgatgaccggctttcccgcggcccgggcggccttgatcagcggggtttcggccggcagcgccacgacgtcgaaaaccacccgggcggcgtcaatggtttcctgggggaaggcgagggcgtcagcctccgctcctcctgccataccgataggggtcacgttgatgagcaagtccgcggtcccgccgtcgagcgctgcctgccacctgaagccatactgccctgcgagcgcccgcccggcagcctcgttccgggcaatgaccgtgacgtccgcgaagccggcgtcgcggagcgcggcgacggtagccttggccatccctcccgccccctggacgaggaccgaatggcttgtgggcaccttgttggtggccaggagctgctcgatcgcggtgtagtcggtgttgtacgccgtcaagcgcccgtccgtgttcacaatggtgttgacggagtcgatggccttggccgaggggtccatctcgtccaccagcgcgatcacgtcctccttgtacggcatggagatggcgcagccgcggatgcccaggccgcggacgcccgcgatggcctgttccaggttcgtgggggcgaacgccttgtagatccagttgaggtccagctgctcgtacaggtggttgtggaaacgggtcccgttgttgctgggccgcgccgagagcgagatgcagagggtcatgtctttattgagaataggcacctgcccattaaacgcgctccctcccaactgtgtagcgctaagtgtcgttttgggggttcaaaacgacacttagcgctacctagttgggatcaggggcacccggttcccgccgggaagtttccgacggcggccggcagctttcccggtgcgcctgccttccctgccaggacagccgcgagggcgtcgaaggcgccgtcgctcctgccgtagagggccaccttcaccggcgcggttgagtcccgcagcggccacggggcgtccagggccacggcaatgtcccctcccgcgccgcggccgccgtagccaataaggctgaccaggggtccggagccaagggccagccccgccctgaccgcggctgcctcgaagcgtgccctgtccgccggcgagccgccgtccaccctaaccgcgccgggaaccagcggcccgctgcagggtccggagagcatggtgaccgctgacgcggagacgtgggctgacagggctccgccgctgcctgccggggcgccggctgccgcggctatccggccgtgccaggccatcatggtggccacgcggcgggctgcctcgtccaaacgctccgggggcagggtgccggaggccacagcttggacgatcgcggcgtgggcctgcgctacgtcggcgggcatcagcaggaggtccgcgccggcggcgagggccatcaccgcggcggcgccgccggggtactgcttggtcacggcgcccatattgagggcatccgttaccgccacccccttgaacccgagcccccgcagcgccgcataggcagggcctgagagcgaggccgggacgccgggttccagcgccgggaccgcaatgtgcccggccatcaccatcggagaaccggcatcgatggcggccctgaacggcttccagtcacggccggcgagctccgcgaccgtggcgggctgcgccgggaggttgtggtgggaatcgaccgtcacggagccgtgccccggaaagtgcttcacggccggcagtactcccgcggcgagcattccctgcgagaacgccacgccgagcgcggcagcggcgtcggggtccgcggacatggacctggcgccaatggtgggatcgccgggcccgatggtgacgtccgtgccgggggcgaaatccaggttgaacccgaggggcaccagttcggcggccaggccctgccccgcttccttggccagcggcacgctgccggcggcgccgtagctcatgggtgtgggccattcggtcaggggcaggcccagccgggcaacctggccgccttcctggtccaccgcgatgatcccgggccacggccgtcccccggctgccgccgccaaccgctggttgacggcagccatgccgtgcacgtccatcctgccctgcgggtcgaggggaacgttgtcgcccatgatgatggacccggcaaggtgcagccgctcgatggcggctgcgtgggcctcaacctccttgcccttgaagaacggaaggaggacctgcccggccttctcctcggtgctcatcgccgccaccgcagcagctgccgcgtcctggtcgcgctgttcaggcccccagccaagcggccgggtaccgggatcaggtgacggggagggcgtggggggtgccgtcgtcgtacttggcgtggaggtggcagacggtgcagacaacgtagttggggccgacgacgacgggacagggcccggcgctgccgtgcaggacgccagggctactgcggcggaggctgccgcgaggaagggaagggatgtgtgaaaactgtcacgcaggggtcggaacggggccatcaatacgatgctacccctgcactagacttgaaccatccgttcgcctgccggcaccagcctgtcagtgacggcgtgagccagcggcaaacaggacagttaggacatgcgtgaagatcgacttcgctacatcaaggcagtcaacccttggtgttgaatgggaactcgcgctggtggacggccggacgggcgaactcgcctccgtggccaacgaggtcctccgcggcgtcgcttcccgccaccccgaactgaacgaagacgacgagcacccgcacatcaagcaggaactcctgctgaacaccgtggaactggtgaccggtatctgcgaaaccgcagccgaagccaaggaagacctcagccgttcgctgaccgccgtgcgcgagatcaccgaccccatgggcgttgaactgttctgcgccggaagccacccgttcagcccgccgcagctgcagccggtcacggacaaggcacgctacgcgaaactcatcgaccgcacccagtggtggggccggcagatggtcatctacggtgtgcacgtccatgtggggctggaccgcagggacaaggtgctgcccgtgctggacgggctggtcaactatttcccgcacttccaggcgctgtcagcgtccagcccgttctggggcggcgaggacaccggctacgcgtcccagcgggccctcatgttccagcagctccccaccgccggcctgcccttccagttccattcctgggaggaatacgagtcctatgtgcaggacatgttcaccaccggcgtgattgacacgctctctgagatccgctgggacatccggcccgtgccgaacctgggcaccatcgagatgcggatctgcgacggcctggccaccctggaggaagtgggcgccatcgcagccctcacccagtgcctggtggacgagttctccaccaccctggataacggcgggaccattcccaccatgccgccctggcatgtccaggaaaacaagtggcgcgctgcccgctacggcatggacgccatcatcatcctcgacgccgcgggcaaggagcagctggtcaccgagcacctgctggaaaccctcaaccggctcgagcccgcggccgccaagctgcgctgcacggacgagcttgccgacgtcgagaagatcatccgccgtggggccggctaccagcgccagcgccgggtggcagctgaacacggcggcgacctccaggccgtggtgctggacctggtcaagcagatgcgcaacggccccaccgcctgacctggcccgcccgaaacggggcacttcggcacggacacgccggccgccgtcgtgatgtacgacggcgaggcccccaaagtgccccgcgacggttcgccgggtgttcgggcgtccggcctgcgtcaggcggggagcgagaccgacgtgaccggcatcgaggaatccggggcgaagcggatgccgctgggttccactccggccattaccagctgggcacccagggccgccaccatggcgccgttgtccgtacacaggtccagcggcggcacgtgcagcctgataccggccgaggcacagcgctgtcccgtcagctcgcggagccgtgagttggccgcgactccgccgcccaggagcacgtccttgatgccgtgttcccggcaggccagcacagccttcgaggagatgatgtccaccacggcttcctggaacgccgccgcaatgtcagccaccggaatctcctccccgcgcgcttcgaactgctccacgcaccgggccaccgcggtcttgaggccgctgaaggaccagtcgtacctgtgcttgccgggctcctcgacggtgcccatgtacttgggttggctgagtccccgggggaagcggatggacttcgggttgccggtgcgggcaaccttgtcgatggccggcccgcccgggtagccgaggcccaggatgcgggccaccttgtcgtaggcttcgccggcggcgtcgtcgatggtggaacccaggagctgcacgtcgtcggtgatgctgttgatccgcaggatctcggtgtggccgccggaaaccagcagcgcgccgaggttttccgggagctgcggtgccgtcccggttccctggccactgcccttcctgtccaacagccccaccccgacgtgggccacgaggtggttgatggcgtacaacggcttgccggtggccacggccagggccttggcggcgcagacgcccaccatgagggcgcctgccaggcccggtcccgaggtgaccgcgatggcatcaacgtcatcgagggccacgcccgcgtcggcgagcgcctgctccagggtgggaacaaacgcgtcaaggtgcgcgcgggaggcgatctcggggatgacgccgccgaaccggacgtgctcgtccatggaggatgacacggtgttggtcagcagcgtggttccgcgcacgattcccaccccggtctcgtcgcaggatgactcaatgcccagcaccagcggctgcgtgcggttcatggctggggtccttccgtggttgttccgtgtgccgttccatcgccaggtgcgccggcaagctgaaggcgcatgatcagggcgtcgacgccgtcgcggtagtaccgggggcggacgtggatctgctcaaagccgaaccggacgtacagctgctgcgcccgcgggttgtcagcgcggacctccaggaggacgtccgcggcccgcctgcgccgggcttcgtcgatgagggtggtgagcagcgtggtcccgatgccccggccctcgtattcggggacgacggcgatggtctggacgtccgcgatgggctcgatgcacatcagaccggcatagcccacgatgccgtcgctgcattgcgccacgaggtaacggcgggtttccggctgggagagttcgtcgaggaacatctgcaacggccacgcgtccaccgggaagagccgctgttccagcgcgctgaccgcggggacatcgttcagcgtcatgtcccggacagtcacgtccgcgccggggcggccgggtatgcggttcacagggccctcttccgtggtccggggacctgggcgtcggactcccggaggtacagcggagtggagtcgaggagggcgtttcctgccacgagccgcgccagcgcgaacttgcccaggtacagcgcatccggctgttcctgcgcgaagtcggggtgggcgttcagcgcatcggcgtagaggccggcgccggcaccgaaggcgggcaggtccgggaggtcggcggcgaagctgacgtgcgggccgtcctccaggacgggaagccggccttcggcgaggctgtaccgcgcccagtagacctctttccggcgcgcgtccgtggccaccaggaactcggggactgccgcggcggattccgccacttccagggccatcgcgtccaggctgaccagcccgtgaaggggtttgccccagacgaaagccagggtccgtgcggtcgcaattccggaccgcagtccggtaaacggtccgggacccacacccactaccagggcgtcgatgtccttcccagtcacgccggcgcctgcgagcatctcctcgatccccggggcaagcacctcggcatggctccgggtgtcctcagtggagaagctggcgagcacggagcccggcgcctcagaggaaaccagggccgcgctggcaacggcggaggtgtcaatggccaggatcagcatcagcggaccccttccatggaggcgcccagttccggagcctcgggccaccgcgggccgtacccgcgcatcacgatggtgcggggctcgtccgcatcctcagtgtcgaagtccaggctggcggaaggccgcccgtcgtcaagtccaactgcgcggtgcacatcgatttccagcctgctctcactaaggtgctccacgcggtcccggccccactccacgaccgtcacggaggagtccatggtgttttccaggtcgatgtcgtcaatttccgcggctgagtccagccggtaggcgtccacgtgcaccaggtccgggccgccgggcctcggcccgtcaggcaggttgggatggatgcggaccagcacgaacgtgggggaaataatgccctcccggacgcccagcccctcacccaggccctgcgtgaaggtggtcttcccggcacccagttcgccgctgagcaccagcaggtccccggcctgcaggaccgccgcgagacggagggccagcgcatgggtctgctccgctgtcgtcgctgttaatgtcgtttcccagttgggccggggagcctggccgttggtggtcacgagagctcctcctgactggacgcggagctccggtcctcttcgttgatgaagcgccgcggcaccctggggctgatcctggtgacgatctcgtagttgatggttccggcggcgcgcgcccagtcatcggccgtggggccgccgtcggctccgtccccgaacagctccgcctcggcacccagcaggtccgcacccgctccgccgatgctgccgaggtcgatgaccatctggtccatggcaatccggcccaccaccgggtaggtccggccggccacccgtacgggcccgccggtggcggaccgcggcaccccgtccgcgtaacccaccgggatcaggcccagcgtgctgtctccctgggtgcggtagtggaggccgtaggacacgccctgcccttccggcacctgcttgcactgggacaccagggtccgcagcgtcatggcggggcggagccccagttcggcggagctctgcccggcgaatggggacagcccatagatgcccaggccaacgcggaccaggtcgaagtgggtgtcgggccgggacagcgtggcgggggtgttggccaggtggcggacctccgggtccacgccggcgtcctccgccacggccaggacttcgcggaacgtggccagctgctggtcggtttcgggacgctccggctcgtcggcgacagcgaggtgggagaaaatgcccaccacgcgcagcaggccctggtcctggtagtccatcgcctcgcccaccagctggtcccagctgtccagggcggcgccgttgcgtcccagtccggtgtccactttcaggtggatgcgggccgggcgctcttgttcccgggctgcggccacaatgcggtccagttcccagccggagcagccaatgtcgacgccggcagccacagcagcgccgaagttgctttccgtggtgtgcagccaggcgagcagcggcgcatcgatgccggcagcccggagcgccagggcctccgagatgtgggccacgcccagccaggacgctcccgcctccagggccgcccgcgccaccggcacggcaccgtgcccgtatgcgtctgccttgaccacggccatgactttcgccggggatgcggcagcggcgaggcggcggacgttgtgccggatggcgtcgaggtcgatcacggcggaccgttcatagcgggagccgtgtcccggggcagcactgaattcgccggttgttgcggggtaagtcaccctagtgattctagtgctggcgcttccggccgaataatcgtcaggcgtccgagaggtgggcgatggtggctgcggccctgcgctgcgctgcgagcgggacgtcctggatgatgtcggccaggaagccgaaccggcgcagccactggctcatctgccgctccggccgcgcgttggcgcgcttccaccagtcggcaatgtccccccacccgggggcagccagggatccgcccacctcctgcaccgccagcgaggcgcaaaggttcgcaaagcggagcctgtcccccagcggccagccggccaggctgccaacgatgaacgcggcgtcgaaacagtcacctgcgcccgtggggtcgtaggccttcaccggaagcgaaggcacccactcctcctcccccgtttcggaatccaccgccatggccccctgcgcaccgagcgtcaccacggccacaggaacccggtctgccagcgcatacagggcagtccagggatcgtccttcccggtgaacgccatggcctcgcgctggttggggaggaaggcatggaagtactgcaggttgtccagccgggcaggcgcccactctccgctggggtcccatccgacatcgccgaacagcttgacccccgcgtggtgtgccgcttttgcccacggctcgatctccctgcccacttccgcgatgccggcgagcgcagggggcgggtcccctatgagttcggaggatgtgatgggggcagcgtggccgtgggtcaccatcgacctgtccttctccacgcagagggagacggtgacaggtgagtgccagccggggactttttgcgacagcgagaggtccacgtgttcctggccggacaggatcttccagttgaagtccccgtaaccgtcatcgccgaacgcggcggccagacctgtcctcagccccagccgtgccgcggcgatcgcctggttggcaaccccgccggggcagctgcccatgccgtcgctccagatttcggtgccgggctccggcgcgtgcggaagccccgtgaaaatgatgtcctggaaaactgttccggccagcagcacgtcgaatccgggagtggcgggcggacggacggctgccaaggggtcgtaggggcgggctgggatcgcgtccatgtccgcacactacgccctgccgctgacatccggtaggggcccgccgggcgcgggcctagactgctggttatgcggcttctcattgccggcggcgggggtttccgggtgccgctgatataccgggcgctggcctccggccgcttcgcgggaatggtcagcgaccttgtgctgtacgacgtcgaccccgcccgactccaggcagtcaccgccgtcctgcacagcatgccgggcggtccgggtgcccgggttccggtgcacgccgccactaacctgccgcaggcgctggcgggtgccgggatggtgttcgcagccatccggcccggcgctacggcagggcgggtggcggacgaaaaggtggcgcaggaccttggcctgctggggcaggaaacaaccggcgccgggggtatctcctacgccctgcggaccatcccgcacatgctcaacctggcacggctgatgaaggagcactgcccggaggcctggctgatcaacttcaccaacccggccggcatggtcaccgaggcgctgctccccgtgctgggcaggaaggtgatcgggatctgcgattcggccggcggcctggtgcagcgcgccgcgcgggcagcaaacgtgccgctgccggagggaaggctcgacggcgtgggctactacggcctgaaccatcttggctggctctaccggctggagtcccgagggcaggacgtgctgccgcggctgctcgcggacccggtggccctggcctcgttcgaggagggccggctgtttccccagccgtttttagctggcctcggggcactgcccaacgaatacctctattactactaccggcgggacgccgcccgcgaggctatgcgcgccatggcccggacccgcggcgaaaccatccacagccagcaggaggagctgtacccgcggctggccgccgccggtgccggtgcgttccggctctgggaagaagcgcgccggtcccgcgaggagggctacctggccgaagcacgcagccagggcgaggaacgggacgaggcggacctggccggcggaggctacgagcgggtggccctcgctgccatgcgtgccctgtcgggggccggtgacacacagctgatcctgaacacccgcaactcccccgcgcccgtaccggacgccgcaccaggcccaatcacggcccggccggccgcccctgaaccggccattccggggctgccggcggacgccgtcgtcgaagttccctgcacggtgacggccgccggcgcgctgccgctgccccagcagtccccaccggaaccgcagctgggcctgctccggcaggtcaagaaggtggagcggttgaccgtgcgggccgccgtcgagggtgaccgcgaagcagccttcgcggcgtttgccgggcatccgctggtggcttcggaggacctggcccaagctttgctggacggctacgaacgggagttccccgcgctccgggacctgtggcgcccaggtgtccggtgagggaggagtagtgttttatcggatgcgcactctaccggcgctgcccgtacacgccggtagccggaaggaggtcccgtggcactgatccgcagggttgctttgctctccctccacacctcgcccatggagcagcccggttccggtgacgctggcgggatgaacgtgtacatccgcgaactggcatcggccctggctgaagccggtgttgaggtggaaatcttcacccgctccacctcggccaaccagcccgccgtcgaacatcccgatcccggcgtctgcgtgcacaacgtcctggccgggccgctcaagaagatccccaaggaagacctgcctggcctgctgcacagcatggtggccgagatcgaacagatccgccgccggcagccgcacggccgctacgacgtgatccattcccattactgggtgtccgggattgctgggctggaactgtccgagctctggggcgtgccgcttgtgcacaccatgcacaccatggccaaggtcaagaacctgctgctggagtccggtgagcagccggagccgcggcggcgtgaactgggcgagcaccgcattgtggacggcgcagcgcggctcatcgccaataccagtgccgaggccgccgagcttgtctcgcactacggcgccacctacgaccggatcgacattgccccgcccggcgtggacctgggcaccttcacgcctgccttcagggcacggtccaggacagagcggggcatcagccccgggacgttccacctggtcttcgccgggcgcatccagcggctgaaggggccgcaggtcctggtcaaggccgccgcgctgctgcggaaacggcggccggacatcgacctccgggtcaccatcctgggctccttgagcggcaacaaggagttcaacctccggcgcctggtgtcggacgcggacatggacgacgtcgtcacgcagcttcccccggtcaaggcacctgagcttgcagcctggttccgcgcggcggacgtggtggtgatgccctccttcagcgagtctttcgggctggtggcgctcgaggcgcaggcctgcggaacaccggtggtggccacgcgcgttggcgggctgtcgcgggccatcttccacggcaggaccgggctgctggtggacggccaccatgccgccgactgggccgatgcgctcgaggccctgtacgacgaccccgccacccgcgaggacatgggccgggccgccgccatcagggcccagaactcaggatggcagcgcaccgccgccattacgctcgaaagctatcatgccgccgtcgacaacttcgtgggaacccggctggtgcaggcctttcccgcgtcctgactgtcccctccacggaaacccaaccccacccgccaagcaaaggacaacgatgtcttccatccttagtgacctcgagattgccagagcggcccggatccggcccatcgaggacattgcggcggccgcgggcatcaacgcggaggccctcgagcagtacgggcggtacaaggccaagatcgatcccgtgcggctgcacgctcccgcgcccgccgggaaggtggtgctggtctcggcgatgtcccccacaccggccggcgaggggaaatccaccaccaccgtgggcctcgccgattcgctggcacgggcaggccacaaggtgatgatcgccctgcgcgagccttcgctgggtccggtccttggcatgaagggcggcgccaccggcggcggctactcccaggtgctgccgatggacgagatcaacctccacttcaccggcgacttccatgccatcacggccgccaacaatgcactcatggccctggtggacaaccacatctaccagggcaaccagcttaatatcgacccccggcgcatgacgttcaagcgggtcctggacatgaacgaccgcgcgctgcgggaggtcgttataggtttgggcgggcccacccagggcatcccgcgccaggacgggttcgacatcaccgtggcgtccgagatcatggcggtcttctgcctggctacggagctggcggaccttcgctcccggctcggccggatcacgttcggctacacctttgaccggtcgccggtgaccgtggcggatcttggtgtgcagggggcgctgacgctgctgctgaaggaggccgtcaagcccaacctggtgcagaccatcgccggcacgccggcgctggtccacggcggcccgttcgccaacatcgcccacggctgcaattcgctgattgccacccagacggcacggcggctggcggacattgttgtgaccgaggctggcttcggggccgacctcggtgccgaaaagttcatggacatcaaggcacggaccggcggcctggcgccctcggccgtggtggtggtggcaacggtgcgggcactcaagatgcagggcggggtagcaaagaatcagctcaccgaaccgaacatcgctgccctcgaggcgggggtggccaacctgcaccggcacgtccggaacgtggagaaattcggcgtgccgcccgttgtggccatcaacaggttctcctccgactcagccgaggaactcgactggctgctggcgtggtgcgcggcagagggtgtcccggccgccgtcgccgatgtgtggggacggggcggcggtggtgacggcggggatgaacttgcggccctcgtggcaaaaacggtggccgggccaaacaacttccggcacctgtacgcgctggggctgccggtggaggacaagatccggaccatcgcccaggaaatctacggggccgacggggtggacttctccgtgccggccctgaaacggctggccgacatcgagcggaacggctggggcggcctcccggtatgcatggccaagacccagtactcgttcacggacgacgcctcccgcctgggcgccccgaaaggattcaccatccacgtccgcgacctgctgcccaagaccggcgccggattcatcgtggccctgaccggtgcggtgatgacgatgcccgggctgcccgttgccccggcggcgatgcgcatggacgttgacggcgacggcaacccggtgggcctcgcctgacccctgcgaccctctctcacttgatgtcggctttccaccgacgccctctcacttgatgcgcgctttttaccgacgctctctcacttgatgcgcgctttttaccgacgctctctcacctgatgcgcgctttttaccgacgctctctcacttgatgcgggctttccggcgctcctcttgcacttcccgcgagtcagggactcgtgcggccgccgcatttgcggtagcaacggtccgcgacctcccgcccacgcggcctccccgcttcactgaaacgaagatcaccgcggtgctcagcaccacgagtccgcagacgaacgcaacggaggaggggtcggtggcaagcagctccggaatggcacggcccggcacagtcgccgcaaagacgaaggccacggcgatgccgatgtagctgccaatcatgtttcccatatgcgaggcgatattgccgcgaacggcgctgagcaggcccaggctaacggtcacgatggtgaaggccgacagaccgtgcagccagctgaaatgcccgtcggacagaatccagaaactgctgaagcagacgtagtacatggcagccacccacaggtagcccatggtgcggtggatgcggtcgcgccgttggcgaaggatctgcaagggcccgatggccagaacaaaaagcgcggcaacgacgtggctggcaagcaggacattccaagactccatagccttaggatagggctactatccaaacgtgtacatcaggatagccgggctcgaattcactatccatagagacgggcaggtaaggagatcgggatgcagctcaatgaactgagtcagcggtcaggagtcacacccgcaagcatcaagtactacctgcgcgaaggcctgctgccgccgggtgaggccgttcacgcaacccgtgccgagtattcagccaggcatctcgagcggctcgaattgattcaggcgctccgccaggtcgtgggcctcaacatcgggcagatccgcggcctcgtgaaaatggccgacgacggcgtgccccgcctcgatctccttgctgcggtccagcgggtggtgctgaatcttgaaaactccacgccggcgagcggtggggaagccacggaggcggcggacgccgtcgtacgtctccgggggtggccggatttcccaagtgacgccaggaacgcactcactgcccacctggagctgatggcgagcctcagaattcctgtatctgcgtcagttatggagacctatagcaaggcgatggacgatgttgccggactcgacattgccgcaaccaccgctccggagagcaccgacaggctcatactcactgccgccgtcggcatgcatatgcacagccagctactactcaaactcctggcactcgcccaggccagccacgccatccgccgctaccacggttaaaggggcggcgctcccccaccgaagtgagagagcgccgcgtgaaaacccacattaagtgagaaagcgtcccaggggtggtcagctggacggacgaaattagcgctcgaggtctccgcggatgaaggcttccaccttttcgcgggcgaggtcgtcgttgaactgctccggcggggacttcatgaagtagctagaagcggagagcagcgggccgccgatgccgcggtccaggccgatcttggcggcacggatggcatcgatgatcacgccggcggagttgggggaatcccagacttccagcttgtactcaagcgagacgggggcgtcgccgaagttgcggccttcgaggcggacaaacgcccacttgcggtcgtcaagccactggacgtagtcggacgggccgatgtggacgtccttggcggccagttcggcctccacgttggaggtgacggcctgggtcttggagatcttcttggactccaggcggtcgcgctccagcatgttcttgaagtccatgttgccgccgacgttcagctggtacgtgcggtccagggtgacgccgcggtcttcgaagagcttggccatgacgcggtgcgtgatggtggcgccgatctggctcttgatgtcgtcgcccacgatcgggacgccggcggcggtgaacttgtcagcccacgccttggtgccggcgatgaagacgggcagggcgttcacgaaggccacgccggcgtcaatcgctgcctgggcgtagaactcggctgctgcctgcgaaccaacgggcaggtagcagaccatcacgtcaaccttggcgtccttgagcgcctgcacaacgtcaaccggctcttcggtggactgctcgatggtctcgaggtagtacttgccgaggccgtcgagggtgtggccgcgctggacggtgacgccggtgggcggcacgtcagcgatcttgatggtgttgttttcgctcgccaggatggcatctgcaaggtcaacgccgaccttcttgccatcaacatcaaacgcggcgacgaactcaacgtcacccacgtggtactggccgaactcaacgtgcatcaggcccgggatcgtggccttggggtcggcatccttgtagtagtggacgccctggaccagcgaagcggcgcagtttcctacgccgacgattgcaacacgaatcggatgtgaagacacggaactcctttgaggacaaacgtcagcccgccggcgtcgcgtccaagagaggacgacggcggtgcggcaggctctgcgccaaaacggcgccatttcatagtaaccaacagagtgggacgcggagttgttccctcgtcccactctgcggaatcaccgtaacggaatcaggccggctgcttccagaggttgatgtcagactccaccgcgaactcgtcgatggcattcagctcatcggcggtgaacgcgaggttgttgatggcggacagggtgtcctccagctgggtgacgctggacgcacccaccagggccgaggtgacaggcgaccccttgggctggtcacgcaggatccaggcgatggccatctgggcgagggactgtccgcgcccggcagcgatcgcgtgcaggccgcggatccggtccagcttctcctcggtgatggcgtcctcggagaggaaacgggccttggctgcccgggaatctgcggggatgccgttcaggtaccggtcggtgagcatgccctgggcgagtggcgagaaggcgatggagcctgcacccacctggtccagcgcttcatagaggttgggcgaaccgttctccgtccaccggttgagcatcgagtagctgggctggtggatgagcaggggcgtcccgaggtccttcaggatacgtgccgcctcgattgtctgctcgggggtgtaggaggagatgcccgcgtacagtgccttgcctgagcggacggcgtagtccagggcgcccatggtctcttccattggcgtttccggatccggcctgtggctgtagaagatgtccacgtaatccaggcccatgcgctgcagcgactggtccaggctggagatgaggtacttgcgggagccccattcgccgtacgggccgggccacatgtagtagccggccttggtggagatgacgagttcgtcccggtagggcttgaagtcgtccttgaggtgacggccgaagttcgtctcggcggagccgtccggcgggccgtagttgttggcgaggtcgaagtggttgacgccgaggtcgaaggcgcggcgcagtatggcccgctgttcgtcaaaacgtttgtcgtcgccgaagttgtgccacagtccaagcgagatggccgggagcttgagcccgctgcggccgacgcggcggtagggcatggattcgtagcggtcttccgctgcggaataagtcatgccttccatcctgccagctgtgacacgcgcaacaggccaaggcaggaaagttacgccgcgggctgacaccagcccgcggcgcaacgttgcctgaacggcgtgtcaggacttaaagatcgccgcactccagggcgccagggcgagggcttcgccgtcaaggttgctgccctcgtccgtcgccaacaggaccgtcccggaaacgtcctccagccggacctttgcgtctgagaggtttagcagtacctcaacgcttccgcggcggaaccgcagccagccggcgtcgtcgtcgaacgtcacctccgtctcggtgaagccgagaccggcaagctccgggtgctcgcgccgcagcgccgtgagggcgcggtagagttccagcagccgcgcgtggtccccggcggaggcttcgtcccagttcagcttggaccggcggaaggtttccggatcctggggatcgggcacgacggcgggatcccaccccatgcgctcgaactccttgatccggccttccgcggtcgccttgcccagctccggctccgggtgggaggtgaagaactgccagggggtgctcgccgcgaactcttcgcccataaacagcatgggcgtgaacggggacgtcagcgtgagcacggcggccatcgccagctgtccgtgggacagcgactgcgagagcctgtccccggtggcgcggttgccgatctggtcgtggttctggttgcagaccaccagcgccgccgggtgcaccagcgaggcattgatgggccggccgtggtgccgtccgcggaagctggagtagctgccgtcgtgcaggaagccgtccttcaggacctttgccaggaccgccagggactggaagtcctcgtagtacccggtggtctcgccgctgacgctgacgtggaccgcgtggtggaagtcatcgctccactgcccggccagcccgtacccgttgacgtcccgcggatacagcaggcgcgggttgttcaggtccgattcggcgatcagggtcttcggcagccccgtctccgctgagacggcgtcgcccaaggcaccgaactcctcgaggatgtgcacggcgcgctcgtccttcagcgcgtgcacggcgtccaggcggaggccgtccacgtgatagtcccggagccagagggccaggttgtccaggatgtattcccgcaccacgtcggagccggggccgtccaggttcaccgagtcgccccaggtgttggcatccccctgtttcaggtagggcccgaacttggacaggtagttcccgctcgggccgaggtggttgtacaccacatcctgaatgacgcccaggccggcggcgtgggcagcgtccacaaagcgctggtatgccgcaggcccgccgtagccttcatggaccgcgtaccactggacgccgtcgtagccccagttgtgggtgccgttgaagccattgaccgggagcagctccacgaagtcgattcccaggtccgcaaggtagccgagctttccggcagcagcatccagggtcccctcgggggtaaaggtgccgatgtggagttcgtagatgaccgaacctttcagctccctgcccttccagccggagtcctgccaggcatgggctgcagggtcgaacgtcctggaaagctcatggacgccggcgggaaggcggcgggagcgcggatcgggaatcggatggctgtccccgtccagcaggtagccgtagtccacctcgccgtcggccggggcgtccggggctgtccaccagccttcagagcccggcgccgtgtccttttccgtcatggggtactgccggccgccggccagcaggacaacggatgtggcatccggagcccagacgtcgaagcgcgcggggccaccattcacgagggtcatgccttttctccatccaccggtacgagcaaagccacggggtaggtacccaggacgtcggctaccgaaacggatccggggccgtagctgttgccggtgagttcgtcgcgcagcgttacgggaagttcgacggcggtgtcccgccatccgccgtcggccgccagtccggcgggaagccgggtggcaagggccagggcacccagggcaccgtcaccgccgcggtggaacgcgaggacgtgatccgccgcaggacctgtggctgtcacggggctgtagccctggaacagttcgggccggtcgcggcggagccggagcgcgcgggaggtgaccaggagcttgctggtctccgtgccggccgcgggcagggtgccggcgtcgagctgtgcaagttcccgctggcggaccgcgaagtccaccggacggcggttgtcggggtcggtcagggaccgttcccagaattcgctgccctggtagacgtccggaacgccgggcatggtcagctgcacgagtttcgcggacacggagttcgatgcggcaaacgaatcaacctttgccacgaagtcttccaccactttggtgacccggccgtcgtcgaacgctgcgtccactgcggccttgacggaggattcgaagtcctcgtcggggctggtccaggtggtggagttgccggcttcgcgggcagccttctcggcatagccctgcagccgctcccggcttgcgggccacgcccccaccacagcctgccagagcaggttttcgtaaggaccgtccggaatcggtgcgagtccgcggagcgtggccagggtgtctgcccactcctgcgggagctcggcgatgaccgagatccgcgcccgggcgtcttcgctgcgcttggtgtcgtgggtggacatggtggtcatggacaggggcagttcctgctggcgccgggccatccgctggtggaactcgtcaggcgaaacagagaattccgtcggttcggctcccacttccgtcagggtgcccagccgggtgtagcggtagaacgcggtatcctccacgcccttggccatcaccatgccggacgtctgctggaaccgcaccgaaatcgcattggcggggtcaagcagcagcggcagcagcgtgccaacggcaacctcgaggtcgggccggtgggccgcggccgattcgcacgcttccttgaggatcccggcaccggtgggcaggtacgtccggtagaccgggaacgcagcgatgatctcggcaatggcatcggccgcctggtccaccggcagcccgtaggactccggaaccaggcgggccaggcgcaggacctcggaccgcaggatgccatccgcgatcatgcgcttggtgccccggatcatctctgcgtagtccgcaggggtgtcggcgccgcgaagcttcgcgtccagctcgtccagctcctgctggcctgcggggtccacgaacacccggtccacgtccgcgagggcgtcgtagccggtggttccctcggtggcgaagtcctggggcagggtttcgcccggctccaggatcttttccaccaggacgtaggctccgccggtgaggtccttcagccagcgcaggtagccggcggggtcggccaggccgtccgggtggtccacccgcaggccgtccaccaggccttccttgaaccagcggcccacctcggcatgtgcttcctcgaagaccctgggggtttccacccggatcccggccagtgtggtgaccgcgaagaagcggcggtagttcagttccgcatccgcccggcgccagtccatcagctcataatgctggcggctgtggacctcctggggagagtcgccatcagagtagcttccggaagccagcgggaaccggtggtcgtaatagcggagctcgccgtccttgatttccagcttgtccaggtcctcgtccgagccaagcatgggcagccggatcttcccgcccgccaggtcccagtcgacgtcgaaggcttcggcgtagggcgagtcctgcccttccttcagcagggaccaccaccaggggttctgaacgggcgtggcgacgcccacgtggttgggcacgatgtccaccaggacacccatgccgtgctcgcgggcagccttggacagggccagcaggccctcggggccgccccggtccgggtccaccgcggaggggtcggtcacgtcatagccgtggtccgagccctgctccgcggtgaggatgggcgagaggtacacccagtcagcgccgaggtccttcaggtacgggaccttttcggcggcatcgaacagggtgaagctgcggcggatctgcaggcggtaggtggatgccgggaccctcactttgccgtagccttccgctccccgatcttggtggtctttccgggctcgctcaccatgggggtggtgagcgattcggtctcgctggtggaggtttgggtcagtgccgccagggaggcagccacggagtggtcgggctccacttcctccactgtgtgcgcacggaggaccaccagggacttggcttcgacgggcagcggcttgccggcctcgaccggctcggtgtccgcgttctgcccggcggtgtcgatgatgacgtcccaggccggagcatactcgtccgagggcagggtgaacttcacggtgtcatcgtgggcgttgaagtacagcaggaagttcacgtcggtgatcctccggccgcggctgtccttgccctggatcccgtgcccgttcaggaacacgcccacggaccggccaaagccgctgtcccaggcttcgggcttcatgttctcgccctccgggtccagccatacgatgtccggcagccgttcgccttcgccccgcagtaccgggcgtccgtcgaagaagcggctgcggcggaaggtggggtgcttggcgcggagcgcgttgacggccgcggtgaactcaatcagcggctggtccacggtgtcccagttgatccaagtgagctcggagtcctggcagtagccgttgttgttgccctgctgggtgcgtcccatttcgtcaccgtgcaggagcatgggcacgccctgggacagcagcagcgaggcgatgaagttccgctgctggcgtgcgcgcaggccaaggacttcggggtcgtccgtgggaccttcaatgccgcagttccaggaccggttgtgggattcgccgtcgttgttgtcctcgccgttggcgtcgttgtgcttctcgttgtaggacaccaggtccgcgagggtgaagccgtcgtgcgcggtgacaaagttgatggatgccacggggcggcggccggagtgctcgtacaggtccgcggaaccggtgatgcgggaagcgaattcgcccagggtggcgggctcgccgcgccagaagtcgcgcacggtgtcgcggtacttgccgttccattcggtccactgcggcgggaagttgcccacctggtagccgccgggtccaacgtcccacggctcagcgatgagcttgacctgggacactaccgggtcctgctggatgagttcgaagaaggtggacagcttgtccacgtcatagaattcgcgggccagggtggaggcgaggtcgaagcggaagccgtccacgtgcatctcggaaacccagtagcgcagcgagtccatcagcagctgcagggagtgcggctggcggacgttcagggagttgccggtgccggtgtaatccatgtagtgcttctcgtcgccctccatcaaccggtagtaggcggcgttgtcgatgcccttgaaggacagcgtggggcccaggtggttgccttcggcggtgtggttgtacaccacgtccaggatgacctcgatgccggccttgtgcagggaccggaccatggccttgaaatcctggacctgctggccggtgtccccggtggagctgtaggtgttctgcggcgcgaagaagccgatggtgttgtagccccagtagttgttcaggcccttgtcctggagggtgccgtcattgacgaactggtgcacgggcatcagttcgatggcggtgacgccgagcttctgcaggtgggagatgacggcggggtgtgccacgccggcgtaggtgccgcgctgttcctcggggatttccgggtgcagctgggtgaggcccttgacgtgggcttcgtagatgacggactggtggtacgggatccggaggttctggtcgccgtcccagtcgaagaacgggttgatgaccacgcccatcatcatgtggctggcggagtcctcgttgttgatggagtccggctcacccaggttgtacgtgaacaatgagggatcccagtcaacctggccgtggacagccttggcgtaggggtccagcaggagcttgttggggttgaagcggttgccggacgcaggatcgtacgggccgtggacccggtagccgtacttctgtccgggctggacctgcgggatgtagcagtgccagacgtagccgtccacctcgtccagctcgatgcgggtttccttgccgtcctcatcgaagaggcaaagttcgactttttctgctcgttcgctgaacagggcaaagttggtgccggttccgttgtacgtggcgccaaggggataagccgatccaggccagacttccataatgctcctcattgtgattcggcagcagaagagcaggagccccctgctgccggtgcgaactaatgcctaccgtaacggttgggtgtgactattacgtttccgcacccctgagttactaagcgtgcttactttaccccacgtctggggtaaggagtctgcgatgcctccagcggtgaccggtcccccggcgcttgcgtccgacgccgcccgtccggctttgccgtgcagggcggctcccagcgcggcaatggcggcccagcgcacgtccggttccacgccctctttactgaagcgtccgacgtcgttccccgcctgggcgagcagtgcaccaataacgccggcaaggacatccccgctgccggcagtcgccagccatggggtgccgtccgcctggctgaaaacgtcgcctgagggtgtggccaccagggtggtggcgcccttgagcagcacggtggccccggtcagttccgaggcgcggcgtaccgcggccagggtttgcgcttccaccacgtcccggtcctccgatccgcccaggcgttgcagcagcgaggcgagctcgccggcgtggggggtgaggaccatgtgcgggccaaggacgtcgggaagagcgggaagggcacccgcgtccgcgacgaccggcagcccggagcccacggcgtcgcgggcccgctggagctgctcgtggtgttcagggcccattccggagcccaccagccaggcctgcacgcggttgtccgcaacggcgccggtactgcagaccacctcagggcacgcctgccttacctggtccgcgacttcgggcgggccaaggtaccggaccatccctacgcccgctgcgagggcgccacggcaggccaggacagcggcaccgggatagtccacggagcccgcaaccactcccagcacgccgcgggagtacttgtgggcgcgccgggcagggtgcggcagcagcctggccaggtcctcgtcgtcgaggcggcggagcgaaggctgcggcaggtgctcctcgatgccgatgggcaccaccatcagccggccggcgtagtcggcgccggggtccgcgagcaggccgctcttggcaccgccgaaggcgacggtcagctccgccggcagcaccggctggaacgcttcgccggtatcggcgtcaacgccgctgggaaggtcgcaagccaccacgaaggcctgtccggcgccggcttccaggaggccggcgacggcggcaaccaggctggcagcactcccccgcaggccacctttggcgccggtgcccagcacggcatcaatgacgacgtcggcgcgcgccgtctcagcggcgagttcggcgggtgccgccccgtcaagacggtgcacccggccgttggcgcgctcaaaagcagccagcgcctgcgggtgggcagtgtctccggtgagcaccgccgtcgtacgcattccccgtgcggcgaggaaggaagcggcgtacaggccgtccccgccgttgttgcccttgcccgcgaggacgaagacgctggcgccgtagatgcccagtccacgggaacggcgttccatgatgacggcgttggccaggccatgcgccgcgcgctgcataaggacgtcccccagtccggcggcgaggagcggttcctcagcctgccgcacctgggttccggtgtaggcgctgatcacggtgccagttcctgtgggggccggagcaggttcagccttcggccaggacggtggccgtggcaatcccgccgtcgtggctcatggagaggtgccagcgcttgacgcccttggcctcggccaccgccagcacggtgcccttgacctgcacggtgggtccgttctggtccaggccgatccagcagtcctgccagttcatgccggcgggtgcaccgaggaccttggcaacagcttccttggcagcaaaccgggcagccagtgaccgggtgttcagctcacgctcagcggggacgaacagccggtcccggaggccgggggtgcgttcaagctggcggccgaaccgctcgatgtctacaacgtctacgccaatgccaacaatcatggcactactctacgtggacggtcccggcccgcggtgcgcagcacacgcctggcatccggcggatacgacggaagccccgggcgccgggcccagggcttccttcatgaatcagtaccgcatcaggctgctactcgaccgtgacgctcttggcgaggttgcggggctggtccacgtcgtagcccttggctgcggccagttccgcggcgaagatctgcagcgggacggtgttcagcaggggcatgagcagcgtgggggtttcggggacgtagaagacgtactcggcgtaggccttcacggcttcgtcgccttcctcggcgatgaccagggtgcgggcgccgcgggcgcggacttcctggatgttggagaccaccttggcgtgcagggaatcgcggccgcgcggggacgggaccaccacgaacaccggctggccgtcatcgatcagggcgatcgggccgtgcttgagctcaccggcggcgaagccctcggcgtggatgtacgcgatttccttcagcttcagcgcaccctccagcgccaccgggtagcccacgtgccggcccaggaacagcaccgacttctcgttggccatgctgcgggccagctcgcgcaagggctcggcgttgtccaggattttctggatcttcgccgggatcttgttcaggtccgcgaggacgtccttgatctggccggagaagatgtttccgcgcagctgtgccaaatacaggcccagcaggtacgcggcggtgatctgcgccaaaaacgccttggtggaggccaccgcgatctccgggcccgcatgggtgtagagcacggcgtcggattcacgcgggatggtggagccgttggtgttgcagatcgagatggtcttggcgccctgctcccgggcgtagcggacggccatcagggtgtccatggtctccccggactggctgatggacaccaccagggtgttcgcatccaggatcgggtcccggtagcggaactcgtgcgcgagctccacctcggtggggatacggcaccagttctcgatcgcgtacttcgccaccatgcccgcgtacgcggcggtgccgcaggccagcacaatgatcttgttgacctgtttcagcagctcaggatcgatccggagctcgtccagggtcagcctgccgttgatgtcggagcggcccatcagggtctgcgccacggcgtcgggctggtcatggatttccttctccatgaacgagctgaacccgcccttttccgccgaggcagggtcccagtcaacgtggtattccttgccggcggccgggttgccgaagaagtcggtgatctccacggtgtccgcggtgatggtgacgatctggtcctggcccagctccacggcgcggcgggtgtagtcgatgaacccggacacgtccgagcccaggaagttctcgccctcgcccaggcccaccaccaggggtgagttgcggcgggcggccaccacaacgtccggctggtcggcatggacagccaggagcgtgaaggccccctccagccgctggcaggccagttccatggcacgggtcaggcggccgtcagcggtgtccccggcgagcttgttccggtaaatatccgccagcagcgcggcggcaacctcggtgtccgtctcggacaggaaggtcacgcccttatccagcaactcaagcttgagctcggcgaagttttcgatgatgccgttgtggatcacggcgagcttgccgccatcggccaggtgcgggtgcgcgttacggtccgtcggcccgccatgcgtggcccaccgggtatggccgatccccgtcaccgtctccggcaaaggatgcgcctccagctcggcaatcaggttgctcagcttccccgacttcttccgcgactcgatcgctcccttggacaccacggcgaccccggcagagtcgtagccccggtactccaggcggcgcagtccctcaagaacaacatccagcgcgctgtgaccggcaattccgccgtcgactgaacggcccacatatcccacgattccacacatagcctcaagactatcggcagcggcaccccagatctaaaccggctgccatccttgcgggggcggaatgttgcggctgccgccgcgcgcaggccgtgctccatttcgctatgtgccgggcccggggcagaatctctagagtgactttgcaacgcaacgaggcgaacggggagggtgtctccccgttcgtcgagctggaccggcagacctggtccaggctcgcggatgagatggaacagcctctcaaccaagaggacatcatccgtctccgtggcctcggggaccccctggacatgaaggaaatccgcgaggtctaccttccgctctccaggctcctgcacctgtatgtggaggctgccgggcagctgcacgccgccaccaccacgttcctgggcgagcacacccagcgcacaccgttcgtgatcggcgtggcggggtctgtggccgtgggcaagtccaccattgcccgcgtgctccgtgaaatgctgcggcgctggcccggcacacccaacgtggagctcatcaccacggacggcttcctctatcccctggccgagctcaagcggcgccagctgctggagcgcaagggtttcccggagtcctatgaccgccgggcgctgctccgtttcgtgagcgagatcaagagcggcgccgaggaagtgcgcgccccctggtactcccacgtgacgtacgacatcgttccgggcaaggaggtggtggtccgccggcctgacgttttgatcgttgaggggctgaacgtgctggctccggcgcgtccgcggcacgacggccggcagggcctggcgctgagcgacttcttcgacttctccatctacgtggatgccaagacctcctacatcgaggaatggtacgtggaccggttccgcaagctgcggagcaccgcgttcgcgcagccggagtcctacttccaccgctacgccaccctgtcagacgaagaggctgagaccacggcgcgcgacatctggaagcgcatcaacgagcccaaccttgaggaaaatgtccttcccacgcggggacgtgcacagctggtgctcaccaaagaagcggaccattcgatccgccggatgctgctccggaaggtttaacccaagtgtgccacgactgctccgccggcaccgccgccccgcttggtgcaccagcggccagccgccgcagcttcgcccgcttcctcgcggcgggtgctggactcactgtcctggcagcctgcacgcccgaggcccccgcgcaggtcccgccgtcttccgcgtctgcctccgccacgtctcacccacctgtcacccccacgcccactccggaaagcacgacggcggcgcccgcccctgaggctgcggcaccggccgcgccgtcccccacgccgtcgccctcggctgcgctgccgcggcagttctccctcactgatccggacagcccctggctgatcgtgaacaagcaccggccgctggtgccggcggactacgtcccggccgacctggtgcgtccctcaatcgccatgactgcttccggcgaggcgtcattgttgaacagcacgacggcggctgcggcggaggcgatgttcgcggcggccgcgcgggacggtgtggcgatggtcctagccagcggataccgctcgtacgccacccaggtggccacctataacggctacgtcgccgcccgcggccaggccgatgcggacacggccagcgccaggcccggtcactcggagcaccagacgggctgggccttcgacattgccgacggcaacggcgcctgcgggttccagccgtgctttgcggaccagccctcggcagtctgggccaaggcgaacgcgcaccggttcgggttcgtggtgcggtacccgtggatgttccaccccgtcacggggtactactacgagccgtggcacctgcggtacatcggggtggaggcggccacggacatggcgaaccggggcgtcaacaccgtggaggagtacttcggcgtggaagcggctccggggtatccgtagggctgcttggctgatctgcgtgttcacctgagttcatccccctaagctgattccatgacggaccgcaaccgcattctggcggagctggctgaccgctcgcggcgtgacctgcaactgcgctatgaccacttcgaccgcgaggaggcggcgcgaaccgcggccatttcggacgagcgcaagaagcagctcaacctgactcctgaacacttccgcaaagcgtgggaattcattgagggtcggcgcgtgcacgagcgagaccagctggagaaggggatagcgtttttcggcactttttcatccgacgtactggccgcgttggacgacgatctgcggaacgaaggcccgttctccaaagcccacgggatcagcctgctcgacggtacgcctggccgccactcttcccggcatagtggaacggccagtttcctaagcgaattcgagtcccgacactctggcgaacgctacatcagggactttttcacctttctgcccacggatgccgccatcatccacgatgcctgggccgcgctggggcttgaggagcctgttgggctcactgaggtcgccgatcggcaatactcgagacaagcgatcagcaacttgctcctaactgcacgggcactgcggtcaacccaggacgcctactacagccggttggtgacgtcgaccggttacagctggggagacgagttcgcttacaggacccaccacctgaggcatctcacccgcgcgttcgcgaagcacctgctggactgcagccccagcgatgaagaactagcccaggagctgggagacgtcacggatgacaggtatggcctgaccttggagggcgttacagaacaggactttctggagatgcttgggcggtaccgcaacgcgccgggtgccaggccttagcccggacactctctgaacgaagctgtcacgtccggggcccactgctgcgctagtttggttcctatgcttactggattcaagaatttcattatgaagggcaacgtcgttgaccttgccgtcgcagtcgttatcggtaccgcgttcggcgcggtggtgacggccatggtcaacaaggtgctcatgccgttcattgcgggcctggtggggtcgccgaacttcgacagtttcggcaaggtggacttcaacggcaacgccatagagtttggggtcctgctgaccgcgatcgtcaacttcctcctgatttccgcggccatctatttcgttgtggtgatgcccatgaacctcatgatcgaacgccgcaaccgcaggctcggcatcggccaggacgtgaaggaggagtcctccgaggatccccagatcgccttgctcacggagatccgggacgcgctgaagacccgctcttcctaaccggctttcgaaccgaaagtggcccgtttcctttccggaaacgggccactttttgttgcgtcggcttgttactcgctgaccagttccagggcgagttcggcgcggaccacctgggctaggtgctcagcgatggagtgggcggtttcttcgtccgcggcctccaccatgacacgcaccacgggttccgtgccggaggggcggagcaatacgcggccggtatcgcccagcgcggcttccgctgcggccacggcctgggcaaggacctcgttgctgcccacccttgtgcggtcgacgcccttgacgttgatgaggacctggggaagcttggtcatcacggtggcgagttccttgagcggcttcccggtcagggcgatctgggcggcgagctgcagtccagtgaggacgccgtcgccggtagtggcgtagtcagcgaagatcacgtgtccggactgttccccgccaaggttgaagccgccgtcgcgcatttcttccaggacgtagcggtcccccactgccgtttcgcggatgctgatgccggcctggcggagggcgatcttcagtccgaggttgctcatgacggtggccacgaggacgtcgtccttgagctttccggattttttgagcgccacggcgaggatggccatgatctggtcgccgtccaccacgttgccttcgtggtccacggcgaggcagcggtcggcgtcgccgtcgtgggcgattcccaggttggcgccgtacttcaacacagcctccttgagcgggccaaggtgggtggagccgacgccgtcgttgatgttgtggccgtccggttcagccccgataacgatgacgtccgcgccggcgtccttgaacacctggggcgagcagccgctggcggcaccgtgggcgcagtccaagaccacgcggatgccctccaggttatgcgggagggtgcccaggaggtggacgatgtagcggtcctcggcgtcggagaagcgctggatgcggcccacgtccgcgccgaccgggcgcactgcttccttggacatctgggcctcgatggcgtcctcgacgtcgtccgggagcttctggccgccgcgggcgaagaacttgatgccgttgtccggtgcagggttatgggaggcggagatcatcacgccgaagtctgcgtccaggtcagcaaccagataggccgcagcgggcgtggggaggacgccggcgtcgtagacgtcaatacctgagctggagagcccggcctccaccgcggcggcgatgaactcgccgctagcgcgcgggtcacgggccaccacggcgcggggccgcgttccgttggagttgcggtcgtggccgagcacgacggcggccgcctgggccagctgcatcgccagctccgcagtcaacaaaccgttcgccaggccccggacaccatcagttccaaataatctagacaccgatcaagtctagaggatgggggtggctcggcttgaaacggcaggtcagtcagccttgcgtggcaccttgagcggcgtggccgcggcaggcgtcggttgatacttcttccaggccccacctactcggtgggacgtcaggtgccatccattgcagtcattgcagggataggcgctggcctcacgtcttccacgatgattcgagcgctggatggcttggagagcacgcacagcacttttccggcttggatagatgactttggcgcaatgagccacgggcgaagtccaatacaggaagtcgcgtggctcatttccacacttgatcggctgtttagtacagaccgacccggatccactcgaagtggctggtctcgtacaaagtaatgcggctttggcgtcaccgtcaatcacaacttaacaagagtttttgctcgattggggttttaaaggcagaagcccgccccgccggacggcgggacgggcttgtgtgcaagcgggtttagcgcttggagtactgctgagccttgcgggccttcttgagaccggccttcttacgctcgatgacgcgggcgtcgcgagacaggtaaccggccttcttcagcgtggcgcggttgttctcgacgtcgatctcgttcagtgaacgggcgatgccgaggcgcagggcgccggcctggccggagatgccgccgccgtggatgcgggcgatgacgtcgtaagcgccttcgagatcaaggatcttgaagggctcgttgacgtcctgctggtgaagcttgttcgggaagtagttgtccagcgcacggccgttgatggtccacttgccggagccgggcacaacgcggacgcgtgcaacggcttccttgcggcggccaactgctgcgcctgcaacagtcagggctgggcgctccttctttggcgcagcggcgtcggcagctgagctttcagaggtgtagctggtcagggtttcctcagcctcaacggcttcggtggtctcttcgttctgagccacggttctccttgtatagataagttgtttggtggccaggactactgggcgacctgggtaatttcgaaagtcttgggctgctgggcggcgtgcgggtgctcagcaccgcggtacaccttcagcttgcccagctgctgtgcagcgagggagttcttggggagcatgcccttgatggccttctcaacggcgcggaccgggttggattccaggagttccgcgtagttgacggaggtcaggccgcccgggtagccggagtggcggtatgcgcgcttctgctccagcttggcgccggtgagggcaaccttttcagcgttgatgatgatgacgaagtcgcccatgtccatgtgggacgcaaaggtggccttgtgcttgccgcgcagcaggattgcggtctggctcgcgagacgaccaaggacaacgtctgtggcgtcaatgacgtgccactggcggttgatatcgccgggcttcggggtgtacgtacgcacggtgtttgcctcgttcttgttctggcgttcttgtttaggtgtcactagctcgtgcacctactatctgcgcgctaccggaacagaggtgagggctctatgtaaccagtcatcctgtggttccgaatgtgcacgttgagtagttatcctgcaaccggattctcaagcgggcacgcaccatcggaataggacacgcacaacgactcccaagattagcgcgttaaggggttcagggtcaaaatggggtagccggaggttgcccaaacacctgacggcctgacggacgcagggggtcgcgtggttgcatcgggtatagacggttccatcgcgtggctgctggtcaccgcagccgccctcttagggctagtcctctccccccttgccgagaccctcattgccaagcgacttccccggctgggcggccttcctactgtccctgtcagaattacgacggcggcaattaccgccgttctttgcgtcgcctttagtttgcggttcggcctgggatttgccctgccggctttcctgttcctggcaatcctcggcgtgcagctgtcccggattgatatcgagttgcatttgctgcccaacccgctcgtgctcatactgcttgccggcggcttcctgctattgctaatgccagggtttcttaatacgcaggccgatgacctgcttcgcgcggcactcggagccctgattctgtttactggctacctcaccttgggccttctttccccgggcgccatcggcatgggcgatgtaaagctcgcggctcccgtcggcctgtacctcgggtacctaggctggagccatctcctctatggaggcctgttggggttcattctcaatggcgtggtcacggcgttgcttcttagcagaaaaggccggaaaaaagcgtcagaagtggcccatgggccgtccatgctcggtgctctcgctggggccagcctcttcattctgtagccctctatctagcgcgagtccaggcgctccctatgcctgggtgcctctttccaagtagtaggccactgtactcgcctgcctacttgagtacctcccccatctttcgagtacgtacttttggcgccccttgaaaaagtcgagtaccactacgcattgttgtcattacccaccgactgacaatctcttcttagcgaagtccagccgctaaggaattacgggggcagctggaaattcgttgaatcaaataaaacccatttcaccgaattaaaggaaattacaatgacttctctcatggtctcaatgactgctttcatcgccggcatcaaggagcgcttcgaatccgaaaagggcgcaacgatggtggaatacggcctgatggttgctctcatcgccatcatcgtcgccggtggcgccacaatcctgggccagggcatcgacgacctgttcgtggccgtcgacggtcagcttccctagttcatccgcacttgctttggcgccggccttatgccggcgccaaagcatattaaagcctttcaaagtagtagcggacgccgttccgttacgaaataacagtccggggagcggtcttgaaaccgaaacaaagcgagcgtggtgcagtagccgtggaaatggcaatccttctcccactgctgctcttaattctcatcggcactatggagttcggtcgtgtgttcaacgttcagaattcattgactcaggcagcacgtgaaggtgcccgtcacggtgccatcaattacaacaaggccagcctcgacgtcgaaggcacctccctagcagcagcaccttctttgaatgggctaggtgtcgcagtcgcccataacgcggctagctgcggaccaaatttgaatatcgaggtaacaacaaccgttgttctgcccagcatgtccggctttctggattcgggatggtttgggacagctgggatctttccaatgactctcacaggcgtaggagtaatgagatgcggcggctaaaagcgttccacgtttccccgaaagaggccgccaacaaggagcgcggtgcagcagcagtacttgttgcgctttccatggtcgtactactaggtttttccgcgctcgcagtcgacgtcggagccatgtatgcagaaaaggctcaactgcaaaacggcgctgacgccacggcattggcaatcgccggccagtgcgccaagggcgttagttgcccggcggctatgtctgatcccaacaaccgtctggccagcgcgaatgccaacgacgattccagtggaaccttctcggtcacccagcccaccacatcgagcgttcgggttgaaaccaacgcgcaggctgccggctccacggacgatagtttcgccctgtacttcgcgcgggtcttgggccacacatccagcgttatccacgcaaccgccgtagcatcctggggagccccatcctcggcgacaacgttgccctggaccatcagccaatgtgtcttcgaacagtacctttcaccctcgcaactggcggagctgaattcgaccggcagcttcacgggtgatcccactcccacacatgtcttgttgcgatatgacgagaacgctcctgactatcccgggtgcgtgcctcagaacggatacgcggaaggtggttttggttggctggaccgggacactgggtgctcggcagatattgacctcgcagcggccgaagtaggcaatgatccgggcaacgacttcccgagtgaatgcaccggcataattgccgctcttatggatgaaccgatactcgtccctatcttcagcactgcaagtgggacggggcagcacgcaacgtatggccttgtcggcttcatcgcatttcaagtcactggatacaagtttggcggcggtccctccttaacgaatctggaccccgtggcacccgaatgcacaggcaattgccgcggcatccagggtttcttcacccgctacgtttccctcgccgaaggactggcagcgagcggtggggcaccgaacctcggggcaaccgaagtttggctctcggagtagccattaggctctccgctctcgaagcagcatgaaatctgaaggagtaatcaagtgaaatcacgcctactgggaggcatcgcggcgctggtactggccgtcataggaacagcacttctcgtcgtttacgtacagggtgcagacaacagggcagcgcagggactcgaccccgtcagcgtatttgtcgtcaaggagccagtacccgccgggacaaaagcagaggaactgaataactacgttgaattggcagctatcccgcagtcagcagtaccggaaggggcgctggaagacctcagcgaccagacaggcaaagttacatccgttgcccttgaaccaggtgagcaactcctcacctcacggctggtggaccctcgcgagctggtgccagggaccgtccccgtccccgacggaatggaggaggtgacgcttctgctctcaccggaacggctcctgggcggacgtattgaagcgggcgacacagtaaccgtctacacctctttcaagtctgaagatgacatgccagcaggtgcgcccgttccagaagaagtcaaaggctggaagcagtccacaggccttctgttccacgacgtgctggttacggcagtccagaaggccgcgcccgagaccgaaaagactggaaacgcaaaccagtcggcaacagcgggaagcgccgtcgaaatgcccaacggatctgcatttgtcacagtcgcgaggaccgacgcagacgccgccaaactggtctttggagcagaattcggcaccatctggctggccaagcagactgacaccagcaccaagagcgaccccccggttacgacctttggagggctgtactaatgagccgtttcgtcgccatcactgcagtacgggactttgaaggacgagttcggcaagccatcaccggtgcactgcacggcgagctgcagacgctttctccggaggtcctggcaggaggaccggaagacgtattgaggcagctctcgggcgcccagccggaggtcctgctcctgggccccggcgttgccccggacgacgctctgaaacttgcaaccgtcttcgacctccaatacccggaagtcagcctgctgctcattgcagaaccaagccccgaccttgtactccgcgccatgcacgctgggatcagggacgttgtgactccggagatcgtggtcaacgatcttcgggtgcttctggagcgcgcgtgcctggcagcggccagccggcgcagaggaatggcaccggcagctgaatcggggcaggagaggggccgtgtcatagcggtgatgtcccctaaaggcggcgtcggcaagacgactgtcgcgaccaaccttgctattgggctcggcaaagtagcgccaatgggtgtagtcatcgtggatctcgaccttcagtttggcgatgtggcttccggcctccttttggagccagaacattgcataactgatgcggtccacggctctgcctcccaggactccatggtgttgaaagcttttttgacagttcatcctgccggcatttacgccctttgcgctccacggacgccggctgaatcggattacatcacggcggaccatgtcagtcgattgatcaatcagttggctggcgagttcaagtacgtggtggtggatactgctccggggctgggcgaacacgtacttgccactcttgaacaagcaacggacggagtgtgggtgtgcgggatggacgtcccgagtgttcgtggcctccgcaagtgcttcagcgtactgaaagagctgcaactagtaccgcaaggaagacatacagtccttaacttcgccgaccgcaagagcggcttgtctgtccaggacgtagaagcaaccattggggtccctatcgatgcagttgttccgcgttcccgcacgctgccgttctctactaatcgaggggttccggtactgcagagcaacaacagggactcagcagctaagggccttaagcgtcttgtggaccgctttgatcctcaatgggtgtcctccccgcaaaataagctccatcgaagggtggttgtatcgtgagactctcagatcggctttctaagcaaagcagcggagctgttgtcacgccggctgaaacaacgagcacgggggaaaggtcgccctcctttgacggggtagcagacacgcccgccgcaccgtcacggatgccgcttgcctcgcagcttggtgcgtcctacaccccgccagcgccagtcgtcgacgcgctcgcaggcctgaaacagcgggctgccctcgcacttttcgaaaggatgggaacccggttcggggattcctcgtcgtccgaagaagaactgcgcacgtcggcagtggaggaactttcggcggtcattgatgaagaacaggtgcccctctcccccgaagagcgacggcggctcatccgtgagattgccgacgaagtgatgggctacggtccgctccagagactactggaggacccgtctgtcactgaaatcatggttaaccgttttgaccaaatctatgtcgagcggggtggccatctaactttgacggggtcccaattcagctccgacgatcacctgagaaaagtcatcgaacgaattgtctccaaggtgggccgcaggattgatgaatcttcgcccctggtagacgcccgcctcgcagacgggtcgagggttaatgcgatcattcctccactcgctgtaaacggcccatcgctcaccatccgcaagttcagccatgtcccgctcaccgtgcgaaacctcattgagtggggttcgctaacggtcgagatggctgaactccttagtgcctgcgtcagggcacggctcaacatcatcgtttctggtggtactggtaccggcaagaccacgctgttgaacgtgttgtcctctttcattccggaagacgaccgaatcgtcaccatcgaggacgcggttgagctccagctgcagcaggaccacgtggtgcgactcgaaagccgcccgccgaatatcgaaggaaagggcgcaattggcattcgggacctggtgcgtaactccctccgcatgaggccggaccgcatcattgtgggcgaagtccgaggtggtgagtctttggacatgctgcaagccatgaacacaggccatgatggatcattatccacagtgcacgctaactcgcccagggacgcgatcgcgaggctggagaccctggtactcatggccgggatggaccttccgcttcgggcaattcgcgaacaggtgtcgtcagccgtggacctcattgtccaagtcaccaggctgcgcgacggaagccgtcgcgtaacccacgtgaccgaagtccaaggcatggaaggcgatatagtcaccctccaggacgtctttctcttcgactactcagcaggaatggacctccagggccgattcgtgggcaagccaattccgaccggcatcaggcccaggttcctcgaccgtttcgcggagcttggaattggcgtctcacctgcggtgttcggcgcagacgtggcgcccctcgggaggcggtagctgtggaaagtcccctgctcatcggggtggcagtcctcgcgtgcttcggcgcactggtcatcctgctctttgtggtccttaagccgacagctggcacgattcccttggaccggagacgtccgaaaggcagcagccccgagaattcgtccctcagtaaagtttcacagacgctggtcgacaacgtggaccgggcaataggcaagtccggcggtcccttcaaccgggacctcctctacaacgcaggtgtgaaaatgacgccggcggatttcaccgtccttgtggccgtcgcgtccgtattgcttggcttcctcggcgcactgttcacaaacccggtcataggtattctcctgggggccgcggcaccctttcttacccgcttggttctgagcattcgcaccgacaagcgccggggtaaattcgaagcccagctcattgacaccatccagatgctgattggtggcttgagggcaggccacagcatcatgcgttccctggaagccgccggcttggaatccgatgcgcccacctccgaagaacttctgcgtattgtcaacgagacccgcataggcaaggacccggggcaggccttggaggaaactgcacagcgaatgggcagtgaggactttgggtggatcggccaagccatacagatcaaccgcgaggtcggcggcgatctggcggaggtgctcgagcaagtcgcgggaaccattcgcgagcgaagcgagatcaagggccaggtgcgttcactgagtgcagagggcaagatgtcagccatcgtgctcatgggcatgccggtagcagtcgccaccatactctcagttatcaaccctacgtacatgaaagtgttcgtggaggagccggtaggaaacatcatgatcgctgtcagcgcggtcatgttcgtcatcggcggcttctggatgagccgcaccgtgaagatcaagttctaggaggatcgtcatgacacccatagcttggctcatcatcgccgccgtggttcttcctctcacctacttcgcttgggtcctggccacgttggatcggaggggtgccttagccattcaaaccaacttgggacaaggtttcactcacaatgggccgacggcgacggctcgtcctcccgccatgttaggtatggccaagcggctcactccaggcagctacgaagcgaagctggaccggtggcttgctttggctggacgtccggtttccatgccgttggagaagctgatcatcggcaagcccatccttgccttggccggcgccgtacttgcgatcctcgtattcaggagttccccaacacctcagagcgtcggcattggtttactaatcacggggctggggtacttcctaccggatctccttatctacaacaaggggatcaagcggcaagaggctatacagctggaattgcccaataccctggaccagatgctcatttccgtggaagcgggactcggattcgaagccgccatggctcgcgcgggtcagtacggggaaggcccgctggcgcaggaactcacccggaccctgcaggacatgcaggtgggacgtccgcgccaggaggcttatcaggccatggcggaccgttcctcggtggcagaactacgcagcttcgtccgagcggtggttcaggccgacaagtacggaatcggtctggctaaggttctccggacacaggcaaagcagtctcgggtcaagcgccgccagcgggctgaagagaaagccatgaaacttcccgtcaaagtcctcttcccgctgctgatgttcattttccctgtgctcttcatcgttcttttgggcccagccgtcatcaacatcatggacacgctgctttaggatccatcctcccagcgccaccaggcgccccaagtaccggaccccctcggcacccagaaccgagggggtccgcttgtgtgttcacggacttgtgaaatccagcgttatcgcagcgaggacccagcaaaagcgcaggagaaatacaccgtgtaaagcctttgcgcaggatgctccaagatccgggattagtgacagatctgcttgctaacttcgtttcagtgctggtgcagggccagccatccgtctcgctcaggagtcaaaatgctttctctttacaccaacctcatgacccgccttcgcaacgaagagaagggcgccactgccgtggagtacggcatcatggtcgccctcatcgccgtcgtcatcattgttgccgtcagcacccttggtggcactctcgacactctcttcgacggtgtcaacactgacattctcaacccgccggcagctgaagaacctgccctctaaataggaccgtccggttccggcccccatttcggaaccgcaccgcctcaaagaagcaggcacagaacacgagtcatccaagaggaggtgcagcaggtgtcacacgattcggaacgcggtgcagccgccgtcgaattcgcgatcctgctgcccctcctcttgacgcttgtcctgggaaccattgaattcggccgggcctacaacgcccagatcacgctcaccaacgccgcccgcgacggcgtccgggtgatggccatcggcaacgatcccgccggcgcaaagaccgccgcccagaacgccgcggcctccgtcagcaccaccatccccgcctcggacatcacgctcagcaccaacgcttgcagcaccggcgcccaggtgaccctcaccatcaagtacaacctgtccaccattaccggcattgctggcccttttccgatgaccggcaagggagtcatgctgtgcggcggctgaccaaggacaaagcaacaaacgaaaaaggcgccatcagcgtcatcgttgccatcctcctggtgaccctcctcggcttcgtggccatcgccgtcgacgtcggggtgatctactcggaacgcgcacaactgcagaacggtgctgatgcctccgccattgccctcgcgcagaaatgcgcacgggacgcaacggatccagtgtgttccacaacgtccaccctcgcggcgagcctcgccaacgagaacgctttggacggtatgagcaaggtgcacaccatcgagctcgacaaaacaacacggaaagtcagcgtcaccacctccgccaaggaactgggcggcagcgacaactccgtctcccttttcttcgcggacgtcctcggcgttcccaccaaagaagtgggtgcccgggcatcggccatctggggaagccccaaggctggccgcaccgcattccccctggcattctccatctgccaggtcaaggacaacatcggcggcagcctccagctcctccaggaacacggaaagaacgccaacgccgactgcaactacggcccgtccggggcggcagtgcagggcggcttcggctggctggtccaggacgccggagcgtgcggcggcaccatcgacctcgccgtcagtgaaggcggcagcgaccccggcaacaacgcgcccggcaactgctccgtcgaactgaaccgctgggccagcgacatcaccgccggccgggacgtcatcgttctcctgccggtgttcaacaaggtcaccggaaccggcgccggcgccgtctacggcctcgtctctttcgcagcattcaaagtcaccggctggaaattcagcggcgaatcatccctcccctacaccttccaaaacagggcatctacgacgacgggcgtcaccaccgcaacggaatgccgcggcgagtgccgcggcgtcatcggcagcttcgtcaagtacgtctcgctcgccgatggctacaccctcgggcccgttgacgaatacggcgccatcatcgcccgccccaccctctagccaccaccccagatattcaggagctgaaagtgaagtctcgcctgctcgccggaacggccgcggttgccctggcgctcgtgggagccctcctcatcatcttctacgcgaacggcgccgaccagcgcgccctcgcatccaccgaacccgtggacgtcctggtggtcaagaccgccatcccggccgggaccccggtcaacgacatggccgcctccctggtcatcgaaaaggttccggcagcaggaaaatccgacagcgccctcagcaccctggacggcaaagccaacaccgtcagcgccgtggaccttgtcccaggcgaacagctcctggacgagcgcctggtcgctccggcagacgtcaaagaacagggcgccattgaggtccccgccggacttcaggaagtctctttccagctggagccgcagcgggtcgtcggcggccggatcaacgttggcgaccacgtaggcatctcgttgaacttcgaaaatggcgcctacaaggcaagagcagaggacgccaccacgcagctcaccctccgtaaagttctcgtcaccggcgtccagggagcggcgagcgccgagactgccgagggcgaagagaacacggctctcccggaaggctccctcatgctgaccgtcgccgtcacagacgttgacgccgccaagatcatcttcacgtcgatcaacggcagcctctggctcaccaaggaacccctggacgcccaggacaacggaccccggatcgagcgcaaggaagtggtttacaagtgagccggttcgtcctcctctcccccagcggcgagttcgaccagaagctgcgcgccgccgtcgcccacggcctccgcggctccgtccagaccatcgcctcggacatcctccccgcgggccccgcggaactgttcgccctcctcaaccaggagcagcccgaagtcctcatcatcggcccggacgtcccctatgaggaggcgctgcggttcgccaaggtcttcgacgtccagctccccggcctcagcctggtgctggtcagcgacatcgagccgtccttcctggtccacgccatgcgcgcgggcatccgggacatcctcagcccacaggccgacgccgccgagatccgcgtgctgctggagcgcgcctgccagtccttcgccacccggcaccggagccccgaaacgcaggcggcggaaaccggcggcaagggcctagtgatcggcgtcttctcgcccaagggcggcgtcggcaaaaccaccctcgccacgaacatcgccatcggcctgggccagatcgcccccatgagcgtggtcatcgtggaccttgacctgcagttcggcgacgtcgcctctggcctgtacctcaaccccgagcacacggtcacggacgccgtcacccccgccgcagcccaggactccctggtcctcaaggccttcctcacggtccacccggccgggatctacgcattgtgcgccccgccgaaccctgtggacgcggaccacataacgccggagcagatcacccgcctgctggagcagctgtcccaggaattccagtacgtggtcctggacacggcccccgggatgcccgaaatcggtctcgccgcgatggaacagtgcaccgacgttgtctgggtcagcgccatggacatccccagcctccgcggcctccgctccggcctcgaggtgctccgccagctggaaatcatgcccgagtcccgccacgtggtcctgaacatggccgacgccaaagccggcctcaacgtccgggacgtcgaatccaccatcggcgccccggtggacgtcagcattccccgctcccgcgccgtggccctgtccaccaaccgtggcatccccgtcctccaggaatccaaaaaggaccccgccgtcaaaagcctccgccagctggtggagcggttcaacccggcgtggcgtacccagacccagcggaagctgcaccgaagggtggtcatctgatgaaactctccgaacggatcagcgcggtccaggaccgcaaccagtccgccggcagcagcgttgccgtgctcgaaccaccgcggcctgccgctgccccggccaggaccagggaaagcgagccgcggcaccttcccgccgctcccgccggcgtgattccaacgtccgacgccggtgcctccacagtgccttcagctccctcggtgcccaaggcacagtccgtggatgtgttcgcggccatgaagcaccgtgcggctaccgcgcttttcgagcggatgggcgcgcgcttcaacgacgcgacggccaccgagcaggagctgcggagcacggccaaggaggaactgacgcggatcatcgacgccgaacaggttccgctcacgcccgaggaacgtacccggctggtccaggacatttccgacgacgtcctgggcttcggtcccctccagcgcctgctggatgatcccgccgtcaccgaaatcatggtcaaccggatggaccagatctacgttgaacgtaagggcaagctgaccctgacggagtcccgcttcagctccgaggaacacctgcgcaaggtcatcgagcggatcgtgtccaaggtgggccgccgcattgacgaatcctccccgctggtggacgcccgcctcgaggacggctcccgtgtcaacgccgtcatccctccgctggccgtgggcggctcctcgctgaccatccgtaaattcagcaaggtcccgctgaccgtccgcaacctgatcgacttcggcaccctcaccccggagatggccgagctgctcaacgcctgcgttaaagcgaagctcaacatcatcgtgtccggcggtaccggcaccggcaaaaccaccctcctcaacgtgctgtcctccttcctccccgcggacgaacggatcgtgaccatcgaggacgccgtggaactgcagatccagcagcagcacgtggtccggctcgaaagccgcccgccgaacaccgagggcaagggcgaagtcaccatccgcgaactgctgcggaactcgctgcgcatgcgcccggaccggattgtggtgggcgaggtccgcggaggggaatcgctggacatgctccaggccatgaacaccggccacgacggctcactctcaacggtccactccaactccccccgggacgcggtggccaggctcgaaaccctggtgctgatggccggcatggacctgccgctgcgcgccatccgcgaacagatcgcctccgccgtgaacctcatcgtccagatctcccggctccgtgacggctcccgccgcatcacccacgtcaccgaagtccagggcatggaaggggacatcgtcaccctccaggacgccttcgtcttcgactactccgccggcgtggacgcccacggccgcttcctcggcaagcccgtggccaccggcatccggccacgcttcatcgaccggttcgaggacctgggcatccacgtctcccccggcgttttcgccggaccccagacggcggtggtccagcccgcggcgggccagaaccacggcggacggtgacggccgccatgatccttgctgccggaaccgctctcctcctcgtagccgtgaccctgttcggcgccgcggtgctgctgccgagcgcgccagacgtgccgctggaccgccgtcgtccttttgatcccgaacctccctcttccctgacgcgcgtggcgctctccgccgtccggtccttcgaacggctcctcgccggccggagcatctccctctttggccggcccgagctcgagaacgccggacttcggctcagccaggccgagttcttcctgctggtggggatcggtgccggcgttgggatgctggtgggaacggtaaccgttggccccttggtggggctgctcctggcgctgctggcgcccttcatcggaaaacttgtcctgggattcctggccggaaaacggcaggccaccttcgacagccagctgggagacaccctccagctcctgtccggcggcctccgcgcagggcacagcatcctgcgcgccatcgatgcagcggccgcggagtcccagaagccgacttcagaggagatgcggcgcgtgatcacggagaccagccttggccgtgacctgctggccgccctcaatgacacggccgaccggatgaagaatgaggatttcatctggatctcccaggccatccagatcaaccgcgaggtgggcggcaacctggccgacgtcctggaccaggtcaacgaaaccatccgcgagcgcgccgaaatcaagggccacatcaaggccctggccgccgaaggcaagttctccgcctacatcctcatcgccatgccgttcggcatcgtggccatgctgctcgccgtcagtcccaactacatgaactccatgttcacccatcccctgggctgggccatgatcggggcctcgtttgtcctcatgaccatcggcgccctgtggatgcgcaagatcatcgacctgaagttctgaggaagccatgaacctgacagtcctcctctccatcctgctggtctgcgtccccgtggccggactggcctggtccgtcctgacggtggacaagcagggccgcctggcagccagtgagctcctggcccgcggcgccgcgccggtcacggtggccgcctccggcaaacccggcctgctcgaaggcatcggccggcgcctcactccccccgcctatgtcgccttccttgaccggttgctggccctcgccggccggcctgcctcgatgccgctgggcaaggtcctcggctccaagctggcgataggccttgcgggcatcacggttggcatctacctgacggccatcggaagcaccccgctgatgaagctttcaggcctttttgtcctgttcctgggctacttcatcccggacctcctgctctacagcaaggggcaggaacgccagaaggtcatgcagctggaactggccaacaccctggaccagatgctgatttccgtggaggccggcctcggcttcgaaggcgccatggcccgcgcaggggaaaacggcaagggcccgctggctgaagaactggtgcggaccctgcaggacatgcaggtgggccgcagccggcgtgagtcctacacagccctggctgaacggaccagcattccggagctgcgcagctttgtgcaggccgtggtccaggcggacacctacggcatcgccatcagccgcgtgctgcgggtgcaagccaaggtcatgcgggtaaagcggcgccagcgggccgaggagaaggcgatgaagctcccggtgatgattctgtttccgctgcttttcttcatattcccggttctctttatcgccattcttggaccggccgtcatcaataccgtggtgactttcagcggacagtaaaggcaacgcagtaccgcctgaaagatcgctcaaggtttccacaggatcccccgaaataggacaacggaagaatttcaggaagtagccttgaacaatgcacagtcaagatcccggcgccagcagcgaggccgccgctgcggcctccccgcagcccgggatcgcttcagctgccgggaccgcgctgcaacaggaagcggccggtctcttgccgctcgttgacgcagccgtccttgaagagctggaagacgaactggccggttccggcctcgcccggcggttcgcccgcgactatacggccatgtgggaccagcgctacgcccggctggctgcggcggtggaccagcaggacagcgcctcagctctggacgccgtcatcagcctcaagatcacttccgccatggtgggcggcctacggctggccaaactcgcggaactgcttgagtccgtgatccgcttgggcgacttcggccagggccaggcgctcatggaacgcgtggcccaggacgggggccagaccgtcaccgagctccaggccacctacatcctggaaaacgactgaccccgcctactcgtcgaacggcctgctgggggccaggcggtagcccacgccgcggaccgtctgcagccagcgcggggacagctggtcctccttgagcttgcgccgcaggtttcccacatggacttcgacggcgcgttcgtccgcttcgctgatgtacgtgtcctcgtcgtagaactcgccgcgaactgcccgcacaaggtcagcccgggtgcacacggcgccggccccccgaagcagaacgtgcagcagatcgaactcgctgcgggtgagcccgaggggttggcctttgatgtccaccgtccgggtgcggtggttcaaggtcaggccgttgtgctggaggacagcggagtcatggctgcccggagaggtggtcgtggcaggtgctccccacgccgacgcaggcttctgcccattaatctcatgccgcggcctgcgcatcatggcggccacccgtgcccggagctcgcggggccggaagggtttggcaatgtagtcgtccgctcccgcgttgagggcagacaacaggtccggttcctcagtcctgccggtcagcatcaccacgtaggcgttgctgaaatggcggatccgccgcaacacttcaaacccgtcaatgtccggaagcccgatatccagcgtgacaacattggcctgtttgctgcggaccacttccacaccggcacgtccgtccaccgctgtatgcacttcgaatcctgcctgggtcagcactccctcaaggaggttgcgtacatcggcatcgtcttcaattactacagccacaccaagttcatccattgatatccctgtgccaggcggacatggccccccatcagcccagcgccaatgccatatccgctccaaccatttatacgctactagtaagccctgctgatcacatccttttcagcattcattttggaaagtcaattactatgacaagacatgtggattatgaccgaaagggtgtgtctgggagtggccggcaggaattcgagcgcacgtgcggaccggctgtccggtccaggccgcggggcctgaatccaaccaatggctgagcacctgttccagcgcggacctgcccgcttcttccgtggcctcggaccacgggcgcaggtggccctgtgccagctgccgctgacgttgatcgtggcggcactggccgtggccactcccttcgcctggccaacactggtgaacagccccgtctacctgtccggcatcctccttcacggcgtcctgttcctcggctgcctcctggtgccctgggagcgcctggcccaccggccctacctgctgatccccatcctggatttcctggccatcgggctgctccggaacggcgccgctcccctgctcccgggcttggcagtcctggcagtcttcccggtgatctggctctctgcctcgggcatgctggcccgcagcagcctggtcctgagcttcttcggcaccatgttcatcatggtcccctccctggccggacgtttccccaacctgactgcatcggacgtgaccacaacgctcctctttcccctcatgatgctctccgtctccctcgccatccgcttcgccagcgtgcacctccggttccagcaacaggaactggcgcagaaggacagggaactccggaagctgctggacgaaagccgggaacgggagaagctgctccagacggtccttgacgcaacagacgtcggcattgccgccgtcgaccgttacgggcatttcctggtgtccaacagccggcagcggcatttccgccaggccaccggcgcggacggcgccgtccccggccaggggcaccagctgatcttcgggcaggaccggcggaccctgctgccacccgggaaacgccccatcagccgggccattgccggagaatccttcgcggactacctggtatgggccggagaaggagcggaccagcgggccgtgtctacggcggcccggcccctggtgggcgaggacggcagcttcaacggcgccgttgtggtgtacacggacgtcacaggctgggtggaggcgctggctgcgaaccaggagctcgtctcgaatgtgtcccacgagttcaagacgcccctgaattccatcatcggcaacatagacctggtgctggatgacgccggctccctgcctccgcaggtggcccaccgcctgctggtggtccaacggaacgccgagcggctgctggccctcgtggccgacctgacggcgtccgcgtcggctgccctgaatgtgcacccgaaaaagacggacctcgccagcctggtggaaacgagcctgggctcggcccaggcggaggccgagcgggcccacatccggctcagcgctgatatgccctcgcccctgtgggcctacgcagatccgctccggatcgggcaggcgctggacaacctggtatccaacgccatcaaatactcccccgacggcggcacggtgagcatcagcgcccgcgcgggcaccgactgggtccagctcagcgtcagcgataccggaatggggatgtccagggaggacacagccagggtcttcaaacgcttcttccgcacggaatccgcccagcgggcctcaatctcgggtgccgggctgggcctctccatcaccaagatgatcgtggagggccacggcggcaccatcagctgcgagagcggccagggacagggcagcacgttcacgctgaccctgcccgcggagggcccgccgccggcgttctagcgaatcgattgctccgtaactgccgttttcggggctcataacgaccgttacggagcaatcgatggggattagtgctcccgccgcgccctggtcagctccgcgcgggccagcagctcgtcgtcggacgggtaggcaacctcttccagaaccagcgggtgcggcgcggccagcacggacttggcgtcccgctgcctggccaggagccgctcgtgcagccagcccggttcctcaacgccctcccccacgtacagggcagacccgatcagcgcgcgcaccatgttgtggcagaacgcgtcggcctgcacggtggcaacaatgacgccgtcctccccccgggcgaactcgaagcgctggagctcgcggatggtggtggcgccctcgcggggtttgcagaaggacaggaagttctgaagccccagcagcttggacgcgccctcgttcagcagcaccacatccagcgggttcttgtgccacagggtgaagtagcgttccagcgggtcccacagggcgggcccgtccgcgatgcggtagctgtaccggcgccagagggcggagaagcgggcgtcgaagccctccggcgccagcgagatccggtgcacctccaccgcgcccgtcaggtcgccgaggatccggctcagcgcaccccggacgcggcgcagcatggcgacggcgggatcgagttcgtgcccccgcgggagtccctgccactcggcttccgtcaggtccaggtgaaccacctggccgcgggcgtgcacgccggcgtcggtgcggccggctaccgtcacgcggatgggccggcggaccagcaggtgcagggcttcctcaaggactccctggacggtcttccggcccggctgcagcgcccacccgctgaaggggccgccgtcgtaggacacatcaagccggacacgcaaaaacccgccgcccccaatacgggggccgcgggtttttggtcgttcatagactcaagtctatgcgaagaacatcagcgaattacttcgcgtccttttcctcggctgcgggagcctcgggtgcttcctcagcggccggagcctcttcggttgcagcttcttcggccggagcctcagcagcgggagcctcggcggcctcagcctcgggagcctcttctgcaaccggagcagcagcggcttccttcttgtccgcatcgcgcttcgcagcggaggtagcctcggctacaacggcctgcttggcggaaacgggctcaagaaccagttcgatgacagccatgggagcgttgtcgcccttgcggttgccgatcttggtgatgcgggtgtagccgccgtcgcggttctccacagcctgggcgatgtcggtgaacagctcgtggacgatgcccttgttgctgatcaggccgagcacgcggcggcgggaagcgaggtcgccacgcttggcgaaggtcaccaggcgctctgcgtacggcttcaggcgcttggccttggtcaccgtggtggtgatccgcttgtgctcgaacagggatgctgccaggttcgcgagcatgaggcgctcgtgagccgggccgcctccgaggcgcggacccttagtgggggtaggcataattgtttctcctcaaatggaagccgtgggctgtgcacaccatggtgcctgcccgccggccaaggtctggtttagagttcgtcgtcgccgaaggcggcgtcgtcctcttcgattgctgcggcgcgagctgcgaggtcaaaaccgggaggcgagtccttgagggacaggcccagttcaaccagctttgccttgacctcgtcaatggacttggcaccgaagttgcggatgtccatcaggtcagcctcggagcgggcaacgagttcacccacggtgtggatgccctcacgcttgaggcagttgtaggaacggacggtgaggtccagatcctcgatcggcagtgccatgtcggctgccagggcagcgtcggtgggcgacgggccgatctcgataccttcagctgcggtgttcagctcacgggccagaccgaacagttccaccagggtggttcctgcggaagcgacggcatcgcgcggggcgatggcctgcttggtctcgacgtcgacaatgagcttgtcgaagtcggtgcgctgctcaacacgggttgcttccacgcggaaagtaaccttcagcaccggcgagtagatggaatcgaccgggatacggccgatctctgcgtcgccggacttgttctgagctgccgaaacgtagccgcggccgcgctcgatggtcagttcgagttcgaacttgcccttcgagttcagcgtggcaatgtgcagatccgggttgtggaattcgacgccggccggcggagcgatgtccgcggcggtgacgactccgggtccctgcttgcgcaggtaggcaacaaccggctcatcgtgctcggaggaaaccgagaggctcttgatgttcaggatgatctcagtgacatcttccttgacacccggaaccgtggtgaactcgtgcagcacgccatcgatccggatgctggttacagcagcaccggggatggaggagagcagggtacggcggagggagtttccgagggtgtagccgaagcccggttccagcggttcaatgatgaaacgcgaacggttttcggagactacctcttcggagagggtggggcgctgtgcaatgagcacttaggtttcctttcggcgagcatccgctatatgacgcaacacaggtggtggaaattcggtctgaagacttaacgcgctgggcttgcccggaccatcagcggtccgggcaagctcatgcggcgtggaaagccttagacgcggcggcgcttcggcgggcggcagccgttgtgcgcagcgggggtgacgtcctggatggagccaacctcgaggcctgcggcctgcagcgaacggatcgcggtctcgcgtccggaacccggtcccttgacgaaaacgtcaaccttgcgcatgccgtgctcctgggcacgcttggcagcagcttcggcagccatctgggctgcgaacggggtggacttacgcgagcccttgaagccaacctcacctgaggaagcccaagagataacagcgccgctcggatccgtgatggaaacgatggtgttgttgaacgtgctcttgatgtgcgcctggccaagcgcgatattcttcttgtccttcttacgcggcttgcgaaccgcgccacgagtcttcgggggcattatttctcctacagaaagttattgggggaaagtccgttaatcccgacggggattttaacgggccttcttcttgccggcgacggtgcgcttcgggcccttgcgggtacgggcgttggtcttcgtacgctgtccgcgtacgggcaggcccttgcggtggcgcaggccttcgtagctgccgatttcaaccttgcggcggatatctgctgctacttcgcggcgaaggtcaccctcaaccttgtagttgccttcaatgtagtcacgcagctcaaccagctgtgcatcagtcaggtccttgacgcgaacgtcggcgctgatgccagtggcagccagggtttcgtgtgcacgggtcttgcccacgccgtagatgtaagtaagcgcaatttccagccgcttttcgcggggaatgtctacgccagcgagacgagccatagtggcagtactccttgataaaccggaggtcgtaggcagtacacccgcacgttctgtgcggccccagcctccgaccgggggttagctgcccgggctccatacgtcccagatcagcttgtgctgcctttatttacttgcgtgggttagcaacccaggatttcccgatgaagggaattagccctggcgctgcttgtggcgcgggttctcgcagatcaccatgacccggccattacggcggatcactttgcacttttcgcagatctgcttgacgctcggcttgaccttcatggcattcctttgcgtgtaacagttggtcaactggagcggcagccagctcgcactggagccgcccagcaatttacttgtagcggtagacgatacgaccacgggtgaggtcgtacgggctcagctccaccactacgcggtcctcagggaggattcggatgtagtgctgacgcatctttccagagatgtgtgccagaacgatgtgcttgttggtgagctcaacgcgaaacatcgcgttaggcagcgcctcggtcacaacgccttcgatctcaatgaccccgtccttcttggccataccctccgctaactgttgttgccgcagccccgccggattgcaccggacatggccacgaacgttttggttggatcgattgccggctccagacccaaaagggcgtggcagtccagacaaccaacaaacaacactactctggatcgctgaaaaagttaaatcggcaatggtaacctaccgggcgccgaacacaccataatcgccggcgggagtgctcacggcctccgcgctggccacgccatcaaggatggccaaacggacgacgtcggctgctgcgctttgcaaggtgatcaggctgaactggcgggcagcttcgtccgagcggtcgagtgccacggcttgggtggacagacaaaaaacagtgtccccgtcagcaagggtatgggagggattcagagcccgagcaatcccggcctgggaggcagccgcagtccgcttgcactcggccacgtcgagaacggcgttggtcgcgactacgacaagggttgtgttcagcggcgcgtcagggcgcgcggagggttcgcgattccccgacggagttaccggaaggccaagggcgttaacaacagcaattgcacccaccaccacgccgttctcaagcgtcagagaggcagtcccgacgccgcccttgtacgtgcgggccatgactgcgccggtgccggcacccacgttgccgcgtccgacgtcgtgcctttccgtttgcgccgcagcggcggcggttgcagcgtagcccatgtccgccgtcggacgcgccgagaagtccccgcccctgcccaggtcgaagatcgcggctgccggcacgatagggactactcccccgggcacggcgaacccgcggccgttctcctcgcaccagcgctgggcgccggcggcggaggccaggccgtaggcgctgccgccggtgaggacgacggcgtccactgtgctgacgagcgtggtgggatccaaggcgtcggtttcatgggtggcaggtccgccgccctggacatccaccgacccgcaggtgccgggcggcggcaggaccaccgtgacaccgctcagccagccgtcgccggatttttgctggtggccgatccttatccccggaacatcgctaatagctcccatggcccaattctgcccttttgaccagcaaacggatgaatacgggcgggtccctgcccttcaaacaaactttgtgcaagactgcaggcaacacagcgttaacgggcaacgaagcctcggataacagtcttttgacgaggacacttgcggctttctgcctgctgactttgtggtgaagtaatggctagaatcccccgaccacggccagccacgagcaggcacgaatcccgtgagagaccgcatgacccgtcaactcgcaccccatccgtccaccaagcccacgaagcccggaccggccgccaccccgcgacgccggcgctggacgcagagaacccggcgggacttcttcgtgttcctcgccctcgccttgcccaacctggtgctgatcgccgtcttcacgtaccggccattgatcagcaacatctactattcaacgctggactggaccctggggtcaccgtcagccacggtggtgggcatcaacaactacgtcaccttcttcaccagcgacgacgcctcaaaggtgttgggcaccacggcgatcttcacggtggtcacggtgggcggatccatgatcctggggctgctcatcgccctggccctgaatgcgaaagtccggggaaccacgtttgcccgctcggcggtattcgctccctatgtcctctccggcgtcggcgtgggcttggtgtggctcttcattttcgatccaggctacggcgtcctcgcctggctgctccgcggcatcgggcagcagagcccgcagtggatcaatgacccccagctttccctggtcatggtgatcctcgtgtacgtctggaaaaacctgggatactgcgcggtggtctacctggcagggctccagtccctgccgcaggatgtcatggaggcagcctccctggacggcgccaacgggttccggcggttcatcaccatgtcgctgccgctcctgtcccccacaacgttcttcctgctgatcaccagcttgctgagttcgctgcaggcctttgacctgatcaggatcatgacgccgctgggaaccggcaccagcaccctgatctacgaggcctacctccaggctttcggtgccttcaaccgggccggctattccgcggccatctcggtgatccttttcgcgatcctcctggtgatcaccgtgttccaactgcggttcgtggaacggaaggtgcactactcgtgagctccctttcaccggtcaacccggaccccacagccccgcccacgcagaccgcggacccagtgattccccgggaccggcctttctcccggcagaatctggtgcaggccgtcctgggcgggtacattccactgatcctggcaaccctggtggttttcctgccgctgctgtggatggtactcagctcgttcaagcagcccggtgaaatcatcaccatggatctggagatcctgccggaaggcctcaacctgcagaactaccagatcgccatgaccaccgtgccgttcggccagttcttccttaacagcgccatcgtcacggcggcgggcgccagcgtcaaggtggtcctggccatcctcacggcctatgccctggtgtttgttcggttcccgttcaagaacgccattttcatgctcatcctggtggcgctgatggtgccgccacaggtgtccatcctccccaactacatcctgatttcggggatgggcgggaagaacaccctgtggggcatcatcctgccgggcctcggaaccgcctttggcaccttcctcctccggcagcatttcctcaccctgcccaactccatcctcgagtccgcagaaatcgacggggcaggccactggcgccggctgtggcgcatcgtggtccccatctccgttccctccatcgccacggtggcgctggtgaccatcgtcagcgagtggaacgagtacatctggccgctgatcatcacagaccgtcccgacaccatgaccctgccggtgggcctgacgctgctccagaactccgagagcaacgcctccggatggggcatcctcatggccggcgccgtcctggtgatcgtccccatccttatcgtcttcgcagccctccagcgttacatcgtcgccgggctcacccagggcagcgtcaccgggtaggcccgtgccgccgtcgttcatcacagaagaagcacccaactcctcaatgtggcacccaacgaaaggacctgcaatgacacagcacctcgatcggaggcacttcctgggactcgccggggtcacggcgtccgccgctgccctggcagcctgcggcggcccgtccaccagcggcacccccgtggccagcgaagccgcggaactcgacttcagcggagtgaagccggccgcaaagatcgacttctggtccaaccaccccggtaagtcgcaggacgtcgaaaaggccattattgagaagttccacgccaagttcccggacatccgggtcaacctggtcacggccggagcgaactacgaggaaatcgcgcagaagttccagacctcgcaggcggcaaaatccggcctcccgggcgtcgtggtcctctccgatgtgtggtggttccgctacttcaccaacggcagcatcattccggtggacgccctcgtcaagcagctggacatcaagctggacgatttccggaagtcgctcgtggacgactacaagtacaacgacaagcagtgggccctcccctatggccgctcaactcccctgttctactacaacaaggaccacttccaggccgccgggctgccggaccgggcacctaaaacctggcaggagttcggtgagtgggcgcccaagctgaaggccagctcaggcgcacagtacgcctacatctacccggccttggcgggctacgcgggctggaccctgcaaaacaacctgtggggctggggcggttcctggtccaaggaatgggaaatcacctgcgattcgcccgaggcaatcgaagcgctgcagtgggcccaggactccatctacaagaacggctgggctggcgtctcctccaaggaagccgcagacgacttctccgccgggctgacctcctccacgatctcctccaccgggtccctcctcggcgtgctgaagtccgcgccgttcaatgtgggcgtgggcttccttccgggcgggccgaaggccgagaccaacgtctgccccaccggcggcgccggcctgggcatcccgagcggcatcaccaaggaggagcagctggccgccggcaccttcctgaagttcatgaccgagccggaaaacagcgctgccttctcggctgccaccggctacatgcccacccgcgagtcggcggacatggaggcggtcctggcccagacgccgcagatccagactgccgtggaccagctggctgttacgcgggtccaggacaatgcccgggtgttcctcccgggcgccgaccaggaactggccaaggcggccgcagcgatcctcacccagcaggcggacgtgaaggccaccatgaccagcctgaagaagacgctggaaggcatctacgagaaggacgtcaagcccaagctgggctagctttctccttacgcaagaagcgccaagtgttgttgtgggatcacaatgacgcttggcgcttctgtttgagctgcttgggccggggcgcggaggcctgccggccgcggactgccggccttggactgccggccttggactacgggatggccacgggggttacgccgagcgggaccaggtgctccgcaccgccgtcgggcgctgacagcacccagatgccgttctcgtggaccgcaacggagtgctcccactggcaggaccgctttccgtccgtggtgataactgtccagtcgtcctccaggaccgcggtttcgatgccgccgcgcaccagcatgggctcgatcgccaggcacagcccgggtttgatcttggggccgcggtgcgtggtgcggtaattcagcacgtcgggggccatgtgcatctccgaaccgatgccgtggcccacatagtcctcgaggattcccagcggtttaccgggaacggacgacacgtaatcgtcgatcgcggctccgatgtcaccgacgtgctttccggtggccagcgcggcgatgccatgccacatcgctgcgcgggtcacgtccgagagccgctggtcctccggatcagccgtccctacgataacggtcctcgctgaatcagagtgccagccgtccacgatcgcgccgccgtcgatcgagatgatgtccccgtcattgaggacccggctgcccgggatgccgtggaccacttcctcgttgaccgaggtgcagatggtggccggaaagccgtggtagccaaggaagttggactttgcgcccgcttcgttcaggacagcggcgaagacgtcgtcgaggtgcttggtggtggcaccgggcactgctgcggcgacggctgcgtccagtgcacggctcaggacaaggcctgcctcgtgcatggtgcgcatctgggcgttggtcttgtattcgatgcggggctggccaaaggccatggtgttccttctttcaaatggctgaggctcctcccggttgccgggaggagcctcggaatacgttcgcctggatcaggctgcctgtgccgccttgatggcctgcatgacgcggtcggtgacttcgtcgatgccgccgatgccgtcaacctgggtcaggatgccgcgttcggcgtacttcgccaccacggcttcggtctgctcgtggtaaaggtcaaggcggtggcggatgacggcttcgttgtcgtcgctccggcccgtttccttggcccggccgagcaggcggtggaccagttcctcatcgtcggcagtcagctgcaggacgacgtcgagcttttcctcacccttggcgaggatctcgtccaggtagtccacctgggcggtggtgcgggggtagccgtccaggaggaagccgccttcgacgtcggactcgctgagccggtcccgcaccatcttgttggtgacgctgtccggaacgaagtcgccgttgtccatgtacttcttggcttcgatgccaagcggcgtctcgcccttcacgttggcgcggaagatgtcgccggtggagatggccacaacgccgaggcgctctgaaatccgctccgcctgcgttccttttccggaaccgggaggtccaataatcagcattctcgtcatcgcaaaagcccttcgtagtgacgttgttgtagctgcgcatcaatctgcttgacggtctccaggccaacgcccaccatgatcaggatcgaggtgccaccgaacgggaagttctggtttgcgttgatcagcaccagtgcaaccagcgggatcagcgccacgaagcccaggtacagggcgccgggcagggtgatcctggagagcacgtactgcagatagtcagcggtcggcttgcccgcgcggatacccgggatgaagccgccgtacttcttcatgttgtccgagacctcttcagggttgaaggtgatcgcgacatagaagtaggtaaagaacacgatcatggcgaagtagagcaccatatagatcggctggtcgccgcggaccaggttgttgttgatccattcaacccacggctggagctgctcgccctgcgcgggctggttgaactgggcaatcaggcccggcaggtagagcatcgaggaagcgaagatcaccgggataacaccggccatgttcaccttgatggggatgtaggtgctggtgccgcccacggtgcggcggccaatcatccgcttggcgtactgcaccgggaccctgcgctgcgactgctcaacaaagacaaccagtgccactgtcagcaggccgaccgcgaggacaataaagaaggttccgggaccctgcgagctccagatggcgcccagcgaggtggggaacgtagcggcgatggacgtgaagatgagcagggacataccgttgcccacgcccttctcggtcacgagctcgcccatccacatgatcaggccggtgccggccgtcagggtgatgatgagcaggatggtggtgataacgctgcggtcaggaatgatcgccaggttacagccgggaagcagctgcccggagcgcgcaagggacacaagcgtggtggcgttgagcaggcccagcgcgatggtgaggtaccgggtgtactgggtcagtttggactggcccgaagcgccctcttcgtacagctgctggaaccggggaatgaccacccggagcaactgcacgatgatgctggccgtaatgtacggcatgatgcccagcgcgaagatggacacctggagcaacgcgccgccgctgaacaggttaacgagctggtacagcccctctgccgtctgaccgttctgcaagcattgctggacattctggtagttcacaccaggcgagggaatgaaagcacccaagcggaaaatggtgatgattcccagcgtgaacaacaacttgcgtcgcagatcaggcgtgcgaaaggcccggccaaatgcgctaagcaagcgtcctcctgtggtgtgaataagagtggtgtgatggggatctataaatcccaacaaccgagtctaacgggtgtatgcgccctgcgaacaatccgcggcggcgccgctgcgccggatggcggcgaaaaaacggcgggcggatggaaaaactcccggccccggggcgatagccccaggaccgggagttcaacaacagggcttggcgcccaccggctctagagagcggtggtgcttccgcctgctgcggcaatcttctcagcggcgctggccgagaatgcgtgggcggtgacgtctaccttgacggtgatgtcgccggtgcccagcaccttgacgggctggttcttgcgaacggcacccttttcgaccaggttctccacggtgactgcgccaccttcggggaacagctcattgagcttgtccaggtttacaacctggaactcaacccggaacgggttcttgaagccgcgcagcttcggcaggcgcatgtgcagcggcaactggccgccggcaaagccagccttgatctggtaacgggctgcagtacccttcgtaccacggccagcggtcttacccttggaaccttcaccacgaccaacacgggtcttggcggttttggcacccggggcgggacgcaggtggtgaaccttcagggcgttctgcttctcagcagcctgagccttatcagcagtgttctctgccatttacttcgcctcctctacctttaccaggtgcggaaccgtgttgagcattccaacggtcacggcatcggcggtgcggacaacggtctgtccgatacgcttcaggccgagggaccgcagggtgtcgcgctggttctgcttgccgccaatggcggacttgatctgagtgatctccaactgggcgtcggagggaaccaggttcttagccataactaggcacctgccttcgtgttcagaagggccttcaccagtgccggcggagcaatctcgtcgaggggcaggccgcggcgtgctgccactgctgccggctcttcgaggcgcttcagggcatcaacagtcgcgtgaacgatgttgatggcgtttgacgaaccgagcgacttggagaggatgtcgtggatgcccacgcactccagtactgcacggaccgggccaccggcgataacaccggtaccggcggaagccggacgcagcattacgacgccggcagcagcctcaccctgaacgcggtgcgggatggtgctgccaacgcggggaacgcggaagaaggacttcttagcttcttcaacgcccttcgcgattgcggcaggaacttccttagccttgccgtagccaacgccgaccatgccgttaccgtcaccaacgacgaccagggcggtgaagctgaagcgacgaccacccttgaccaccttggaaacgcggttgatggtgacgacgcgctctacgaactggctcttctcggcttcacggccgccgtcgcggccgccacggccaccacgatcgccgcggccctggccacggtcgccacgctcgccgcgacgagcgccgccacggcggtcgtcggcagctgcgggggcagtggtctcagcggcagctgtggcttcagtagccttctgatctgcagacacagtgtccttttccttgtttgcttccgtcacagtgacagcccaccttcacgtgcaccgtcagcgacggcggcgatccggccgtggtacttgttaccaccgcggtcgaagacaacagcttcgataccggcagccttggcacgctctgcaacgagttcgccaacgcgcttggccttggcagtcttgtcgccgtcgaatgcacgaaggtcggcttccagagtggaggcgctcgctacggtcaggcccttgctgtcatcgacaacctggacgaatacgtggcgtgcggaacggttgacgaccagacgcggacgtacagccgtaccggagatgcgcttacggatacgaagctggcggcggctgcgctgggcagacttgctcttgttcgtacgcttcttgttaattgagatggccatggttacttaccagcctttccgaccttgcggcggatgacttcgccggcgtaacggatgcccttgcccttgtaggggtccggcttccgcagcttgcgaatgttggcagcaacctcgccgacctgctgcttgttgatacctgaaacagagagcttggtcggggtctcaactgcaaaggtgatgccgtccggggcggtgacgctgaccgggtggctgtaaccaagagcgaactccaggtcggatcccttggcctgaacgcggtaaccggtaccgacgatttcaagcttcttctcgtagcccttggtaacgccctcgatcatgttggagatgagggtgcgggtcaggccgtggagtgaacgggaggcgcgctcgtcgttcgggcgggcgacagtcagggtgtctgcatccagggagacctcgatcgggctggccacagtgtggttcagctcgcctttggtgcccttgacgctgacgacagagccgtcaaccttgacctcaacgccggcaggaacggtgatggggagacgtccaatacgtgacattattctcttcctttcccgttaccagacgtacgcgaggacttcgccgcccacgcccttcttgccggcctgcttgtcagtcaggaggccggaagaggtggacaggattgcgacacccaggccaccgagcacgtgcggcaggttggtggactttgcgtaaacacgcaggcccggcttggagatacggcgaacgccagcgattgaacgctcgcggttcggtccgaacttgagctcgatggtcagcttcttgccaacctcagcgtcctcttccttccagccggcaatgaagccttcagccttcaggatgtcggcaacgcgtgccttgagcttgctgtacggcatggtcacggtgtcgtggtatgccgagtttgcattgcgcagacgcgtaagcatgtctgcgacaggatctgtcattgtcatggtgggctcgtgcccttcctcgtaacggtttccgcggtgctgcttgcctgaccggagtcagatgccatgccgccggaccttttacgtagttagattagtcttcggccttgaacgggaaaccaagcgccttgagcagcgcgcggccttcgtcatcggtcttggcagtggtaacaaccgtgatgtccataccgcggacgcggtcgatcttgtcctggtcgatttcgtggaacataacctgctcggtcagaccgaaggtgtagttgccgttgccatcgaactgcttgccggagagaccgcggaagtccctgattcggggcagtgccagggtgacaagacgatccaggaattcccacatgcggtcgccacgcagggtagcgtgtgcaccgatgggcatgccttcgcgcagcttgaactgtgcgatcgacttgcgggccttggttacctgcggcttctggccggtgatctgggtgaggtcgcggacagcgccgtcgatcagcttggagtccttggcggcatctccaacacccatgttcactacgaccttcacgaggcggggaacctggttgacgttctcgtacttgaattcctcaatgagcgtgctcttgatggattctgcgtacttggtcttcagacgaggaacgatcttcgttgccggagtctcgagagtctcagtcattagatgtccttccctgagctcttggccacgcggatgcggacttcgcgcttcttgccgttacgctcaacggtttcagtgcggaagccgacgcgggtgggcttcttggtggacgggtcaaccagagccacgttggagacgtggatcggggcttcaacaacctcgatgccaccggtcttggtgccgcgctgcgactgaccgaccttggtgtgcttggttacgcggttgacgccttcaaccaacacgcggttggtgtcggtgaacacgcgcaggaccttgccctgcttgccgcggtcgccgccgcgctcagccttggcaccagtgatgacctgaaccaggtcaccctttttgatcttagaagccatggactagagcacctccggagccagagaaacgatcttcatgaacttcttgtcacggagttcacgaccaaccggtccgaagatacgggtaccgcgggggtcaccgtcgcccttcaggatcacagctgcgttctcgtcaaacttgatgtaggaaccatccgcacggcggcgttccttcttggtacggacgatgactgccttgacaacatcgcccttctttacgttgccgcccgggattgcatccttgacggtggcgacaatgacgtcaccgatgcctgcgtagcgacggccagatccaccgagaacgcgaatggtaaggatttccttagcacccgtgttgtcggcgaccttgagtcgcgactcctgctgaatcactatttactccttgcgtcgcgccggttctcagaccgaaaatcttcctacggaatgagccttgcggaacggttgatcggggtgtctcttgacctgcctggattttgccagaccaggcctaaactcccgtgccagaagcagttgctcccaaccggtccaggactactcctgggcgcaagggggcactatgccgtggcacgcttgtttacgaggtttgatgacggcgcacgaacggcgccatacaaactcaaaatcttagcacagttccggccagtccccatatcatcggcggcgctcccccgcaacaccgccaacgctctatcactccctgcaccttttcggccgacgctttatcactcccgctggccgttcgtcttggaggtgagagagcgtccggaaaaagccagcattaggtgagagagcgtccggaaaaaaccgccagtaagtgagagagcgtccgggagcgaacgacggcgtcacgcacggaggcctttcggcgcaccacaggcgacgctcccccgcaaagaagcggcgccgccgtcgtgccttcagcaaaagcctgcccggcgtgacggacccaggacgacacccgacaacgcactcccccggttaacgcggaaacccccgctcccaaagggagcaggggtttccggataccgaagcagcaggtgctacttggccttctcgaggatttccacgagccgccagttcttggtggcggacagcggacgggtctcggcgatgacaaccaggtcgccgatgccggcggtgttgttctcatcgtgtgccttgaccttggaggtacggcggatgaccttgccgtacagggcgtgcttcacgcggtcctcaacctggacaacgatggtcttttccatcttgtcagagaccacgtagccgcgacgcgtcttgcggtaaccgcgctgctcagccgtggctgcggtagcagtttccgtcacgttctcgtccttttcactcacttggcatcctcctcggtctcaaccgtttcagccttgggggcttcagccttgggggccttcttggttgctgccttcttggacttcttttcttccttggcttccacaaccggcgcggcaacctcggcacgaatgcccagctcgcgctcacggagaacggtgtagatgcgggcgatgtccttctttaccgcgcgcagacgaccgtggttctccagctgtccggtggcggactggaaacgcaggttgaacagctcttccttggccttgcggagttcttcaacgagacgctcgttgtcgaaaccgtccagctgtgcgggagccagatccttggatcctactgccatttctattcaccaccttcgcgacgcagaatgcgtgccttcaacgggagcttgtggattgccaggcgcagtgcctcgcgggctaccgattcctcgacaccggagatctcgaagagaacccggcccggcttgacgtttgcgacccaccattccggtgaacccttaccggaacccatgcgggtttcggcaggcttcttggtcaggggacggtccgggtagatgttgatccagaccttgccgccacgcttgatgtggcgggtcatcgcgatacgggcagactcgatctgacggttggtgacgtatgccgggctcagggcctggatgccgtactcaccgaaggagaccttggtgccgcccgtagcagcgccggaacgacccgggtggtgctgcttacggtgcttgactcgacgtgggataagcatttaagcctgtcctccttctacagctgcagcaggtgcagcctcagctgccggagcctcggcagcaggagctgcgtcggcggccgggcggtcgttgcgacggcggcggtcaccacggtcagcgccacccgggcggcccggacggtcgccggagcgtccgcgggacggggcggaagcggcctgctgggccagttccttggcggtgacgtcacccttgtagatccagaccttcacgccaatgcggccgaaggtggtcttggcttcgtagaagccgtagtcgatgttcgcgcggagggtgtgcaggggcacacggccttcgcggtagaactccgagcgggacatttcagcgccacccagtcgacccgagcaggcgatacggatgcccttggcacctgcacgctgcgcggactgcatggccttcttcatggcgcggcggaatgccacacgtgaagtgagctgctcagcaacgccctgggcaacaagctgtgcttccatctcggggttcttgacctcgaggatgttcagctggacctgcttgccggtgagcttttcgagctcgccgcggatgcggtctgcttctgctccacggcggccgatgacgatgccgggacgggccgtgtggatgtccacgcggacgcggtcacgggtgcgctcgatctcaaccttggcgataccggcgcgctccatgcccgtggacatgagctggcggatgcggatgtcttcgcgaacgaagtccttgtaccgctggccggccttggtgctgtcagcgaaccagtgcgatacgtgatcggtggtgatgccaagtcggaacccgtgcgggtttactttctgtcccacttagcgagcctcctctttctccggggtagcgactaccacggtgatgtggctggtgcgcttcttgatctgaaatgcgcgaccctgggcacgcggctggaaccgcttcatggtcgggccttcatcaacaaacgcttcgctgatgatgaggtcaccttcgtcaaacgcaacgccgtcgcggtccgcgaggacccgggcgttggagattgccgactgtactaccttgaataccggctctgaagctgcctgtggggcaaacttcagaattgccagagcctcattcgcttgcaatccacgaacaaggttgacgacgcgccgggccttcataggcgttacgcggatgtggcgcgcaattgccttggcttccattgctttccttctctcgtctttgacgtaagtgcaggcgcctagcggcgcttgcccttacggtcgtccttgacatggccgcggaatgtccgcgtgggagcgaattcgccgagcttgtgcccgaccatcgactcagtgacaaacaccgggatgtgcttgcgtccgtcgtgtacggcgatcgtgtgtccgagcatgtcggggatgatcatcgaacggcgggaccaggtcttgatgacgttcttggtgcccttttcgttttccctggctaccttcacaaagaggtgctggtcaacgaaaggaccttttttcaggctgcgtggcatgtgtccaggctcctatcgcttgttcttgccagtacgacggcgacgaacaataagcttgtcgctctctttgttggggcggcgggtgcggccttcccgctgaccgttggggttgacggggttacgtccaccggacgtcttaccctcaccaccaccgtgcgggtggtcaaccgggttcatggcgacaccacggacggtcgggcggacgcccttccagcgcatgcggccagccttgccccagttgatgttcgactgctcggcgttgccgacctcgccgacggttgcgcggcagcgcacgtcaacgttgcggatttcgccggaaggcagacgcagctgggcgaagcggccttcctttgcaacgagctggatcgatgcgccggcggagcggcccatcttggcgccgccacccggacgcagttcaactgcgtggataacggtacccacggggatgttgcgcaggggcaggttgttgccaggcttgatatcagcgttggcgccggcctctacgaagtcaccctgggacagcttgttcggggcgatgatgtaacgcttggtgccatcaacgtagtgcaggagggcgatgcgagccgtacggttcggatcgtactcaatttcagcaacgcgggcgtccacgccgtccttgtcgtgacgacggaagtcgatcagacggtactggcgcttgtgtccgccacccttgtgacgggtggtgatcttaccggtgttgttacggccgccctttttgggcagcggacgtaccaacgacttttccggcgtcgaccgcgtgatttcggtgaagtccgctacgctcgagccacgacggcccggggtagtcggcttgtatttacggattcccataatttatttcctcgttaaagtggtctccgctacgagagcggaccgccgaagatgtcgatggtgccttctttgagggtgacaatcgcacgcttggtgttcttgcgggtaccccatccgaatttggtgcgcttgcgcttaccggcacggttgatggtgttgatcgattcgaccttgacggagaagattttctccacggccagcttgatctcggtcttgttcgaacgggggtccaccaggaaggtgtactttccctcgtcgatcaggccatagctcttttccgacacgacgggtgcaagcacgacgtcgcggggatccttgatggtggctgcactcacttggcatcctcctcattctttgccactgccttgccggcaacgaatgcgtcgtaggcagccttggtgaagacaacgtcatcggagacgagaacgtcgtaggtgttcagctggtctgcgtacagaacgtgaacaccggcgaggttgcgcacggacagtgcagcaacatcgttggcgcgctcgatgacgaccaacaggttcttgcggtccgaaacaccgcgcagcgctgccagtgcggccttggcggagggcttggtgccttcaaccagttcggcgacaacgtggatgcgtccgttacgcgcccggtcagacagtgcgccgcgcagtgcagcagcaatcatcttcttgggggtgcgctggctgtagtcacgcggggtgggaccgtggacaacgccaccgccggtcatgtgaggagcacggattgaaccctgacgggcgcggccggtgcccttctgcttgaacggcttgcgtcctgcaccggaaacttcggcgcgggtcttggtcttgtgggtaccctggcgagcagcagcgagctgggctacgacaacctggtgcagcagcggcacgttggtctgaacgtcgaagatctctgcgggcaggtcaacctggacagtgttagccattgaactaggctcccttcacggcggtgcgtacgagtacgacctggccgcgggcgccgggaacggcacccttgataaggagcagcgacttctcgacgtcaaccgcgtggaccgtgaggttcagcgtggtgtgacgaacggcgcccatgcggccggccattttcatgcccttgaagacgcggctcggggtggatgcgccaccgattgaaccgggcttacggtggttcttgtgggcaccgtgggaagctccaacgccgtggaagccgtgacgcttcataacaccggcgaagcccttacccttggtggtgccgatgacgtcgatcttctggccggcttcgaagacctctacggagagctcctggcccagctcgtactcagcagcatctgcggtacggagttcgacgacgtggcggcgaggcgtgacgcctgccttttcaaagtgaccagccagcggcttggtgaccttgcggggatcgatctggccgtagccgatctgaacggcgacgtagccatcagcttctgcgttgcgcagctgggtgatgacgttcgaatctgcctggaccacagtgacggggatgagcttgttgttctcgtcccagacctgggtcatgccgagcttcgtgcccagcaggccctttacgttacgggttgcggtcatagtctctcagcacctccctacagcttgatttcgatgttcacgtcagccggcaggtcgagacgcataagcgagtcaacagccttcggcgtgggatcgatgatgtcgataagacgcttgtgcgtgcgcatttcaaagtgctcgcggctgtccttgtacttgtgcggagagcggatcacgcagtacacgttcttctccgtaggcagcggcacggggcccactaccgttgcgcctgcgcgcgtgaccgtctcaacgatcttccgtgctgaaacgtcaatgacctcgtggtcgtatgacttcagccggatgcggattttttgtcccgccatgtcgcctgactctctttcagtaaatgctgctctgtttacttacgtgttgtatggctgccgaagcatttgaagtcgtaactaccacccgccgcacaaactgaatccggatgaatccgggttcctcaccttgccggcgcaaccgacccccgcggtcgggcgtgtcgcgctttgcacgcatacaaatccgctattccaggggagtgggttatgtttggtcttccacttggaccctgacacccggcattatccggatcgggacacgaagaagcgcttgaacaactcatccagtatgccggaatttatggccagaagcgaatcgatgcccccggcgtagtcctgcccgtggccccgccagccccattgcccccggtcatttccgaatggatgataggggaatgactctggaaagcaccgaatcggcgaccgaactggccaaccgcatgccgccgtcgttcaccctgggggtcgcggcagcggccttccagattgaaggagcattgaccgacggcgggcgcggaccttcaggctgggacgcgttcgccgagaagccgggcaccattatggacgggcactcccccgctgtggcgtgcgaccactacaacaggttgccggaggacgtggcgctgctccaggacctcggcgtggactcctaccgcttctcgctgtcctggccgcggatccagcccgacgggcgtggggagttcaacaaggagggcctcgacttctatgaccggctcctggatcagctgctcgcggccgggatctccccgatggccactctctaccattgggataccccgctgcctctggaacaccgcggcggctggctgaaccgcgagacggccgagcgctttggcgaatacgccagtgcggcgggcgagcgcttcggggaccgcgttgcgcagtgggtcacgctgaacgaaccggtctccgtgaccttgaacggctatgccttgggcgtccatgctcccgggcatgcgctgatgttcgatgccctcccctccatccaccaccagctgctggcacacggactgggcgcgcaggccctgcgcgccgccggggtgtccggcggcataggcgtcaccaacctgcatgcccccgtccgcccggcaacccgaaagatcggcgaccggctggtggcgcacctctatgacctgctcatgaacagaatctatgcagatccggtgctcctgggccggtaccctgccctccccctatatgcaaagccctggcttcggtccatcgggaaaatctccgacgccgacctgcgcaccatccaacagcccctggatttctacggccttaactactatttcccggtgaaggtagccctcggtcgagggtctgcgtcaattcccgcggatgtgcataaagcggtggcaaggctgccgttccatgaggtgggctatccggaatacagcagcaccgggttcgggtggccggtggccccggaccatctgggcgtcctgctgaaggaacttcacgaccgctacggccaggcactccccccggtatacatcaccgagggcggcgccagcttcccggaaccggatacggtctcgggaaccctggcggatgaagagcgcgtaaggtacctggcgacccatctgggcgctgcccttgacgccacagcccccggcgggatcgccgccggcgtggacctgcgcggctactacgtgtggaccctgatggacaacttcgaatgggcagcaggctactcccagcgtttcggcctggtgcacgtggacttcgacaccctggcgcgcacgccgaagaagtccttctactggtaccaggccctcagccaggcgcggaaagccaggggcgcgtagctccggtgttccagcctggcgcggcagtggctaaaggtttttgtttgcccggttgatccgcttggcgcggttgatctcgttgcggaagtgcttcttggcccagaacacgccggcgacgacggcaacggcgatgatcaggaaaataagccagcccatgatgaactcctttcggtccagcaacagtatcagggacgcaataaccaaaaagaacagccccgctgcagtagcagcggggctgttcttcagttcaacaagaattacttgatgatcttggtaacgcgtcctgaaccaacggtgcggccgccttcgcggattgcgaagccgaggccctcttccattgcgatcggctggatgagcgcaacggtcatctcagtgttgtcgccaggcataaccatttccgtgccctcgggcagggtgataacgccggttacgtccgtggtacggaagtagaactgcgggcggtagttggagtagaacgggttgtgacgtccgccttcgtccttggagaggatgtagacgttggcctcgaagtcggtgtgcggggtgatggaacccggcttgacgacaacctggccacgctcgacatcgtcgcgcttcagaccgcggagcaggaggccacagttctcgccggcccatgcttcgtcgagctgcttgtggaacatctcgataccggtaaccgtggtcttctggaccgggcggatgccgacgatctcgacctcggagttgatagcgagggttccacgctcggcgcggcccgtaacaacggtgccacggccggtgatggtgaagacgtcctcgatcggcatcaggaacggcttgtcgcggtcgcgtacggggtccggaacggactcgtcaacagcggccatcaggtcctcaacggacttgacccactcggggtcgccttccagggccttgaggccggaaacgcgaaccacgggtgcttcgtcaccatcgaagccctgcgagctcaggagctcacgaacttccatttcaacgaggtccagcagttcctcatcgtcaaccatgtcggccttgttcagcgcgaccagcaggtagggaacaccaacctggcgggcgagcagaacgtgctcgcgggtctgagccatggggccgtcagtagcggcgaccacgaggatagcgccgtccatctgggcagcaccggtgatcatgttcttgatgtagtcagcgtgacccggagcgtctacgtgtgcgtagtggcgcttttcggtctggtactccacgtgggagatgttgatggtaatgccacgctgacgctcttcgggagcagagtcgatcgacgcgaagtcgcgcttctcgttgagatccgggtacttgtcgtacagcaccttggaaatcgcggccgtcaacgtcgtcttaccgtggtcaacgtgaccaatggtgccgatgttaacgtgcggcttagtccgctcgaactttgcctttgccacaggttcctcctagaacgttttcaaatgacatacccttcagccgcgcttgtcgcggcggaaactcaggtaagtctacttggggggctttggattggtgaaattgcagattcaggaactaatactagtccctcgagcctgttcgtgcagatggccggtaccggcttggccggacgaatccgaccggcaccggccacctgcaccggctgtgctttcctgaatcgaaaagcgcacccgaggttgttcgctgcgaaagtccggggactattcgccgcgggtcttctggatgatctcgtcggcaactgccttcgggacctcggcgtagctgttgaacgtcatggagtacacagcgcggccctgggtcttcgagcgcaggtcaccgatgtagccgaacatgccggacagcggaacgtgcgcacggatgaccttgacgccctgtgcatcttccatggactgcatctggccacggcgggagttgaggtcaccgataacttcacccatgtattcctcaggggtgcggacctcgacatccatcagcggttcgagcaggaccgggttcgccttgcgtgcggcttccttgaaagccatacggccggcgatcttgaacgccatttccgaggagtcaacatcgtggtaggcgccgtcaatcagcgtcgccttgatgccgacaaccgggtaaccggccaggacgccgtcgttcagcgcatcctggataccagcgtcaaccgacgggatgtactcgcggggaacgcggccaccggtgaccttgttctcgaactcgtacagctcgccatcggcagtgtccagcggctcgatcgcaatctggatctttgcgaactggcccgaaccaccggtctgcttcttgtgcgtgtagtcgtggcgttcgacggcgcgcttgatggtttcgcggtaagcaacctggggcttgcccacgtttgcttcgaccttgaattcgcggcgcatgcggtccaccaggatgtccaggtggagttcgcccatgccggcgatgatggtctggccggtgtcttcgttgagggacacctggaaggtggggtcctcagcggagagcttctggatggcggtggagagcttctcctggtcacccttggtgttcggctcgatggcaaccgagatcacgggctccgggaagctcatggactcaagcacgatctggtttgcggagtcgcacagggtgtcgcccgtggtggtgtccttcagaccgatggctgcgtagatgtggccggcggtagcgccttcaacaggcatttccttgttggcgtgcatctggaacagcttgccgatgcgctccttcttgcccttggtggagttgaccacctgggcgcctgcttccacgtgaccggagtacacgcggatgaaggtgagctggccgaagaacgggtgcgcagcaatcttgaaggccagtgcggagaacggctcttcggaggaaggcttgcgggtcagttccttctcttcgtcgcgaggatcgtgaccgatcatcggcgggacgtcgaggggattcggcaggtagtccacgactgcgtcgagcatcggctgaacgccacggttcttgaaggccgaaccacagaagatggggtagagctcagagttgatcgtcatcttacggatgccggccttgagctcatcgatggagatctcttcgccctcaaggtacttgtccatgagctcttcggaggactctgcaacggcctcgacgagggctgcacggtactcctcggccttttcctggaggtcagccgggatctcacggatctcgtacttcgcacccatggtcacgtcacccttggcatcgccgggccacacgagggcacgcatgtagagcaggtctaccacgccgatgaagtcgttctcggcaccgatcggcagctgcatgacgagcggcttggcgcccaggcggctgatgatggtgtctacggtgaagtagaagtcagcacccagcttgtccatcttgttgacgaagcagatacgcggaacgttgtacttgtcagcctggcgccacacggtctcagactgcggctcaacgccttccttgccatcgaaaacggcaacggcaccgtcgaggacgcgcagggagcgctcaacctctacggtgaagtcaacgtggccgggggtgtcgatgatgttgatctggttgttttcccagaagcaggtcacggcggcagacgtgatggtgatgccgcgttccttttcctgttccatccagtcagtggtcgaagcgccgtcgtgcgtttcgccgatcttgtggttcacacccgtgtagaacaggatgcgctcggtggtggtggtcttgccggcatcaatgtgggccatgatgccgatgttgcggaccttactaaggtcggtaagcacgtcctgtgccacggggtctccttttgggattgactacgcgttcgccgccagctcggttgagccggcggcgcccgggagtattaccagcggtagtgtgcgaaggccttgttggactcggccatcttgtgggtgtcttcgcgacgcttcacagcggcaccgagaccgttggatgcatccaggatttcgttctggaggcgctcggtcatcgtcttctcgcggcgggccttcgagtagccaaccagccagcgcagtgcgagggcggtggagcggcccggcttgacctcaaccggaacctggtaggtggcgccaccgacgcggcgtgagcggacctcaagggaaggcttgacgttgtccatggccttcttgagggctgctacggggtcgccgccggacttggcgcgggcgccttcgagggcaccgtagacgatgcgctctgccgtggacttcttgccgtcaacgagcaccttgttaatgagctgggtgaccagcggggagccgtaaacgggatctagtacgagcggccgcttgggggccggacccttgcgaggcatattacttcttctccatctttgcgccgtagcggctgcgtgcctgcttacggttcttgacaccctgggtatcgagggcgccacggacgatcttgtagcggacgcccgggaggtccttcacgcgaccaccgcggacgagcacaatggagtgctcctgcaggttgtggccaacaccggggatgtaggcggtaacttcaatgccaccgttgaggcgtacacgcgccaccttacggagagccgagttcggcttcttcggggtggtggtgtaaacgcgggtgcagacaccgcggcgcatggggctgccgttaagcgcgggagccttggtctttttgaccttcggcgtgcggcccttgcggaccagctggttaatcgtaggcactctcgtgttctccgttttatccggagtggccgcttccagccactctcctttgcgttgccccgccgcctgggccttgaagaagatctccaaggcggcgaaggcgaagccttaatagtcggatcgcatacgcagggaatgacctgactctcgtcttcaacggtccctaggcatgcaaaaatgtggcatacgttgcacaagaaccgtgcaaaccggaaacgtcgctctggttcagccctaaagctggaaccggcgcactcatccactgccacaataacaattggtaacaagtctagcatgaacggcccctaccccttaatcggggccgccctcccccaaccaggtagcgctaagtgtcgttttgagcccccaaaaggacacttagcgctacctagttgggttaacgggaggagccccgcttccccagcgcctatgcactgcggaaacggggctcgcttcacgagctcctagcggaagtcgttgcccaggtcgtagtcatccaacgggatggcgtggaactcgggagctccgtccccacccagggtgtcgtacgagaagtcactgaacgcgctggggccggtgaacaggttggcctttgcttcctcagtgggctcgacggtgacctcggtgtagcgcgggaggcccgtgccggccgggatcagcttaccgatgatgacgttctccttgaggccgagcagcggatcgctcttgccttccatggccgcctgcgtcaggacgcgggtggtctcctggaaggaagctgcggacagccaggactcggttgccagggacgccttggtgatgcccatgagctcgggacgtccggaagccggagtcttgccctcggacacaacgcggcggttggcatcctcgaaacggctgcgctcggcgagctcgccgggcagcaggtccgactcgccggactcgatgaccgtgacgcggcgcagcatctggcggacgataacctcgacgtgcttgtcgtggataccgatgccctggctgcggtacacgccctggacttcgtccaccaggaacttctgtgccgcacgcggacccatgatgcgcaggacctgcttgggatccaccggaccgttgatcagcttctggccgacggtgacgtggtcgccatcctcgatcagcaggcgtgaacggcgcaggaccgggtaggcgatctcttcggttccgtcatccggggtgatgaccaggcgcatctggcgctcggactcttcgatggtgatgcggccggctgcttcagcaatcggtgcgacacccttcggagtacgggcttcgaagagctcctggatacggggcagaccctgggtgatgtcgtcgccaccgctggcagagactgcaccaccggtgtggaatgtacgcatggtcagctgggtaccgggctcaccgatggactgtgcggcgatgatgccgacggcctcgccgatgtccacggtcttgccggtggccagtgaacggccgtagcacagtgcgcaggttccaacgctggactcacaggtgagcacggagcggaccttgacctcggtgatgcctgccttgaacagctcatcgatcaccacgtcaccgcagtcggtgccggcggctgcgaggaccttgccctcggagtccacgacgtcgacggcgagcgtacgtgcgtatgcactgttctcgacgttttcgtccaggaccagctcaccgttggaatcggcgacggcgatgggcgtgaccaggccacgctcggtgccgcagtcctcttcgcggacgatgacatcctgggagacgtccaccaggcgacgggtcaggtaacccgagttggcggtacgcagcgcagtgtcagccaggcccttacgggcaccgtgggtggcgatgaagtattccagaacggacaggccctcgcggtaggaggacttgatcggacggggaataatttcacccttcgggttggccacaagaccacggatacccgcaatctggcggacctgcatccagttaccacgtgcaccggaggacaccatgcggttgatggtgttcatcggtgacaggctgtcgcgcattgcctgggcgatctcgttggttgccttgttccagatctcgatcagttcctggcgacgctcgtcgtcgtcaatcaggcccttgtcgtactggccctggatcttggctgcccgctcctcgtaaccggcgaggatcgccggcttcgcggccggaacctcgatgtccgagatggcgacggtgacgcctgaacgggtggcccagtagaaaccggcatccttcaggttgtccagcgttgccgcggtgacaaccttcgggtagcgctcggcgaggtcgttgacgatgcgggacagttcgcccttgtcggcaacggcttcaacccaggggtagtcctcgggcagggtctcgttgaagaggacctggcccagggaggtctggacaagcgcgggctgaccctgctcccagccttccggagcttcccagcctgcgtagggcacgaagccttcgaggcggatcttgacctgcgagttcaggtgcagctcgcgggcgtcgaacgccatgatggcttccgaaaccgaaccgaagatgcggccttcgccagctgaacccttgcgcttggtggtcaggtggtagaggccgatgatcatatcctgcgagggcagggtgaccggacgtccgtcagagggcttcaggatgttgttcgaggacagcatcaggatgcgggcttcggcctgggcttcggggctcagcggcaggtggactgccatctggtcgccgtcgaagtcggcgttgaaggcgccacaaaccagcgggtggagctgaatggccttgccttcaacaagctgcggctcgaatgcctggatgcccaggcggtgcagggtaggtgcacggttgagcagcaccgggtgttcggtgatgatctcttccagcacgtcccagacctgcggacggtaacgctccaccatgcgctttgccgacttgatgttctgggcgtggttgaggtcaaccaggcgcttcatcacgaacggcttgaagagctccagtgccatctgcttgggcaggccacactggtgcagcttcagctgcgggccgacgacgatgaccgaacggccggagtagtcgacgcgcttgccgaggaggttctggcggaaacggccctgcttgcccttgagcatgtcgctcagggacttcagcggacggttgcccggtccggtgaccggacggccgcggcggccgttgtcgaagaggctgtcaacagcttcctgaagcatgcgcttctcgttgttgacgatgatctccggagcacccaggtcaagcaggcgcttgaggcggttgttgcggttgatcacgcggcggtacaggtcgttgaggtcggaggtcgcgaagcggccaccgtccagctggaccatggggcgcagttccggcgggataaccggcacggcgtcgaggaccatgccaagcgggctgttgttggtggtcaggaacgcgttgaccaccttcaggcgcttgagggcacgggtcttgcgctggcccttgccgttggcgatgatgtcgcgcagcaggtccgactcggcctgcatgtcgaagccttcaagacgcttcttgatggcttcggcacccatggagccttcgaagtacatgccgtagcggtcgcgcagctcgcggtacaggccttcgtcaccttcgaggtcggcgaccttgaggttcttgaagcggtcccagacctgctcgaggcgctcgatgtcggcgtcggcgcgcttacgcacattggccatctggcggtcggcggagtcgcgggccttcttcttgtcggcagcttttgcaccttcaccctcaaggcgcgcaatttcgccttcgaggtcgcgggcgatcgccgcgatgtcggagtcgcggttgtcgatcagctgcttcttctcgatgtcgtgctcaacctgcaggttgggcagttcctcgtggcgggcagcttcgtcgacgctggtgatcatgtaggcagcgaagtagatgaccttttcgaggtccttcggtgccaggtcaaggaggtagcccaggcgtgagggaacacccttgaagtaccagatgtgcgtgacgggagcggccagttcgatgtggcccatgcgctcacggcggacctttgcgcgggtgacctcaacgccacaacgctcacagatgatgcccttgaagcgcacgcgcttgtacttgccgcagtagcattcccagtcccgggacgggccgaagatcttctcgcagaagaggccgtccttctcgggcttgagcgtgcggtagttgatggtttccggcttcttaacctcgccgtaagaccagccgcggatgtcttccgcggtggcgaggccgatctgcatgaggccgaaggaggattcgctggacatatggtccctgttctctcttgttctctaaattctgaagtcttgggtgcggaatgaggaaaggaggacgacggcggacgctcagcccgccgtcgtcggaccccttagacctcttctacggaactgggctctgcacgagacagatcgatgcccagttcttccgcagccgtgaagactgcgtcatcagagtcacgcatttcaattgtggttccgtccgtggaaagaacttccacgttcaggcacagcgactgcatttccttgatcaagaccttgaaggactcgggaacacccggctcggggatgttctcgcccttgacgatggcttcgtagaccttcacgcggccatggatgtcatcagacttgatggtgaggagttcctggagcgtgtaggcggcgccgtaagcttcgagcgcccacacttccatttcaccgaagcgctggccaccgaactgtgccttaccacccagcggctgctgcgtgatcatggagtacgggcccgtggagcgcgcgtggatcttgtcgtccaccaggtggtggagcttcaggatgtacatgtagccgaccgagatcggatccgggaacggctcgccggagcggccgtcaaacaggcgggtcttgccggaggagttgatcaggcgttcgccgtcacgggtcacgttggtggaatccagcaggcccgtgatttcctcttcccgggcgccatcgaacaccggcgttgcaacagtggtctggccactttcgcgcggcaggttcggcagctgcttgacccactcgggctcgccttcgatcttccaaccggtcttggcaacccagccgaggtgcgtttcgagcacctggcccacgttcatacggcccgggacacccagcgggttcaggacgatatcaacgggggtgccgtcggcaaggaagggcatgtcctcaacggggaggatcttggagataacacccttgttgccgtggcggccggcgagcttgtcgccgtcggtgatcttgcgcttggcagcgacgtagacgcggaccagctggttcacgcccgggggcagctcgtcgtcgttgtcgcggtcgaagacgcgcacgccgatgacagtgccggactcgccgtggggaaccttcagggaggtatcgcggacttcgcgggacttctcaccgaagatggcgcgcagcaggcgctcttccggggtcagctcggtttcacccttcggggtgacctttccgaccaggatgtcccctgcttcgacctcggcaccgatgtggatgatgccgcgctcgtccaggcctgccaggacttcctcggacacgttggggatgtcacgggtgatttcctcggcaccaagcttggtgtcgcgggcatcgatctcgtgctcctcaatgtggatggaggaaagaacgtcctcggcaacaatgcgctgcgagaggatgatggcgtcctcgaagttgtggccttcccatgacatgaatgccacgagcaggttcttgccgagggcgagctcgccctggtccgttgccgggccgtcggcgatgatgccgccaacttccaggcgctggccttcgttcaccaggacacggtggttgtagcagttgccctggttggagcgggcgaacttgttgatgcggtagttggtctccgtgccgtcgtcgttaagcatgatgacgagctcggcggaaacctcggtgaccacaccggccttcttggcgatgacaacgtcaccggcgtcgacggctgcggcgcgctccatgccggtgcccacgaacggagcctcggaacggaccagcggcacggcctggcgctgcatgttggcacccatgagtgcacggttggcgtcgtcgtgctcgaggaacgggatcagggcggtagccacggacaccatctggcgcggggaaacgtccatgaactcgacgtcgtcggcggggacgaggacgggctcgcctccaccaccgcgggcacggaccaggacggtttcttcggcgaacttcttgttctcgtccagcggcgcgttggcctgggcgatcaggacctcggcctcgtcgtcggccgtcaggtactggacgtcgtcggaaacgacgccgttcttgaccaggcggtacggcgtctcgatgaagccgaacgggttgatgcgtccgtaggatgccagcgaaccgatcaggccaatgttcgggccttcaggggtttcgatggggcacatgcgtccgtagtgggacgggtgcacgtcacggacttccatgccggcgcggtcacgggacagaccacccgggccaagggccgacaggcggcgcttgtgggtcaaacccgagagcgggttgttctggtccatgaactgggacagctgggaggttccgaagaactccttgatggccgcaaccacggggcggatgttgatcagggtctgcggcgtgatggcctcgacgtcctgggtggtcatacgctcgcggacaacgcgctccatgcgggacagcccggtgcggacctggttctcgatgagctcgccgacggcgcggatgcggcggttgccgaagtggtcgatgtcgtcgatttcgacgcgcaggtccacttcctggccgtcacgggtgcccttgatggtcttctcgccggcgtgcagcgcaacgaggaacttgatcatggcaacgatgtcttcaacgtgcaggaccgaggcttccttgtcgccaagggagcggtcgatgccaagcttgcggttgatcttgtagcggccaaccttggccagatcgtagcgcttggagttgaagtacaggttgtccagcagggactgggcagcctcgacggtgggcggctcgcccggtcgcagcttccggtagatgtccagcaacgcgtcttcgcgggtctcggtggcgtccttctccagcgttgcgcgcatggagtcgtactggccgaactcttcgaggatctggccttcggtccagccgagggccttcagcaggaccgtaacggactgcttgcgcttgcggtcgaggcggacgccgacctggtcgcgcttgtcgatttcgagctcgaaccaggcgccgcgggacgggatgatcttcgcggtgaagatgtccttgtcgctggtcttgtcggcggcgcgctcaaagtaggcgcccggggaacggaccagctgggagacgacgacacgctcggtgccgttgaccacgaaggtgcccttctcggtcatcagcgggaagtcgcccatgaacacggtctgctgcttgatttcgcccgtgttgttgttcatgaactcggccttgacgtacagcggagcggagtacgtagcgtcccggtccttgcactcggccatggtgtacttggggtcagcgaactccggatccgagaagctcagggacatggtgccctggaagtcctcgatcggggagatctcttcgaagatgtccgacaggccggacgtggtggcgacgctgagatcgttttcttcgacagccttcgctacgcgtgcctgccagcgttcattgccgaccagccagtcaaagctgtccgtctgcagggcaagcagattcggaacgtcaagaggttcgtgaatctttgcgaatgagagccggcgagtggcaccatcagtgctgtcggcagtgttagcggtttcgttattagaggtgctcgaggcgaccaagagggatccttccacagaccttcaggcgttttcagatctcccccgctgtgcaccctgcggaatgctccgcagtgctaccatccggttccgctatatgacccggggcctgcgctgaccatgctgtgacgtggttgacggcacgttgattgtcagctgcaaggcaaagcccaccgctatatgaaggctgaaggtaaacagggaagacgcaaatatctacgatacggcaaaataacctacatgtctaccccatgtccggccggaatgcaagcaccggttttcgcgcctcttcggggctaaagccgcagcgtgacgccggcgtccgtgcaggtgccggcactggcaaagacggcgtcccggacagcgtcctttgactcttgcgccggctccccaccggatccggccgtgcccgagtggtcaatcgagagcaggctcagcgatgcgaacaggccgcgaaggtcgccggataccgtgccttttgcctcttcggcccgcaggtagatgttctcgtagccttcggaatcgtcggaaggaactgctgcgtagctttcaaagagggagttgaagagttcgcacgctgccttggtgccgttggcaggaggcgacgacggcgtcccggcactgccgccggcggcggcgctggtgcgggtggaggttggctccggctgggatgggggcgcggaggcggcttcctggtcaggcacggatacggaacaggcggtgagcgctgcgagggcggcggctgccgccgtggcgagtagttttttcacgctgctgctccaaccatcccggggcagggacccgctgttccccctgcaaaagtgtccgcggtccaccctacgcacgccgccgccgtcgtgcacgttcatgggatggggacctctcccctgccgggaagcagtggactgttcccgcagcgcactgcgccggggcggaatgcacatacggccccgggcgtttgaatacttaggtgaccagggtcacgatagccttggtggcttacaccggaaaacggatcggaagagataaccatgggcaactcccgtgacaacgctgacgttgtcatcctcgcagcagcgcgcaccccgcagggccggatcaatgggcagctggcaagcttcaccgccgtggaattgggttcccgcgccatcaaggccgccctggacgccagcggcgtggatgccggtgacgtggatgccgtcatcatgggccaggtactccaggcaggtgccggccagaacccggcccggcaaagttcaatcggtgccggcatcggttgggacgttcctgccgtgacaatcaacaaagtatgcctgtccggactcactgcggtgatcgacgctgcccggatgatccgtggcggcgaggcgtcagtggtggtggccggcggccaggagtccatgacccgggccccccacctgcttcccggctcacggcagggctggacctacggttcaatccaggttttggacgccgcggcccacgacggcctgacggacgccttcgacgggcagtccatgggcctgtccaccgagacccgcaacctggccctgggcattgaccgcgcatcgcaggacaacgtggcggcccagtcccaccagcgggccgcgctggctgccaagaatggaacgttcgacgacgaaatcgtcccggtcagcgtgaagcagcgcaagggcgatccactcgtggtttccgctgacgagggcgtccgccccaacacctccgtggactccctcgccgggctgcgcgcagctttcgtgacggacgggaccatcaccgcagggaactcctctcccctgtcggacggggccgcagccctggtgctggcgtcccgcggctacgccgaggaacacggcctggagtacctggccgtcgtggggaagcccgggcaggtcgccgggccggacaactcattgcactcacagccgtccaacgccatcaagaacgccctgggacgggccggctgggccgttgctgaccttgacttcattgagattaacgaagcattcggatccgtggccgttcagtcactcaaggatttggactacccgctcgagaagtgcaacatccacggcggcgccattgcgttgggccaccccatcggggcctcgggcgcacggctggccgtccacgctgctcatgagctgaagcgccagggaacgggtaaagccgcagtgtccctgtgcggcgggggcgggcagggcgaagcgctcctgctctaccgcgactgatggcaggccccgtgatgaacggagcggacggcgccggacacggccggttcctggccgatgcctccgcccgcgggctggcagtggacatcgtggaaaggccagccgccaggagccttgcagaggcagccgggattctgggaatcagccctgccgacatcgtcaagtcgctggtggtcaagcacaaggacggtacattcctgtttgcgttgatccccggcgaccgccagatttcctggcccaagctgcgaaccctggtgggtgtcaacaagctgtcgctgccgcccgcggacctggccctggaggcgaccgggtacgagcgcggcaccattacgccactgggcagcaccaccagctggccggtctacgcggacgccaccatcaccgggcgccggatctcgatgggcgcaggcgcccacggttacagcgccttcgtggacgcggacgccctgaccgctgccctggatgccgtggtagcggatatcagcgaccccgcctgacctcccgggcccaactgagtagcgctaagtgtcgttttggggccccataacgacacttagcgctacctgctttcggtgagaacgcaaaaagccccgcccacaaacgtggacggggcttcctgaggaaaaagcgcgttactacttgagggtaacggtggcgcctgcagcctcgagctgctccttggccttctcggcagcttccttggtagcaccttcgaggacagccttgggagcgctgtcaaccaggtccttggcttccttgagacccagggaagtgatggcgcgaacttccttgatcactgcgatcttcttgtcgccggcagcttcgaggacgacgtcgaagtcagtcttctcttcaacctcttcagcagcagcgccggcggggccagcaacagcaacagcagcagcggtaacttcgaaggtctcttcgaagagcttgacgaactcggagagctcgatgatggtcagttccttgaaagcttcaatgagctcttcgttggtgagcttcgccatggtaggcgtccttcctgttgtggtgttcagcggcacgcggccgtgcttcacaccggagtctggtctaaaagagagttagttctcttcggtggctgcggcttcggccggagcttcggtctctgctgcttctgcggccggagcttcttcagcggcgggcgcctcggcagctgccggtgcaccgttctcttcttcaagcttgaggcgcagagcgtcaatgatgcgtgcagcggcagcagcaggggccttgaggacgcctgcaaccttggcgagctgcagctcgcgggactcgagagctgccagtgcggcaacctcgctggcgttcagtgccttgccctcgaagtaaccggtcttgatgaccagctgcttgttggccttggcaaaatccgtcaggctcttggcagcggcaactgcgtcacccttgatgaacgcgattgcagtggggccggagagctggtcgttgaatgcttcaacgccggcttccttggctgcaatggcggtcagggtgttcttgacgaccgcgaacttggtgtcctggccgagagaaacacgcagctgcttgagctgtgcaacggtgagcccacggtattcggtcaggacagcggcgttcgattccttgaaatcgttagtgatctcagctactgctgaaaccttgataggcgttgccataaccctccttccggggatagtgccggtattcgacggtccccgctcaagagagctaaaactaaaaacgccccgcgcagatgcacggggcttggctcaacacaggtatcccgtggagctttgcttcgttcacctgcgccggccgccctgcgttgagggtccttcgtccggaaaaccacttcaatcccccgcgcacaactacagagttgagccatgttcaagggagtggatttccaacaaccgacggtctttggtcatcccagtctaagggaggtgccgccggtccgccaaatcggcagtcagctgttgctggtgccaaggttcgggagctccttctgccagattcccgttacgcccgcggtccggaatcccaattgctggttgacggtgaggaggtagcggttttccggcgcgttccaggtgtagatgacccgggcatcaggaaactgctccgtcagccgttccatgttcgccaccttgatcaggagtcccagcttgttcccgcggtgctcctgcaggacgagggtatcgtcctggaaaaccacgtccgctcggtgggccagcaccgtgatggtggtcaggcccaccagcgccccgctggcgagatgctcgacggcggtgaccacagtctgccggccctgcgcaatggcaacgtcttcggcctcccggaggatggcgccgtcgaacaccatgtcctgctccaccggcacctgcagcgacggatcgacgtcggccccggcttggttttcgaggacggcgacggcctccagccagcggtccgggcaccggtccgtccaatggtgcagccggtaccggccgttgttggcttcctccgcttcggcctgcaggtccgccaccagcttcgagtccagcggcagcaggcacgaactgaactgctcgatatgctgcagggtgtatccggtgcgttgggcgaactccacctcccggctctccagcggcacgaatccctgccccgatccggggaccagctgggcacgttcgaattcgtgcagggacgcccctggatggttggtgtccaccagaatcatggtgcggccttcattgcgggccagctgctcggcggcctggagcagcctcctcccgacgccctggcgctggaactcaggcaggatgtccagcgtgaattccgccaggtccaggttgtccgtgaggggaagggcaatgtcaacggtgcctacaatttccccgtccaccttggcgacgaggatcagctgccgctcgtagggatcctcgaactcaaggagcttttccatggggccgtaagcgaggtcgtcgctgccccaggtctgcatgcggactttgcgtcccacttcgacggcggcaaggaagtctgcagcgtccggcgcctcgagtgagtcggggatccagagctgctcgatcttcacgtcttttgccataggcgcatcatcccagccgtttctgccactcaccttcataaccagccggcctgaatccaagggcaatatttatggccagcatatgttggttttcactggcgttccatgtcaacacagaacgcgccgacggccacctgccctgggcacgccgcagatttgccaccttgatgagcatgccgaggcggcggccacggtgtttcgccgtgaccagggtgtcctgctgggcaatggaggccggcacaccgggccgccagttgaggaccgtgtaggcaaccagttccccggtagcgctgtgcactgcggcagtcaccgcggactggacgccgccgcgggccatcgtttgctcctcctcccgcaccctggctgtgtcccagtcctcgccctcccagtccatcccggcgatgggaacgtccgtgctcatccgtgccttgagaagcgcgtaggcctgcaccaggtcttcggggcagttgtcatcccagccccagatgctgtagccgcccgccccgcctgctgcctctgtttccagccggtccagcagttccggcgcaacgggtaggtccagccggctggaccgttccacctgttccagctcatagccggaggcggcggcgaaggccactgcgggctcagtgaccggcaggcctccggcaccggacttggcggggagcacggggttcccgtcggccgcggccagcggaacctcgtggtagccatagagggatgtccggccccgttccctggcaatcgattcggcgtgtagcagtagcgtcctgcccaggccctcgcgccggtaggcgggggcaatcaggacatcgatacccgcagtgtgcgtgttctcgcggagcggcagttccacagagcacataccaacggtttccccattcatcttcgccaggaagagctgccgctcctcgtactcattgccccgccagaactcggcagcctcctggagcgtggggcaacggtccaggttgccccacagtgcgagctcgtgctgcatccgcagggcgtggcattccctgagatcggctgtgggccctgcagaagcggcagtcattccgggctccggcatcacctcaacggcgaagattacgggtgcagcgggggtccctgggaagatatgcgactccgggtcagccattcctacagcttaggcaaaaggtgccggcgccgggattgttccgcggctaaaacaaaaccgcccggcacgggtgccgggcggttttgttgcggcggatagatcccgctgcaggagtttcggacgaggatttaggcctcggtcagaaccttggtgacgttcgggtcgacggagatgccgggaccgaacgtggtggcaaccgtggccttctggatgtagcggcccttggaagcggacggcttcaggcgaagcacctcttccagtgctgctgcgtagttctcggccagcttgacggcgtcgaaggagaccttgccgatgatgaagtgcaggttggagtgcttgtcgacgcggaagtcgatctttccacccttgatgtcgttgacggccttggtgacgtcgggggtcacggtgcccgtcttcgggttcggcatcaggttacgcggacccaggaccttaccgaggcggccaaccttgcccatgaggtcaggggtggcgacggctgcatcgaagtcggtccagccggctgcgatcttttcgatcaggtcgtcggaaccaacgaagtcggcgccggcagcgattgctgcctcagccttgtcgcccgttgcgaaaaccaggacgcgggaaaccttacccgtgccgtggggcaggttgacggtgccgcggaccatctggtcagccttgcgggggtccacgccgaggcggaaggcaacctcaacggtggcgtcgaacttggacgggttggtgtccttggcgagggtcactgcctcgaacggcgcgtagaacttctccgcgtcgatcttggcggctgctgcctcatatgctttgctgcgctttgccatgctgcttatttctccttgtgcagttgtggtctgcggaccgcgctgggccctgccacagttggtgggcgggctcgttatccgtgcccgtttcccaacatttcagttttggtggtgccggtgtcccggcggtgccgcccgtcgtcgtgcccttattgccgggcacaacaccaaagcggcggaagcggctagccttcgacggtgatgcccatggagcgggcggtgccggcgatgatcttcgctgcgccttcgaggctggtggcgttgaggtcttccatcttggtggaggcgatctcgttgacctgggcctgggtcagcttggcaaccttgacggtgtgcggggttgctgaacccttggcgacgcctgcagccttcttgatgagctctgcagccggcggggtcttggtgatgaacgtgaaggaacggtcctcgtagaccgtgatttccacggggatgacgtttccgcgctgggcttccgtcgcagcgttgtacgccttgcagaattccatgatgttgacaccgtgctggccaagcgcaggaccgatcggcggggccgggttagcggcacctgcctggatctgcagcttgatgaggccggtgaccttcttcttgggagccaatgtagggtccttctctcaataacgtcctggggcacaggagcgtgcctcaggtttgtggccgccatggcaaggcggccggccgttccggtgctgctaagcgggcagccccgggacgaattcttgggcggtcagatcttggtgacctggttgaacgccagggtaaccggcgtttcgcgctcgaagatggatacgagcaccacgagggtctgggattcgaccttgatctcggagatggtggcgggaagggtctcgaacgggccttccttgacgatgacggactcgccaacttcgaagtcaacgtccacgggggcctggttctgcttgttgaccggcttgcccttctcggcctgctcttcctcgaagacgggagcaagcatggagaagacctcgtccaggcgaagcggcacggggttgtgggcgttgcccacgaagcctgtgacacccggggtgtggcggacggcgccccacgaggcgtccgtcaggtccatgcggaccagcacgtagccggggatgcggacgcggttgatgaccttgcgctgagcattcttgatctcaacgacttcttccatgggcacctggatttcgaagatgtaatcttccatgtccagggtctggatgcgggtttccaggttggctttcacgcggttttcgtaaccggcgtaggagtggatgacgtaccagtcaccttcctggcggcgcagcttggccttgaactcctcggcggggtcaacgtctgctttggcggcggcagcggcgagggcgtccgtagactcctcttcggagccggcgtctgcctcggcgtcaaagtcggaaccggcgtcctcggattcgggcgcggaggaatcaacctcagactcttcaccggcttctgccgtgacgtccgcggactcttccagctcagtctcggttacctcgagctcctgctcagacacttggtctcctgcttcctcattgcctaacatgcctatttaaatggctcaattccgcacaccggcgtttcgtccgggaatcccggaggaatacgcggcctgcggaccgtgcagcgttagctgtccgtggtgccagtcccgccgaagacccagccgacggcggttccaaaaccgatgtccagcaggctgacgatgaccatcatgatgcccacgaacaccagcaccacgagcgtgtaattgaccagttccttgcgggtgggtgcaacaaccttcttcagttcgccaatgatctggcggacgaaaagtgcaatgcgggcgaagaagtttgccttggcgtccttcttagctgggcggcccttggagctgctggcagctgtttcggtcacctggtcctcgctcatctttgcaatgttggattacccggccctgatcagaaccatggttactgcgcttgccccggattttcgcccggggcgcttgcgcagggcagacaggactcgaacctgcaacctgcggttttggagaccgctgcgctaccaattgcgccactaccctatggagtgaattccactctccgacaacgatccgacagcttgaactggggcgcacgtcatcatccgtgtttcaacaccggtgaaccagtctacgcaacaacttcgcgttcgtcgaaccggcccatttccggcccccacctgatggcctgccagacatttgaccggaacagagtcacaaatcaaaaccggcaacccggagggtccggtgaacagcatagagtagaactcgtcgaatcccacattccagcccccgggctgcaagcgaagaacggacctgccatgtctgccgcccgcgtttcccagcgcatttccgcaattgccgaatccgcaaccctcgccgttgacgccaaggcgaaggcgctgaaggcagcgggccggccggttattgggttcggtgcgggcgagccggatttccccacgccggactacatcgtccaggccgccatcgaagctgcaggccagccgaagtaccaccgctactcccccgccggcgggctgccggagctgaagaaggccatcgccgagaagacgctgcgcgactccggctatgcagtggacgcctcacaggtcctggtgaccaacggcgggaagcaggccgtgtacaacacgttcgccaccctggttgatccgggcgatgaggtcattgtccccaccccgttctggaccacctacccggaggccatccgcctggccggcggtgtccccgtggaggtgtttgcgggccctgagcaggactacctggtgactgtggagcagctcgaagcagccgtcacggacaggacgaagatcctgctgttcgtgtcgccgtccaaccccaccggctccgtctactcgccggagcaggtggcaaagatcggcaaatgggcagcgtccaagggcctctgggtggtcaccgacgagatctacgagcacctgacatacgacggcgttcccttcacttcgatcgccaccgcggcgccggaactgggcgacaaagtggtcatcctgaacggcgttgccaagacctatgccatgaccggctggcgggtgggatggatgatcggtccggccgacgtcatcaaggccgccaccaacctccagtcgcatgccacctccaacgtctccaacatcatgcagatcgccgccctggccgcggtctccggcccgctgaccgctgttgatgagatgaaggtggctttcgacaggcgccgcaaggcgatcgttgctggcctgaacgccatcgacggcgtggaatgcccgacgccgaagggcgccttctacgtctacgccgacgtccgcgcgctgctgggcaaggaattccccaccgcctccggcaccgcaacgccacagacctctgccgaactcgcagcgctcatcctggacgaggttgaggtggccgtggttccgggcgaggcttttggcccgtccggctaccttcgcctttcgtacgcactgggcgacgatgacctggcgatcggcgtgcagcggctgcaggacttcctgggcaaggcacagtaggacgctctctcacttaaagcaggaattccccaaacgctctatcactcccttcacagcgagtgatagagcgtttggcgttaaggcacatcgagtgagagagcgtccggcgtataggcgcatcaggtgagagagcgtccgggtttatcgggcatcaagtgatagagggtttaggttagaggaggcggcgctcggcggcccacttggtcagctcgtggcggctggagagctgcagcttccgcagcaccgctgacacgtgggtttccaccgtcttgatgctgatgaacagctccttggccacttccttgtagctgtagccgcgggcgatgaggcgcatgacctcgagttcccgcgcggacagcctgtccagttcgtcgtcggcgatgtccgcgggggcggtgccgaaagcgtccaggacaaagcccgcaagccgcggcgagaagacggcgtccccgccggcaacccggtacacggcgtcagtgatttccgcccccgagatggtcttggtgacgtagccgcgtgctcccgcccggattaccgccacaacgtcctcggccgcgtccgagacgctgagggcaaggaacttggtggcgtgcagcagggcagcggaacccgcgatgacctcccggcccccgccacccaggccgccgggcaaatggacgtccagcagaaccacgtccgggcgctgctgcgcaatgacggcgatggcctgttccaccgtggctgcctcgcccaccacgtggatgctggggtccaaatccgctttcaggcccgagcggaagatcgcgtggtcgtcgacaatgaccaccctggcggacctggcggccggatccgaacccggtccctgcgttgtgttcatggcttgccttccgtgctgtcctgcggggcggcggggaagcccagccgcacctccgtgccttcgctgctgctggtgattgcggccgtaccgccgtggcggttcatgcggccgatgatggattccctgaccccgagcctgtcctccggcacgtgctgcaggtcgaatccggggccgcggtccttgatgaagacctcggcacgtccgccggatgcctcaaggtagaccgagacggtcccgccgccgtggcgggaggcgttgagcatggcctcccggctggcctggatcagcgcttcgtggccctccgtgacggctgtgtcccccacgcagaccacctcgacggcgttgcccagcaggtcctccacctcggcggccacggccttgatccggtctgacagctgcccggcgtccttgccgggatccgcgaaaagccagccccgcagctcacgttcctgggcgcgggccagacggacgacgtcgtgctcgctggccgcccgccgctggatcagggccagtgtctgcagcaccgagtcatggaggtgggcggcgatctcggcccgctcggtttcccggatcctgccggcccgctccgcctccaggtcgcgccagaacttcagcgcccagggcagcaggaccagcaccaccccgccgaggacagccaccgaggccagcagcgccagccaggtctgctcccaggaaccggagccggacaccatcaccaggacgccggccaccaccagcgccaggcccgccgcaagccgggcccagccccctgcctggtccgccttggttttgtctacgagaccggcccgccgggtttcatccagctgcatccacgcaatggaggcgccgccgagcactgccgctgccggtatcagtgtccccagcggcacatccacgcccagcagttgggcaatcaggatgcctgccaccagcagcagcccggccccgagcaggatttccttgctgtagcgcatctcccggaaccggaaccagggcggccggacgggctcggacacggatgctgcggcgtcccccagggcgggatatccaaggccgcgtggagaggcagtatccgtccggaggccgccgtcgggcatgctgggcgcagcgatcccgccgccagccggagccgcagcccaggggacggcggccggcacggtgtcccggctgacggccggtgcaatgggcgacgacggccggcgcgcctggcgccgtgcgctttcgtcagccgtggggaccatgatccacaaccaggcatagaagacgacgccggccccgccggccagcgaggcaaggaccattgccacccgcacgtggaccacgggcacgcccaggtgggccgccaggccggagcacacgcctgcgatgaagcggtcgctgcggcggaccagcgggaggcgtgcggggacggttgtcatggatcaatccaagcacggatcagggttcccgggcccgcaatccggccggatccggggtcctctcagggaccgttcagggtgtcccccagtagagccgaagcgccgcaggcggaaggatcgaagcatgaactcgcaaacccccacccctgatgacggccacccgacggaacccctccccaaacgggagagcgaaaaccccacggcccccctcccgccggctgagtccccattggcgccttccccctcacctgctcccccgccggcgtcggaccaggcctcgaagcaggaatcggagcacgaagacgacgacggctccgctcgcggctccatccgggatgacgtggcgtacgacagcgcaggcccggcctataccgggcagccggccggagcgtacccgggccagggcagccccggcacgggcagcgcaagcccgggtgccggcagctacccctatgccggagcacccaaccagcagaccgactttttcggctgggtgcgcagccatgggatcacgcgcggccaggaccgctggatcggcggcgtctccagcggcatcgcccagcgcttgggcatcgacccgctgattgtccgaggcgtcttcatcgtgatgacccttttcgccggcatcggcgtgcttttctacggcctggcatgggccttcctgccagagcccgatggaagaatccatgtccaggaagccggcgccggacggtggaccagcggcatgaccggttccctgatcgccgtaatcctcggcttcagcggactcggcggcgacttctggggctggagcaaccacggcttcggcgctttcctctggacactcttctgggttggcggcgccatctacctgatctactacctcgcgcagcgtaacaaagcagcgttgggcacaccggcgggcgcagccgcacccggcaccacctcctacccgggcaccgcataccccggcagcaccacgcactctgccgcagcctccacggcaacggctcccccgtactcggacgttgcagggaccggtccgtttaccggcagcccctacggcgccggcagctccggcagcggcggctgggacaacaaaggcgccggcagcacgtggcagccgcagggtcctccgccggcacccaaggtgcgccccgcaggtcctggtgcccccgccgtcgcgatcgcggccggcagcgcactgatcgtcggcgcgggactgaaagccctggacgtcaccaacatcattgacctcggtgactccacaaacgccatcgcctgggccagcgcggcggcggtcctgggtctcgggatcctcatcctgggcttccgcggccgcacctccggcatcctgtcgttctttgcggtggcagccctcatcacgggaggaatcttcaacgtggtgggcaacaacggcgagcgcgtccgcttccaggaagttgactgggcacccatgagcatccagcaggcaagcgaggggctgaacatcacggcaggacgcggaaccgttgacctcaccgggctctcccaggacgccccgcttgcatcagaggtcctggtccccctggacttcaccgccagcaacgtcacggtggtgatccctgactccgtgcccgtggacatccgggccgacatgaccttgggcaacctcacggaaggcgggagccagcgcggcgggacaaccacacgcgaaagcagctacaacaccgacaagcccggcagccacctggtcatcgagatcgacggcaccgtcagcaacgtcaccatcaaggaaggtaactgacatgagcagccagacaccggcgccggacccgtacagcccggggagcaacgcggccgcacgcaccgattccgtccctccctccggggcgcgggtgggaaccatcgtatggggcctgatcgttcttgccctggcagccctgatcatcatcgcccagctcggaatcgtcgccctcaacgggacctacgtcctgatcggcctcatgatcggggcgggcgcggcactggtggtcggaggactcctctccgccaggaaaagtgacaacggcaccacaacacggaagtcttgaaccatggataaattcttcagcatcatcaggggcctgggcctgaaacgcggaccccagcgcatcctgggaggcgtcctgggagggatcgcggcaaaactcaacgtggacgtggcctacgtccgcattgccttcctcctctttgccctcctccccggccctgccttcgttttctacctcgtggcctgggcaatcctgccggaccagcggaacgtcatcccgctgcagtcgttcctcgacaggcggtcactgaaccgcccgtaagggaccgccacacagggccccgctcctccatcctggagcggggcccttcgtgtaaccagtttgtgtcgtaccgcacacaccgcactagactctatgtgagctcagcgtggcgctctgcctgtaaaccctctccccaggatttgagcgagacatgaaaattggaatccttaccagcggtggcgactgccccggactgaatgcggttatccgcggggcagtccttaagggaattgccatccacggccaccagttcgtcggtttcctcgacggctggcgcggcgttgttgagggcgacatcatcgacatcccccggaccatggtccgcggcattgccaagcagggcggcaccatcctgggtacctcccgcaccaacccgttcgaaaacggcggcggccccgaggtcatcaaggcccacatggagcgcctgggcatcgatgccatcatcgcgatcggcggtgagggcacgctggcggcagccaagcggcttaccgacgccgggctgaagatcgtcggtgttcccaagaccgttgacaacgacctcgacgccaccgactacaccttcggtttcgacaccgccgtgcagatcgccaccgaggccatcgacaggctccggaccaccggggaatcgcaccaccgctgcatgattgccgaagtcatgggccggcacgtcggctggatcgccctgcacgccggcatggctgcaggtgcccacgccatcctcattccggaacagaaagtcagcatcgagcagatcaccgaatgggtgaacgaggcccatgcccgtggccgtgcgccgctggtggtcgtggctgaggggttcgttcccgagcacatggaaaccccgcattccgagcgcggccttgacaccttcggccggccccgcctgggcggcatcgcagaccagctggcccctgaactggaagcccggaccggcattgaaacccgggccaccatcctgggccacatccagcgcggcggcgtgccgtccgccttcgaccgtgtcctggccacccggctgggcatggcggccatcgactcggtggttgagggctactggggcaccatggtggcgctcaagggaacggacatcgagcacgtgggcttccaggaagccctgggcaagctgaagacagtcccgcagaaccgctacgacgaagctgccgtcctgttcggctgagccgtcctgcacccctgaagacgctgacggccgatgtgtcctgtccggctggaccggttgcccgtcctaggctgggagcatgacactcgaccccggttcggccgccatcatccagcttgcgtgggcccggcgcctggggctggatgatgacgccttcagctccgccctggcctccggggaacgcatggtccgtgccgacgagtcggcgcggacggtcgagttcgtccggctgttcggcagctcggcgctggtgggtccgcaatgggtcatcgacgccgcggctgacctccccgacgaggaaatggcgcagcacgtcacactgctgaccctcaccagggggcacggcgggcacggcctgggggcagccgcactcttttttgcggatgacctgcccctcaggcagccgtcggaggagatgaccgtctcacacggcaacgctgaagcgatcgagcttgagggccgctgcccgccggacgacgtcaacgaggtggggctctcagacctggagaaccgctacaccatcgtccatgagctggatgggcaccgggtgccccttgcctgcggcgcgtactcagagtgggaagggctgctggcgcatcttggcgtcctggtggatcctgaatggcgccggcgcggactgggctccctggcagcgtctatcgccgcccacgaggccctcgcggcaggactgaccctccagtggcggacggacgtcagcaacacaggttccctggcgctggcccggaagctgggcttgtcagccggcggtatccagaccagcgtccaccttggctgaccccggcaggcctccgccccagccctgaaccggctgcggcttggcgaagaacagcgccaccgccgcgcctaccaggatgaccccggcaggcagcagcatggactggcccatcgccgtcgcaaatccggcatgaagggcctcgggaaggcctccggacagggccatgccctcgcccgccgccccgccggggccaccgcccggaagctccgcggcgagccgcgcttggatcagcaccgcaatggccgcgctgcccagcacggcgccgatctgccgcgtggtgttgtagacgccggacccggcccctgcctgccgcgggggaaggttgcgggtggcggtggtgctcagcggagcccagatgcctgcgttggcgaaccccaggatggcgctgggcaggaggaacagcaggatgggtgtgtccggctgcatcagggccgagttccacacgagggcaacggccatcagcaccaggccggcggcggtgatgaacttcgggttgaccttgtcgatgattttccccaccaccggcgccaggccgcccgagatcagcgccatgggcaccatcatcagcgcggactgggtgggcgtcaggccgcggaccagctggtagtagaagatgagtggcaggctcaacgcggtcacggtgaagccaacggtggtgattccgatgttggcgagggagaagttacggtcccggaagagtgccaggggcagcagcggctcgcctttgttgaaccgctgccagaccacaaagagggccagcacggcaaggccggcgatgatcaggccccacacggtgacgggcccggcgatggtgccccagttataggtttcgccttcctggatgccgaacaccaggaggaaaagtccgacggcgctgagcaccacaccggggatgtcgaaccggtgccggtgggtactaaggaccggcacgttgcgcagggcgaggatgaaaccggcgatgccgacggggacgttgatgaagaagatccattcccagccgagaccgtccaccaggacgccgcccaggatggggcccacgagggtggccatgcctgcggtggcaccccagatggccatggccgcgccccgccggtccgggggaaaaatgcgggtgatgacggccatggtctgcggcgtcatcatggcggcgccgagcccctgcagcacgcgggctgcgataagtgtctccacgtcgccggagagcccgcaccagagcgacgccagggtgaagaccaccaggcccgagaggtacagcttcctggggccgaagcggtcgcccagcctgcccgtgatgagcagcgggaccgcataggccaaaaggtaggcgctggtgacccagatgaccgagttgatgtccgcgtccaggccctccatgatccgcgggtttgccacggacacaatggtggtgtcgatcaggatcatgaagaacccgatcaccagggaccacagggccggccagggtcttgctacgttttccacggtcgtccttcgtcaggtggttactgccgggcgggaccaggtgaacggctgagtcacacctaggccaggaggtccaggatctcctggcgggcgaacatctgggcagcggcgcgggccgagggcgcaccggcgtccgggtcggcaccggcatccagcaggacccgggccacatcggtgtagcccttgaacgccgctcccgcgagcggagtctggccgcggtcattggcggtgccgggtccggcgccgtgttccaggatgagctgtacggtctccgcgtggccgtggtaggcggccagcataaggagggaatcccctgccgaattcgtcagcgtggcgggagcgccggcgtccaggtaggcacgtagcagcgctgtgtccccctccctggcagcctggaagagcgtgtgcgccaaagccagcgcgtcgtcgtcgggccctgaatcgggctggacgttgtcagtcatgggcgcggccccctcaggaatccggtctggcgccccaccacctggccggcgtcgggggcaacgatgagttcctgggcggcagggtatggctcgtcgccgtccaggaccgtcagtatttcatccggcgcgacggaacgctttatgactgccagcgcaaccgggcccatctcgtaatgctgggccacggacgtcaccgtccccactttgcgctcccccaccaggaccgggcttcctgcctgcggcagggtgtgctgggatccgtcgagttggaggaacacgaggcggcggggcgggtggccgaggttgtgcacccgtgcgatggtttcctgccccttgtagcagcccttggccaggtgcaccgcggtccggagcaggtcaagttcgtgcgggatggtcttgtcgtccgtttccgccccgatccggggccgccaggctgccacgcgcagcgcttcggcggcaaggacgcccgcaaggggccgccccgcaactgtctcctccaggtcatcggccggaatgaggtattcgaaccacgggcgctcgagcccggggtggctggcctccgggacggtcgcataggagtagccgccggccccaacatgcggccacgggtcctgccaggccagcaggccggaccactccgggacagttttggtgctgccaacaacggcccagttcgcggaagcatcggcgatgtccacccgcagcatgaacttcatcctgttgaggaacccggcgaggggtgcggcctcggcagcttcgacgatcagccaggtggtggcgccgtcgtcaatgacccgcgcgtcaaaatcaatcctgccctgcacgctcaggaggaggagttcgctggattcattcggctgaaggccggcgacctgctgcgaggaaagggtgttgagccagctcaggcggtccggaccggttaccgtcacaacgccgcggtgggagaggtcgacgacggcggttccggccgcgagggcgcgctgctcgcgcaggggctcgccatagtgggcggcaacgccggcgtccgcgccggccgcctcaacggcgccagggcgcgacagcagggggctgggagtagtcatatgtagtagaagtccttggggctcggcggtattccggattttcatggccggagtggatccgggccgcctgcgtcttttatgccgaaggaccgggaggagtcaggaaacctttttcatgaaggccgaggcatgcgcttccaggcccttgccttccttgccgccaacagcaacatcccagcgccacaggaggttgccgtccaccaggccaaagatgcgcgtggcggcgctgtagtccttggaatggctcccgcgcatcaccatatccgtagtgagctggatctgcgggcccttgatctgcccgtagtacagctcggaaatgcctccggggtgggagatggacaccgagatgtcgaacccgccctcgctgttgcgcagggcttccacctcgtccgcactcttcagcgcgggaacgatgtccgcggggatcaggccggggccgccgtcggcatcaagctgcttgcgctccagcgcccaaaagccggtctcgacagtgagcggccgcaggcgcgtgccgtcgtcgtccgtcagccagctttccgcacggtactgaaggtacggcagcccgttgtgcgtaaaggacacgtgctgcaggaagtgctccgagtcctcgtcaccgctgccgaggcggccgcggccctcccactcaccaatgagccaggagagggggacgagttctggagtcaggtctgtagggatttcaatgggcacagcgactacctctggaaatcggctagctcaggaagaaggcgtctacttctggcccttgaagaggcggtagaccacgaatccggcaaaccaggccatggcgaggctggcgatgccgagcaggacaaggaagaagatttcaaaagcaagtacggacatgatgccatcctaacgcgttagtagatgaggagtttgtctatgaagtaggcaagggaacccaccgccgagacaggggcaaggcccatgctaagcgcagcgggaacgttcaggggcgcaccccgcagggtggccagtcgccggaagctcgccagcaccgcgcccaccaccacgccgaagatggctgccggcaggacggcaatgtccgagagcaccagcccggcgaggggtcccgcgaggcctgccatcacaatgcccaggggcgccacgacgctgtccggccagcggatcagcccggccagcagggcaaccgcggcgctgatggcggccacgaggagcatctcgcggacgccattgaaccgtgcgccggctatccatccggaaccgaggcaggcgagcagcacacccgcgcagcagcccagggtggattccaggcgctgggcctgccctgttccgcggagcagctgcacgatgaagacggccatcatgcccagggcaatgaacgccggggtccagtcgaggtagccgggggcaggggccaggccggcagcaaccgccgccccggctcctggcacggcaatgacggcggccagggttttcttggcgggaatccgaaggaagtgcggccacccgatgccgatggcggcagccatggcaacagcgacggccacgagcgcttcccgggaggtgtagacaccggcgatgatcgcagcgaggccggccatccccacaatgccgatagtccaggagcccaacgaccgcgccggtgcctgcagctccgcggtcatgcggagcccggcctggatttagtttctgcactcactgcgctgcaatcccatcctggcgtcgacctggaagggcgggaccgcccttcgcggagggcgtcggggccctggctcaatcctgccttatatgaacgggatatgtcgcaaaacgtcccctcatccgggccggatccatggctccggagaggccggcgggtatactcaaagctcagctaagctcactgctgaggtggcaggccggcccttttccgctggcccaaagccggagcaggaagccagtaccggccggtgaaaacccggttcagtcgcccaatgatgcgcggacggcccatggaggaacaatgtcgcacatcctgctcttgacgaacagcactggctcttcggtggacatcctgcctgccctggaactcctgaaccaccgggtccacatccttcctgccgagcccacagccctgctggagaccgatccgtgcgacatcgtgctgctggatgcccggaaagacctggtgggcgcccgttcgctcacccagctgctcaaagccaccggcctcagcgctcccctggtcctgatcctgaccgagggcggcatggcagccgtttcctccgcgtgggccgtggatgacatcgtgctcgattcggcaggcccggccgaggtggaggcccgcatcaggctgtccgttgcccgcgccgtcccggaccatgaggacgcgccgacggagatccgcgctgccggcgtggtgatcgacgaggcgagctacacggcccgcgtaaacggcgcaccgcttaacctgaccttcaaggaattcgagctgctgaagtacctggcgcagcaccccggccgcgtcttcacccggcagcagctgctcaccgaggtgtggggctatgactactacggaggcacccgcaccgtggacgtccacgtcaggcgcctgcgggcgaagctcggcgccgaccatgagaacctcatcagcacggtgcgcaacgtgggctaccgccttaccctggtgcggcagcaggaagacgagctcaccgaggcctgagcgcccttgcggcatcccgtatagccttgcctcatgactccagcgcatcctgagaagtggcccgtccatacggaacggggcgcggttgaccagcagctcctgaaggactgccggaacctcctggccgcggcagaagaatctgacggcaacccctccatttcggagcagaccctggtgaccatgcggaccggcggatcggccgggcagtcaccgctgaccctcgccctgtatgccccggacgaggactccgacccggccaccggccaggacctggccggattcgccgtggtggtggaggaaccggacggcaccggcgtgctcgagatcgctgtccatcccagctaccgcaaccagggcgtggcagaccgcctggtgggtgcgctcaagggcagccgcgggctggaggggctgaaggcgtggtcccacggcaaccatgaggccgccgcggacctggccgcccggtatgggttcggcccggtccgtgaactgtggaagatgaggatgacgacggcggaagcggaccttcccgaggccgtcctgccggagggcgtgtccctccggagcttcgtacccggacaggatgaggacgcctggctggcggcgaaccgcgccgcctttgcgcaccaccctgaacagggaagcctcacccgggccgatctcgaggcccggatagccgaggactggttcgacccctcaggtttcctcctggcagaggacgggcagggccggctgctgggcttccactggaccaaggtccatccgaagcacggcccgcacccggccatcggcgaggtctacgcggtgggcgtggcgcctgaagcgcagggcatgggactgggcaaggccctcacggttgccggcatccggcacctccaggacctgggactgcacgccgtcatgctgtacaccgacgccgacaacgcggccgccgtgtcgctgtaccggagcctgggcttcacccgctgggatatggacgtcatgtacggacaggcggcagctgtttagtccagcaggctgacatacggctcccgggcgggaaatgcacggccttcggcacactgattgcttgtaaggttggaagcagaacccgcgcaggccggaagcgccagcatcaaccgccaggtaaaggagatgccatgaacccggaaccttccggagcagtcacgtcccaggacgtcgcagtgccggtccgcgcccgcttcgggtcctcggaagttcccgcctcgcgcgccacccaggaccgcatcgacatcccggagtttgcgccgaacctgcagccggagggcgacatccgtccggaccggttcctggaccgtgaactgagctggctcagcttcaactcccgggtcctggaactggccgaggaccccacgctgcacctgctggagcgtgtgagcttcctgtcgatctttgcttccaacctggacgagttcttcatggtccgggtggcaggcctcaaacggcgcatcgccaccggcctcgcggttccctccccggcaggcctgagccctgttgaggtgctggagagaatcagcggtgaagcccaccggctccagcagcggcacgcgcaggtctgggccgagcagatccgcccggccctggcctacgaacacattcacctcatgcactgggacgagctggacgacgctgcccaggagcagctcagcgtgatcttcgccgagaaggttttccccatcctcacgcccctggcagtggatccggcgcaccccttcccctacatttccggcctctcgctgaaccttgccgtggtggtgcgcaacccgatcagcgacaaggaactctttgcccgcgtcaaggtgccggaccagctcccgcgcctgatgtccatcgacggtccacgcgccggcgccgtggccggacgcgtggcgcgcttcattgcgcttgaggaagtcatcgcggtccacctggacaagctgttccccgggatggaggtcctggagcaccacagcttccgcgtcacccggaacgaggacgtggaggtggaagaggacgacgccgagaacctcctccaggccctcgagaaggaactcctgcgccgccgcttcggcccgcccgtccggcttgaggtcaccaacgacatcaacccgaacatccgcgcgctgctgatccgcgagctcggcgtcgaggaatccgaggtctattccgtcccggcccccctggacctccggggactttccgtgatcgccggcatcgaccgcgccgaccttcactacccgaagcacgttccgcacacgtcccggtacctgaacgagtcggagacgtccaaggccgctaacgtgttcgcggccatgcgccgccgggacatcctgctccaccacccctacgactcgttttccacctcggtgcaggcgttcctggaacaggccgccgccgaccccaaggtccaggccattaagcagaccctgtaccgcacgtccggcgactcccccatcgttgacgccctgatcgacgcggccgaggccggcaagcaggtcctggccctggtggagatcaaagcccggttcgacgagcaggcaaacatctcctgggcccggaagctggaacaggccggcgtgcacgtggtgtacggcatcgttggcctcaagacgcactgcaagctctcgctggtggtgcgccaggaggttgacgggctgcggcgctactgccacatcggcaccggaaactaccacccccggaccgcccgctactacgaggacctgggcctcctgaccgccaacgagcaggtgggcgaggacctgtccaagctcttcaaccagctctccggctacgcgcccaagtccacgttcaagaggctcctggtggcgccgcgttccgtccggtcagggctgatcgaccggattgagaccgaaatccgcaacgcccgcgccgggattcccggccgtgtgcagatcaaggtcaactccatggtggacgaggccatcatcgattccctctaccgcgcgtcgcaggccggggtaaaggtcgacgtagtggtccgcggtatctgctcgctccgccccggggtgcccgggctcagcgacaacatcaccgtccggtccatcctgggcaggttcctggagcactcccgggtgttcgccttcgcaaacggaggggatcccgtggtgtacatcggctcggcggacatgatgcaccgcaaccttgaccgcagggtggaggccctggtccagctgtccagcgtcgatgacatcaactacgtccttgacctgctgcggcgctacatggccccggaaacctccagctggcacctggacaacgagggagtctggacccggcaccacctctccgacgacggcaagccccttgaggatgtccagtcctggctgctggcgtcccgcccccggcagcgcagcctgagccggcgttaagggcacctgttttgtcgagcgatgcactcgtagcagaccagacagaccacccgggggaaccagtagccgttacggctgccggcgctgtgccgtggcgcgtggtcaaggacaagcttgaagtcctgctgatccaccggccgcgctatgacgactggtcctggcccaagggcaagatcgacgacggcgaaaccatccccgagtgcgcggtccgggaggtccaggaggaaatcgggctcaccgcccaactgggcattccgctgccgcccatccactaccacgtggcctccggcctcaaagtggtctattactgggccgtcaaggccaacggggcaaggctgcttcccgacggcaaggaggtggacagcgtcatgtggtgcgcccccgaaaaggccgtagcgctgctgtccaacccctccgacgtcgtgcccctgcagtacctgcaggaagcccacgggcgcgggcacctggacacgtggccactcctggtgcttcgccatgccaaggcaaagccgcgctcctcctggagcaaggccgaaggcgagcggccgcttgccgctacggggacacggcaggcgcaggcggtgagccggctcctgcacgcctggaagccgcttcgggtggtgaccagcccctggctgcggtgcgccgcaaccgtggcaccctacgccaaggcggcgggcgccaaggtgaaactcgcggaagcgctcaccgagcatcggcattcccgcagccccaaaaaaacagccgccgccattgaagccctgttcgacaagcagcgtgcggtggcggtctgcacgcaccgcccggcactgcccaccgtgttcgggcagctcgccgagcatatgccgcagcacctgcgcgcactcctgccgggaaaggagccctacctctcccccggcgaactggtggtgtgccatgtggctcccggcggtaagcggcgcatcgtagcagtggagcagttcaagccgtttgacgattagagcggccgctgccgcgtgcttgacccctggcactttgtatcaaagacttagtacattgatgcacaattctgggggatgacgtgccgtttaccgatgcagccgtgttcagcaatgttccgccgatggccgttttatggccttttctgctggcggccggcagctacctcctgcttcgctgggtcatctgggggccgggcagcggctccgcggccactgcctcccagcacgcattctgggtggggatcatggggtggctggccagttccctgcagccggccggaaacgcgggcatcctctacgttaatccggactcccggccgctcatcagcaccgcggccatcgtgcccgccctggcctggccgatactcggatgcctggctgttcacgccatcggccagctgagttatcccggcccccggttaccccggcgccaggcggatctggaagcgcggcgggtccgcgacttcctgccccggccactcgcctggactgtccttgcggtgtttgcagggaccgccgtgctgatcggctggatggcgacgcttcccggctacgatccggtcccctacagctcccgccccgaccccgtccacacctatgtaacgtctggcggcgacggccgggtccccggcgtcgacctggcttcctacctgggccctgccctccttgttttggcggtgggaacctggctggtgctggtgctcatcacgcggcgccgccggcttgaggcgctggatactggggagaacaacctcctcaggaccattgccatgaacaggttgctccggaccgtggccaccatagcctcgggcctggcggcaatcgcgggcaaccacgcggcacggcccgatccttcccttgttagcagcgggtggatcaacgcggccggggcggtgaacctcgcaatcctgctggccatgtggtggtgggccccgcccaagctccccgcggtccaggcagacggcaccgtacttcaaccccgtgtaccggcagcggcctcccaccccgcaacccggcttgccatgtccctgggagcagccctggggcttgccgctttcgtcccagtcctggtggcggtgatcattccaggggcggtgacggggcataccgcccttgtggtggcgatggccgccgcgcccgtcctgctggtcacgggcgcgggggaactgctgatccagcgcaactacggaacccccgaagcgccgcgcggatggccgcggcagccggtcagtccggccctgctcacaaccggcatcgcagccctcaccgtactggccgcagccgtcgtggtgaccgcttctgtccaaccggaacttcgcatcctgccgtcctgggctcctaccctttgggcgtccgctgcagtggcgctcctcgcagtcgtccccctggctgccgcgaaaggccggagaggcattccgacggcggtccccgggctcgacgcagcgctccgcgccatcaccgtacacagggtagtccggaccctcgccgcctcttttacggtgcaggccggcgtgctgctgctgtcagcagggccggacatacagcgggcacttgacctggaacctgcgccctgggcctgggcctgggcctgggcctgggcctgggatgtggcacccttcactggcgtgctgttgtgcaccgcggggatcgtcattgccgtgattcccgtgcgcagcttcgcccgtaccaccgtttccggccacacccctgcgaaggaacccgccacatgagtgccgggattaccgttgacctgcgctccgcaacgccgccgtatgaacagatacgctcgcaaatcagctccctgatcgcgttgggtgcgctcgtccccgggagccgactgcctactgtccgaagcctcgcggcggaccttggtatcgcagcgggcactgttgcccgggcctacaaggagctggaggctgcgggactcgtggatgcccggcggcggggcgggacagtcgtcgccgcgccggccgccagcaggccgggcgcccgtgggacggtgcccgtcccggccgcggtgctggccgccgtcgaccattacattgcagccggccgggcagcgcgcctgagcgacgaagtcctgctggatgtgttgcgcggcaagctgggacgggacgcaaggtgacacggacacccagccgcccggtgatgtccaagtagacttgagccgtgagcatcccaacgccttatgaagacctcctgcgcgatgtcctggcctccggcacgcacaaatcggaccgcacaggcaccggaaccaccagcgttttcggacgccagatccgctttgacctggccaaaggtttcccgctgatcaccaccaagcgggtccacttcaagtccgtggcagtggagctcctgtggttcctgcgcggtgagaccaacgtgaaatggatgcaggaccagggcgtcaccatctggaacgaatgggccgacgccgacggcgacctgggaccggtctacggcgtccagtggcgcacctggcccaccccggatggcggccacatcgaccagatcgcggagctgatcgagaacctgagatccaacccggactcacgccggcatgtggtgtccgcatggaatgtctccgaactgcaggacatggctcttcccccgtgccacgccttcttccagttctacgtagcggacggcaagctgtcctgccagctgtaccagcgctccgcggacatgttcctgggcgtccccttcaacattgcctcctacgcactgctcacctgcatggtggcgcagcaggtggggctggagccgggtgagttcatctggaccggcggagacgtgcacatctatgaaaaccacatggaccaggtcctcaagcagctggagcgcgagccctacgagtacccgcagctgaagatcacccggaaacccgagtcgatcttcgactacacactggaagacttcgacgtggtgggttacaagcaccaccccaccatcaaggcgccgatcgcagtatgagcaccgaaaactccacggatccacagtccttcaccgaagagcttgccgcctcgaccaccggggtgggcctcatttgggcgcagaccccggacggggtcatcggcaaggacggggacatgccctggcaccttcccgaagacctcaggcacttcacccggctgaccacagggcacccggtcatcatgggccggaagacctggctgtccttcccggacaagtaccgtccccttcctgggcggaccaacatcgtcattacccgccagaaaagctgggccgatacgcctgaggcgaagggcgccgtcgtggttccctccctcgatgacgcgctgctggaatcgcagttcgtggacggcggcgacactgtctggatcctgggcggcggcgaaattttccgccagtcaacggaactggccaacgtcgcggtggtcaccaccatcgatgtggaggccgacggcgacacgttcgcccccgaccttggcaccagctgggaggcggccgcctccgtccctccggacggctggctgacggcagagaacggcacgcgttacagattcaccaaatggtcaaggactgaaggctagatatgttgaagaaaccggaaaccctttttgtcctgggctacatgctgctccccttgctggccctcctgtccgcaatcgtcgggctgaccatgatcctgggcggcaacaaaatcgccggagcgattgtgctggtggtggtgacccaggtcttcgccttcggggccttctttgccctgcgggcgcgcaaggctgcggtgctcgaggaatcggaacgcggctagcctgcgtaaccgtccgggcatggggacgacgccccatcgcggccggcccgatcctgacttaggctagggctgcagcagtcaggtgctgttcgaatatttgggggaagcctggtgtcaggaaacgtatggggcgccgacgtggcacagctgcgtactcttgcgcagcagttcagcaagacggcggacctgctgcagcagcagtccatgcagctgagcggccagatcaacaacagcccggcgtggaaaggccgcgacgccgtacatttccggtccgactggaacggcaagcatcggaccctcctgcagcagacggctacccgtctgaagcaggaatccaagctgttgctgaagaatgccgaggagcaggagaaggcgagtactgcccggggtgcgggcggctcggatggtcccatgactggagtgtctgccacctctcccacctctggcgtcacgggctggggtgcggactggatgtcagacggaaactcacccttccgaactggctgggacgcctacaacggtgttctcggccttaagaccgtgccgtggggacttcgcgatgtttcgcactttgccgccctgcacggcgacgaagtcgccgagaactggcgactggttttgaacagcgggctgtggcgggaggcagctgcggcggacaacatccgcggtgctttctccggtaccgccaacctcctgagcggaaaatttggtgactttgcggaaatggcacgcggagccgacgcggcaccgctgagcagggccacaatgcttgggttgaactccgccgggcacctgctgggaggagcaggggtggcgcttgatgggctggatacgatcaatgccatcgggaacggcgaaaccggcgatgccgtcaggtccggtctcaagaccgcgctcggcgcgctctccttcgctcctccgccggtcggagtgacctgtatggtcatcggcggtgcctgggccgccgtcgaactgatccccggcgccaaggatgcaatcgacagcggcttcgacgcctttggagactttgcagacgacgccgcggaagaaatcagtgacggcgtcaaggactttttcgggttctaggcactgaacgtaaaggatcgaggatagtgataaccgtagaagacaattccgtaggtttcggctttgccgagatggcctacattctccaactccaggacaccgcgtccgctggccggagcgcagcgtggctgcgcctgacggatgagacggccaatccggagctgcagagggccgggctgtcttcactcctggcgcgcggcatggccacggtcaccgacggagcggacgtctcattcacgcaaccggtggacgtggttgcctacacggtggccagggctgagcggtggacgcagctggatctcctccaaagcagaacccttggcgatactgtcgtgcagattgagtccgaccggacacaactgctgttccagccccgcaccatgcaggcctggttcgttttgccccaggatcagggactctcggctgaagccgcacagtcgcacatagtgcgccaacacctggaagctcacccatccggcggcgtccggctgagggccgaaggacctgagggacagctggagcttgtcgtacgcaagggagcagacggatgggtttgcgcaccggttgatggtgacgtcgtcggtccggctaccgagcccctcagcgacggcggactccttcagtggctgcagtcgttccgctccggattggcgctagccaatgactaacatccagagcaagaccgcgaggcaacggcgtccctacttctacgggtttgggcagggagacaccattcatgcctacactcccgaggagtggggcctcggaggctcggccgcatccagcgccagcaactccacgcacagcctggtcattctcactctggtcgaggccgtcattaccgtcccggcccttcttgccccgatctggctggtcatcggggttatccggctgaatatcggcgttgtcctcctgtgcctgttctgcaccatcctcttcacaggcggctggtttttcatcctgaaatccattcggcaggaacttcgggcacggaagctgaggcgggcccgtggactgcccaagccctggtacgcggtcacggacgatcaggcgcgcacatggttcgaagaacgcccgggaacggtggagatcacccggacaaactttccgaacagcggtcatccgttcccaggcgaaccatcatgatgggaaacgttccgggcatcaaaccgatcacttcagccggcggactgctcttcctcaccgtcctgatctcactggtatcctccgttgtggccggacttgccattagtttgctcaccggctaaggggtcaccaactggccccagttcattttcggctgcgccacagtgcttgtcctggtcccgacctcatgggcttactacttgaaggaacgcaaagccctgcgccttcggaaagcggatggaacaacccttgaacctcccgcccgccgctcgagcagccgagactggtaacagatccaacttctgggccagcagaaaggaaacgaatggtaacccgcaacggcccgcggtccgggcacgacgttgccgcggcgaagagcgacgggccgatcctccaccccaccgcaactggtggattgcatagttactcgcgggaagaactcggagtggtcaccgccagttcacacccccaagtgcggtctgccgccggcttcctggtattagccgttgtcttcgctgccgtcgcagtcttctcactcctgctggtggccggccccaccagcaggggtgaagacccgatgtggagtgccctgttcctgacattgttgggatcggctggcgccctctacgccgttcggatggcgagggtggcttcgagagccaaacgcctgcgggctgaacgcagactcccggaacccagcagccgccagcttgactggaatcaggaccagcatggccaggcgtagcaggggcgtgccgccggaacccggccatgttccttatcagccgcctgaaaagcggatactgcaccggctcgctgagaatggcgaggtagtggcctacaccgacgaagagtacggggtccgcaaggacggcggtccgggcatcaccaaacccgtgaattcctcgggcggtctgctgttcccggccatttcttctctcggcatgtatgggaggcctcgtctacggagtggtccagatagccctgacagaccagtgggaaatcctcggcagagtctggtgggtgtttcctgccaccctatttcccttctctaaagctgcgcagggccaggtacctcccgcggcccgtcgaatagggccccaggcgcgtgccgccgtcgtactttccctatcccgtccacagtgacgtaaccgactgcgcccttccggttgcgaagtctaaactggaccaatgactacagcagctaccccttccgtcggcctggtcggatggcgcggcatggtcggctccgtcctcatgcagcgcatgcaggacgagggcgacttcgccaacatcaacccggtgttcttctccacctccaacgccggaggtgccgcgccgtcatttgctggaacagcaggaggcagcgccggcaagcttgaggacgcgttcgacgtcgacaccctggcgaagctgcccattattgtcaccgcccagggcggcgactacaccaagcaggtgcacggcgagctccgcagccgcggctgggacggcctgtggatcgatgccgcctccactttgcgcatgaacgacgattcgatcatcgttctggacccgattaacagggacgtcatcgataagggcctggtcaacggcaccaaggacttcatcggcggcaactgcaccgtgtcctgcatgctcatgggcctcggcgggctgttcaagaacaacctggtggagtggggcacctccatgacctaccaggctgcttccggcggcggggcacggcacatgcgcgagctgctcagccagttcggcacgctcaatgccgaggtcagcacggaactggacgacccggcgtcggccatcctggacatcgaccgcaaggtcctcgcccaccagcgcaccggcatcgacgccacgcagttcggcgtcccgctggccggatccctgatcccctggatcgacgccgacctgggcaacggacagtccaaggaggagtggaaggccggggtcgagaccaacaagatcctgggcacctccgaggacaaccacgtgaccatggacgggctgtgcgtgcgcatcggtgccatgcggtcccactcccaggcgctgacgctcaagcttcgcgaggacctgtccgtggccgaaatcgagaagctcctggccgaagacaaccagtgggccaaggtggttcccaacaccaaggaagcgtccatggcggacctgaccccggtggcggcatccggcacgctggacatccccgtgggccgcatccgcaagatggagatgggaccggagtacatcagcgccttcaccgtaggcgatcagctcctctggggtgctgccgaaccactgcgccgcatgctcaacatcgccaccgggaacctgtaaccctccagccttcacttcggcggccctgccccgcacgaacggtgctgcccagcaccgtccatgcggggcagggccgctcctgcttggcccggacgctctctcatttgatgcgggttaaaccgagacgctctctcacttgagcagcggaagtgaaagagcgttcgtgaagaaccgacattaagtgagagagcgtcccggtcagctctccaggaacctgaggtaccggtctgcggccttcctcatggcggcctgggcggcggggcccaggtgcctgccgggttcaaagagttcaggcacgacggcggcatcccggcgggtgccgtcccgggcccaggtgccgaccacttctcccccggccaccagggtcttcttgaaaacgccgttcccgccgggcacgatcctgtcaaagtgctccgggtgcaggacggctgaccggtccttgtatcccagcaggaactcatcaaacccgggcagcagcaggacggaccgggctcccggaaccccggcatccagcagggctgcggtctccggcgacatccagtaccccgcgccgccgaactggtattccacaagccgcccgcggacattttcgaacgcggcccgcacctccgtcagcgggagctgggtccaccacgcgaaatctgccagggttgccgggccgtggctgcggaagtaccgcaacgcgaactccgccagggcctcctggcgctccaggttccgcgacaccgggatccagtcatcgaaggccaccagcagttgttggttcttggccagcggcccctgcaccagccacgcgtgccggcacagtgtccccaggaggtggatgccccgctgcccctgcgtcggctgcccggcggcgtcgaacacctggaacagacccgcccggctcacgggaccgccggcggcgatgtgctccagcgcaacatcccggcacttctcaacgtccgcccacgtgatgcccagttcccggtggcgggccgcgatgcttttggtgagccgctccgccgtgaggtccagcatccagcgcaggtcctcgggggccacgagatgcagcgtgccgcgcatgggccacgaccggaccacggccccggtgtccagggcggaccggacgtcgctgaggccggatccgggcacccgcgcgcccacggcccacatggcggcctgcaggtcctgggcctgcatcgctgtcatccaacgcacagcttccgcaaccgatccgaagctgtccgttccacccgcaagcctgtgggaggcaagcctcagcctgcctacgatcctgccgtctggacggcccttgccagcagccatggccctatcttagggcgcgccactgcccgccggtcacagaccgctagggtagaaccatgactttggggagtttgtggcggttgctcgcgcttaaaacgaggtggtggatggccggtggcacggtctgcgtcctggcaggatccggcctggggctgctcctcctcagagatggccggtccgatcccctgctgctgctcccctcgctcgtcctgagcctcggcggcggctatgcggtgcttttcccgggcatcagcgtcagccgccagggagtgaagctgtaccgggactggcggcaccacccgcccgcggcaaaggtcctctgggtcctgtccctcgccgtcgccctcggcggactggtggcctgcatcctgtcaggcctcgcaaacccgctgttgccgggccagctggtatggcttttcacgggaatctacctggtgctcgccggctggtcgtccgccctgctgggccaggcggcggtggtccgcgccaaggccccgggcatggcgggcgatcctgccggtgctacagctccaggccgataagcagcggttccgggtgcagttggatgccaaagcgctgttcgacgccggcacgcacctcgcgtgccacggccaccacgtcctgggcggtggctgaaccgcggttggtgatggcgagtgtgtgcttggtggacagggaggcccgtccaccgctgacgctgcctagttccagcccgaaacccttggcaaagccggcctggtcgatcagccaggcggcggacagcttcaccagcccgtcctgaccggcagggtaccggggtgcgccctctggcagggccgcagccacctcggccggaacgatggggttggtgaagaaggatcccgtggagtacgtgtcccggtcctgcgggtcccacaccatgcccttggaggcacgcagccggagcacctcgcggcgcacatcgttcgagtacgcgcgcttgcccacttcgacgccaaggacacgggcgagttccgcgtaacggatcggcgcgctcatccggcccaggggcagctggaactccacggtcagcaccacgtaccggggtgagccgttgacggtggtctgcttgaggatggagtcccggtagccgaacttcagctccgagttcgtgaaggtttttactgcgttccgctcccggtcccacgtgcgcactgccgcgatggtctgggacacgtcggcaccgtaggcacccacgttctgcaccggcgtcgcacccgttgatccgggaatgccagccagggcctccaccccggaccaggcatggcgtaccgcgtgctccaccagcttgtcccagttgtgcccggcctgcaccaccacggccacgccgccgcaggagtcctccgcgttgacggtgaacccctgcgaggcgacctggaccacggttccggggaacccgtcgtcggaaatcagcaggttggagccgccggcgatgatcagcagctgctcccccgcggcatccgccgcccggacggcgtcgatgatctcagcttctgttccggccttgatgaacttgtgggcagggcccccgacggcggccgtggtcagctgggaaagcagggtggaagtcacctgtccaccctatcgggaaagtgttgccgccttcccgggctatgccagtttgacgaccgcctgggccttcatcaggaccttctggccggcggccatgacggtaaggtccacccgcgcggtgttcgcctcggcgtcgagctttccaatgatgccgctgacctcgatggtggcgccggcgtcggccgtgcccgtggtgtcggtgaccaggacgggtttggtgaaccgggtctggaagtcgacgacggcggccgggtcgcctgcccagtcggtgaccaactggacggcggagcccatggtgaacatgccatgggcgatgacgccgggcagttccacactggtggcaaaggcctcgttccagtggatggggttgaagtcgccggaggcaccggcgtacttgaccaggtcggtgcgcgtgacctcgatggtgcggctgccgatctcctggccggcgctgagttcgtggatgctgaggctcatggttactgtccctctccgcggaccaggatggacgacgacgtggtggtgacgggctcgcgggaatcatctgcgccgagggcgaagatttccgaccgggtggtgatcatcgcaccgccgcccatagcgcggacaccgtccacgtggagctccgcgacaaggcggtcccccgcgaaaatcggccggtggtgggtgaagcgctggtctgcgtggaccacgcgggagaagtcgataccggcttccggatcctcgatgagctgggcgtcggcacgctgggcgatgatgatggcgaaggtcggcggagccaccaggtcgccgtggcccagggccttggcggcgtcgacatcgaagtgcgcggggtgggtggcctttacggcgcgggcaaactcgcggatcttttcacggccaacgtcgtacacctctgcggcagggtagcttcggccctgcaggtccggattgatagtcatggcctcaagcctatcgttgccgcacccgcccgtggggcttgcattgccttgatatgatgaattcatcaatccatcaattcgctggcgccagtctattggtcttcagtgtcacgttgaggagcttcccatgctgccttccgcccaggctccgctgtacgagatcaaggccaacctcttcaaggggctggcgcaccctgcaaggatccgcatccttgagctgctggcagcggcgccccaggaaactgccgcggtgagctaccttctggcggagaccgggctggaggcctcgcacctctcccagcacctggccacgttgcgcaagcacaaggtggtgacctctgtgcgaaccgccaatgccgtgacctaccggctggcgcaccccgggatttcccagcttcttgccatcgcgcggacgttcctcctggacaaccttgccgattcaaacgaacagctccggctggcccagcagctgcccgcagggcacctggctggcggggctgcctcgtgaacccgggcgtaagcaccgcaaggcggcacttcaaccggttcctgccctcgaaactggattacgcgggactgggaacgtcgtggcggaccgacctgctggccggcatcaccgtgggcattgtggccctgccgctggccctcgcgttcggcgtcagctcgggagtgggtgcggaggccgggctcatcaccgcgatcgtcgccggcctggtggctgccgtgatggggggatcacccgtccaggtgtccggcccgaccggtgccatggttgtggtgctggctcccgtggtggcagtccacggggccggcagcgtggccccgttgtcactgatggcggggctgctggtctgtgtcctgggattcagcggcctgggccgggctgtcgccttcatcccgtggcccgtggtggaaggcttcaccctggggatcgccgccattatcttcctccagcaggttccgctcgccaccggcacgtccggcgtcccgggacacaacaccctgatcgctgcagtggaagccgcgtccaccgcaacggctccgacggcgctgctgaccctcgcagtcgtggcgggcgtcgccgtcgtgatggtccttgtgcaaaagctgctcaaggccctgccggccagcctgatcgcggtgctcctcgccgcagcggccgccgagctgttcctgctggacatccccaggatcggccccctgccgcattccctgcccgctccggcggttcccgcctttgacatcgatctgttgggcagcctggccatgcccacggcggcgatcgcctgcctcgcggccatcgaatccttgctgtctgcccgggtggcggcaggaatgaccgggcccgacggcaggccgagtggaccctacagcccggaccgggaactgacaggccagggcctggcgtcaatcgctgcgggcctcttcggcggcatgcccgccaccggggccatcgctcggacggccgtgaacgtccgctcaggtgcaaaaacccgcctggctgccgctgtccacgccgtggtgctgctggcgatcgtgtacctcgcctcgggcatggtcagccgtattccgctggcagccctcggcggggtcctgatggtcactgcggtgcggatggtatccaggcggacggtcgcggcgatcctccgctccacccggtccgacgccgccgtcttcatcctgacggcgatcatcacggtggcgttcgacctgatcattgccatccagataggactcgcggcggcagccctctttgccctgcgcacgttcgcctcgctgagcagcgtacagcgggaggagatccccgggccccgggccgagggtgacgagcacatcgcggtcctccggctggacggggccatgttcttcggcgccgccgaacggatcctgcaggagatcagccaggtcaaggacgtccaggtggccatcatcaggctttcccagctgcggatgctcgatgccacgggcgcgcatgcactggtggaggtggtctccgcgcttgagctccggggcatcaccgttttactcaaaggcgtccggccggaccacctgcggctggtgacgaacgtgggagtgatccggtccctgcggcaccacaagcacctgttcgagcacctcggggacgccgtggaacacgcccgcagccacgtccgccgtaacgccggctaccgcttgtagcccttccggatcgcctggccgcggaccacgatcccggcgatgtgcagggccaggcccaggccgatcacgggaagggatgccgtggcgaggccggagttgccgctggtgttgcctaccaggttgaggatgataccgacggcgatcagccccatcgcactgaaaaccaggactttatagcgggtcggcgcggtggcccagaattcgttcagcaccccgccagtctaccgggggccgcgcccgcagcagcggctaattgccgggacgcaggctcagaacagcgcttcctggacggccggcacctcggacctgtactggcccagtccgatgctgcggcccttgagttggccgaggtccaccacgaactccagctcggtaccgtcgatggttgccagggcgaagctcccgcacagtgaagtaatggtgaagccgtgggagcccgccgcgagggcgtgcggatacaggtgccggcggcttgaggagcacagcgggtttgccagttcgggccggttccaggactcctccaccacctggaagccctccgcgccggatcgggaaaccacgccgcgggcggaagcggcgagggccgcgttatgcccgctgagccagccggccggggccggggaagccagtgcggctgccttggctgcggaccggacctgctgcggaagcccggcctcgcgtgtgaccaggtcctcgaggatccgcaccacgcgtccgtcggcggcgtgggcgacataactggccgttacggctccctgctccgcgaggcgttgccatttgcggagttccgcggccgtgcccaccttgctggcgccgttggcgaaggtggcgacgtagagccagtgtggctgcatcaggtagctgcgcagccccggcgggacccggccgtcccggtgaaagtcgtggatgagccgggagtcgtccaccacgaagcaccgctcgcactggtgtccgcggaccgcgggagcccgcctggcgcaaaggacgtggtcccggtgggcggggccgtgcaccacatggtggccgaggcagtgcttcccttcggaggcgagccggaagcccaggcgcgttccggcgtcgagcgttacgttgtggaaggtgccgtccggcgcctgaagccggaggaacgggcacggctcgacgttcccgccggcggttaggtccggaggcgcaggccaaaagaccccgtggaccagatagcgggtatcggtcacggggtctcctgaagtgaaagcgtgtgtactacagcgccggctgcaccccaaaggctaccgcgagcttcatgatcttttcggcgcggcccaggcggggcaggtcggagccgtcacggatgacgcgcccgttggcttcgaagtccgccatgaagtcggtggcccaggcgacgtccgacggcgtggggctgatgacctcgttgatgacgggggtctggtcgatggccaggcagagcttgccggtcatgcccatcatcacggtgatgccggtctgctcgcgcaggatggggtggttggtgcccacggtgggcccgtcgatggggccgggaaggttgcccacccggctggcgacgacgagcttggcgcgggggtaggccatggcctcgggcgtggcagccatgcccgtgtcccggcggaagtcaccggagccgaacgccaggcggaaggcgccctgtgccttggcaatgttgttcgcttcctcgatgcccagcgcggactccaccagcgggatgaccggcgtcttgccgtccatgcggtggaagctctcggtcacctggtctgcggattcggtcttggccagcatgacgcccaggagcccgggcgtgccgcgcaggcccgccaggtcgtcggcccagaaacggctggtggcgtcgttgatgcggacccaggccttgccgccggcggtcaaccagtccacaacgttgttccgtgcgtggtccttctgcgacgggtccacggcatcttcaatatccaggatgatcgagtcagcgcgcgacaccgcggactggtcgaacagctctgtcttcatggcattgaccaggagccaggaacgggcgatttctgctgggatattgcgttccggccttacggtctcggtggcgatggtagacgtcatgtatctaccgtatccgccccgcaacccggacaccgaagaaaatggcctgcttgtggggatcaatacgaactaaacccgatatgaccgggccgggcgggatctgggtagcggcaagtgtcgttttgagcgctcaaaacgacacttaccgctatctagttgggatgggtcaggggatgttgctgccccgcgccgtgacccagagtttgtaccagtcggcccgggtcatggtgccggccacgcgggcggcgtcggcacaggcacggatccgttccgggttgaccgtcccgatcaccggcgcgatgccggccggatgcttcatcagccatcccagcaggacggcttcgccggaactgccgtactcccccgccagccgggcgacgagctcggccgtggcggcatctgctgatgccgggctttccggttccgcccccgtgtagaggccgcgcgccagcgaaccgtaggcctgcagcgtgatggagttgcggacgcagtactcaagcgtgccgtgcgggaagctgtagtccaggtgctcggcgtggttgaccagcacctggctctccagccaggcccgcttgagcaggctcatctccagctggttggcaaccaccggggtttccagccggtcctggagcgcctcgatctgcgccccggacatgttggacacgcccagctgccggaccttgccttccgccatcagctgcccgacggcggcggccacctccgccgggtccgccaggggatcggggcggtggagcaggaggatgtccacatagtccgtccgcagccgcttcaggcttccgttgacccgctccaggatggcctcgcggctgaggtcgtagtgcgtctgcagcccccgttcattcagccggatgccgcatttggtctggagcctgatgcggtcccgcagccccggctgggcggccaggacttcaccaaagactgcctcagacttgccgctgcggtagatatccgcgtggtcgaacagcgtgatcccggcatccagcgcggcctcgaccgcggcggcggcctggtccacatgctccgttccatgcggctcgtcagaccagctgccgcccaggcccatacagccgtaaatgagttcctgcatcagacgggccgcccttccgggacgggtacaggcatcagcgcagccatgcggtggtgttgcctggcagcatgccgccctccagcggtgcgctgctgaccaggacggtccccgcggggagttcgacggcggtgtccccgaagttggtcacggactgccagccgccggggcggcggaagtgcaggatctcagggttggcgttctctatccattccaggtcctcatccgcctgcagttcgtggcgcagcttcattgcggtgcggtacagctccagggtggagccttcggtgccgtcctgtgcctccacggcgtacttgctgaaccagtccggctgcggcaggtgcgcgccgccgtcgccgaagccgaaggaggtgccttccaccttccagggcaggggaacacggcagccgtcgcggccgatttccactcccttgttccggaagaaggaggggtcctggcgttcggattcggggatctccgccacttcctgcagtcccagttcctcgccctggtagaggtaggcggatcccggcactgccagcatcagcaaggtggcggcgcgggcacggcgctcaccgagctccacgtccagctcctccttggggccgccggcaagcagccattccttgccgtcctggcccttgccgcccgccttgctcttggaaacctgcggcaggccgtagcgggtggcgtgccggacaacgtcatggttggagaacacccaggtggaggaggcaccggtggcggcggcctcagccaggttgcgggtgatgatctcgcggaactcatcggcgtcgaaatcggcctgcagcaggtcgaagttgaaggcctgcccgagcccctgcgggctggcgtagcgggcgcggcgggtggcgtgcacccaggcctcggccacggcggtgcgcggtgggttgtactcgttgaagacctcacgccactcggcgtacacctcgtggacctcgtcgcggtcccagaaggggtgcgtgccgtcgtcgaaaccgtccacgccggtgttggcggcgctcagttccagcttggacagcagcggttcggtgaggtccttggtgagggcgtgcgccacgtccacccggaagccgtccacgccgcggtcggaccagaagcgcagggtcttgaggaagtcgtcgcggacctcgcggttggaccagttcaggtccggctgctccttggcgaagatgtgcatgtaccactggccgggggtgccgtccggttcggtgatgcgctcccaggcggggccaccgaagacggagtcccagtccgacggcgggaactcgccgtcggggcccttgccgtcacggaagatgtaccggtcccgggcgggcgagcccttgggcgagacgagtgcttccttgaaccactcgtggcggttggaggagtggttggggacgatgtccgcgatgagcttgatgccggccccgtgcagcgccttggccatctcgtcgaagtccgcgagggtgcccagcttgggatcgacgtcgcggtagtcatccacgtcgtatccgccgtcggcgagcgccgaggggtagaacgggctcagccacacggcgtcgatacccagcgccttcaggtacggcaccttggaggtgatgcccttgaggtcgccgatgccgtcgccgttggaatcggcaaaactgcgcgggtagatctggtagacagcggcctgccgccaccagttcggatcggacaggtggccggaatcggacagggttgccagggtggcggtggtgctcacaacgctccttttatttagtatctaaattttttattgaccagtatgttccggccgggcggggaaggtcaacagcaatgctgcctgcccctccggacgccgcttcaggccttgagccaggcggttgattctcctgggagcatgccgcctgtgatcccgccgctggagatcaggacctcgccgtcaggaagttcgacggcggcagtaccgaagttcgccacaacgtgccagccgcccgggcgcacgaagtgcagcaccaactcgtctccgctgtggttccactccagggtctccgcaccttggagttcgtggcgcagcgccaaggcctggcggtagaactgcagcgttgaggtgttgctggcttcctggctgctggccgcgtagtcggcgaaccagtccggctggggcaggtgggcgccgttggcaccgaagccgaaggatggtcccgagggttcccagggcaggggcacgcggcagccgtcccggccaaggccgtcgtactccgcgccccggaagaatgacgggtcctggcgctggtcagcggggatgtccgccacctcgtgcagcccaagttcctcgccctggtagaggtaggcggagccgggaagggcgagcatgagcaacgtagcggccttggcgcggcggaggcccccttccacgtccagcgcttcgcggggaccgcctgctctgacccattccacccccggcttccccggccgcccgttgagcggttcgagaccgtagcgggtggcgtggcgggtgacgtcgtggttggaaaatacccaggtggtggtggagccggtgaggcgtgcctgttcgaggttgtcggtgatgatggtgcggaactgggtagcgttgaagtcggccaggagcaggtcgaagctgaaagcctggcccagcccttcaggggaggcgtacttggcgcgccgctcggccgtctccacccatgcctccgccacggcaaatcgcggcggatcatattcgttgaataccttgcgccattctgcgtagatgtcatggacttcatcgcggtccatgagcgggtgcgtcccggcggtgcggtccatcgcgtccagttcctgcttgctgggaagctcggcggggaggtccttgacgagaaggttggccacgtccacgcgaaagccgtccacgccccggtcggcccagaagcgcaacgtcgtgaggaagtccgcccgcacctcagggttgtcccagttccaatccggctgttcaggcgtgaaggtgtgcaggtaccactggccgtcgtccacccgggaccaggccgggccgccgaaagcggctgtccagtccgacggcggcagttcgccgtgctcacccttcccgtccctgaagtggtaccgctgccgggccggagaacccttgcccgcagccagggcttcctggaaccaggcgtgccggttggaggagtggttcgggacaatgtccacgatcaccttgatacccgccgcatgcaaagccgcagccattgcatcgaaatcttccaggctgccgatcttgggatcgacgtcgcggtagtcatcaacgtcgtagccgccgtcagccagggccgaagggtaaaacgggctcagccatacggcgtcgatccccaggctcttcaagtacggcaccttcgcggtaatgcccttgaggtccccaatcccgtcgccgttcgaatcggcgaagctgcgtggatagatctggtaaaccgcggcctggcgccaccagttggtggcgtccgcgggtccgttgtcggcatgatgcgtctggctggcgaggatggacaagcagtttcccctttccggggtgctggagttcttgatggcgtgcatgctggccgtactcagcctttgacggcgccctgcgtgacgccggccatgacccaccgctgggtaaagaggtaagccacgatagccggagccatggccatcagataggacgcaaaggacacgtggtagttgttgctgaactgggtctggaacaggttctgccgcagtggaagggtttgcagtgccgggtcggagatgatcaacgaaggcatcatgaagtcattccaggcgtagaggaaggcaaaaatgccgactgttgcgctcatcggcgccaacagggggaagatcagttgccagaaggtctgccaggtcgtggcgccgtcaatacgggcgctctcttccagttccatcgggatcgaccgcaggaaagccgtgaagagcagcacgctgaagctcaactggaacattgtggcgagcaggatcacgcccagcgggttgtccaggcccaggcggccggtcatctggatttgcggcagcgctacgaccggaaatggaatgaacattgctgcgagcaagtagtagaaggagtaccggaacaacctgcgttcccagttgcgcacaatcgcatacgaggcaaatgcggccagcacaatggtcgctaccacggtccctgccgtgaccagcaacgacatcgccgcgccgacggggaagttcgtcaacgtccacgcctggacgaagccgtcgatgctgaagggggcagggaatgagaacgcattgccgtccacagcctgcccctgggttttgaaggccatggacacggtcacgtagagcggaagcaggaccgtgacggcgcagaggaccaggatggtggtacccggccagttcacccgctctaccttcaggcccgggcgtcgtcgtccgtgcccggcaggggttgattcggtgtggcggagttcctcggcggtgagagttgagggtgtggtcattagagtgtgttccgtccgcgagtcagcgacagctgcaggagagagatcaggacagcgacgacaaagaagatcgtcgcgttggccatctggtaggcataatcgccaccgttgaagccggcgatgacggtcatcgcaatgcttcttgttgaggttcccgggccgccgttcgtgagtccaacgatgatgtcgtaagcgttgaggaagcccttgaatccgagaatgatgttgatcaccacgtagccggccacaagtggagctgtgatcttcaggagctgctggaacttgctcgctccatcgatctccgcagcctcgtacacgtcccccggaatggagacgaggccggcaatatagatcagcagcgccccgggcaccgcctgccaggcggtaaccaccacgatggcaatccacgcaaggtcagggtttgcaaggaggctcgtttccagccaggtgatgcctgccgccgcacctgcagcgggcagcgagttcgaaaacaggaagttgaaaacataggcgatgatgatgccggagaccaccatggggatgacgaagatggtacgcagcgctgtcttcatgcggatctgcgacgtgagccccacggccaggaggaaggcgatgacgttcaccaccagcacggtgacgatagagaagccgaaggtgaacaggtagctctgcagaatggccggatcgctgaatattgctatgtagttggtcaggccggcgaattcccagtcgccgattccaatggagtccgtgaagctgaagaagatgccaacgaggccgggaaccgtgatcgccagggtaaagagaacgaggctgggcaagaggaaaaggtagaagatcggttcgacccgccgcctgcggcggctttcggggcgtgcctgcccccgtctggttgctgtggtggtggacatgtgtctggctcccttgttctgcgctactggcggtacgccagacgcgcccagtctgcgtcgagtgtgcggaaggtggctgcaggatctgcgcccaacacgagcgcctgggtgtaattcataatggggatggtgcggggcaccagcaccgatggtccttggtacacatcgcccttttcgtagtactccaccatgccctcgattcgcgggtccggagccgcgtcggcatcgatggtgggcgtgaagcccagctgcgacttgttgtactcttcaataatttccggctggtagagatactcgaggaagtcgcgcgcagcgtccttgtgtttggattcctccgggatccacgccgcgagatcgacgttgacccgcacactcaggtcctcggggttgtccgtcatcggcagcggaaaggttcccagttggagattgggagcagtcttcgcgatctcgctgaatgcccaagggccctgcaggtacatggctgccttgccctgggaaaacgcgaggttcccgtcgccgtagccgcggctcgcggcgtccttattgacgtaggagttcgccagtttcagcatcttctcgacaggctgttcaaagtccttttgaaacgacactggcgagtccggtccgacgtccgtgccggcttcggcaagcttgtcaaagaagtcgatggtgtccacctggccgcctacggagtagtcaaaccatccctgggcaaccgtccagtcgtccttccaggtagcgtagaacggtgtcacaccggcggctttcagagcgtcacacgccgcaagcagctcgctccaggtcttaggcacctcgatgccgtgtgcggcgaagatctccttgttgtagatcaccgaggacgccatgaccgaatacggcagggcgctggtccggtccgggtaagaaccgtactggtccatcagcggctgcaggtccttccggatgcgggtggcggcctgcgttccggacaggtcgctcagcgcaccgcgctgcacgaaccttgccgtttccatgttgtagttcgccagcgcgatgtccggcggattgccccgcacaaaactcgccgagacgacgtcgacgccggaggtatcgaggacgacctccgtgctgtcctgcgaggcgttgtaatcggccaccagtttcgtcatgaagccgatggcctcccgcttactgaatgtgaagcggatcgtctccttgccggagtctcccgtgcagcccgagaggagcccggcaaggagggccaggcacaggccaagcgctgccatgcgtagtgtgcgcgtcagtttcaaagacaccctcgtcctttcgtggtgcggtagaacgccgcataatcacggcggcgacggctgatgcgtcgccgcaagttgatataagaggtaaatttagctcctatcgttagtatggggggcggaccgcgcaggggtcaagcactgcggaatatgtttcctcggctatatttatgacctaaatttagaatcacctgcggatgcaccctgcaagcaggccagaacggagttcccgaatgatgactgagactgcaccgtcaacgcagttggtgcggcgggtcaacgccagtgcgatgctcaaggcaatgcgcggggccggcatcatgacaggcacggacctcatggcggccaccgggctctcccgggccacggttatctcgatttgcgatgagcttgtccggctcggatggctccaggaactggaaaaccagcggggcgccgagggatatatcaaaggcaggccggcgcgcaggttcgttttcgacgaccgcgcggccagcgttctcggcatcgacataggggccaacaaaatcaccgccatcgtcgcggacatggggggcaaggccctctccagggtgaccacgcctttccgcgcctacaacgtacccgctgacgagcgcgccgacgtgctggaccgtatcgccgcagaggccttggagaaggcggccgtgtccgcggactctgtcctggccgtatccgttggagtcgccgctccggtgagccgcgacggcgaagtcctcaccgtccaggaattctggaagtctttcgacgtccgccggctggtctccgagcggcacggctggcacgtgctgctggagaacgatgccaatcttgccgccctggctgaacgctggcggggcacggcgcagggcgtggacaacctcgtcgttatgctcaccggggatcgtcttggcgccggcatcctggaatccggccgcctgctgcacgggcagcttggcggcttcggtgagctgggatacctgggcaatgtcgaaggggtcggcgacaccctcggcatcgcgcactacgtagcactgtggggccaggaagcgctcgccgccggcgccacaacgcagctggacgagctctgcggcggcgcagcggaacgcctcacggccgagatggtgtttgccgcggccggggacggcgaccaggtcgcccaggacgtcctcaaccgggtggcacatcgcatggcccgtgtgatcggttccgtgagcacgcttttaaaccctgaactcgtcgtcctcgcgggagccgtcgcagcctctgcgcgcacactcatccccgccatcgaaaagcagctaccggactttactttcactccgccgcgcgtagaggcatcctcccttggtgacggcatcgtttccatcggagccatccgcctggccctggattacgtcgaagagcacgcactggacctttatcccgcttcgttcccgaagcctgcccaacccgtttcctaaaggcggttcacgctacgcgggcgcctgcagggcggcggcgataggcaggctgccgtcacagaactcgatggtccggcccgttgtgtccggcatctccaggactgccacggcgacgcttgcggtgttgctgcgggaggtctcgcggcttccctccggggaggggtcgacgtcgatcaggccgctccccggcttgtccgtcaaggctccggggcccaggatggtccacgcgaggcctgtggttcgcaggtaatcatcggcggcggccttcgcgtcggcatatgcaaagaagctgttgctttcgggcacgccgtggttcctgccggctcccagataggagaccatcacgtagcgacccacgccggcgtccgctgcggcatccatcgaccgaatggcagcatcgcggtccaccgcataggtgcgcgccgggtccccaccgcctgcgcctgcggaccagaccacggcgccatgccccttcagcgcaacggcgatctccgccgtcgtcgcattttccacgtcaaggaccgacggcgttgcgccggtttccgcaacgtcgccggcatggtccgggttgcggatgaacgaggtgacgctgtgcccctcgtccgtgaggaagctagacaggtgcagggccactttgccgtggccgccaatgattgcgattcgggtcatggccctattctgctcccccggcccgccgatgccacgccaccggcgcgtcggcggctgccggtgtcagccggccatgcgatagcgcaggtacacgacgccgtttccgaaccggcgctcgtccaggagttcgagccggaccttcaggccgtcaggcaggaagcgcaggccgcctcccacggccaccgggttgaggaagatccggcattcgtccaccagcccggcctggagtgcggcggctgccagggtggcaccgccgataccaatgctgccgctactgtccgctttcaatgccctcacggccgcgggatcgaaggagcgccggactattgtacgcggagtaggcgggagcttcagggtttccgagaaaacaatcttgtccgccgcccgccagatccggccgtagtcctggatcacgggcggatcgtccggccctcccagcgtttcccacacggacatgacgtcgtacatgcgccgccccagaaggtaggtcccggcttcgcgctccaggtcgttgacgaaggcgtgcacttcctcatcgggcgcactccagtcgaagttcccgttgctgtccgcaaggtaaccgtccaaggaggtgatgccggtgtagatgaggtcagccatgcgcccattctgcctctccggccgggtttttaggagggaaacagcaggaacgccatgggcgtcacgaggatcagcgtcaggaccacccgctggaaccagatgaccaccagcttccagaccggaatggggatgtcggtggccatgatgcagggcaccagcgcggagaagaagatgatcccggatacggacacaacacccacgacgaacttgaccacgggagctgcctccgccgcaaggagcgcgggaaggaacatctccgcaacaccaacggcgctggctttggccaccagcatgggttcgggcagctgcagcgcccaggtgaaggggtagaagaggaagcccagccagtcgaacactggagtgtgggtggcaaggaccagtcccagcaggccgatggaaaggatggacgggaggatggccatggccatcaggacgccgtcccggacgttggtccacacgttcaccgccagcgacggcgctgcctccacagtctgccgggcctcacgccaggcgaccgacagccggcggccggaaacgtcctcctcaggctgcggcacggcctcggggtggtactcgtccgggatgctgttcaacggccagatccggacggtgatggcggtgacaacgaacgtgaccaggaaggtgatccagaagtacgcggtccactgccccatcaggtccagcgtcttggccacgatcaccatgaacgtggcggacactgtcgaaaacccggtggcaatgatggcggactcgcgggcggtgtacttgccttccttgtagacgcggttggtgatgagcaggccaagggagtagctgcccacgaaggaggcgaccgcgtcgatcgcggaccggccgggggttcgccagatggggcgcatgacgcgctggaccatgactccgatgaattccagcaggccgtagctgaccaggagcgccaggaacacggcgccgatggggacaagcagccctacgggaatgacgagcttttcaaacaggaacggccccatgccgggttcaaacagccacgcgggccccaccttgaagaccatcatgaagcccaccaccatccccaccactttcagcagggagaagaccacctcaaccgcggaccttttccaggttccggcaacgaaggggtatccggcaccggcaacaatcacggccagtgcatagaagggcaggacgggaccgatgttcgcctggaggaacgagacgatgtggtccagcatgatggtgttttttccagcgatcgtcaccggcacgaagaacatgaacgcgccgatgccgctgtacacaaacaacttccacatgtgccgcgacgctgtgcgcggggcttgcgaggtgatggccaaaggtctgtctcctgactgcagccggcctgtccgggccggcgttttgtgaacagaaccatcgcaccgtgaatcaccggcaggaacaatggactgcactgcacagcagtctcggataggagactcaggtaaatgctgcctgggggcgccgccctgcattcgagcccgcaggcaggcccgggaccaggaagttaaagcaaaagacccccggatcctcaagggatccaggggccttggcctgtagcggtggggaggctcgatctcccgacctcacgattatgagtcgtgcgctctaaccaactgagctacaccgccacgaatgagaaaaacctgcgccaagccggtcaaaaccgccttgacacaggccctcattcagagccccccaccggaatcgatccggtgacctcgttcttaccaagaacgcgctctaccactgagctaggggggcaacgagtaaatactctaccggaagatttacccaccaacaaatcggcgtccgggcaggcaaggaggagctcgaacaggttttcgccgggcgctttatcggacgaaaaagccgaaaaatcaaggaaaatgaaagccttccaacccgcgcaggcgggccgggacagagccttttcctaaggacccacggcacggatgtgtcgatccccacactccctctggagttttcgtccagatatgcagacttcgaggcacccgaagtccgcatatctggacaaaaactcacaggatggggcaggcaggagggggggcgggccggaggttccagagactcccccgccgccgcccgtcgttgggcattcactacagcacgcataaacgcctgtgggccggctcgaaagccggcccacaggcgccttgtcagctagctgtactgtcccggcaggttggtgacacggctggccggtggctgacccctgagtgaggtgtggcctcgatgatgattgtagtgatggagccagtcggggaaagcgttaacacgctcggcctctgatttgtaggggcgggcgtaggcccattcgtcgagcatggtgcggttgtagcgctctactttgccgttggtctgggggcggtacgggcgggtgcgtttgtgcttgatgtccgggcccagcgcgtctgtgaaggcgtgggagcggtagcaggagccgttgtctgttagcacccgcttgacggtgatgccgtgggattcgaagtaggcgttggcgcgtgcccagaaaccggctgccgtttctttcttttcatcggccaggagctcggtgtatgcgagtctggagcggtcatcgacggcgttgtggaggtagtggtatccgggtctgcggttggccgcggtaccggttctgttacgccagccggcggccctgccgaacgcgcggtggccgccgccgtcggggatccggccgagtttcttgatgtcgacatggatcaggtcccccgggcctgtcgtgttcgtagcggcggatcactcgtccggtgccacggtccagccaggtcagtttcgccagccggtagcgggacaggacccggtgcacggtggaggggtggatgcccagcagataaccgattcttgccggtccccagcggcggttcacacgcacggcgatgatccgccgctccgtacgtgttgccgtgcgccggggcgaacaatgcgggcggctggagcggtcctccatcccagccgggccgtgctcgcggtagcgctgtgcccagcgagcagcagttggcacggagacctgaaaccgctctgcagcccggcgcaggttccagcactgatcaacgacacattgcgcgagctgcagccgcccccggggcgtcagaagagcgttagggtgggacatgaagacctccgtgcgtggaattggactctagacaagccccactccacccggaggtcttcttcatgtcaccaaaccacgccgaacatcactaacgtccgtggtcaatacagctagctgacggatttaccacttgcccttgcggttgaagtcccgctggccgccctcgttgccgtggcggggcttgcgggagccgtcaccgtggccgccgaagcgggagtcgctggcctggccgcggttggcgccgctgtcggcgctgaaggaacgctcgctgtaggagcggccgccgcggtcagcggaggaacgctcgccgtcgttcttgcggaattccttcttgaacccgccgttgcccttgaagttgcctccccggtcaccgccgcggttgccctggtaggagccgcgctcgccggatggcttgcggccgttgtccagctcgaggtggatcagctcgccgccgatccgggtgcgggacagggcgcgcagctgctcggggctcaggtccgcggggagctccacgagggagtggtccgagcggatgtcgatgccaccgatctgggccgaggagatgccgccctcgttggcaatggcacccacgatggagcccggcatgacgcgctggcggcgtccgacggcgatccggtaggtggcgttgccctcggtgagcgtacgggtcggtccgcgtgagccgaagccgtccttggagcgttcgcgcttctggaactccggagctgcgggcagttccttcaccagcagcggctgaccgccctgtgccatgacggcaagggctgcagcgatctccgcagcgggaacgttgtgctcttcctcgtaggaggcaatgaggtcgcggaacgctgagacgtcctcagacgccagcgtttcggtgatcttctcggcgaacttgcccaggcgaagggtgttcacggactcggccgtgggcaggtgcatctgctccaccggctggcgggtggccttctcgatggaacgcagcaggtacttctcccgcggcgtcatgaagaggatcgcgtcaccggaacggcctgcacggccggtgcggccgatgcggtgcacgtaggactcggtgtcgtgcgggatgtcgtagttaatgacgtggctgatgcgctctacgtcaaggccacgggccgcgacgtcggtggccacgaggatgtcgatgcggccttccttcagtgcgtccacagtgcgctcgcgctgctgctgcgggatgtcgccgttgatggcggcggcctggaagccgcgggacttcagcttgtcagccaggtcctcggtagccatcttggtgcgcacgaaggcgatgacgccgtcgaactcttcaacctcaaggatgcgggtcagagcatcgagtttgtgcgggcccatgacctgcaggtaccgctggcgcgtgttggcgccggtggtggtcttggacttgacggagatctcggccgggttgttcaggtactgcttggacatgcgtcggatctggctcggcatggtggcagagaacagcgcaacctggcggtcagacggggtctgctggaagatctgctccacgtcctcggcgaagcccatgcgcagcatctcgtcggcctcgtccagcaccaggtactggagctcggacaggtccagggaacccttggagatgtggtcgatcacgcggccgggggtaccgacaacaacctgggcaccgcggcgcaggccggcgagctgggggccgtaggcggagccgccgtagacgggaaggactgtgaagtcgtcgatgtgcttggcgtacgaggtgaaggcctcggcaacctggagggccagctcgcgggtgggagccaggaccagggcctgggtcttgcgggacgggccattgaggtcgtggagctcggccaggcgggacagtgccggtactgcgaatgctgcagtcttaccggtgccggtctgggcgaggcccacgacgtcgcggccttcgagcagcagcgggatggttgctgcctggatgggggaaggcttttcgtagccgacatcctgcagggcggcgaggacgcggccgtcgatgccgaggtcggcgaagcggacgccttcttcttcgtcttcctcagccttggcggcgggagcggccggagcttcctcagccggggcggcgggagcttcctcggccggggcggcgggggcttcctcagccttggcggcgggagcttcttcgggggcttcggcgggtgccggtgcggcctcggctgcgggggcagcgggctcagtgaattcgatgctggcagttgctgcttcagcggcggcgtcgttgtgattttcgggcatagggaagtattcctcatccatagggggccaggcggcactacccgaggtgagtggagccgcagtacgtgtgccgtggatgccgggcaaacattgaccggccggtcacagaagtccggcgctttcgcaatcccgtggcaggacttcccgctgcatctcttggctgctatcccagcagtctgtacagcgttttctttagccggctctccctatgaaaatgcccgcatcgcttgtgcgggccccaacacttgccagtcctgcctcaaaaattgggcaggaataagggatttccggagtgggggatgtttcaagtgtaaggtacgcacctgccgcagcggaaattgaacgtacgacgacggcggtgagcttgcgcacaccgctccccttccagccgcttcagcctgaagttaccggtccagctgccgttccagcgcctcgaacttctgcttgaactccggctgctgcaggcggatctcgccgtcggcgtcggcgtcgcgcagggcctccatggactccgcgtccggttcgctgaaccacttgcccacggtaattccgtgcttcggcacataaagccggtgaatatggtccccggcctggatggtgccggtcctgatgacgcgcaggtaggtgcccacgcggcccgcctcggtgaacctcttgacgaagtgcggctcccgcatccggcgctggaaggtggcgcagggcgtccgcggcgaggtgacttcgacttcgacgttgaggccgatcttccaccgttccccaatcaccgctcccgtggcgtcgatgcccgccacccggaggttctcaccaaagattccaggcggcaggtcccgctgcagctcccccgcccagtagtccgcgtcctcctgcgaataggcatacagggcctggtccggaccgccatggtgtacccggttcgcctggatgtcgccctggaggcccagtcggtgaaccttgaccgggccctcggcccgacgcttgtcgatggctgtcacgcccacgttggacgcgtccggcaggagctggtggacacggcagacggcaacaacggaggcggtttccatggcaccagtgtagggtccgcaatcccctgcgggcggcagttgccggcatggggacttctcccccgttagctatccgctgcgctactcgcagccggctccggcagggactacgctgagttcaggattgcaattgggggtgcagcgctgtgcccaattcacgtggactactgaaggggacgccatggacccgaacaaagacccggagcacgggcgggcaagcggcaaccagccaggcggtgacggccgggccggcggcgggcatgacagcggccgggattccggcggcggagcaggtgccaagcctccgccctggcaggtacccaaaccggagctccgccctgaactcctcaatgagcctgtcaccccggtggacccctttgcccgcgaccgggagaggcacctcaacgaggcggcggacaagaagaaacgctcgcagcggcgcaccgtggtggtgggcctgggagtgacagcgctgctcgccggcaccatcacggctgtggtggccagcaaccaggatgaccccgagtacgcccaggtgtgtttcaacgacgaaaccggcgagcgcgtggaggacaacaactgcaacagctctgccggccgaagcggcggcatctacgcctggtacttcttctcccgcggcgcgttcgtccccgccgtcgggcagaaccgctcaaccgcgcccaactacaccaggaccgttcccagcggtgcaaaagcctcaaccgggtacagcagcaagggcggcactgtcagccgcggcggctttggcaccaccgcgaagagcggtacaagcggcggcggcagcaaagtggggggctgagcgtgaagcggctgttgtctgagcccaggcccgactggaagcagaagatccaggaacagggcctggtcttttccaccaccaccatggacgacgggcggcggatcgagtactggaacgagtccgcatactacgaattcaccacggacgaggtggaggccctcgaggtgggggccgaggacatgcacaggatgtgcctggaagcggccaaattcctggccaccggtgccatgggcgatattggcatcggcccgcaggctttggagctggccgcggagtccctgcaggctggggacgtggatgtctacggccgcttcgacttcatctatgacggccagggcgggcccgccaagatgctcgaatacaacgcggacacccccaccgggctcatcgaggcggccgtggcgcagtggttctggctgcaggacgtcttcccggaaaaggaccagtggaacgggatccatgaggccctgatccggcagtggaaaaaggtccagtaccgcaccggcatgagcaccctccacgttgcccactcggaagtggaggaatccggcgaggactggatgacggcggcttacatgcgggacgtcgccagccaggcaggctggaccaccatcggcatcaacatgtcggacatcggctgggaccccaacctgaaccggttcgtggacctggacaatttcatgatcagcaccatcttcaagctctacccctgggagctgatgatgaaggaacccttcgggcagcggcttctggaacgcgcccacaacccccgctgggttgaaccggcctggaaaatgctcctctccaacaaggcgctcctcgccgccctctggcatctgtatccgcagcatcccaacctgctgccggcctacctcaacgagccgggtcccctcaaggagtgggtggccaagcccctgcacggccgcgaaggggacaacatcaagatccacgcccagggcatcagccttgagcagcccggcggttacggccgcgagggctggtgctaccagcagtaccaggaactgcccgacttcgacggcaaccatcccgtcctgggcctgtgggtggtggacggcgagtccgtaggctgcggcatccgggaatcggatgggccggtcacggactacttctgccgttttgtgcccaacaccattgacgcgccggcgccgctttcggccgaggcctcctccaacaaagcaggtatcgcactatgaacccggtgacagcatgagcacaggaaccacgacgacgggcggcccgggcggcgcgccgggcaccaccgtcccggccaaggggctccgcgccgggatcctggacctcggcgactccgtgatgctggggctggcctccacggcaccggtgtactcgctggccgcaacgctcggcctcatcgtggccgtaaacggcaactacactcccctgatcctgctgctcggtttcatccccgtgctgttcatcgcgtatgcgttccgcgaattgaacagcgccattccggactgcggcaccaccttcacctggtcccggcgtgcgttcggaccctgggcgggctggctgggaggctggggcgtggcgctcgccggcatcgtggtgctcgccaacctggcgcaggttgcgggccagtacctatggctcctggtgggggacggctccctggcggaaaacaaggctgtggtcacagccacgggagtgctttttatcgccgttatgacgctggtcaattaccggggcatccggctgggtgagcacgtccagcgggtgctgacgtacgtgcagtacatcgcccttggcatctttgccctggcgatcgtggtgcggatcgttgcaggtgctgccgccggagacacaaccatccaggccttctcttttgagtggttcaacccggtgggtgcctttgcggatcccggggccgtggtgcacggtgcgctcctggcactcttcatctactggggctgggacacgtgcctggcagttaatgaggaaactgagaaccccgcaaccactccgggccgcggagcggtcatctccgccttcatcctcgtggccatctacgtctccgtggcgctgctggtgatgatgtatgccaccgtgggcacggaaggcattggcctgggcaacgaagccaaccaggacgacgtcttcctggccatgcgggacgtggtgctgggtccctggggctggctgatcgtcgtcgcggtcctcgcgtccgtcctgtcctccacccagaccaccatcctccctacggcacgcggcaccctgtccatgggcgtccatggcgccctgccggcgaagttcggggaggtgcacccgaagaaccagaccccgggtttctccacccaggtcatgggggcggccgcgattgcctattacgtggccatgagtttcctgagcgagaacctgctctccgattccatcagcgccatcagcctgttcatcgccttctactacgcgctcaccggtttcgcgtgcttctggttcttccgcggcaacctgcggcattcggcacgcaacctgtggttccggggcatcctgccgctcgtgggcgcgctcctgctgacggccgccttcttcatctcggctgtgcagatgtgggacccggcctacggcgacacccagatcttcgggatcggcggggcatttgtcagcggggtgctgctgctggccctgggcgtggtgctggctgtggtttgccggttcctgcccgccacccgcggctacttcctggcgaagccgtgaacccggatccttcggacgtccttgccctggatgccctgctgacccccggcgagcaggaaatccagcagaaggtccgcgatttcacgggccagcggatcaaaccggacatcgcgcgctggtacgacgacgccgtcttccccctggagctcgcgccggaactgggtgagctgggggtgctcggaatgcacctggagggctacggctgccccggccgcaccgccgtcgaatacggcctggctgcaatggaacttgaggccggcgattccgggatccgcacgtttgtctcggtgcagggctcgctggccatgaccgccatccacacgtggggctccgaggaccagaaacaggagtggctgccccggatggctgccggcgaggtcatcggctgtttcgccctgaccgagccttctgccggctccgatccttcctccatgaccacctttgcccgccgcgacggttcaggagatgacgccggctgggtactcaacggtgccaagcgctggatcggcctcgcttcggtggccggggtgatggtggtgtgggccatgaccgacgacggcgtgcacggcatcctggtgccggcagggacccccggcgtcactgccgtccccatcacgcaaaaactgtcgatgcgcgcgtccatccagtgcgatgtggtgttcgacgacgtcaggctgggtccggaggcgctgttgccggcggcgcgtggcctgcgcggcccgtttacctgcctgaacgaggcccgctacggcattgcctggggagccatgggcgcagcccgcgattcgtaccaggcagcgctggcctattcgcaggagcggctgcagttcggaaagccgctggccggataccagctgacccaggaaaagctggtcaacatgctggtggagatccagaagggcacgctgctggcactgcacctgggacggctcaaggacgccggcgtcctgcggcccgagcaaatctcactgggcaagcttaacaatgtcagggaagccctcacggtggctcgggaagcccggtccatcctgggcggaaacggcatcaccctggactactccccactgcgccatgcggccaacctggaatcggtgcgcacctatgagggcaccgacgaagtccacaccctggtccttggccagcacatcaccggcatcaacgcgttccgctgacctcgacgccgcctcgggtcaggccgagaagccgccgtcggacttgatgagctggccggagacccagcggccggccggagagagcaggaaccccaccgcccctgcgacgtctgccggtgttcccagccgtcccgtgggctgttgggccgtcagcgcgtcccggatttcctcgtccatccagcccgtgtccaccgggcccgggttcagcacgttcgccgaaatgccctgcggtccgagctcccgcgcggcggcaatgacgatccggtccagcgcacccttcgaggcaccgtagggaaggttgaacgctgtgtggtcactggtcagcgcaacgattgcgccgccgtcgtccgttgcctgccgggcgaaagcggcaatcagctgccagctggcccgcgtattcacggcaaagtgccgctcgaacgattccacgctggtgtccaggatccccgagtccacggactcggcatggctcaggaccatgccctgcagcgggccggccagctgcacggactccgccaccagccggtcgggcacagccacgtcggcaaggtccgcggacagcacgtggacctgcgcgccgatggcttcgagctcggcagtcaggcgtacgacgtcgtccggttcagtcccccacggcatgcgggcgtcgtagtcctgccagtaagccagcaccaggtcccagccctcggcagcgaggtgccgggcaatgcctgcgccaatggatgccagcctcccggcacccgtgatgagggcgacggggcggacggctgctggggaagaaggttccatgggatcagcctagtggcgcgcggcagaggtgcccgcccgaagtccgcacggggtctactcgggcaacaggaccaggtccaggtacgcgcggagacatccagccatatcaacgctcccgggcgccaggagccactgcgtctggatgccatcccacagggcgatcaatgaggcagcggcagtggccggatcaacacccgggcgcagccggccttcccccgccagctgctcaagctggcgcgcatagctccgccgcagccgctcaaaacgctccgtaaaatagtcgcgcccggggtgcccctccgtgaccgcttccccgcacaggacggtgtaaagctcaaggactcccggtacgtcctcattgaagcgcgcctggcggaggacggcatcaacaagtgattcctccgggtccggcggcactgtcccgtctcccgtaatggagtcgcgccagttcagcaccgccagcagcagttggcttttggacggaaagtaatgcaggaggctcgtttggctcatgccggcgcggttggcaacgtcctgcagcgagcccccgcgatacccgtgggcggcgaagacggcgtgagctgcggtcaggatggcctggcgccgctcggcggacttcgcgtagggtccccggcgggacgtttgaggcccctccttggtgctcatggcaagccagtgtacccgccatatggccggacaaatcaaaactcgagtagtcactcgacttttcgtgttagcctgtctcgaaccgaacaaaaagtgccatggttcacacttttaggcacatatccgacacaatgaggtgaaggcagatgtcccaattcacgcgaagacaactcctgagtgcgggcctgggcaccgcagcggtggggctcctttccggctgtgccacgccaggcatacgctccgtcaacacagcaccggtgctcgctccagccgcaagcggggaaaagattaccctgacgtactggtgctggctcaaagatgcccaaaaggtggccgacatctggaacgcctcccatccgcaggtccaggtggaggtcgtgtggattcccggcggcaatgccggcgggtatcaaaagctctattcagccctggccgccggcggcggacctgacctggctcaggtggagatgcggtccctccccgagttcatgctggtcaacggcctggtggacgttgcccggtacggcgcccaggactacgcgcacctgtacgaccagaccctgtggggccaggtcagcttttccggcggtgtgtacggcatcccccaggactccgggcccatggccatgttctaccagccggcagtcctggaccaggtgggcggcacgaaccccggcacgtgggacgaatgggcagccctggcacgcgaactgcgccaaaaggacgtctacctggactgcttcccgctgggcgacgcctccgtgttcacggcgttcgcggcccaggccggggccagctggctccggcctgaggaggacggctgggtcatcaacatgactgacgacgccaccatgaaggttgcccgcttcttcgaccaggcaatcgatgcggaccttgtccagacggcgttcggcgcatactcccccgggtggttcgctgcagccgccaagggaaccattgcctccgtggtgtccggcagttggggagacgcccttattgagggcgtcagcggcggcagcggcaaatggcgggtggcacccatgcccacctggggcggcaccgggttcgggtcaagttaccttggcggttccaccgcagcagtcctggccaacagcaaacacccccgcgaagcactcgagttcgcagtctggatgacaacgtcgagggaaggcatcgacgccgaaatcgccaacagcggcattggctggtcgccgtcgccggacttcatcggcactccacggcaggcgccttcggagttcttcggcggccaaagctaccaccaggaaatcttcgtgccggcggcccagcagcagaacaaggactggtcctggtggcccgtcactcagcagtccttcaacatcctgagcgacggcttccggaagaaggcgtccggaacgagcctggtggactcggtagctacggcggaacagcagatcatgaccgtcttcaggaacaagggcctcagcattcgaaaggaagcgtcatgacagcgacatcacccaccgcacggacggggcaggtttcgtccgcgcaatcttccgcacggacggggcaggtttcgtccgcgcaatcttccgcccggccgggcaagcgcggcgaccggacaggcgccgcatcccgtgcgccctggctcctgctggcgcccttcctggcgttgttcatcctcacctttgtccttccgatcttcgttgcagtcctttccagcttcacgaaagtgacccgaagcgggctctttggcgaagccggggtcaagagcgaattcgccggtttcagcaactacgcccaggccctggcggacggcagcttcgtggcgtcaatcggacgcatgctcctgttcggcgtggtgcaggtgccgctaatgatcgccctctgcacggtgcttgccctcatgctcgaatcagcgtctgccaagtggccgggtttcttccgtgccgcatacttcctcccctacggcgttccgggtgtcatagccaccattctctggtccttcctctacgtccccggactgagtcccctgttcgatgtcgcagccctggtgggtctgacccccgatttcctgggtgccaacaccgtgctgtggtcgattgcgaacatcgtcacctggagctacaccggctacaacatgctgatcatcgtggcccagctgaaggccatccccggggaactgtatgaggcggcgaaggtggacggcgcctccacgtggcgggtggccctcagcatccagctcccactgatccggcccgcccttgtcctcacaacagtgttctccatcatcggcaccctgcagctcttcgcggaggcgcaggtcctgaagaccgtcgcgcctgccatcgacagccagtacacgcccaacctcagcgcgtacaccaccgcgttcgcctacaacgactacaacgtggccgctgcgcaggccgtgctgatcgctgtggccgccttcgtcctgtccttcgccttcctcaaattcacgaacaggaagtcatcatgaccgcaaccgtgaccccgccgtcgacatcggcttcccctgcccgcacgtccactgcagggaccaggcgttccggcagcaaaggccgcccgtccaccatcatcgtcacagcggtgctggtggtggttgccctgtacttcctcattcccgtgtactgggtggtggtcgcagccaccaagtccacggaggacctgttctccaccaacggattctggttcgcccccaccgttgcgctgtgggacaaccttgcgcaggtgctcagctatgacaacggcatcttcatccggtggttcctgaattcggtactgtatgccggcatcggcgccctcctggccacctactttgcggcggcgggcggctacgcgctggccaagtacgagttccgcggccggaacctggtctttggaaccatcctgggcggagtgctggtacccggcacggccacagccctgccgctcttccttctcttcagccagctggggctggccaacacgtactggagcgtgctgctgccgtccctcgtctcgccgtttggactgttcctgtgccggatctattcgcaggccactgtggacacctcactcatcgaggcggccaggctggacggcgcgggcgaactgaagattttccacaccatcgggctgcgtgtcctcacccccgccctggtcaccgtgttcctcttccagctggtgggaatctggaacaactatttcctgccgctcgtgatgctgtccgattccgggctgtacccgatcacgctcggcctgaacaactggctgagccaggtggaccggctccctgagttctacgagctgaccaccggcggcgtgctgctctcgatcatcccgctcagcatcgccatggtggtccttcagcgcttctggcgcggcggcctcaccgagggttccgtcaagtaggaaacttcccaacgcaggacggcacgtcgcggcaaccccctcagtctggggactgccgagacgtgccgtccaggtttaaaggcgaggctaagggatggcggcgaacgcctggtccaggtccgcgatcaggtcctccacgtcctcgatgccgcaggacaagcggaggaggttcaccggaaccgccagctcggtgcctttgacggaggcgtgggtcatctcggacggatagttcatcagggattcgatgccgcccagggactccgcaagggtgaacacggacgtcgattccgccaccttccgggcagcagcctcgccgcccttgaactgcaccgaaaccatgccgccgaagctccgcatctgctttttggcgagctcgtggcccgggtgggacggcaggcccggatacaggacagcctccacctcggggcgttccaggagccactcagccacggcctggccgttaaggctgtgccggtccatgcggacccccagggtcttcagcccgcgggtggtgaggaaagcgtccatgggaccggagacggcgcccacggcgaactgcacgaagccgatcttctccgcgagctccgcatcattgaccacgacggcgccgcccactacgtccgaatgcccaccgatgtacttggtggtggagtggaccacgacgtcggcacccagggcgagcgggttctgcaggtagggggacgcgaaggtgttgtccaccacgaggagggcaccggcgtcgtgcgctattcctgcgagcgccgcgatgtcggtgatcttcatcagcgggttggacggcgtctccacccacacgaagcgggtcttgttggcggccaccgctccccggacggcgtcgaggtccgccatgtccaccggagtgttgccgatcccccaccctcccagtacccggctgatgagccggtaggtgccgccgtaggcgtcgttgcccagcacaatgtggtcgcccgggcgggtcagtgcccggatgagcgaatcctccgcggccagcccggagctgaagctgtaggcgtgggtgccgccttccagcgcggcgagctgttcctgcagggcgtcccgggtggggttgccgccgcggccgtactcataaccgctgcggagtccgccgatgccgtcctgggcgtaggtggaactgaagtgcagcggcgggaccaccgcgccggtgcggggctcgaaggcctgtccggcgtggacggcacgggtgttgaaaccttggttttcggggacggacatgatgctccttgtctgggtgaagccgtatcagggtgaagcaggtcagttgctgaggtaggccaggaggtcgtgccgggtgaggatgcccacgggcgcgccgacgaacgtgaccatcacggtgtccacgtccgagagcagttccctggccgccgaaatggtttccagcgatccgatgacgggcagcttggggcccatgtgctcggagatcttgtccgtcagtttggcttcgccacggaacagcttggcggtcagggtgcgttcgtccacggcaccgagcacctcgcccatcactaccggcggctcctgggacaggaccgggatgtggctgacgccgaactcgttcatgatgttgatgacgtcgcgcacggattcgttgggatggatatgcacaaggtccggcagttcgccgttcttggagctgatgacctcccccacggaggtctcctcgccgccggagaggaaaccgtaggaacgcatccactggtcgttgaagatcttcgccaggtagccccggccggagtccggaaggatcacgacgacgacggcggactcgggcaggtcccgcaccgccttcagcgcagccaccacggccatgccggaggatccgcccaccaggaggccctcctcgcgggccaggcgcctggtcatggcgaaggaatcggcatcgctgaccgcgatcacctggtccgggacggacttgtcgtagttcgccggccacatatcctcgccgacgccttccacgaagtacgggcggccggtgccgccggagtacaccgagccttccgggtccgcggcgatgatccggaccaccccgccgtcggactccggccggcccgccgatgcttccttcaggtagcggccggtgccggtgatggttccgccggttccagcgccaatgacgcaatgggtgatcctgccgtccgtatcgcgccagatctccggaccggtggtctggtagtggcttccgggcgctgcggggttggagaactggtccggcttgtacgcaccgggggtctcccggacaatccggtccgagacgccgtagtagctttgggggctgtccggcggcacggcggtgggcgtcaccaccacctcagccccgtacgcctggaggacggcgcgcttgtcctcacccaccttgtccggaaccacgaagacgcacttgtagcctttttgctgggccaccagggccaggcccaccccggtgttgccggacgtgggctcgacgatggtcccgccgggctgcagcttgccgtcccgctcggcgtcctcgatcatcttcaccgcaatgcggtccttgatggacccgcccgggttcaggtactccagtttgaccaggacggtggctttgatgccttccgtcacgtggttgagtttgatgagcggggtattgccgatgaggttcaggatggactgggcgtacttcatggatacaaagctaccgcttcactgccgtgggcaccttcccaggattttggccccggcggcacgccacgcggagccggccgtccccagcaggttccacgcaggcacgggtgggatcattgggcggtgcagcagttcgcctggttgatgaaagtccggagctacctccttcccggagcaatgctcctggccggtgttgtctccctcgcctccggggcactccccctgcctgccttcgacgcactggcgggccgcacccttcccatcctcgcgtttgtgctcgcgatgtccctgctgactgaactgctggacgaagcggggctgttcaaggtagttacggagcgcctggccgggctgggccggggccgagtgttcctgttgtggctccttgtagtggcgctggcgactattgccactgttttcctgtcgctcgacaccactgccgtgctggtgacgccggtagtggttctcctcgcagtccatgccggcatccagccgctccccttcgcgttgaccaccatttggctcgccaacacggcgtccctcctgctgcctgtgtcaaacctgacgaacctgctggcacaggacgcgctgggactcagtcccctgggctttgcaggcaccgtctgggcaccggcactggtgggggtcgttgttccgctggccctgctgtggctggcgttccgcaaggacctgcggggacggtaccggccgcaacggtcccccggagtgcgggaccggccgctgctggtcattgcagcggccaccctgctggtcctgctgcccgccctggtgtccggcgtacccgtgcagtatccggccatcatggcggcggccttcctcctgatggtcttcctctggcggcggccctccgtgctgcggtggtccatggttccgtggcgtccgctgatgctcacggttggactgttcatggtcgttgaggccctgcatgccaacgggttgacggcgctcctggcaggcgcggccggccagggcgacagcctgcccgccctcatgcacctggcagcgctgggcgccggagcggcaaacgcagtaaacaacctgcctgcctatctggcgcttgagccggtggccgggtctccggcccgggtggccgcactcctgatcggtgtcaaccttggcccactggtcactccgtgggcgtcccttgccaccctgctctggcatgagcggttgcgggcgctgaacgtccccatcaaatggagcggctttgccctggccgggctggtggtggcagcccttacggtcccgcttgcggttgtggccctgtgggtggcgtccgggatgccctgacgctacccggcggactgcgcctgctggtcagcgggaaggttctcccacagtcccatgatgttgttttcgggatccttgaagtaggcgaagtagcccatcccgggaatctcgttcttgggcataacaacagaaccgcccagttcctctatggtcttcagcgtggcatcgatgtccggcacgtccaccgtgatgacggggttggtgatctggtcctcgcgggccatcatgccgccgttgatggcacccgcggttgtgggctggccggtggcctcgtccatgggcgtggtgatcaccatgttgtagtccattccagggacaggttctatccgccagccgagggcctgctggtagaacttcctggcccgctcctgatcgtccgcggggatttcgaaatgcactactccacccattgcgctcacctggaatctctggaatctcgaaaggaacagcgcggacgccccgcgccacacctgggagtctagtcctctgtccgcggccgggtaagagccgcggacgagccgagtttttgtccagatatgcaggcttccgaggcgcgcaacccggcataagtggacaaaaactccggccccggaaccggcacggcggacacggcgggcaaactgtcagggcaccgtgggacgatgggtgaatgacgatcgcagaggtgcccgcacggctggcggccgccgcggacgcctccctccggtggtatccgggcggcccctacgacctggtgcggaccctccgtccgctcctgcgcggcaacagtgatccgtccttcgcggccgaaggcggcgtcatctggaacgccttcacaacagccgagggcaccgccaccctccggctcagcccggcaggcagccccgagatggagcacagggtggacgtccaggcctggggtccgggcgccgcggcggcggtagcggcagcgccgcgcctcctgggggcacacgacgattggtcggcattcgacgaaccggtgttccatgccacgctcccccgcatggtcagggaagcgcggcggcgcagcctggccgtccggcttccctccagcggccgcatggtggaccagctcgtgcccatcatcctggaacagaaagtcacggtcatcgaagcccgccgcggctaccgatacctcctccaccgcttcggttcccccgcaccgatggctggatcgttggctcccgccggtctggcgctggcgcccacggcggcgcagtggctgcaggtccccagctgggagtggcacaaggccggggtgggcccgcagcgctccgcaacggtgatgcgggcgctgcgctccgccgtcgcgcttgaacggctggcggagctgacggcgctggaggcggccgcaaaattgcagaccattcccggcatcggcatctggacagccgcggaagtggtgcagcgcacgcacggctgcccagactcgatctccgtgggcgattaccacctcgccgcctacgtcggggccgcactgaccggccggcggatcgatgacgccggcatgctccggctgctggaaccgtgggcgggacaccgccagcgcgtagtgcggatgatccaaagcagcggcttccgcaaacccacgttcggtccgcggatgaccatccaggaccaccgccggcactgacgcccgccgggcacacggcccccaacgcacgtgcgcgatttttccgtggactcgtgccggggatgggtatagcgtggcgccagggagcccgtcccagagccccggcacgccgcctcctctggagtcacgcatgatccacacggacaaactggcaaagacgttcacggtcaaaaaagaaacagtggaagccgtcaaaggcgtcgacatcgacgttgcgcccggcgagcttgtggccttccttggcccgaacggggccggcaagtccaccacactgcggatgctcactaccctgctgacgcccacctcggggacagcccgggttgccggcgtggacgtcaccgcggatccggcgggagtgcgggcaaggattggctacatcggccagggcaacggcggcgggcacagtttccgggtgattgatgaactggtgatgcagggccgcttctacggcatgaactccgtggatgcccttgcccgcgcccgggagctcctgcaatccctggacctcgcggacctcgcaaagcggacggtcgtcaagctctccggcgggcaacgacggaggatggacgtggccctggggctgatgcactcgccgcagctgctcttcctggacgagccctccaccgggatggacccccaaaaccgggccaacctgtgggagcacatcatgcggatgcgcgaggaacacggcaccaccattgtgctgaccacgcactacatggacgaggccgactccatgtccgagcgggtcatcatcatcgatcacggcaggatcatcgccgatgacaccgccgcgcggctgaaggcgaacctcgcgggcgacctgctggccgtcgaagtggcggcggcctccgcggccggggtgcgggggctgctggggcgcgccgcggcgggcggggaggtcaccgagaattcgtacgacggcgttgtccgcttccgcctccggctccccgaaggtgcccggctggcgcctgcgctgctgctggagatgcacgatgccggcgctcccgcccagtccctggagctgaagccgcccacgctggacgatgtgttcctggaactgacagggcgcaacctgcgggaaggggcgaaccgctgatggccacgcacggcaccgctgccggcacccggcaaaaacccggtctgggcagggtcctgcacgacaccaggtacgtgttctggcgggaaatgctgctgccgctgcgggacccgttctcgctggtcttctcactgctccagccactggtcttcctggggctgttcggcccgttgctgggcgcggccgtgggcgcgccggcgttcggcggacagtccacgctccagtggttcctcccgggcgtggtggtgatgatcgccctcttcggaacctccatgaccggttcaaacctgcagtacgagctcatgacgggctcctacgagcgcatcctggcgacgccgctgtcccggtcctcgctgatgatcgggcgggcactgaaggaatgggcaccgctggtggtccaggggctcctcatcgcactggtctgcatccccttcggcttcgtgttctacccgctgcacgtgctgttcgggctggtcatcctggggatcttcgggataggactcggcgccctgtcgtatgcgctggcgctcgtctcccaaaacaaggaatggatcttctggggagtccagcagacgctgctgttcccgctgatgatcctctccggcatcatgcttcccatcgaggcgggacccgcctggatgcagacggccagcctgttcaaccccctgacctacctggtgaacgccgagcgcgaactgttcgcgggcagcgtcgggacggacaccctcctgggcctgctcgccgcctcggtgacagccgccgtcggccttgccgtgggtgtgaaagcgatcagccgcaacatccgctgacgtcacagccccagccgggccacggcctcctggcgcatctccaccttgcggaccttcccggacacggtcatggggaaccggtccatgacctcgaggtagcggggaatcttgtagtgggccagcttcccccggcagtactcggcaagcgagcctgcgtccagcggctgggcgccgggcttgaggatgacgcacgccatcagttcctcgccgtacctggcatccggtaccccgatgacctgcacgtcctggatggacgggtgggcgaacaggaattcctctatctcccgcggatagatgttttcgccgcccctgatcaccatgtccttgatccggccctcgatgatgacatagccgtcgtcgtccatccgggccaggtccccggtatgcatccagccgtcggcatcgatggcctcggcggtcttgtccggctggttccagtacccctccatcacggcatatccccgggtgcagagctcgccgatccggccccggtccaggatctcccccgagcccggatcaacgatcttgctttccaggtgcggcatggtgcgccccaccgtctccgtgcgctgctgcagggtgtcgccctgcctggtcatgctggacaccggagaggtttcggtcatgccgtagcaaatggccacatccaccatgttcatctccgatatcacccggttcatcacctcgacgggacacagcgaacctgccatgacccccgtgcgcagggtggacagatcgtaggaggcaaagtccggcagcgccagctcggcgatgaacatggtgggcacgccgtacagggaggttcccccgaaatcctggacggcctccacggcggcagccgggctgaatccgcggccggggatgatggtggctgcgccgtggctgagggcattgaggttgccgatcaccatgccgaagcagtggtagaacggcaccgggatcaccaccctgtcgtgctccgtgtatccaagcagcccgccgatcgaaaacccgttgttcaggatgttgtggtgggtcagtgtggcccctttggggaagcccgtggtcccggaggtgtactgcaggttgatgggatcttgcgggctgagttccgccatgcgggcctgcagtccggaatgtccgacgtcgtccgcccgccgaagcagctcggcgtacgtcagctccgcatcaccgagggggacgccggcgtcgaacccgtcctcccccggcgcgggcaggaagacgagctcgcgcaggtccgggcactccgcgagcgccttccgggccatcgccacatagtcgctgttcgtatccgacggggcggtgaccagcatccgcatgccgttctgctgcaccacgaattccagttcgtggctgcggtaggcagggttgacgttgaccaggatggccccggccttggcggtggcgtactggaggagggtccactcggcgcagttgggactccagattcccacccggtcgcccttggcgacacccagtgcgaggagcgcacgcgcgagtcggtcgacgtcgtcgttcatcttggtgtaactccagcggcgggcgtcggcacccggaacaggcgccgcctcgatcagcgcgtcgtggaagggaaagcgggccgccacccgctcaaagttccggccgatggtttcatggagcagcgggacgtcagtgtccccggctgtgtaggcgcgcatgctggcacgctaccaagtggcttccggcaatgaaaggaccaccggatgtacaccaagcgggtccggcgcaacagaatgaaagccgtccgttggtgccggtattgtgaaatccatgacttcacccattgatctgcaggcaacattcattcccaacgacggcgagtttcaccgcgtcaagctcgccctcgaaatcgccatcgacgaggtggtgaatgaacccggctgcatccggtacgagctgacggaagccaccgaggagaagctggtcctgacggaacagtgggcgtcggaggaggacctggccaagcattccaagggcatcgccgtgcaggacctgaacgaatcactgagcgcgctgctggctgagcccgtcaaggtggaacggatctaactgccttaacaacaaatgcgggacctccccctgggaggtcccgcattttgcgttgtggtaagccttaggcgtccgggatctgcgtgccgtcctgcggaccggccggtttgcctgctgaggcggcggcctcttcccgctggcgtgccacgtgggcgtggacttcctccatgtccagggccttcacggcgtccaccacctgttcgagctgctgggcgttcagcgcgccgggctgggagaacaccagcaccttctcgcggaaggccatcagggtggggatggacgagatgccggcctctgcggcgagctgctgctccgcctcggtgtccaccttggtgaagaggacatccgggtgcttctccgagacggccgagtacgtggggccgaactgcttgcaggggccgcaccattccgcccagaaatccaccaggacaatgtcgttgccttcgatggtggatgcgaactgttcacctgtgatgtctagggtagccatgtgtcaacggtacgcgtcactcccccggcctgtcctgcccgtggccgccttgttcgctccccgcgtcatcgggaataaccgggcagccgcaatgtacagggcggccggcggcgcctagtctggggttcatcgccgcgcgtgcgtacccaggaggtctgatggcaaccgctatctcagcgaagtccctgaccaaggaattcgggcgccgcgaagtgctccacggcgtcgatttcgaggtggaggccggctccgtctttggtgtgatcggcccgaacggagcggggaagaccaccaccatgcgctgcctgctggacatcatccgccccaccagcgggaccatccgggtgctgggtactgatccgcgggcgggcggtccggaactgcggcgccgcatcggctaccttcccggggagctgttcctggcgggccgggtgacggggcgcaccctgctggcccactatgaggcaatcagcgggccggtgccgccgggccgggtggaccagctggcagagcggctgggactggacctcacccgccacatcaggaagctgtccaagggcaacaaacagaaactggggctggtgcaggcgttcatgcaccagcccgaactgctggtcctcgatgagcccaccagcggcctggacccgctggtccagcaggaattccacgccatggtgcgcgaggcgaagcaccgtggacagaccatcttcctcagttcgcacgtgctgagtgaagtccagcagacagcggatacggtggccattctccgggacggcaggattatcgccgtcgagtccgtcaatggtctccgcgaaggtgcggtgcgccgcgtccgcttcaccacgtccggcattgcagcgcacgacgccgttgcgctgctcagtggggtgcccggcgtcggacacgtggaggtactggagtccgacggcacggcgacgctgtccgccaccattggcggggacatccagccgctggtccggatgctggcttccctccggctgaccgacctcgtcctggaagagccggacctggaggaagcagtgctgacgatgtacgccacaccgcaggaggaggcacggtgacggccctgccactgttccgccgggccttctttgacacgtggcgctccaccctgggctgggcgctgggactggccgcggcgatcttcctctatctgccgctgtacccgtccatcggggggagcgcgcagatgcaggacatgatcgatgccctcccgccggagatgaccaaggcgctgaactatgaccagattgccaccggtccgggctacacgcaggccacactgttcgggctcctcggcttccttctgatgaccatcgcgtctgtctcctggggcgccgcggccgtgggcggggacgaggagtcgggccagcttgagctgaccctggcgcacggggtacgccgggtgcaggtggtgctggagcgggcccttgccctgctgctgcgggtggtgctgctggcggcggtggtctgcgtcctggtgtggctgctgaacgggcctgcgcagctgggcatcgagctgggcaacctgctgggcgccaccgtgctgttcgccgggctggccctgctcagcggaacggctgccctctgcgttggtgctgtctccggccgccgcacgtacggactggccgccggcgccgccgtcgccgtcctcgggtacgttttcaatgcggtgggccggcagaccaaggacgtggagtggctgttggacgtgagcccctaccactgggcgtacggaaactcaccggtggcgaacggggcggactggccggcagcgggctggctgtgggccatctcggccgcgctggtggtgctcgccgccgtcgccctggaacggcgtgacgtgggcgcttaggccgctacgcttcccagttgtgcggcgcaggtgtccggctcccgggcagcgtgctggacgcccgccactcgtggatccagtcgggaagcaccaggtcagcgggcggttcgccgaactcctccaggatgtccggctggctgaccgggcgccctttgctgaccagccgggtggcgatatacgcgcgtgcgtacacctcgccgtcggccaccattcgctgttcaaagaagatggctttggcatccagcccgatgatgcgggtctcgatggtgtagtgctgccacagctggagggacttccggaaagcgacggtctccgctgccaccacagggccccagccgcgccggcgcatccgcttccagacgccgctgcgcaccatcaggtcgaaccggcccaggtccatgagggacaggtacattccgttgttgacgtgcatggcgatgtcgatgtccgtgggcaggacccgcagcggcagtgaggagctgtcccagacggtcagcggcgggcggcgggacgaacggaccagcataagcagggttcttaggagcaggtgcatccccttatgctacccgccagtaacattgggttcctgcgtgccgtggcactgacagtaggatttcctgcatgacgcaacaacgctaccgggacctggcggactggccgctgacggtgacggcactcgtcttcctgggagcctacgcgtggcaggtgattggccggatcgaaggcaacccagccctcctgctcgaggctgttatgtgggccacctggggtatttttgccgtggattacctggccaacctgtggctggcgtccaaccgcggcagctggtttatccggaacctgcacgagctggtgattgtggcgctgccgttcttccggccgctgcggctgctgcggctcgtgacactgctgtccgtattgcaccggacactcggcgacaccctgaggggccgggtggtcacctatgttgcgggctcagccgccatgctggtgtttgtgggcgccctggcggtcctggacgtggagcagtcggccccggacgcgaagatcgtcacctttggcgatgccttgtggtgggccatgaccaccatcaccaccgtgggttatggcgacatgtacccggtgacgccgatcgggcgcatggttgcagctgccttgatgatgagcggaatcgccgtgctgggtgtggtcacggcgtccatcgcctcgtggctggtccagcgggtggaggatacggctgaggcagtgtccgaggccgaggagccggtccgcgcggaagtggcggaactgactgctgaaattgccttgctccggcgtgagatcgccgcgcttctggagcagcgcacgccctagccggacagctggcaccgggctgcccggaaaacatggctgcatggcaagtatcgggccttcggcgtttgagtagcatgctccgcgccactaagtaccgcacgcaaatattcgggtaactcctactggtgccgctgcggtgcgcccttcctagactcgggattcctaggaccgaacacacgtgccggcggtcccccggaattgcttccggggtcccgcccctcgcggagcctccgtattttctgggtgtgcggatgcctccatcccgcgcctcttctgcggccccgcatcagcggaggcggccggcgcgttcccctcgatccgtcccgcccgccgaagcgcactgctccggcccggctggaccgagcctgaacgggctacccatgaaccagccacacctttccatccccgaaggccccagcaggagcttcgccacggatgaaccccgcaccgagatcaccattggacggactgccatcagcaacaggctgtgggccggcatggcaacggccgccgtggtggcggcggtgggcgtcggcgccctggcggggccacccacagcagtggaccagggcgcgacgacggttgggcaggttgccgccgccgcgttgcctgaggtgccgaacgccgccacgttgcctgaggtgccgaacgccgcagcagccgcagaagcccagcccgcagctgatgctgcttccggggcaggactgactgctgccgaggcgcccgccccggcagcgcccgcggccgaaccggcgccaccacctgcgcccgagccagttcctgcgcctgcgcctgaacccgcacctgcgccggcgggtgacccaaacctgtacaccgtggttccgggcgatacgatcggagccattgctgccaggcacggcgtggacatgaatgccatgctcgcagcgaacggactgggccactacagcatcattgttccgggccagacgctggtgctgaccggaccgcctgttgcggtggctccagccgagccagcccccgcgccggcaccagcgtcggttcccgcatcggcggcccccgcaccggccgcagctcccgcccccgctcctgcctttgtccccgctgccccagccatccgcaccatttacgtggccggcgcaggcgggcagtccatggtggacgcctgcatcgggcccatccactacacccccaacgacggctactcgctctttatcactgagcacgatttctgtggcggttgggcccggttctccggcataggcgtaggggaaaccgtcagcctcccgggctacggaacctacaccgtctcagcgcggggacaggtgcccaacccgggaaccaccaacgacgtcattgctgtcttcggcggctttccccgggcaatcctccagacctgcatccccggcaccagccagatgctcctgattgccctgaactgacgggtatgttcaagaggcactctggccggagcggctgaagggctcccaggtttcccaagcttgtccgcggttcctagccttgacggcggggagccgcgggcaaggccaagaccgggcacaaagaaacgccacggaggggaccccgtggcgttcgtagcgggaaatcctgacggggagatcccacctaggcgttcatcggtttgcgctccgagatgtgctctacgagctcacccacgcgctgctcggagtagttccgggcaatgtcgccctggctgatgatgcccaccagcttgtggtcggcaatgacggggagccggcggacctggtgggtttccatcatctcgatcgccgcgtcaacgtttgcgtccgcgtcgatccagtgtggcctgcccgaggcgaggtcgcgggccatcatttcgcggggatcgcgtcctgctgccacgcacttgagcacgatgtcgcggtccgtgatcatgcccttcagcttgccgtcgtcaccacagatgggcagcgaaccgcagtccagatccatcatcatccgggcggcatccaccagggactggttttccctaatacactgcgcgtccgtcgtcatgaactcacgtacggcactcattggtcctccttcatcgatggggatatcgacgcagggcatcgggcacatgcgccgatgctgccagcctacgccgggcccctgctgatgtcgacggcggttcggcacccttccgggacggcttcagtccctgcgcggggacacaaaaaacctccggaaccggatggttccggaggcttttcattgggtgcagatgagggattcgaaccctccagcaagcccgcgtcagtcagcagatgccggctcttttgggcccggcaggtgaggtccagctcccagtcttcgggagccgaagaatcaagttgccagacgtactcgttttttagcttggaaccgtccgatgtgaacgggccggtgcgcagcggatagaaagcaattgttggcaggcttgcctcgggtgatgtaaggattgcgttgttaaagtcgccgttcatgcttctcaaccggtcaaggatgtatgtcctgtaggaagctgcgtcgaaggtgccctcgttggtggctttcgacgtgagctgaagcgcgatgtgaagctgccggtttcccaaggcgtcctcgaaactgacaaggcggtggttttcgactgctgaaagtaggccctgatcactgctaaggacgtcgcgcagtgcatccggtgccacaaccgctccgttgaaatcgacggacaggtcgctcctgccgtaatggaagagcaggggcaggtcgaggaactgctggcggataatgtgttcgaggccaaattccttaagcacagcgttaagttcacgcacgcgcagcacatgtccgcggtcatggatgttgtaccggatccgcgggttgacgttctccttgcgcacgatcgtgacgacgagttcgccgtttccgttcgtttcgacgaggtagtcgtacgggttgaactgaaagatcatcgggagcacaccgtattcatcctgtcgggtgagccgtgccgacagttccgggttggccgcgatcgcctggcggagctctacggtgtagtccgtttcgatggctatgttgatctcaaggtcggacgcaccgtaggagccgaaggcactgtgggcgtacttcgtgatgtgtgcccgcatgttctcgctgataccctcaccgccgaatgccgccacgatatcgtagtcctcccacctgatccggtcgtcgtcgaaaagggctttcaggaagggcggataactaagaatgatgtaggtgtaatcaggcccgaactccagcatcgtggcaattaccttgtcacggtccgggccgatggatttgatcattgtcacgtctgtcagcgaagtcgtgacgttcatccctgttgcccatgctccgagtgagaagcagttgagcacgaacggctgcttcctcagtgtctcggcggtgcgcgagaagccaacctggagcagctgccttgtggcaaggcgttcgtcgaggccccgcacccagctggttggaacgcctgagcttccggaagactcatcaacaactacaccgtggcgcggaagcacgccgtccacgctgcgggcaggaatggtccagcgtttgatgtagctgtccttgtccgtctccggcagcgcggcgaaggcctccgccaccgtcttgcctttgagtgaaagccttccacttaggccatgttcggagaggaattcacgataggcaggcacacgtttggctgccatctcaaaggtccgccaggccctccagcgcccggcggtccaacggaaaggttcgatgcccggcatcagcagtatccggtgagttgaaacccttggcgtgaaaatcccgacgaacctgtccataagaaagacgaaggcaaagatgagtttcttagtcaaggtgtggctcctgtatggacatggtatcggtgagcagcatcgacgccgcagggcggcggtgggcctgtggcggggtggcgctataaccgaacctgaacagcatccacgccatcctgtccgcagactcgctgattccagcctccttgacgaattctgcgtgagaagaaggattggtgatcacagtgccaaaggggtggagatatacgcctttttccgaaaaaaagagccagacctgcataaaggtgcgcccggcttccaggaaatggccaggctccgcgaacgggccttccaaccatccaagctgccgcaccccacgcatggtgcggagataaacagcccttatgaaaccgcctatggctgggaaggaccaaaggttacggtgcttcatcgcgaatcgaagcacccggccgggaatgatcatggtctctgcactgaggccatcggcccgggctgccgcctcatcctttgaaaaccgcaaccactccataatctcggcgtagaccgcattattgcgcaagtcggaaaatagggtttcctggttaatccgcacgagtgaagaaacagttctgctgtcagtggttgaatggaattcgtatccatggcgggcggcaatggaagaagctgtcctcaggatttcctcatcgacaacccgcctgtcgtacggccggcgtgacgtccgcctggcccggaatgcagccaaagcactttcggccaaggactgggaatgggcgtcagcaactgctggttccaatcggactgtgccaataagatgcaaccggtcctcggcatcgaaatccatttcggaaagcttgaggctttccacggtgcggtatccccgggctgcggccaccacagacagtgactccaggaagacacccgcgcacacgtggccgaaagggattccgaacgattcggcaggcaacccgaggtcaaggtcgtaataaacaactgccgcggtctcgctgatcggcctcagcttaatcggctgggagttgtgtggagagggataccagcggacctcctccgcgatatcgagccagggtcccccaacatcttcagacatgacggccacagatttctgacggacgttcagataaggctctttcataaaccccaatgatgttgcagcaattcccgtccatgtcatgcaccgacgaatgtcccattcttcaatttccccccaaattgcgaacctgtgagaagagtatccggggcatcatcaagatcgccccagaattgtcacaggattgcaaaaagatcgactggcctgcccgtctgtcttggatccggggccaactcagggtggttgcccttagccttgcagaggatgctcgggcctacgtgggcggcgaggacactggacatcaatgcggatctcgttgacgaggatttgtccgcttgggccgccgccctggacggtgctgtcccacagttgacctggtgcgggtgttgccgcgcaggcggctgcccgggaatggcgaaagcccgtagtttcccaggattctgggaaactacgggctaccgcttgggtggcagatgagggattcgaacccccgtaggcgttgccagctgatttacagtcagccccctttggccgctcgggtaatctgccgaacttcaaaagaagtacccgccgatgcagtctgcgaaccgtccgcttccgggccgttccgcttccagtaaccgcgggcaagacaactttacagaacttccgccgaagaatcgaatcgggccgcggacccgtgcaaaacccctgcaatatcggggaaaactaacggaatcaggcctcgccgaggatcctgccggcgagccgttcttcgaacttgacggcctgctccttcgtgatctggttcagctggacagcccggagcagatcctcatggacgccctccatccgggccgaggcctcgggcacgggactgaagacgatggccgctgcaacggccgcggcggcgacggagctggcggcgccggcaaccgccccggctgctgctgtggtggttcgcgcggcataccggacggccttgtggtgcatggtgttcccttcgtgcaacttcccaactccttcaactctgcggtggcctccttcgttccctccgggtgtccgctgagagggaactgtgaacccggctcccccaccaacagcggcttccgtattaggcttttaggcagcgaacaagccctgtccgcgcacggggttcccaccagcacaaggagagtcatggcaggcgagtcaacgttcgacgtcgtaagcaaagtggacaagcaggaagtggccaacgcgctgaaccaggcccagaaggaactggcccagcgttacgacttcaagggcgtgggagccgaggtggacttcagcggcgaaaaaatcctgatgaaagccaactcggaggaacgggtcctggcggtgctggacgtcctccagtccaagctgatccgccgtggcatctcactgaagtccctggacaccggcgagccgtacgcctccggcaaggagttccggctcgaggcctccatcaaggagggaatcgcgcaggacctggcgaagaagatcaacaagctcatccgtgacgaagcgcctaaatccgtcaagtcccagatccagggcgacgaactgcgcgtgacgtcaaagtcccgtgacgacctgcaggccaccatggccctgctgaaggacttcgacgaagccgacctgcagtttgtgaacttccgcagctagctctttccgtcggttttcgacacgcaagatttgggccgccggccgcacgtcaggctggcggccggcccgccatgcgctccagccgcgcaatccggtcccgcatgggcggatgcgtggcgaacagcttgttcatggcgccgccgcggaacgggttggcgatcatcaggtgcgaggcgttcaccaggcgctggtcctgcggcagcggtgcaatggtgacgccccgctcgatcttggccagggctgaggcgagcgccagcggatcgccggtcagctgcgaaccgtcctcgtcggcgtcgtactcgcgcgtccgggaaatggcgagctggatcagggacgccgcgaagggagccagcagcgccatggcaatcatggccagcggattcgcgttgcgccggtcgccgccgaagaacaggagcatctgccccaccgaagtaatgacgccggcgacggcggcggctaccgacgaggtgaggatgtcccggttgtagacgtgcatcagttcgtggcccaggacgccgcgaagttcccgggcgtccaacagctgcaggatgccctgggtcacgcagaccgcggcgttgcggggattccggccggtggcgaaggcattcgggttcagggtgggcgaaagatagatgcgcggcatgggctggttggcccgggcggagagctcgcggaccgtttggtagagctcaggagcctgcgcctcggccacgggaatggcctgcatggaccggatggcgatcttgtcgctgttccagtatccgtaggcggtggtaaacacccccaccagggccataatccagatgggcgcggagctgcgggtgctgatgccgattaccgccccgagtccaaggagcaccgcccacagcacaccgaagagcgccgccgtcttgaggccgttgtagtgttggtgcacgtttcctccttactcactaagggaacggctgtctagggaacagggttccgggcgtcgtattccctgaagccgggctgcagctttgcggccacccatgcgccggcgacgcacaggaaaccgccgatcagcaggacccagccctctgccacgattttggtggcaccgcccgccagcaggtcgccgattctgggtcctcccgccaccaccacgatgaacaccccctggaggcgtccgcggaggtggtccggcgttgcggcctgcaggatggtgtggcggaagacgccgctgatggaatcggcaatcccggccagcgcgcagcacagtgccgcaggaatcagccacggcgtcaccgccccgtccggggcgcgcccggccagcagcaccaccagcccgaacccggcgatggaagcgccccaccccatcaccgagaagaccacggcactcccctgccggcggacattgccgagcggtcccgagaacagcccggccaggaaggcgccgatggcagtggaggcaaggaggacgcccacggtggcctcgccgccgccgatcatgaccgcgccaatggcaggcatgagcgcccgcggctgggccaggatcatggcgatcaggtcaatgacgaaggtcatgcgcaggttgggccgggtgcccaggaagcggaatccttcgacgacggagcggagtccgggcctgtgcgaggttcccgacggcggcaggggcggcagccggtagacggcccacaggacaaaggcgaaactcgcgaaatcgagcgtgtaggtccaggcaaatcccacccaggccaccagcacgccggccagcagggggcctgcggtcatggcaaggccgaaagacatcatgctgagggcgttggcagcgggcaggagttccttgcggaccagcatgggaaggatggcgctgcgggccggctggttgatggcctgggccccgctctgtgctgccacgagaaggtacaggacccacacgttgcccagctggagccaggactgcagggcaatcgcgccggtagtcagccacaggacagaggtggcgatcagcgccaccatgcggcggtcgtgggcgtcggcgatggaaccgcccagcagcccgccgatgaccagcggcaccagggcgaagaccgcgagcaacccaacgtagaagctgtcctgggtcaggcggtagacctccaggctgaccgccaccagcgtgagctggcttccgacggcggacacggctgagcccagccagagcctgcggaacgcgggactctcccggagcggtgtgatgtcagcgagcagtttccccaccctgcaaccctagtggtgcggatgtggctgctggttcccgggaggttagccccaccttattgtgagatgttcataataagtgcttgaatggtgtcatgacggaacactttgacggccacgaagcatgggctgctgccctgcgcgcccacggccgcagggtgaccaaacagcggctggcggtcctggccgccgtcgaacgccacccccattccccagctgaaagcatcctgagcgccgcccgcgccgagcttcccgagctgacggcccagtccgtgtatgtggtgctgggcgacctgacggacctgcacatgctccgcaggtttgagcccccgcactcccccgccctgtacgaaacacgggtgggagacaaccaccaccacgccatctgcatcagctgcggccgcgtggaggacgtcgactgcgcagtgggccatgcgccctgcctcaccccccactgggatgaggacgccaagccgatgaccatccagatcgccgatgtcatgtaccagggcatctgccaggactgccagcagtcccaacaacttccttccaatcgtccctcacaagaaatagagaaataggagaacaatgactgtcatttcaacaacccagtcaggtgcccccgttacgtccgacgcgcactccaagtccgttggcgccgacggtgccatcatcctgactgaccactacctggtggaaaagctcgcccagttcaaccgcgagcgggttccggagcgcgtagtgcacgccaagggcggcggcgcattcggcacgttcaaggccaccgaggacgtgtccaggtacaccaaggcagccttcctccagcccggcgtcgaaaccgaaatgctgatccgcttctcctccgtagccggcgaaagcggctccccggacacctggcgcgatccccgcggcttcgccgtgaagttctacacctccgagggcaactacgacctcgtgggcaacaacacccccgtcttcttcatccgcgacggcatcaaattcccggacttcatccactcgcagaagcgcctccccggcacccacctgcgtgacgcagacatgcagtgggacttctggaccctgtcccccgaatccgcccaccaggtcacctggctcatgggcgaccgcggcctgcccgcctcctggcgtgaaatgcagggctacggctcgcacacctaccagtggatcaacgccgagggcgagcgcttctgggtcaagtaccacttcaagtccaaccagggcgtgaactccatgagcagcgagcaggccgagcagctggccggctcggacgcggacttctacatccgcgacctgtccgagaacatcgaagccggcaacttcccgtcctgggacctgcacgtccaggtcatgccctacgaggacgccaagacctaccgcttcaacccgttcgacctgaccaaggtgtggccgcacggcgactacccgctgatcaaggtgggcaccatggagctcaaccggaacccggagaactacttcgcgcagatcgagcaggccacctttgcgccgtcgaacttcgtgccgggcatcgccgcctccccggacaagatgctgcaggcccgcatcttctcctacgcggacgcacaccgctaccgcgtgggcaccaaccacgcccagatcccggtgaaccagcccaagaaccaggtcaacaactacagccaggacggcgccgggcgttaccacttcaacgccccgtccgttccggtgtacgcccccaactccgtgggcggccccgctgccgtggagccgcagaacccggccggcggctgggagaacgacggcgagctaaccctcgctgcgcactccctccatgctgaggacagcgactttgtccaggccggcacgctgtaccgcgaggtcttcgacgacggcgccaaggcccgcctgctcgagaccatcaccggtgccgtgggcggcgtgaagagccccggcatcaaggaacgcgccatccagtactggacgaacgttgacgccgacctcggcgccaagctgcgcgccaacctcggtgccgctgacgccccgtcagccccggcttcggacgcagaatcagccaacaagatcggctgatccagcctttcctaaggttgctccaaggggccaccccgccacggaatccgtggcggggtggccccttttccacacaggtccccccatagggggactttgtgcacataggggacgctttgcacatagcaggtccgtgccctgtcctccggtgcggggcgcccctaggctcgcaccatgacaactttccagggcatcccggccggcgccttcgggttttacgaagagcttcaggacaacaacaaccgggagtggtggcaggagcacaaggccgggtaccagtcgctggtcaaggaaccgctggcagccctgctcgcagagctggagccccgtttcggtccggcgaagctcttccggcccaacagggacatccggttctccgaggacaagtccccgtacaagacggcccaaggtgcggtggcgtccgtccaggagggcgttggctactacctgcagataagcgccgacggcctgctggtgggcgggggctaccactcgcacacccctgcgcaactggcgcgctaccgcaattcggtggacgcctcaggcaccggtgaggctctccgtcacattgtggaggctgttgccgctgccggcttcaccgtggagggcgagaagctgaagacagtgcctcgggggtatgcccgtgagcatccgcgggcggaactcctgaaacagaaagccctctcagccagcgtcggcctgggccggcccgagtggctggcaacccccggcgcggtccaggaaatcgcggagctgtgggaggacctgcgcccgttggtggattgggtcagccggcatgctgccccttgagccgtgtttcctcccccgatgaggccgcagccgggcggtgccccttcttggccagctggatctgttcatagacgtggtggcgcagctcggtgaagcgcggcagggaacgggtgttcagctggtcacggtccgccgggaggtcgatctggatatcctcctggatcaccgtcggagagctcgacaggatgatgacccgctcgccaaggtagacggattcgtcaatgtcgtgggtcacgaacagcaccgtcacgccgagcttcttccagacaaccctgatgaggtcctcaaggtcggcccgtgtctgggcatccaccgcggcgaacggctcgtccatcaacaggacctcgggctggtaggcgatggcccgggcgattgcgacgcgctgctgcataccgccggaaagctgccaggggtaggaccgcggaacgtgggagaggcctaccgattcgagggcgtcgtccaccagccggtcgcgttcgcatttggggacgccctggtttttcagcggcagttccacgttgtccctcacccgcatccaggggaacagtgagcgcccgtactcctggaagaccaccgccatcttcttgggcggcccggtcacgcgcttgccgtcaaggagcacctcgccctcggtgggcgccatgagcccggagatgcacttgagcagcgtggtcttgccggacccggaaggccccaccaggcaggccagctccccggcgcgcaggtcgaaggtgaggttccggacagcctcgacgtccccgccgtcggcctggtagaccttcttcagcccccgcacggagagcgtggcctccgtgtttggttgagtgtcaggctgcattttctacctctttctggccgtggtaccagcgcaggatgttccgttcggcccactggaagatgaaggacatggccacgcccagcaggccaaggaccacaatgccggaccacatctcggggatggcgaaggaccgctggaactggacgatcgtaaagcccagcccggaggacgaggcaaacatttcggagatcaccatcaggatcagcccgagggacagcgactggcggacgccggccatgatctgcgggctggcggagggcagcaccaggtaccggacccgtgcccagccgctgatgccataggtgtgggctgaatcggagaggacggggtccacggcgcggacgccttcgatggtgttcagcagcaccggccagacgcagccggaaatgatcaccatgaccttcatggagtcggttattcccatgagcagcatcaggaccggcaccaggaccgggggcgggatggcgcggaaaaactccagcgtcggttccaggagggcccgcagccagcggacggagccgatcaggacaccgcctaccaccccgatgaggatggccacggcgacgcccaccacgagccggcccaggctgggcaggacatcggaaaagaagcggtcaccgaaccagacctcgccaaacgtctccacgaggtctgccggcttggggacaaagaagttgactgagcccagggtggacaaccaccagaccaggaccagcagcacgggcagccccaggatgtagccgatgttcctggccgtcctcatacgatcacctccgaccggatggacgagtgccagcccaggatccgcttttcgatctggcgcatcagcatgttgatcaggacgccgatcaggcccgtggccagcaccagggcgtacatgcctgaaatggccccgccggactgggcaagtgctatttccctgccgagtcccggggatccgatgacgagttcagcggtgatggccagtaccagcgccacggcggcggcgagccgcacgcccgtcatcaagtagggcagggcggtgggaaaaaccacgtaccggatccgggccatcctgcccaggccgtaggtctttgccgtgttgttggcaaccatatccacgtcggccactccgtacagcacctggatcaggacctgccagaaggaggcgtacacgatcaggagcagggacgactcgattttcacgccgaagagcagtacggccaacggaatgagggccaccgacgggatggggcgaaggaactcgatggtggagttggtggccttccgcaggaaatcgctggagccgatgatgaagcccagcaggacggctgccgccactgccatcagcagccccaggaaccacgccttcatggtctctcccaccgcaacccagaaggccgtcagcccgaagtcgacaaccaaggcggctatgacctcgctggcgggagggagaaaccgttcatcaatcaggccgagccggggaatgagctcccacgtcgccaggaatccgataatgcccaggatccccagcagttgtttcgctgcccccttgcccgccttccggcgctgccgctccttaggtggagcggcaccgccggcggccagggttcctggactcacgggaggaggtcgtccgcactgggggctttggagagcgtgccgtacttggctgccgcgtcgcccagcgtcttgaacgcgccctcgtcgaactcaacgcggtagcgcgggaggatcatcttggcccgcgtggcctcgtcgatcttggtgtacgtgcccacgatctcgcggacttcgtccgggtgctcctgggcgtattccagcgacttgttcatggcgcgggtgaacttctccgtcaggtcggctttgccgctaatggtgtcgcccttggtgaagtagccggcgatatcgagttccgggctcatctccacgaagttcgacgacaccactgttccgccttcatccacggccttggacaggaacggttcaaggatccaagctgcgtccacctgcttgttggccagcgccgcgggggcgtccgggaaggccacttccacgaacttcacggcggtgggatcgccgccgtccttctcgatgaccgacttgatggtggtgtcgccgatgttggagaggttgttcacggaaacagtcttgccggcgaggtccttggcggactggatgtccgatccggccgggacaacgacaccgccgatgtccttgccctcttcacccgtggtggaggcaccgtttgccacgaacttcaggtccagccccttgtccttggccaccatcaccgagatcaggttggagaaggcgaagtcgaagctgccgctcaccacgccgggcacaatcgccgcgccgcccgtggctgtctggatatccagctcaaggccctcttccttgaagaagccctgcttgtcaccaagatagatgggtgcgcagtcgacaatggggatgacgcccacgctgaccttggtcaaacccgcttccccgcccccggtggcgggtgcggttccacctcccgtggaactgggcgagccgcttccgcaggccgccagtccaaggatggaggctgctgccagaacggaaataagacgacgtgacatgttcactccttcgtgcacatgaccgggaacatctgcgttccctagccctgatgttcgccattcgaacaagcgttcgattactctgattcaatcatggtacggcggtcaagccacccatgtacggctcattgttacagctctgagacggcggcgtaagggacgcccggtgcagcctgctgctgcggtggcggcgggaagtacggccgagagggcgctcagccgtcctgtccgcttgccgccagccgggcctcaaggttgttgaagaagaccgtgagcatcagttcgaaggccttcgtggctgcctccggctcgttcatgaccacgaagtcgaactggagtccgtagaaggtggaggtgaagagccgcgcgtcggtatcggcgaattcctccggtattccctggaccatcagccagtcgcgggtcttgtggtggagcatccggaagtgctcctgcgacgttccccgcggctcggcggcaacgatgtcctgcgccgtcgcttcaaattcgagccgggtcaggtgccggttgcgctgcgccatggtccactgccaggagtccagcaggaactcccgccaggcggcgcggtcgatgtcccgcacgtccgtgttgcgcatccggtccagccgggactcgatggaaacaacgatgtcgttgatcagctgatcccggctcccgaagtggtacaccagcacgtaggcgctcgtccccaggccctcggccaggctccggaaggtgagctcggccagcgtcttgtccatcaagtagtccaggatggcggcgaggagctcggccttgcgttcgtctcgtgttgggcgggccataagtccaatcctaagtggcggctccatcctggaagccgggcatgcgaatgcccgcccgggcaggcccgggcgggcattcggtacatggtcagacgcgggtaagctcgtccccgccgtcgcgcacctggccgggcgccgttccgttgacggcggtgctggcgtcgccgaaccgctcgttgaggcgggagtggcgctggccgtaggcaaagtagatggccaggccgattgccagccagatggcaaagaagatccacgtctccaccgcaaggttggtcatgaggtagaggcacagcacggcggacacaatgggcaggaccttcccgaacggaacgcggaaggcgggcttaaggtcaggccgcttcttgcggagcaccagaatgccgaggctgaccaccacgaacgcggacagcgttccgatgttaatcatttcctccagcagatccacgttggtcaggccggccaccagtgcaacagcggcgccgcagatgatctggaggcgcaccggcgtcgaacgcttctcgcttgtcctggacagcgcccggggcaggaggccgtcgcggctcatggcaagaaccacgcgggacaggcccatgaggagcaccatgatcacggtggtcaggcccaccagtgacccgaaggcgatgaccttggccgctgaggtgtcgcccacggcctcgaaggcggtggtgagggtggaattttccgcctcggccaactgcgtgtaggacaccattccggtcagggccagtgagaccaggatgtagagcagggtcaccagggcaagtccgccgaagatcccgcgcggcagggtcttctggggattcttcacttcttcggcggaggtggccaccacgtcgaatccgatgaacgcgaagaacaccagcgcggcgccggcaaagatgcccagggtgccgtactgggccggggcggcgccggtgaggaaaccgaagaatgactgcttgaggacgtcggcggcgcccgtgccgccggtgggctcagcggccggaatgaacggggcgtagttctcgaacttcacgtagctgaagcccaccacgatcacaaagaggacgacgccgatcttgatcagggtgaagatgttgcctacgcgggcggacagcttggtgccaaggaccagcagcacggtgaagacggcgacaatcaggaaggcgccccagtaaaggtcaaccccgcccagggagaccgcggccggaatgtcggcccccatgagggcaaacaccttgctgaggtagatgccccagtacttggcgatcacggccgccgcggtgaagagttccaggatcaggttccagccgatgatccaggcgaggagctcgcccatggtggcgtaggtgaagacgtaggcggagcctgccaccgggatggcggtggcgaactcggcgtagcacatgatggccagcgcgcaggtgaccgcggccacggcgaaggacagggttactgccggtccggagaagttggctgccgctttggcgcccacggagaagatgccggcgccgacagccacggcgacgcccatgatcatcaggtcccacgtgctgagggaacgcttgagcttgcgtccgggctcatcggcgtcggctatcgactgctcgattgatttggtccggagaaggttcataggggatcacaatcctggtttcggatggaaacagacctattaacgctagtgtccatccactggacggcccgaattgttccgaatggtgagacacgtgcagtgccaaacgttgttccggcaaacgcgcttgggaccctccggatggagggccccaagtgtgcttcggccgaattactaagcaggccagtccatcagggtagagcggatcaggaaccgtttgccctccggcgcttccacggaaaacccgctcccccgccccggcaccacgtccactgtcaggtgggtgtggctccagtaaccgaactgttcccgggacatccagaattccagcggctgcggctccagtccgtcggagaggtcgaagagacccagcaggacgtctgcgtcaccggtgatgaagtcgcccgccggatagcacatgggcgaggacccgtcgcagcagccgcccgactggtggaacatgagcggcccatgctggagccacagtttccgcagcaactgcacggcggccggggtgagcgccacccgggagaactcttccccgggcagcgtcaccgcagccttcagcgtgtccggcatcagaacctcaggaccacgcggccgtcgatcttggcgtgcttcatctcgtcgagcaccgcgttgatctcagaaagctcccggactgacacggtggggtggatcttgccctgcgcgtagaagtccagcgcttcctccatgtcctgccgtgttccgacgatcgaaccgcggaccgtcaggcccttgagcacgatctcgaagatcggtgcgggaaagtcgccgggcggcagcccgttgaacacgatcgtcccgccacggcgtgccatgccgatggcctggccgaaagctgacgggtgcacggccgtgaccaggacgccatggcaacctccggtttcgcgctggatgacttccaccgggtcctcgtgcagggcgttgaccgtcagttcggcgccgtgggccttcgccagggcgagcttgtcgtcggcaatgtccacggccgccacccgaaggcccatggccaccgcgtactggacggcgatgtggcccaggccgccgatgccggagatggtgacccactggccgggcttggcctcggtcatcttcaggcccttgtagacggtgacgccggcgcacagcaccggcgccacctcgacggggtcggatcccgccggtatgcgggcggcgaaccgcgagtccaccagcatgtattcgccgaacgagccgtccacgctgtagccggcgttcttctgcacttcgcagagtgtttcccagccggtgcggcagtactggcagtccccgcaggcggaccagagccaggcgttgcccaccaggtcaccgacggcaaggtcggtgacgccctcgccgagggccaccacttcccccacgccctcgtggccggggatgaagggcggtgagggcttcaccggccagtcaccttctgccgcgtggaggtcggtgtggcagacgccggtggtcaggactttgaccagtgcctgtcccgggccgggagtgggaatctcaaggtcttggatctggagatccttgccgaattcggttactactgctgcttgcattctcgtcgtcattggcgaaatccttgcgtcgttgtagcggggttggagctggggtgcagcggcggcttctagaagaagccgagcttgttttcgttgtagctgaccagcaggttcttggtctgctggtagtggtccagcatcatggcgtggttctcacgcccgatgcctgaggacttgtagccgccaaacgcggccccggccgggtaggcgtggtagttgttcacccagacacggccggcctggatttcccggcccgcccggtacgcgacgttgccgttgcgcgaccagacgccggcgccgaggccgtacagggtgtcgttggcaaggcccatggcgtcgttgtagtcgctgaacttcgtcactgccaccacggggccgaagatctcctcctggaagatccgcatcttgttgtggccctcgaagaccgtgggctggacgtagaaaccgccggccaggtcgccgggcagttcggcccgggcgccgccggtcaggaccttggcgccttcctgctttccgatgtcgatgtaggaaaggatcttctcgagctggtcgttggatgcctgggcgcccacctgtgtctcggtgtccagcgggttgccttgcttcatcttctccacccgggcaacggcgtcggccatgaaggactcgtagatgtcttcctggaccagggcccgggacgggcaggtgcacacctcgccctggttgaacgcgaaaagcgcgaaaccttcctgtgccttgtcgtagaaggcgtcgttctcctgggcgacgtcgttgaagaagatgttggggctcttgccgccgagttcaagggtgacgggaatgaggttctggctggcgtactggctgatcagccggcccgtggtggtctcgcccgtgaaggcgatcttgcggatccgggggctggacgcgagcggcttgcccgcctcgacgccgaagccgttgaccacgttcaggacgccggcggggagcaggtcgccaatgagctccatcaggaccaggatggacgacggcgtctgctcggcgggcttgagcaccacggcgttgccggcggccagcgcgggagcgagcttccagacggccatcaggatggggaagttccaggggatgatctggcccacgacgcccagcggctcatggtagtggtaggcggtggtgtcgtcgtcgagctgcgaaagccggccctcctgggcacggacggcggaggcgaagtagcggaagtggtccgcggctagcggcatgtcggcgttgagggtttcgcggatgggcttgccgttgtcccaggactcggcgacggccagcatttccaggttctcgtcgatccggtcagcgatcttgttcaggatggcggcgcgctcggccacggaggtcttgccccaggacggtgcaaccttgtgcgcggcgtcgagggccagttcaatgtcctcggccgttccgcgggccacctcacagaagactttgcccgtgacgggggtgacgttttcgaagtactggcccttgacgggggccacccactcgccgccgatccagttctcgtagcggtccttgaaggtgactttcgaaccctcggtaccgggctgggcgtaaacagtcattgctagctcctttgctgtgcatggggcggaggccgggtcatggcctcctccgttgcactcagcgtaggagggcaaaggttgcagtcaggttgcacaagagtggtccagctcacagcagaggttgccgggcggaacgacggcggcacatggctaggcgctgagttcggcttccagccgctcgaggtcggcgacgacggcggcacgcttgggcgagcgggcaggcagcagtttcagggcggcacggcggaccccgacgtcgtccctcgcctccggcagctccgcgtacctgagcagcgtttcggcgctgccgtcggtgaggacggcttcccgcatcagggatgagaccctgtcccgaaggtcgatgatgccgggggcctcggacttgggcagtacggcgccgcggtagatctccagtgcgatccggtgggcgccgcgctgcaggcagttaagcacctggctgctgtccggcacaaggtccatggtgagcatgtacggccgggactccggcacggcggacgggttgagctgctgcaggaccttgcgcagcctgaccatttcggcgcgcagggtcatggtggagccgtcgcccgggtacaggaggacgctgagttcctcggcgctcagtccgtcagggtgcgagcccagcagggcgaggatttcgctgtgccgggcggacagcaccacggttttgccttcgatgctgaggagggcctggtcgcggcccagcagctggaggctgttgcggtacaggctgccttccttcgcccctgcccccggtgaccgggaagcgctgccctggctccgccgtcgtgcgggcctgctggccagcgaggccgccagctgcagccgctcaacccgcagctgggcctgcgcggcggccacggtcgcctcgacgagcgacaacgtgtggggtgccaccgccgtggccgtaccggttatgtccaccacgcccaggacggcgccggaatccggatcgtggaagggaacagcggtgcagctccacggatggaccgtgcgctggtagtgctcggcaccggaaatctggatgccgcggcccagggccagggcggttccgggcgcactggtgccgacggtggcttcggaccagtcggcgcccgggacgaacatcatgccctcggcccggcgctgcagcgcagggtccccgtcaacccacagcagcctgcccacttcgtcgcccaccgccaccagcaggccgctgtcgtggctgggctgcaccaggagtttgttgatcaccggcatgatggcagccaggggatgctgcctgcggtagtcgtccagctcgtccaggtccatggccagcggggccgcagggttgtccgggtttgccttgaagcccgccgaccgctgccaggattcgcggatcaatgcacgcaggccgggcagctccggcgcatcggcgaacgtgccgccgtcgagctgctcatgcgcggccagggcgcggagctgcagcgactcgccggcgccgggctgggtgaggttcgtcatcgaactcctggttgctgcaatccgtctgcaagggggcatggccgcatgctgccggccaaggggtggacgccattgtagcgcggctcccctcccccacctagctctcgagtttttgtccacttatgcagggttaaggggcattcaagcctgcatatctggacaaaaactccggctcgggggcgggacgggtcagccgcgggagatgcggatcatctcctcgcgcggcaccaccttgatgcgttcgcggaccacgtggtccaggccctcgggacctgtccaggccgcaccgagctgtgtttcgtgggagtcgagcctgttccagccctcccacgtggtgtattcgatgccgcgctcttccagaagatcgatgatggcctggggatcgggattctgggccggcggcagggaaagcctgtcctcaagcaggaaaccgatggtctccagggcgtcgcccttggtgtggccgatcaggcccaccggtccccgcttgatccagccggtggcgtagatgcccggaaccgggttgccatcggcgtcgagcacccggccgccctcgttcgggataacgccgcgcttggcgtcgtactccagctcgtccagcgcggagccgtggtagccgatggcccggtagaccgcctggaccgggtactcgacgtactcccccgtgcctttcacgttgccggtgccgtcaagctgcatgcgctcaaacttgatcccggccaccttgcccgtgccaccctccccgccgtcggcaaggatttccaccgggctgtgcaggaaatgcaggtgcagccggcgggacgaggggttctccgactctgtgtgttcctccaccagccagttggtgagggtgttcaccatggtcttgatctggttgttgctgcggatggcttcatcggaggcttcgtcgaattcgaagtcttccgggtaaagcacaatgtcgacgtcgttcatatggctcagttcgcgcagctccaacggcgtgaacttcacctgggcagggccgcgccggccgaacacgtgcacgtccgtgaccggggaagacttgaggccggcgtagacgttgtccgggatctcggtgctcagcagctcttcggggtgcttgaccagcatccgtgccacgtccagtgccacgttgccgttgccgatcacggcgatttccctggcgtccagcggccattcgcggggaacatccgggtggccgtcgtaccaggagacgaagtccgcgccgccgaacgagccctgcaggtcgatgccggggacatccaggtcagcgtccttgacggccccggtggagaagatcacggcgtcgtagaaggcgcggaagtcatggagggtgaggtcacggccataaatcacgttgcccaggaaccggatgtcgccgcggtccaggaccttgtgcagcgcgttgacgatgcccttgatgcggggatggtccggggccacaccgtaacggatcaggccataaggcgccgggtaggcctcaaagaggtcgatgctgacctcaaagtcgccgtccttgaccccgctggacttggtcaggatgtccgcagcgtagacgcccgccggtcccgcgcccacaatggcgacgcggaggggacgggaagaggtggtttcgctgtggttggacaccggaagcccttctgaactgatcatctaatgcatgacgtcgcgccgaacaggtagcgcacagtcccctattctaggcctcagccgctcttcgccagcggaaccacgtcgccttcccggtacagcagcgcccgcaactcggcttcggctgagtccggccgtttggggtcgatggtctcgccctcgtggtagtggtccaccacgcgcgggtccacgtagctcttgcgggcgatggacgcagtgttgcccagcacctcggacgcgtcaatcatggcccggctgatggcgcgcttgcgcttggcggccgtccgctgcgggccggtccgtgccaggctggcggcggcagctgcagttccgcgcagggtccggaagtccttggcggtgaagtcggagccggtccgttccttcacgtaggcgttgatgtccgcgctggtgacgggacgccagtgccggccctccttgtacgccaggagcctggcgttcccgccgcggcgcttgagcaggcgcagaagggcggcgaggtcggcgtcgcggatttccgactcccagtccttgccgctcttggccgggaaactcaggtggacccggtccttgcgcacctgcacatgggcacacaacagggtggcaagcccgtggctgccgttttcgttcgtgtaccgttcggaccctacccgcagggatccgctgtccagcatcctgaaagcgccggcgaggacccgctctcgcgggaacccttccccgcgcaggtccatggtgacccggcgccgggcggcgggcagcgactcggccagctgcagggcgcggtcgaacttgacccgatccttccgttcccgccattccggatggtaaatgtactggcgccggcccacggcatccagcccggtggcctggatgtgcccgttctcaaacggggcaatccagacgtcggtccaggcgggcgggatgccaatgctctccagcctgtcccggacaggtccgggcggcagcgttgaaccatcgaggtcccggtagctgaagcccttgcctgcggcgacacggcggtagccccggcctgaggccttgctgcggcggagcctcacagggccgtgcccggccgcttcgcgaatgtcatgaaagcaagcctactgactatttcccggattgcatgtcctgcctgctggaatacctgcccctgaggtggtgttatgggtttcgtgccctctcccgacggatcgtcctccctcagcgccccggctcccgcggctgccgccggttcctcccccggctcttcttccccggcaggccccaaggcagtgggccccaaggcagtggacaaggagacgacggcgggagtcctctttggcatcgccgcctacgggctgtgggggctgctccccctgtacttctttgtgctcatgccggccggcgccgtcgagatcgtggccaaccgggtggtgtggtcgctgctgttctgcgcactcctcatcacggttacccgcgcctggtccgccctggcacaggccctccggaaccgcgccgtgttcggttccctggccctggctgccttcctgattgccgtcaactggctcacctacacctatggagtcaccaccgggcaggctgttgaggcgtccctaggctacttcatcaacccgctggtgtccgtgctgctcggtgtgttcgtcctgaaggagaagctgcgtccgctgcagtgggccgccgtcggcatcggttttgtggcggtgggcgtcctgacctactcctacggcaagctcccctggattgccctgacgctggcgttcagctttggcctttacgggttcgtcaagaaaagggtggggccaagggtggacgccgtcacgagcctcagcgtggaaaccatggtgctggccccgttcgcagcggccatcatgatcttccttgccgcgaccggaaccggcaccctcaccacgcagggtcccggccatttctggctcttgctggcgtccggggtgatcaccgcggttccgctgctgttcttcggcgcttccgcccgcaggctgcccatgaccaccatcggcctgctccagtactgcgctcccgtcctgcagttcatccttgccctggtggtgttcagggaagcgatgaccgtggaacgctggatcgggttcggagtggtgtggctggccctggccgtcctgaccgtggacatgctggggacggcacgcaggaactcggtggctaaacgcgcaaagcggggcatatgacgtctcctgccgcgggaaacaccaggcgtgcccgcatccgtattgccgtcgccgcgctcctcgcgcttgccgtcctggcggcgctggtgctgctcactaacctcccgtcgggggaccagccgcccggacctgccagccctgaaccttccccgcccgccacatcggcaccagccccagcggccgggggacccgcggtggagacgtccagcttttcggggtccggcgacgtggcggatgacgcggccatctgggtggaccccgccaacccggccaacagtgtggtcatcgcggacaacaaggcagacacggacgggggtgtcggggtgtttggaatggacggcaaaatgatccatttccgtccggacggaaagatcggcaacgtcgacctgaggacagggtttccgctgtccggaaaatcggccgtgctggtgggcgggaacaaccggacggacgacaccctggccctgtggaccctggatacggaaacccgggagcttacacccgttgcggcaggcgacattcagacgttcgcacccaactacggcttctgcatgtaccgcagcagcgccagcggcaagttctacgcctttgtcaccccgaacgaggaagggtccatccaacagttcgagttggttgacgacggcgaaggccgggtggaggcggagctcgtcagggagctcccggtcagcagcatcacggaaagctgcgtcgcggacgacgaactggggcacctctacgttgcgcaggaggacgtcggcgtgtggaagtacagcgccgaacccgacgccggaacggaacgggccgccatggacaaagccggcgcggggcgccttgtggcagacgtggaagggatgggcatcagctacggccccggcggctcaggccacctgttcgtgtccagccagggcgactccaccatcgccgtctatgagcggtccggtgacaatgccttcatcaaaaagttcaacgtgggcgggaacggggatatagacggcgtgtccggaaccgacggcctggacgttacggcactggatgccgggccgcagttcgagcagggacttctggtggtccacgacgaaaagaacagcggcgggggaacgtccaacctgaagtacgttccgcttgcctcggttttggagtaacgaagccccaggccccggaagcatgctctccggggcctggggctgtgtgcgcccttgtggggggcgccggctctgtgcgggtgttacgcgttggccctgatggcggcggcgaggacgtccagtccgtcattgagcaggtcatcggtgatgaccagcggcggcagcagccggatcacgttgccgtaggttccgcaggtcaggatgatgacgccttccttcaggcaggcagcggccacggccttggtcagctccgggttgggttccttggagccggcctggaccagctcgatggccagcatggcgccgcggccgcggatatcaccgatcacggctgatccggcagcggcgagctcggactggagttcgcggagccggccggtggcgagttcctcgatgtgcttggcgcggccgttgaggttgtactcctccatggatccgatggaggcaagggcagcggcgcaggcaaccgggttgccgccgtaggtgccgccaaggccgccggggtggacggcgtccagcaggtctgcgcggccggtgatggcggagagcggcatgccgccggcgatgcccttggccatggtcaggatgtccgggacaacgccctcgtggttgacggcgaaccattcaccggtgcggcagaagccggactggacctcatccgcgatgaaaacgatgcccttgtccttggcccacgcggcaagtgccgggaggaagccctcggccgggacgatgaagccgccctcgccctggatgggttcgatgatgatcgcggcaacctggtccccgccgatctgcttttcgatcatggtgatggcgcgcttggcggcctcggcaccggtgatctccgggttttcctcccggtaggggtagctcatgggcatgcggtagacctcgggcgcgaacgggccgaagttggtcttgtacggcatggccttggcggtgagcgccatggtgaggttggtccggccgtggtaggcgtggtcgaaagccacgacggcgtcgcgtccggtggcgaggcgggccaccttgacggcgttctccacggcctcggcgccggagttgaagaggacggtgcgcttctcatggtcgcccggggtgaggcggttcagttgctcggccacggccacgtagccctcgtagggggtcaccatgaagcaggtgtgcgtgaagtgctccacggcttccttgacggccccgacgacggcgggatcggacgcgccgacgctcgtcacggcgatgcccgagccgaggtcgatgaaggagttgccgtcgacgtcgtggatgatcccgccgtcggcgtctgcaacgtagacggggacgctggaggcgacgccggcggcgacgactgccttgcggcgttcggtcagggctacggacttggggccggggaagtcagcctggacccggcgcttctgctccaggcggaaggtgatgtctgatgcggtggtggtcatgggaaggcctttctttgaagcctggggtttgctgcggtggggaattaagagtcgagggcggacatcacgtgcttgatgcgcgtgtagtcctcaacgccgtacatggagaggtccttgccgtagccggactgcttgaagccgccgtggggcatttcggcggtgaggaggatgtgggtgttgatccagacggcaccgaaatcgaggtcccggctgagccgcatggccgtgccgtggttgctggtccagacgcttgaggcgagggcgtagtccacgtcgttcgccagctcaacagcctcttcctcggtgctgaacttctgcaccgtgatgacgggtccgaaggtttccttctggacaatgtcgtcggtctgcctggcgccggtgacgatggtgggttcgaagaagtagcccttctcccccgcccggtggccgccggtgacaatcttgcagttctccggcaggttttccaccaccgagctgacggcgttgaagtggttgacgttgttgagcgggccgaagtagttgtcctcgtcgttctgtgagcccgtgcgcagggtcctggtgtgctccaccatggcggccacgacgtcgtcgtgcacggaatcctcaaccagcacccgcgtgatggccgtgcagtcctgccccgcgttgaagaacgcgaactcggcaatcgccgctgcgctcttcttgatgtcggcgtccttgaagacaatggccggcgccttgccgccaagctccaggtgcgcacgtttcaggcccttggcggcacccgaggccacggcgatgccggcgcggacggagccggtgatggacaccaggccggggaccttgtggtccaccatcatggcgccggtctcgccggtgcccagcaccacgttcaggacgccggccgggaagatctccccggcgaggcgggccaggaccagcgtggattccggcgtggtgtccgagggcttcaacactacggtgttgccggctgccagggcgggaccgatcttccagatggccatcaggaacgggtagttccagggtgccacctgcgccacgacgccgatgggttcgcggcggacgtaggaggtgtgcccttcgaagtattcaccggcggacttgccctcgaggatgcgggctgcaccggcaaagaagcggagctggtcggcgccggcggcaacttcctccgaggcgatcagggaacgcacctggccggtgttgcggtgctgggcctccacgagttcatcgctgttggcctcgacggcgtcagcgagcttgaggagcatgagctggcgctgtcccggggtggcgtgcttccaggttttgaaggcgtccttcgccgcggtcatggcagcgtccacatcggcctgcaccgagacgggcgactgcgccaccacctcgccgttggtggggttcacgatgtccagcagggcggtgccggcaggagtgacgaacttcccgttgatgaagttctgcaaggtttggaccacggtgtgcaacctctttcgtaggggccgtccgcgcccgggcggaagtcagggcggatggatggaactgcctagagcctatgccagcgcccctgccccgtgaatagccacctgcacacccttcctgagcctgtttagtgcggttgcccagcacccctctatccttgatccatggccatttcccttgccgccctcctgggtgtgaactccctgaagctgaccaaagcagggctcgcggaaaccacctggcaccaggacatcaactgggtggcggtgaccgagctggaggatccgcaccgcttcattaacggcggcgaactgatcctcaccaccggcctgcggctgcggtccgcaccggagcagcggcgctttgtccggcaggtgcagcgggccggcgccgtgggcatcggcttcggcgtggggctctcccacgagacggttcccccggcgctgctggcggaagccaaccgctggggactgcccgtcgtggaggtcccctacgagacgcccttcatcgccatcggcaagctggtggccgacgcccagtcggcggaccactacgccaagcttgagcggctgatcgccgggcaccaggtgctggcacgcgcactgctcaccggcggcggactcgccgagctcctcaagcatctgggaggcatgctgcgcaccgacgttgccctgacccagttcacggcccagctctacaacagcagcagcgaacccccctcggcggacacctggtcctcctaccccgtccccaccggccggcgggacgcctgcaccctgtgggtccggcagccattcgaggattcaggcatcatcggctacgcccagaacctgatcagcgtcgagctgaacaacatggtcaagcagcgccaggcccagcgggcgttgtgcggccaggtcctcgaggacgtgatccacggcgccctggaaaccagcgaggcccagcggcgcctggcgggcgtcggcgtcaacagcacccgcaaaaacgtggttctgctggccgtctccgctgcacacaacaaagccttggtgagcacctccgtgccgcgcgaactggagaacgcggtagccgccgtcgtgggtaaggacctggtgctggtgataaatgacgacggcggcggcgcacctgcgctggcccgcaagctgagcgaccacctggccgaggcgggcctccatacgaccatcggaatcggcggggcctacaccaagccgaacggcctgcggtggagctacttcgaggcccgggatgccgccagccacggtttgcccgtcaacgagccggagcggctgagcctcacgtcgctgctgctggccagtgaggacgtgccgctggcggacatggccaatgaatccctgaacccgctgcggaccttcgacgccacacacggttcagaactgatgaccaccctggagagctacctcaacaacaacggctccgtggccgctgtggcggaggaactcacgctgcaccggaacacggtccgctaccggctggcgcagatcaccgaactgaccgggtacgaccccgccgtcaccacagaccgggtccagctttggctggccctggccgtggcccggctgggcgcgcggcagggcaagtagccggccctggcgtcaaaggacgccacggcgcagcagttcgcgggacttcctgcgggctttccggtacttggcttcggcgtccttcatcagctcgtcctgccggttctccagtgcagcgaagaccgcggccgcggctgtctgctcctggcgcgagcccgcggtgatgagcaggtcgcgggctatcacggcgtcatggaagtcgcccaggatcttctgctgccgctgcgccgccttggccaccttcccggcacgcctgccgcgcaccagggctgccgtttccgccacatgccggagccgcttggcatccttacggacctggtggagggcgttttcgtgatccgtcccgcgcctggcacgcgctgccgccttgtgcgagcgccgcagccgcctggctgacttgtccactgctttcgcggactcccggcggccccccgacacggcgtccgaccggaccggcggggtgtcccggaaggcctcgagttcgtccaggagccggaagtagcggtccgagcgcagcgcctcctgcagttgccggtacccgtcgtcgaactcaccgcccacccttcgttccacccggtcactggcggcgtcaacaccctcgcctggcggcagctcacccaagtgcccgcggagcctgtccagcaggacctccgcatcccgagggccgcccagcagctggcccagccacttcagttcgtcccgtaaatgccgcaccgggcgggcggagtagagcttgcggtaggccgcgagcgcggatcggatccgccgcactgccgaccgcatgttgtgcacggactcgggttcctccagccggacccccgggtcctgggccaggatttcctggatctgcccgccgaggtacacggtgacgacggcggccgctggcgctttcttgccggcagcaaggtccggggtgtttccgtcgcgagggccctggccgcccacttcgccgcccagggcgcgggccagcttggaagcgtggcccgcggggcgtgcaccggcctccatcagcagttcttcagccggggcaaagagctcgggtccgccgtggacaagttccaattcccactcgcgccactgctgctgcccgccggatatggcgcccgctccctttcccgggtgcaggcgctccgccgtcacgcggtcatcggccaggtccgccaggtgcccgccgtcctccccgtagagggcgtgggtggtgcgccgggtctcgagcctcaccaccggggccacggccgctccgcggaggtatgcctggatgtggtcgagcaggctgtccggcaccacgccgggctgtccgagcggggcatgcaattcccgccgctgctggggttctgtgccggtggccccggtttccagcggcggcagtttcaggtgccagcctgcgtcggttccgccggtccgccggcgaagggtgatccggcgggacgcgagaatgtggcggccggtgtcaaagtaaacggcttccaggacatcggtatggggagctgccaccctggccacgccgggaaggctgtccagcgcgggcacggcggcgccgtcgccgacgtcgtacttcttttcaatctcaagtccctgcgaagccttcacaagctgtcccttccgcttccgtgcaccgggtccggtccgtggcgtccgggctcccgctggcagtctattgcccggcgccacgacgccgggagagcttggccacagaaccgcagacatcaaacgtctaacctttaggctggagggatgcccgccccgtatcctcccgccacccaggcgccgtcggtccctgttccggccaccttagcgccagccgccgcccccgcttccgaaacggggaacgccaagccacgctccgccgtcgtcttcggcgttatagcgctggtgctcatcgggctgaacctgcgggcgggcatcacaggagcgtcggccctgctgcacgacctgcaaacagtgctgggctacggcgcgctggtggccgccatcatcccgtccatcccaacgctgtgcttcgcgcttgcaggggcgggcacgtcctggctgacgggatggctgggcgtggagaaggcgatcctggtggccctggccatgctggcgggcggactcctcctgcgcggcatccccgccaccggcatgctcgtggccggcagtgtcctgggcatgtccggcctggccgtctgcaacgtagccatgccctccttcatccgggagcactttgcccagcggacgtccctgatgaccgccgtctacacggtgaccatgaccacaggcgccaccgtcaccgccgtcgcggtggtgccgctggcgcaggcactcggctcaccctcggccgccgtcggcgccattggcatcaccgccgtggcggcactcctgggcttccttcccgtggcgctgcatgcgcaccggaacagtccccggacggccggcggacggatctccccctggccgttgctgcggacccgcaaggggctgctcctcaccgcgatcttcacgctccaggccctgcttgcctacgccctgctgagctggctcccctacatgctgaccaccatgggactgggcgccgcggacagcggactgatgttcgggctgatgcagcttgtctccgttccggcgggcatggtgctgatcgccgtcggttcccggccgcggatgctgcggcccgccttctacctggtcagcatcaccatggtggccgggctggtatcgctgctggtcctgccggtggggctggccgccattcctgccgccctgctggggttcggcctgggcatcttcccgctggtgatggtgatgatcagccgcagcggtgcgagcaccgccgaaaccaccgcactgtccacgctggcgcagtccacgggctacctgctggccaccgcggggccgttcgggatggggctgctgcacagtgccaccggcgcctggaccctgcccctcctgctcctccttgccctggcgctggcccagatcgtggtggcgcacctgatcacgggcaaggccatgaccaacgccgtggtaaggaagtagcggccatggcactgagtccttccgcccgcgcgccgctcgctgacgaggtcaccgccaaactgcgcgccatggtgcagtccggcgaatggcccctccaccagcgcatcccgtccgaaacagagctgatggccggcctgggggtctcacgcggcaccctccgcgagggcatcaaggccctggcccacagcgggatgctggaggtgcggcgcggcgacggcacctatgtccgcgccaccagcgaactgtccggcgcggcccggcgcatgtaccaggaccacaccgagcagcacatccttgaagtccggctgggcctggacacccaggctgcccgcctggcggcccgccatgcaacggccgacgacgtcacggccctgcgtgccctgctcaccgcccgggaccaggcctgggcagggggagactacgaggcgtgggcgcgggcggactgggggttccacgaacgggtggcgcaggcctccggcaatcccctgctgcacgagctgtacctcagtttcggcagcgccttccaccaggacctcctcaagcagcagcgccggcccggcttcgacggccgcccgcacgagggacacgaccacctggcggacgccattgaagcgcgcgacgaggacgccgcagccgccaccgttgaccggaacctgaactcctgcgcggagtggctggcaggatagtgcagcctctggggtttcttccaggcttaatcggtcagtaggcttactatctgaagaaggtagtcctgtccgccgcccatcccggcgcggcaggcaccgctgacgatgaggagtttccatggcgcgatcatcacgcgtgaccgagcacgagctgggcaaagagcccgcgcagacggcagggacggattcaaccgggacggacttagcagtggcgccgcattcgcagcggccggccacccgagtcccccgggacatcaagtccccctcccagctgtggggggacggcctgggccgcgtgggcatccggtgcgcccaggtactgctgatcctcaccgtggcggtggtctccgtctacgcgctgatgcagatcaagctcctggtgattcccatcctgatcgcgctgatcctggccgccgcaatcggcccgttcgtgaacatgctccggcgccggggcatgcgcggcggactggccacgggcattgcgttcatcgggctgctgctgctccttggcggcgttggcacggtgatctatttctcggtccgcagccagtggggcgaactggcccagcaggcctcctcgggcttggacgagctggagcagttcctgctgaccggcccggttcccattgaccaggggcagcttgaccaggcccggcagggaatcattgattttgccaccagcagccaggtgcgttccggcgccatcaccggactctccatggtcaccgaatttattgcgggcgccagcctcgtggtcatcatcctgttcttcttcctgaaggacggggccaagatctggaacttcttcctccgccccttcagcggggcccgcgaggcgaagctgcgccgggtaggcagccgcacccttgaggttctcggcggctacgtccgcggcaccgccatcgtggccctcgtggacaccgtggcgattggcgcggcactgctgatcatgcaggtgccgctggccttcccgctggccatcatcgttttcctcggcgccttcattccgctggtgggtgcaacggtggctggcatcctcgccgccctcgtggccctcgtggcgaacgggccggtggttgccctgatcgtggtggccgtggtcatcgcggtcaaccaactggagggcgacctcctgcagccggtggtcatgggcaagtcgctccagctccacgccctggtgatcctgatggcgctgacggccggcaccatcctggcgggcatcgtcggcgcggtcctgtccgtgccgctggcggccgtcacctgggccatcatccaggtgtggacggccgaagacccacacctcgaggacatgaacccggacctcccgccggccggcaccaacccgatctgaccccctggagtttttgtccagatatgcaggcttgaagtgcgttttggcctgcatatctggactaaaaactcaggcgaagaacatagcacgacgacggtccggcacctgggtgccggaccgtcgtcgtgcgtctattgctggagctgcggggcagctctgccgcgttaggagcggaggcccgcgaacacgttcttgggccgctgcatctcaccgtgcttggcgcccaggacaacaacggcgccggcgaacgcggggatggcccactgcagcatcttcagctgctgctgggcggccttcagctcgtctgaagcatccggacgcggttccgtggcaccctcggcaccctcggcggccagcttctccaccttcttgcccaggatgccggagtacagggtcacgccagcgcccaccacggtgaccgcggtcttgatgacggtgtccctcgccacgccttcctgcttggcgatgcggcccttgttctcccaggcgatggcgaggtccgccaccaggtgcgaggcgaacgcggccgtctggaacggcgcccacttcatccagcccgcactggaaagccgcgtccgctcggacgggtccttcgcctccgctgccgcaccattcaggccgatggcgcccatgagggatccgccgaaccaggctgctgccgtgagatcgtgaactgaacgggcaataagatttcctgccatggtgtgcattcctatcgttgagctgcctaagatgccgcgcctgcggacttcacttgccgtgtcccatcaaggtcatggtcagcccatggtaagcacacttactaatgttacgaaagcccgtcttccaccggcggaacgcgtaatatcgtggctatgggaaacacagggacgctgttcggctgggcatttggtgacccggcgcgggaacaagaggacgcatacgtaggaaacctgcaggacgaggccctggccaacgcccgggagaccgcaaaggccaaaggggtttccctggtgcctgactcccaggtgttcacagtcctcagtgccgacgactcactcgtggaactggacaacgcgccgggcaagcttgtggtccgctgcaccgtgcacgtcgagggaccgggtgctgaaaagctgcgcgccgaagggccgatgaacggctgaccgatgtcggacggggaatcgaccatcagccaggccgccgacgccgtcgagcaggcctccaacaccaaaaccttggatgtcctggcccgggccggcttcgccgtcatggccctgctgcacgtcgtcatcggcgccattgccatcaccgtggccttcgggcagcccggcgaagcggaacccacgggcgccatcgagcagatggccgcgaacccttggggcacggcaatcatgtggtcctgcgtgctggcatgctttggcctggggttgtggcaggcgagcgaggcgaccctgcgggcccgcccgctcccgcggaaggagcggctctccaagctgatctcctcgggtttcctggccatcgcctacaccagtgtgggtctcagctttgcgggcttcgccgtgggaatgcggggggactccagcgaaagcacccgggatttcagtgcctcgttgatggccacgcccgcgggactctgggcgctggtagccctgggcctgacaatcatcgggatcgggatctatttcgtcgccaagggcgtgcggcgcggattcaaggaggaactcttccactttgacggcacccggcgcggccggctgatcgacacgcttggcgttgccggccacatcgccaaagggatagcactgttcctcaccgggctgctcttcgtgatcgccgccgccaagcacgacgccgaagagtccaccggactggacggcagcctcaaggccctgcgcgaccacccgttcggaccaaccctgctggtggccatcggcgccggattcatcgcctacgggacttttgccctggtccggtcacgcttcggccggatgtagttccggcctgtttcggggtacggaggaaccatgacgcattccgcagctatagaccaaacccccggcgtcggctccgccgcaccgggggatgtaacccccgctgtcacggagacggcaggccgcgccttcgccggcatgttccgggtgctgaagctggccaggccggaccggcccatccacccggagggcctcggcctggcaggacggctgacacggaccggcagttccggggcaaccagcggggtggagtggctcgatactccgggcatcgactccgtcagggcccggttctcgcgatcggtgggattgccccagcagcttccggacatcctgggcctggccctccgcatcacgccaacctccggcggcatctcggacgtgctgttggcctccaccggctggcggcgtcccggcaggttcctgctccagccgaaactggacgttgccggcgccaccttcacaacgctgatgccgtaccggggcgggaaagggccggtgctgctggggctgcggaccagcgagctgccggccgggccgctgacaacgggagagtgggtgctgcacctctactgggccaaacccacgggaccctggcgcgaatgcggcgaactccgcctgcgggcagaaccggaaccggcggatactcccctgcgcttcaatcccctggagaaccagccgccgggagcgcagacctacgcctggacccgccgcctgagggaacactcctaccgcgcggcgcagcggccggcaccagccgccgtcgtacattccgccgttgcctcagccacacccgccgctacagaaaggaacaccatgtccaccgtgtcgcagctgttcaactcccccgccgccgatgtatggagggtcatcgccgacggatggctctattccggctgggtggtgggcacctcccggatccgggctgtggacgaccaatggccagcagcaggcgcccggctccaccactccgtgggcggctggccgctggtgatcgacgacagcacgcaggtgaccgccgtcgagcccggccgccggctggaagtcatcgcccgcggctggcccatgggtgaagccaaagtggtgatcacgttggaggaccaggacgggcaatgccgggtcaccatttccgaggacgccgtccgcggcccgggcaagatgatgcccaagttcctgcgcgaccccctgatcgctgtccggaaccgggaaaccctgcggcggctcgaactgatggcagcaggcggagccgggaagtagcgcggccgggttaacgcaggaaagccggccgcgggaatgttcccaggctgccggctttcccgccgtctgaacccttgttcgttagacctgcgcggccacgtcgtcgcgggagatgttgaccatgtcctcgcgcggtaccaccttgatgcgctcacgcttgacctcaacaccgtgcgagccgccggcctcggtggcggctgcgccgagggccagttcgtgggcgtccagcgccagccagccttcccagctggtgaactgcacgccgcgggcgtccaggagttccaccacggcgtcttcctggggtgcctgcgccacgggaaggttttcgcggtcctccagcaggtaggtcacggtctccagggcgtcgcccttggtgtggccgatcaggccgacgggtccgcgcttgatccagccggtggcgtagatgcccggcacgtgggtgccggcggcgtccaggacgcgtccgccgtcgttcgggatgacacccttggtgtggtcgaactcgatctccggcagggctgaaccgaagtagccaatggcgcggtacacggcctggaccgggtaatccacgaactcgccggtgccccgggcgttgcccgtgccgtccagctcggtgcgctcgaaccgcatgccggccaccttgcccggcgtctcggcgtcgtcatagatctccaccgggctgtgcaggaagtgcaggtgcaggcggcgggaagccttcagctcggagaggtcctcaggctgctcggcgatccagttggtgagcgtgcccaccatggtcttggtctggttgttggtctggatctggcggtccgattcctcgtcgaactcgaagtcctccgggtagaggatgatgtccacgtccttggagtgggacagctcgcgcagctccagcggggtgaacttcacctgcgcggggccgcggcggccgaagacgtgcacgtcggtgacgggcgagttcttcaggccggcgtagacgttgtccgggatttcggagaccaggaggtcgtcggcatgcttggacaggacgcgggccacgtccagcgccacgttgccgttgccgatcacggcgatttccctggcgtccagcggccattcgcgcggcacgtccgggtggccgtcgtaccaggagacgaagtccgcgccgccgaaggagccttccagctcgatgccggggatgttcaagtccgcgtccttgatggcgccggtggcgaagatgacggcgtcgtagtgggtgcggaggtcctcgatggtgaggtcggtgccgtagtccacgttgccgaagaagcggatgtcgccgcggtccaggaccttgtgcagcgcgttgacgatgcccttgatgcggggatggtccggggcaacgccgtagcggatcaggccgtagggtgccgggtagcggtcaaagaggtcgatgctcacggtcagctcgccgctcttgacggcttcgctcttggtgaggatgtcggcggcgtagacgcctgccggaccggagcccacgacggcgacgcgcagcggacgttcggcagaacctacggtggtgcttgatgacacggctgtgttcctttttcttcggtccgtcccaactaggtagcgctaagtgtcgttttgagggctcataacgacacttagcgctacctagttgggtggcggggctaggtggtgaggactcggggcttgctggtgcgggggctgttcggggtggtggtgctgtagtcagcggttttgaagagcgacggcgcgaaggggctcacgcgcacaacgtcgccgatgacaatgactgcgggatttgcgacgccggcggcttccgcctggtccgcaatggaaccaagcgtgccaatggtcacgcgctggtccggcaaatagccgttttccacgataccaactggcgtcccgtcaggcaggccggctttgcccagagcggacgcggactcgcgcagctggcccacgcccatcagcaggacaatcgtgtggtcggcccgggcggggacctcggagagttcctcgtgtccggtcaccacgctgaagcccttggccaggccccggtgcgtgacggggatgccggccgcagccggaaccgagatcgcggacgtgaccccggagaccagttcaacctcgacgccgtgctgccggcagtattcggcctcttcgccgccgcggcccagcacgtaggggtcgccgcccttgagccgaaccacgcggtggccgttcagggcttcctccacgaggatgcggttgatctcggcctgcggcaccggatggtggccgggggtcttgcccacctcgatgatgcggacgtccggggcgagctcgttaagcaggccgcgggggcccaggcggtccgccacaacgacgtcggcctggcccaagaggcggcggccgcggacagtgatgagcccggtatcgccgggtcccccgccaaccagcgcaacggaaccgcgatgggcgcggcggcggcgcagcggaaggtcgcctgtttccagggcggtggcaacggcgtcgcggacggccatggcgcgccgcgggtctcccccggcgttcacggcgatcttgacgtcgtccacttcggcaacagccggggtccacgccgcagaggcttcatggtctgaggcgttgacgcaccagatgcgctgcgcctcggcgtcggccgatacctgcgcgtccacggcggaatcgccggtggcggtctggacgaaccaggcgccgtcgacgtcttcggaacggtaggggcgcggctcccaggtgaggaggccggcgtcggccagttccttgagcgcggcggaggcaacgggagccacgacggtgacccgtgcaccggcgtccagcagccccttggcgcggcgggccgcaacggggccgccgcccaccaccagcacggggcggccgaggaggcgcagcgccgtggggtagatatcctgaattgccatgaatcaacggtagggcggcgtcacatatgccaacaacggcgcagcaacaccagttcacgtaaggtaacgctgcgtcacatagcctgccgcccgccgtcgtccgccatcgtggggcacgttcgcggggtcagggccgcatacgccgtgatccccggcgagtccgtgtcaatgtgccccggttcagctactgatgccagccaggaaccgcccgcggtcccgaatgagccgctgcaggtaggggcgcaggaccaggttttcgactgcgcggcccaggagcccgaacggcgccgtgaactccacccggtccgtcatgatgcacccgccgggggtggcctcgaattcgtggacgtggcggaaggacctgaacgggccttttacttgttcatccgtgaagctgcgggggaagtccatatgggtgacgcggctggtcatggtgagcggaagcccgaagtgctgtgcccgccaggtgacctcctgcccctcaccgatcagcccggacgtcacgccggccaccgcccgctcccccgagcccttctgggacttcacgtggacgtcgacgctgcgggccaggtcgaatagccgctccggcttaagggagctttcggtgcggcacacaaaactggcggtcatggggccagtctgccacccggcggacacagcaaggcccgacggcgggaggcggcgtcgggccctgcgggttgcggaaggtgggggtgcttagcgggtgctgccggccaggagcccgcggctgcggaggagtcgcttctcgatgggcccgaagaccagcagttcgatcaggatgccgacggcgaggattagcaggattgccgacatcaccacggccatgtcggacagctgccggccctggtccagcagggagcccaggccgaagccgatggtgccgcccacggcgatgatttccgcggccatgagtgagcgccaggaaaaggcccacccctgcttcaggccgccgaggtagcccggcagggctgcgggaaggatgatctgcagcgccatctccaggcgggacgcacccaaaacggtgcccacgcgccggtactgcggcgggatctggtccacgccggagatgaggccgttgatgatggacgggattgcgcccatgaacaccacgaagtacacggtggcgtcggtgaggccgaaccagatgatggccgccggaacccatgcaactgacggcaggacctggagtccggaaatcagcggcccgaacgcgcggcgcaccggagcaacctgcgccagcagcaagcccacgggcgtggcgatggccaccgaaatgatgaagccaaccagcccgcgttgcagtgacgtccacacggattcctgcactttgccctcgctccagaggacacccatctggcccagcacgtccatcgggcctgggacctggtcgcggcgcttcaggccgagcgagacgtagaactgccagatcaggaccagtactacgagcgcggcgatgggcagcaggatgcggctccagtcgatgcggttcttgcgcgcggcgtcggactgcagggagtccagcccggattcaagttcccgcaggtcctcgttgccggtggaggttcgggtgagcgcggcgtggatgtgccggggttccacgggctcaaccaccggatcagtgtcagccaggggggtttggttacttggcatggcggcggatctcctcccggagccgggcggtgatgactccggtcagctggccggcgagtccggcgtcggtgcggtgttcctcggtgacggcccattcctggaccacgcggccggggcgggaggacagcagcagcacgcgctggcccagccggacggcttcgcggacgttgtgggtcacaaagacgatggtgcggccggtttccttccagatccgctccagctcatcgtgcagcaggtcgcgggtgatggcgtccagggcggcgaacggctcgtccatgagcagcagctgccggtcctgcgcgagcgacctcgccagggacacgcgctgccgcatgccaccggagagctcgtgcgggcgcttgtcccccgccgcgcccaggtgcaccagttccaggagctcctgggccttggccttgcgctcggccttgccaacgccgcggagtttcagggccagctcgatgttctcccgggcggtgagccaggggaacagcgcggcgtcctggaacataaaggcggcaccgtcgctgggcacctccaaggcgcccgacgacggcggctccagccccgcgatgatgttcagcagggtggatttgccgcagccggaggcaccgaggagggcaacgaactcgcccttcccgatggtggcgttgacgtcgtccagtaccggggcgccgtcgccgaagcgcttgcccaggtgttccagtacgactggcatggtgccgtccttaagttggtgggtggatcagtcctggccgaggctggctgctgaaatcttgattgccgagaccccgttgagcgggcggagatcgaagaggccggtgatgtccgcctgcttggtggtgccggcctcgacgccgtccgccaggagccgcaggtagcttccggccagcgggtccagggtgaacgtgatgttggccagggaccgggccaggacgtcgtcggccagggctgccccggccgattcctgcagcgccgaattgacgacacttgccttttccgcggcgggggcctcgttcagccaggcgaccgactccgcgtggccggccaggagtgccttgacggtgtccgggtggtcagcggcgaactcctggttgacgatcaggacggtggtggggaactcgccgggcttgcccgtcccggtcccgtcccagaggtccttttcgtccaccaggaccttcgctccggcctggagcaccagccgcgaggcccatggctcaggcaaccacgcgccgtcgagctttccgtcctggaacagcttgagcgtctgcgcgttctccgtggggttgatggcaacgtcgccgctgccgtccacgttggtctggtacccctcggacgcgagccacgcgcggagggcgacgtcttgggtgccgccgagctgcggtgaggcaagcgtcttgcccttgaggtccgcggcggagttgatctccggcttgaccaccagctgcgcaccgcccgcggcggcgccggcgatgatgcggacggactggccctggctttggacgaaggagttgatggccgggttggggccgatgtaggcggcgtcgatggcgccggcgttcagggcctcgatcgcggcgggcccggcgttgaatgtttcggtgctgagcgcggtgctgcccagggcctcggccaggaagccctccttgatgcccaccagcgcgggagcgtgggtgacgttgccgaagtaccccagcttgagctcggcggcgggcgtgggttcagcggcctgcgcctccgtgttgcgtgaaacggtggaggccaccacggcgccgacggcgatcagcaggaccagcccaatggccagggcagcctcaatggcacgcttgcgcttgggtaccgcgctttcgcctgccacgatgcgggtcatcccgggcttggaactagtcattgtttcaccatagggagtgccccaaacccgttcaatgacgcggaaacggggggtcacgcaggttcatctagcgtcatattcggacactgttcgccggggtcgccggaacggtacccgctcgccgttccgctccggcgccgtggcaccgttccggcgatcgcgcggcgtccgggtgcccgtgaccgcctcagtttcccttgacgttgaccaactgccgcagcttgtgccggacggtgaccaggtccgccgcgtcctgcatgacgacgtcgatgggtttgtaggccgcgggtatttcgtcgatgaacgcctccgaggccctgaactcgatcccgcgcatggccttcttcagttcgtccagggagaaggttttgcgggcggcgttgcgtgagtactcccggcctgccccgtgcggcgaggagttcagcgacgccacgttgccgaggccctccaccacgtacgacgacgtccccatggaccccggaataagtccgggatcgccgggcgcggctttgatggctcccttgcgggacacccacacggacttgccgtagtggacctcctgctcggtgaagttgtggtggcagttgacccgctcgagttccgtgacgggcccgcccacccagcggccaaactgggtgctgacccggtccatcatttcttcacggttcaggagcgcgaagtgctgggcccagcgcagctccgcgatgtaccggtcgaactgcggcgtgccctcctccaggtaggcgaggtccgggtccggcaggtggatccgcctcttggtcaccacgttctgcgcgacgccgatgtggtgctgggcaatcttgttgccgatgccccgcgaaccggagtgcaggaacagccacacggcgtcggcctcgtcggcgcacacctcaatgaagtggttgcccgatccgagtgagcccagttggaggtcccacttctccacgtactgtgccgggttgaaaccggctttcgcggccagactcttcagctccgcgatccttggttcagccgtcggctgcaccgtccggttgttgtggccggcggacagtggaatggcccgctcgatgtcctcgcgcaggctcttccggtccttgggcaggcccttcagcgagtactgggtccggacggcgatcatgccgcagccaatgtccacacccacggctgccggcatgattgcgtgcagggttgggatcaccgagcccacggtggcgccctttcccaggtgcgcgtcgggcatcagggcaaggtgcggatagatgaatggcagctgcgaggcccgcaccgcctgctcgcgcgtcttgtcatccaggatcgaggcccagttcagcagcttgctgttgatggtttccatgcggtgcctcccatgggacggccggggactaacgtggttcctaggctaaccccgagcagatcacctggccggtccatcctgacaaggagacgcatctatggtgaacgtccagaccggcatcctcatccgcaggccccgcgcggaggtggcaggctatgcggccaacccggacaacgcgccgaaatggtacgtgaacatccataagtcgcagcgcctgaccaccggaccgctgggcactggcaccaaggttgccttcacggcgaaattcctggggcgcgagctgaactacacctacgagttcgtggactacatcccgggcgaaaggctcgtcatgcgcacggcgcagggcccgttccctatgcagaccacctacacctggacggacgacgacggcgggacacggatgacgcttggcaacaccgggagcccctcaggtttctcgaagctggccgggctgttcatggcaccgatgatccgccggcaaacccgcaaggacctgcagaaactcaagaccattctggagacatgagaggtctggaacctacgccgccctgcggtgcaggccccgggtatggttccggccaggcgccgtctgcggctcacgcagcaggcgcaggttgaacccacagaacatcgcgagccccaggtacagggacagttccatcgcctcggcatactcggagatgacgaacgtgggctccggccagatcagcaggcggaaaaggcggtagccggcggccagcaggaaggccggcaccaggcaaagcggcgggaccagcaggcgcctgttcttcaggcgctcccaccgttttccaacggcagcccataccagcggggcacaggcgccgtagaggctcgcaaggagcatggccgcggggaccagttcctgcacgccgcggatgttgtgcaccgtggtctcgccctggcggttgacctcgttgagggattcgggcgtcgcccagccgaagatgcgctggccccaggaaatctcctcgcccgtcaggaaccagacccccagcgtgacaaccgcatagagcacagccatgccccagcgtttggcacggaccaggtacacggtgatgaggggcaggaagatgcttgccgccagcaggcaggcgaactgcagccattcgatcagcgagtcctcgttgaccaaccagaggtagaagtccttgaacggaagggctgccgcggcaacgatcgcgatgatgaacgggatcaggatgagcagccgcgcctggccgggtgcgatcttccagtcctcggagtctcgccgcaggtgctcagccgcccgggttttccactcttggatggccggcattatgcctcctcggctgtttcgtccaggtccaaaggaagcttgtgcccccgctgaccattaagtcttggaggtgcagcacgccgcacgagtagcgagtacttgcatttgaacgggacggcactgagggctgttgccagtactcacgggcggacccttaaacagaaccggcggcctgttcgcggatccgaaccgtcaaggccaggatctgcgaacaagccgcggtatcaggaaaatcagatgctgtagcgctcgtcctcgtggtcgcccgggtggtccttgaccagtccggcagcaagggtgttgccatccagcgggtcgatcaccaggaacgcgccggtccggcggtggtggaggtagttctccagcggcagcggggcggcgagccggagctgcgcgttgccgatgtcgttgagttccagggtggacgccggttcctgcttgaaggaggcaaggtccagcttgccgccaacgttgcggaccaaggcctggacggtgcgggtgccgtgcttgaccagcaccttctggccctcgcggagcggcttcggggacagccagcacaacgacgcgtacaggtcggcagaggcttcgcggacggtgccggcggcggcgatggtgtcaccgcgggcaacgtcgaattcctcggccaggcggatggcgacggactgcggggcggcggcttcctccagcgaggcgccggcgaagtcgatgcccacaaccgtggtggtgcgcgggtcctggccgggagtcaggacggagaccttgtcccccaccttgacggagccttcggtgatctggccggcgtacgcgcggtagtcacggtaggcctccacgtccaggccggcggcaacggcgtcgggagccagggcgccctgcggccggatgaccagctgcaccgggaagcggaagctctccaggtggctttccagttcgtcggcagctggcagggtctcgaggacctcgagcagcgccgggccggtgtaccagggcgtgcgctgcgagcggtccaccacgttgtcgccgtcgagagcggaaacggggaccaccaacaggtcggtaattccatcggaaccgaggcccagctcacggcccacctgctgcacgtcggcttcgatctcgcggaacacggactcgctgaagtccacgaggtcgatcttgttcacagccacgatcacgtgcgccacgcgcaacagctgcagcacggacaggtgccggcgggtctgctcgagcacgcccttgcgggcgtcaatgagtacgacgacggcatccgcggtggacgcgccggtcaccgtgttcttggtgtactgcacgtgcccggggcagtcggccaggatgaagctgcggcggtcggtggcgaaatagcggtaggccacgtcgatggtgatgccctgttcgcgctcggcacgcaggccgtcggtcagcagagccaggtcgatgccgcccttttccccgccgaagccgcggtccgcagaggtgcgggcaacggcgtcgagcgtgtcagccaggatggccttggaatcgtgaaggaggcggcccaccaaagtggacttgccgtcgtcgaccgatcctgcagtggcgaaccggaagagggtagtgggcaggccttcggtaagcgagcctgtcgaaatctcggaaattgtgctcattagaaatacccgtccttcttgcggtcttccatggcggcctcggagattcggtcatctgcgcgggtggcaccacgttcggtcagggtggaggcagcgacttcaaccacgacgtcggccacggtgtacgcgtcggactccacagcgccggtgcaggacatgtcccccacggtgcggtagcggacggtcttggtgatgacgtcctcgtgcggcagcggctgggacacctcgcccactgcgcgccacatgccgtcgcgggcaaagacctcgcgctcgtgggcgtagtacaggccgggcagctcgatgttctcgcgctcgatgtagcgccagatgtccagctcggtccagttgctgatggggaacgcgcggacatgctggcctacggtgtggcggccgttgtacaggttccacagctcggggcgctggttgcgcgggtcccactggccgaactcgtcgcggaggctcaggatgcgctccttggcgcgggccttgtcctcgtcgcggcggccgccgccaaagacggcgtcgaacttgttctgctggatggcgtccagcagcgggacggtctgcagcggattgcgggtgccgtcggcgcgctcggccagctcgccgcggtcgatgaactcctgcaccgagcccaccacgagcttcagccccagccgctcaacagtacggtcgcggaagtcgatgacctcggggaagttgtggcccgtgtccacgtgcagcacggggaacggaaccttgccgggccagaaagccttcgtggccaggtgcagcatcaccacggagtccttgccgccggagaacagcagggcgggcttctcgaactcggcaacaacctcgcggatgatgtggatggcctcggactcgagggtgtccaggctgctcaggcgcgtggaaacggcagcgtcagtcacctgggtggtctcctcggttaggtaagtgctcatacgtgtagtccgcattctgtcttgtcggtccctgcccagcggccggcgcgggggtcgtcgcccggcgccaccttccgggtgcagggctggcagccaatggaggggtacccctgggaaagcagcgggttgacgggcagcaggttgtcgtccgaatactggaccagctggtcgaacgtccacgcggccaccgggttgaccttgaccaggccgttgactgcgtcccacgtgaccaggggggtgttggtccgggtgggggcctcatcgcggcggacgccggtgaaccagagttcgtagccggccagggtgcggcgcagcggggccaccttgcggagcgcgcagcactgggcggcgtcgcgggcaaagaggtccttgccgaggagccggtcctgctgttccacggtgttctcggggagcacgtccaccacgttgacgcggaggtttgccgccacctcgtcacgcgtggcgtaggtttccgggaagtggtagccggtctccaggaagaggacgtcgacgccgggcaactggtccgcgaccagggcgggcaggacggcgtcggccatggagcaggcgacggcgacggcgggcagttcgaagttgcgctccacccaggcgatgacatcgcgggcgggggcgtcccagccgagctccgccgccccagcttcggcgatggccttcagctcttcgtgggagcggagcttgggggcggcatctgccacggtggtatcgacctgcgctgcggcctcagccggtgcaaccaccgggttgatgccggctgcgtgcttactcactgcagtgcctcctcgtctgctgcgtgggcccactcggcgaaggtctggccctcggcgcgctgggcaacgaaggtgcggacaacgcgctccacatagtccgggaggtcgtcgacgtagaccttgaggccgcggacggtgcggcccaggcctgcttcctcgcgctcgttcgaagccagcccgccgcccaggtggacctggaaacccggggaggggtcgccgtcgggcgttggaagcatcatgcccttaaggccgatgtcggcggtctggatgcgggcgcaggagttggggcagccgttgatgtgcagggacagggcgtgcggcagctcgccggaggcggcgaggtcggccaggcggcgttccagctcggcgaccgccgtggcagccgtgtacttggtttccacgatggccagcttgcagtactcgatgccggtgcaggcgatggtgccgcggcggaacacggacggacgggcagacaggcccagcgcatccagctcggccacgagcggctccacctggtccttctcgacgtccaggacaacgagcttctggtgcggggtggtgcgcagccggaaggagccgcgggcctcgagggtgtccgcgagctttaccagcgcggccccggacaggcggccggccagcggggtggcgccgatgaagaacttgccgtccttctgctcgtgcacgccgatgtggtctcccggggtggtgggcttgggcgcggcggggccgtcagccagcttgtagcccaggtactcgtcctcgaggatctggcggaacttctccggaccccagtcggccatcaggaacttcaggcgtgccttcgtgcgcatgcgccggtagccgtagtcacggaagatgctggtcacgccaagccacacgtcggcggcctgctccggcgtcacgaacgcgcccaggcgcttgccgagcatcgggttggtggacagcgcaccgccggcccagaggtcgtagccgatgccgagttccgggtggcggacacccaccagggcgaagtcgttaatttcgtggaccacgtcctggctggggtggccggtgatggcggtcttgtacttgcgcggcaggttggacagcagcgggttgccgatgaaccgctcccccagctcctcgatgagcggggtggggtcgatgatctcgtccttggcgatgccggccacgggcgagcccaggatgacgcggggaacatcgccgcaggcttcggtggtggacaggccaacaccttccaggcgggtccagatctcggggatgtcctccacgcggatccagtgcagctggatgttctggcggtcggtcaggtcggcggagtcgcgggcgaagtccacggagatctggccgatgacgcgcagctgttcggtggtgagcgcgccgccgtcgatgcggacgcggagcatgaagtacttgtcctcgagctcgtgcggctcaagcgtggccgtcttgccgccgtcgatcccgggcttgcgctgggtgtagaggccccaccagcggaaccggccgtggaggtcctggccggggatggcgtcgaagccttccttggagtagatggtctcgatacgctcgcgcacgttcaggccgtcgtcttcctgtttccaggtttcgttggcgttcagcggcgttttgccgtccactttccactgcccgtgcggcttcgcggcgggacgggacgtgcgggccgggcgcttcgcggcagcggaatccgccgacgctccggctagagctgtatcagtcatgcatcgactgtaggtcccgcccgaagaccgtcacaaaggcccggaaacgctaagtcacctagggaaatatttcgtcacgaaacgccggacagccttgaagaagccatcctgctgtgcagttgcggcctgttccgcgggggcctctttcggggtgtgcgcggctgtttcagccggcccgtgggcggcggcttcacgggcttttgcgacggcggcgtcatacctgtccagcgcgatctcggcgagcaccggcgagggcagcagcggttcggtcacgaggtcggcccccgccttggccagctggtcgtggaagaagcccggcgccaggaggtaggaggcaatcaccacgcgcccgccgacgtcgaccgctcccgcggactcacccgccccggcaccgccttccagttcctcgcgaagcatcgcgacggcgtcgggcacggaaggtttcgcagaggcaccgtaggcggccaccatccggttggaccgcagctcccgcagctggccaagcagttcctcaacgctgacggcggcattgggattggaggagcccgccgcggccaggatgatcacgtcgttgtccgtcacgccggcctcgcgcaaccgctggtcgagcagcgcggccagccgcggatcaggccccagcggcgcggctgcggcactgcccggcctgctctttacggcccgcgcgatgtccaccttcacgtggtagcccacactgagcagcagcggcaccaccacggcggcctccccctcgggcaaaccagccaccacgtccaccaggtccggctgctggacgtccacataggcctcccggacgtccaggccgggacgcagttcggcgatggcggcgcgcagggcgttgacctccgctgctccctgtgtgttggacgtcccatgggcgcaggcgatcatgatggggctgttcatacgggctagcgtaacgttggagccgccctgtccgccctcttttgaattgccgggacgctccatgacattcgcctttgacaactcgccggtgtggctggatctgctgggcgtcttcttcttcgcggtgtcgggatccctgctggcggcgcggaagcacatcgatattgtgggctccctgctgctggcttccctggtggggctcggcgggggcgtgatccgggacatcatccttgcagttgtccctgccgctttcaccaaccccgcctacctcgtgccccctgtactggccacggccctggtgtacttcctgtttcccagcgttcagcgctatacgtcactgttgacgctgttcgacgccgccggccttgccctgttctgcatgaccggcacactcaaggccctggccgccggcatgaacccggtggcgtcggtcctgctgggagttacgacggcggtgggcggcgggctgctgcgcgacatcaccgccaacgaggttcctgaacttttcaacccaaaggacatctatgcgctgccggccttcgtgggggccgcgatgaccgccggactgtgggtcctgggcgtcttcaacgtgctgaccgcgaccgccatcgccgccgtggttttcactttccgcatcctggcatggcggcgctcctggcaggcgccgctggccgtgcacgggtggcaccggcgggacagcaatcccgcggcctgacgacccctccggtggtgttcccccgtcactttgcagggcccgggattagctaggatatgaagcatgactgacatgttcctcgagaaattccgtgcgcttgttccgaagtatctcgaagacgaatggcaggcagaggatgggctggatccggacgagctggacaaggccctggccgaccaccagttccagattcccctggtgctccgcgagttctacctggccgttggcggctgcgaggacctgatggaggcgtaccactacttctgggatcccgacgagcttgaggttgatgacgaaggcttcctgatgttcctcgaggacgaggaagaggagtacacgtggggcttccgggtgggcgacctcagcgtccccgaccccatcgtctaccggcgcaacaacgcccgcgggcagtggaagtccgaggaaggcacgttctcggagttcgtgttcgacatgttcgagtgggccttcgaggacgacgacaactagggcttccctctcttccgtttcagcgtggcgtcgagatcctccggtgcccgctgggtttcctcaccttttggggtgggcgacggcgtgtcctcctccgatgacggcgtttcccccggttcgccagcaaaaccttgggaatctcagcggataacccggccccggaggacctgccacacctcggccatgactctttccgggtgatgaaccacgtcggcgtacccgtaacgtagtaccgcatatccggtgagggtgctggcgttgttccgggcgcggtccttctttacctgccggggctcaaggtgggtggcgccgtcgagctcgacgatcaggaatccttccagcaggaagtccacgatgccgatgccggggagctccacctgtgtctccgtgaaaatgcccgccgtgcggaaaagaatccgggcaaccacctcgatgggcgaatctgcggtaccgtcaacgagctccagcacgcgcctggctgcaccgttccgcttaccggggagccgcccccgcaggtagccgagggtggtaatcccctgccgcgctgcactctccaccatgacggcagcttccatggccggaaggcagcgcaggctgtggatcaacacgtcagtagtgctcgccaccggttttggtgaatccggaggaatcagggacccgcggtgcacgacggcgtccgccggcccacggtgacggcacaggaggtgaacccttgacggttccctcaacagccaaagacggcgatgtactgcggcagaagcacaggtcagcaagccattgcccaggacagccgcagtcatgtccgccggggccccgggcagtgccaccaccccgtgccggagacggcggatgtcacccagcgccaccgcattgcgaatgctccggtcggtgaaaccagcctgcaggagtgtggatgtgcgcgccactgagcctgcgtacgtgagaaatccggtgaggtccatggagccagcagacccaatgttcgatgtggaatgcagtgccggggaggcctatgtggacaaaactcctgctgaacttccccggctttcgagctgcctgtcggcgggtcccggcaactcgccgggttttctaccccttccgggcagaaaggtggggaaactcagcgccgacaagtccgtgacaaccgaggtaacaacctacttgcgtaatgtgacaaacctgtcatagactattcacggatccgctaaacgcctccggcgggtctgatgcgaacggagagatagcctcggttcacagcaacgtatgactcgtatcgttgctgcggaccggggctatcccgtttaaagcaaagttgctccggtgccgcatacacagcaaagcccggcccttcaggggccggacttcacaggggttgggtcagctggcgcggtccaccacagccagcgcgaagctggacagcgaatccttgaccacaccttcaggcagcggtgcgagcgcgtcgatcgcctcgtaggcccaccggcgtgccaccacccaggattcggcagtgacgggatgctcccgcaggccggccactgcctcggcaagggcctcgtccgaggtcaggtcgccgtcaatgagccggagaagttcgacggcggactggtcaccgtcagcggcggccttgcgcaggagcagcaccggcagggtgggaaccccctcgcgcaggtccgtgcccggtgacttgccggacttgaccttgataccggtgacatcgatgacgtcgtcggcaagctggaatgccacgcccaccttctcgccgtactccaccaggacggattcgtacgcgggatcggcgccggcgaaaatggcaccgagctggccggaggcggccacgagtgaacccgtcttgtccgcgatcaccgacaggtagtgctccacgggatcctcgtcagggcgcggccccacggtttcgtgcagctggcccaggcacagccgctcgaacgttcgggcctggatgccgagcgcgcgggaaccgagttcggacaccaggattgaggcgcgggcgaaaatcaggtctccggtgaggaccgcaacggagttgccccagacctcgtgggcggtgggtgcaccgcggcggaacggggccgagtccatgacgtcatcgtgatagagcgttgcaaggtgcgtcagttccaccacgacggcggcctgcaccacggcgggcagcgaggcgtcgccgaggtgtgcgcagagcagggtcagcagcggccggatgcgcttgccgccggcttccaccaggtggcgcgacgtggcgtcagcgagcgggtccgagttggcgatggcttcgcggagcttcttctccaccttggccaggttgttggtgatggccggccccagttcggcatctccggcgatggccgcaaaacccgcgggcagctgcaggcccgttgcgatggcggtggtattgaggctgggttcggagtccggcaggccgtgtccggcgtgcgtccagctgtggtctgcggggttggtcacgggttaaccctaactttttgttgcggataccgctgattcgaggccgccagcgtattggatgtggccggaaccagcgattccaggacgcggattgcccggtcctcgaagcccttcgcggacgggtccgtgaggttggccaggagccggaccacgaaccgcatcagcaccgggatgggcatgccggtccggagtgcgagcttcatgaccgcaggcttgccgatcagcgcggcgaacgcccggcccagggtgaagtgggagccccactgttcgcgcacatagtccgcgtaccgcgcaaggtgcgcatcggcgtcgtacgttccgccggccgccgctgatcgggaggaggcgtcgatgatgaactctgccgcgaaccgtgccgactccatggcgtaggaaatgccctcgccgttaaacggggacaccatgccgccggcgtcgcccagcagcagcaggcccggcgagtagtgcggcgtgcggttgaagcccatgggcagcgcggcaccgcggatctcgcccacctggttttccggcgtgaagccccaatcggcgggcataccggcggtccattcgcgcaggacctgcttgtagtcgagcttgccgaactccttggacgagttcaggatgcccaggcccacgttggaggtgccgtcgcccacaccgaacacccagccgtagccgggcaggagcttgccgtcgcggccggggagctccagccagccttccatccagtcgtcgtccgtgcggggcgaggtgaagtaggtgcggacggcgacgccgagcgggcggtcgtcgcgtttatgcattccgagggatacagcggtgcgcgtggagttgccgtcggcggcgaggacgacgtcggcgctgaactcacgcgtctcccccgtcttgcgtccggactcgtcaaggagcgctgcgcggacaccggtgacgcggccgtcgtcgttgcgaatggcctcggtgacgctgtgccgctcaaggatggcggcgcccgcggattgcgcgtggcgggccagttcctcgtcgaagccaagccgggtacggatcagcccgtactggggaaagtcggaaacttcgggccacggcagttcgatggtgcgcccgccggcaataaggcgcaggcccttgttgcggcgccagccgtcgttctccggatgcggcaggccgagcttctggatctcgcggacggcgcggggtgtcagcccgtcaccgcagaccttttcgcgcgggaagctcgtcttctccaggacggtcacgtccaggcctgccctggcaaggtagtacgcggcggtggacccggctgggccggcgccgacaatcagtaccttcacaggtcagcggacgatgttgcggcgcagcttggccacggggcccttgtgcgcggcgatggcggcagcggcgttgtccggcgttgattcctcggccttgaacgcgcggtgcacggccacgattccgccggtgaggttgcggtaggtgaccttttcccagccggattcctgcagccaggcggcaaggtggtcctggtccggccacgcgcggatggattcggcgaggtagacgtaggcgtccgggttggaggcaactttcgtggcaatcgccggcagcgcccgcatgaggtattcggtgtacatggtgcgccagagcggaaccacgggctgggagaactcggcgatgaccagacggccgccgggcttggtgacgcggagcatctcctgcagtgccttcttgggctcgttgacgttccgcaggccaaaggaaatggtggtggcatcgaaggagttgtcagcgaagggcaggttggtggcatcgccggcaacaaaattgatgtccgggcggcggcgcttgcccaccttcagcattccgagggagaagtcgcaggccaccacgtctatgccggcgtcggcatacggttcgctggaggtgccggttccggctgccaggtccagcacgcgctggcccttgaagacttccatggcttccaccacaaccttgcgccagcggcgcgtctgtcccatcgacaggacatcgttgacgacgtcgtatttcggtgcgacgtcgtcaaacatcgtggctacttcgtccggacgcttatccaaggatgctcggttcaccatgtcattgtctcaaatgttcccggcggtgctgaccagccgctatttgtcccatcccggctccgccccggccggggaaggccaccgtgtacgcgggagtagtgttgtctcatcatgacgagcacgttccgcaccctgacagtccccctggatggaaaagatttccccggggggcttcctgcgtttttggtccgggacgatgtcctctgctggacccggagggaagccgggctggctggcttcggcgagattgcacgcttcacggccaccggccccgagcggttcctcgaggcagacatctggtggcggcaccttgtccttgaggccgacgtcgccgattccgttgggctccccgggacgggccccgtggccttcggctccttcgccttctccaagacttccgcccacgagtcccggctgatcgtgccggagatcgcggtgggcgtgcgggacgggcaggtctggctgacccagctgacgttcgacgacggccccctcactgaagacaccgcccgcgccacgctggaccgctggctccggagcgctgcggcccctgcggcagggccctcaggaagcacgacggcggcagcggacccctgcccgggggacggcacctcgggtgccgtgcccgccaaggcgggcggcgccgtcgtacgccccctcccccttgctgccggggcaacccttcacaccggctcgctgagcgaagaagcctggatggcggccgtcgaagcgggtgtggccgagatccggaccggggcgctggagaagttggtcctggcacgggacgtggtggccaccatcccgtctggggtgcacgcggccacggtgctgcgcgaactcgccgcacgctaccgcgagtgctggacgtacggggtggacgggctcgtgggggccacgccggagatgctgatccaggtggaaggacgcaccgcacaggcgcgggtgctggccgggaccctggaccgccgggatgcccacggcgaggacggcctcccgatggattacgccacccgggtgctggccggctcggaaaagcagcggcacgagcacgagatcgccatccagtcgttgaccacgcagctggcgccgttctccgaagcgatgaatgcgcacgacgagccgttcatcctggagctgccgaacgtgtggcacttggcctcggacgtcaaggctgagctggccgagatcgagggccatgtgcccacctgcctggcgctcatcaacgccctgcaccccaccgcggccgtctgtggaacccccacccaggttgccggcgccctgatccggaagctggaacacctggaccgggggccgtacgcaggccccgtgggctggctggacgcagcgggcaacggcgaatggggcatcgcactgcggggagcggtcatcgagtccccggacaccgtccggttgtatgccggctgcggaatagttgacggctcacagtccgaggccgagctcgcggaaacctgggccaagttccggccgatgctggagtcgcttggcatcagcagctgactccccctctcccaactaggtagcgctaagtgtcgctttggggtctcaaaacgacacttagcgctacctagttggggaggcagtccgggatgggagacatcttgttcccacgcgggcttgatttcccctgtgatttagttatccaatagtgaaacttagtttcctgtgatgcacatctcataatcggcgctacactatgaaccgatttagtaccgcatactccccgcaacaaaaggtaagaaaacatgcagctcaagtccctggccacggccaaaatgaccgccaaggcagcagcagtcttcgccgccggcgccctcaccctcacggcgtgcggcggcagttccacccctgcagcctccgagggcggcatccagctcatcaacgccggcaagctcacggtctgcgcggacatcccctacgagccgttcgagttcgagaaggacggcgagactgtcggcttcgacgtggacatcgccaaggagctcgccaaggacttcggtgccgaactgagcatcgttgacagctccttcgaagcgatcgagaccggcactgccctgacccagtgcgacctgggcatctcctcgatctccatcacggacacccgcaagtccgtcatggacttctccaccccgtacctcgacgacgacctggccctggtggccagcgaggactccggcatcaccggcctggatgacgccaaaggcaagaaggttggcgtgcagcaggccaccaccggcgccgactacgcccaggagcagggcatcgacgcgcagcagttcgaggacacgggcctcctggtgcaggctcttgaagccggcaccatcgacgccgccctgggcaaccagtccgtccttggctacgccatcaaggaccagcccaagttcaagagcgttgaggacttcgcaaccggcgagcagctgggcatctccatcaagaagggcaacaccgcaatgctggagaaggtcaacggcacgcttgagcgcctgaccgaggacggctccctggagaagttcaagaccacctggttcggcgagaccgccaagtagccaacaaccgccaagtagtcgccgtgcaggcctggggctcccccgcccggccctcgttacggccctgagaactacgcagccggggccccggacgagctgtaccgcagtccgtccggggcctctgccacgcacaacgaatgtgagcaacccatggcaatgaccgcacgtcagcgagccagagtaagcctgtatgtccaggccggaatctttgtggtggccatcgccgcgctgatcctggccaccgactgggagaccatcggcaacagcgtcttcaacttcggcaagatcggccccatgttcccgggcatcttcgtcaccgggctggtgaacaccctgatctacacgttcctcggcttcatcgtgggcctctccggcggcctgctgctggccctgatgaagctctccagctttcccctgtaccgctggatcgcctccgggtacatcgagttcttccgcggcatcccggcgctgctggtgttcatcgccttcggctacggcgtgccgctggccttcggcgtttcctggaacatcaccgtgattgtcatggtttcccttggcatggtggcctcggcctacatcgccgaaaccctccgcgcaggcctgcaggcggtgcccaagggccagctggaagccgcccgttcgctgggcatgccccagtggcgggccatgatcaccatcgttatcccccaggccttcaagatcgtcctgccgcccctgaccaacgaggtcatcctgctcaccaaggattcctcgctgatctacgtcctgggcctcactgcttcccagtacgagctcaccaagttcggccgcgatggcatctccagcctgggcgcgggcctcacgccgctgctggtggccggcgctttctacctggtgatcaccatccccctgagcttcctggcccggaagttcgaaagccgcaccgcgcggaacaatcgataggcagggaagaccatgaacgacgtcgtaaattcctccgccggcagcaccggcaccatccaggccgccggtgtagccatcaaggacctgcgcaagtcctacggttccaacgaggtactcaaaggcatcagcctggacgtggcgcccggcgcagtggtgtgcctgatcgggccctccggctccggcaaatccaccctgctgcgctgcgtaaacctgctggagcagcccaaccagggcaccatccacgtgggcggcttcgaggccacggacccggatgtggacatcgacaagatgcgccgcaaggtgggcatggtgttccagcagttcaacctgttcccccacctggacgccaagcgcaactgctccatcgcccagaccaaggtcctcaagcgttcgcaggcggaggcggacaaggtgtccatgcacaacctggagcgcgtggggctggggcacctcgcggaccgtttcccggaccagctctccggcggccagcagcagcgcgtggccatcgcccgcgcgctcagcatggaccccgagctgatgctcttcgacgagcccacctccgcgcttgaccccgagaccgtgggcgacgtcctctccgtcatgcggaacctcgccaaagagggcatgaccatgctggtggtcacccacgagatgggcttcgcccgcgaagtggcggaccgcgtggtgttcatggacggcggcgttgtagtggaggaaggcgtggccgagcaggtcatctcctcccccacgcagccccgcaccaaggagttcctgcgccgcgtcctcgatccgacgcacatcgacatcgaggagtagggcctcttcgctttcgctacgtacaatccccggcgctacggattttccgcagcgccggggattttctgcgtcacggggcaatcagcgcctcgcttgtgaaggaggcgcacgacggcggcacgcgcctcctgtgcgggcatttacttccgcggtgccggggcacacaataggtcccatcacagccctggctcagcagcgcgctgcccgtccggccgccgtcccgcgcggcggcgcatccaggagcgcagagatgaatccccaagccccacccccgcaggcggcagtatccgaacgtgccgcgcggctggcatcagtaccctcgttccagcgggttgactccttcatccggcggtatctcaaccggggtcaggaccagcgcaccgtctgcgacttcacgttcggcaacccccaccagatgcctccggaccgctgcgtcaacactttgcgggatgccctggttccccgcgatgaccagtggtttgcttacaaaaccaacgtcgagacggcgcaggaagcggccgcgcaatcccttgaacggctgctggacgtgcctttcaggacagaggacatcttcctcaccacgggcgggttcgccgcgatcgccctggcgctgaagaccgttgcggaccccggcgacgaggtggtctacagcctgccgccgtggttcctgtacgagccgctgatcctcgaagccgggctcgttccggtgaaggtcaaggtccacaccgccacgttcgatctgcacctcgccgcaatcgaagcggccatcacggagcggacgcgggttgtgatcgtcaattcgcccaacaaccccaccggacggatctatcccccagagctgctgcttcggctcgccgacctgctggaaactgcgtctgcaaggattgggcggcgcatctacctcatctcggacgaggcctacaaccgcattgtgttcgacggcgtgcggttccacagcccggcggagttctacccgtacacgctgctggcttactcctatggcaagacccacctctcccctggccagcgggtagggtatctggccctccctccggccatgccgcaccgggacgagatggcgccggctatcagcggcctgcaggtagcgatgggctgggtgtaccccaacgcgctgctgcagcacgcgcttcccgaactggagaagttctccatcgacgtcggccagctggagcggcgcagggaccgcctggtggacgcgctcggcggcatgggttaccgcatgcggccgccggagggcacgttctacttgttcgtcagcacgcccggtccggacgacgaagccttcaccgagtccctcgcccgccgcgacgtcttcgttttcccgggcacgctgttcgagacgcccgggttcttccggatttccctgacagccaacgaggacatgatcgagcggagcctgcccacattcgcagcagcgatcaaggaaagcaggagcggaacatgaacggacggacgtatccgccgggggtgccgtgctggatcgacacaacccagcctgacatcgatgcggcagcaaccttctatgccggactctttggctggacgttcagggaagcagctccgggcggcggggcggaccgctacctggtggcccagctggacggtgcggacgtggcagggatcgccagcggccgcgaagagacaacggcctggagcacgtacattagtgtcgaggacgcagatgccgcggtggaccggctggtggctgccggtgccgggttgcgggcgccggcaacgggcgcgggagaggacggccgcagcgcggcactggctgatccggagggcgtggaattccgcctctggcagccgaagcggcaaggtggggcacagtccgtcaaccagcccgggacgtggaacttcagcgacctccacacacgcaaccccgaggctgccgtcggcttctaccatggcgcattcggctggcaggtggacaaggtgggcttcggggcggacggcgccgacttcggaatgatggtccgtatgcccgggtacggcgatcaccttgaagcgaccgtcgatccggagatcagggcacggcagtccgagttcgcggctccgccgggcttcgcggacgccgtcgcctggatcgtgcccattggagctaaccggacgccgcactggcatgtcacgtttgctgtcgccgaccgggaccagacggccctcgacgccgaacggctcggtgcccaggtcctcaggcaggacgacacggggtggacgcgcgaggccatgatccgggacccgcagggggcggtcttcaccgccagccagttcacaccgccgatgggataggtggcgcattgggaactccggcaaccccggaaagcctgccgctcagcccaccgcctggttgcgtggcttatcttccagtgcgtactgcaaccacgtggaaggcaaggtcgaagtagcggcccacgaagccccctgcacccgtgatgccgaacgaataacggtccaggtggttggcctgcgccgtaaggcggatttggccgggagccagggcgtcccaggacaggactgtgacctccgcggcagcttccactccgtgcatagccacaatcccggcaagaagaatgggacctccgtcttcgcgaatccccgttgacgagaacgcgatgatcggaaaggcggccacatcgaacaggccccggcctttgacgtcgcggtcccggcgctcgttggccgagtcgaaactggccgagtcgatgatggcactggcgctgctccctgccaatgttgacgcgacattcagcagtcctgaggagatggtgaagtcggcgcggaccctgcccagtccaaacatatgccgcgaggcgtaggtgacgcctgagcgttcggggtcgatacggtactcaccagcctcgggcaacttgtggatttgtacggctggttcggcggtcacggcggattccttaggcttggcccgattccccccgcgccgggcaattgctgacgtatcaacaaccctgctcctgttatgctgacgtgtcaacaactctgtggttcctccagggataggatgcacgttgcctgagtatcgccgcctgacccgggacgaagaagaagtctggttcgcctacatccacttcacccgccagttggcagccgggatggagaggcagctggcggggagcggcgtatcaggcgccgattaccagatgctcgccccgcttgccggagccggggccgccgggatgcgcgcccgggaccttggacacagtgccgggtgggaccgcagcaggcttgcgcaccagcttcggcggatggaggaacgcggcctggtcacccgggaaccggcgagcgatgacgcccgcggcatcatagttcacctcaccgaaggggggcgggctgcactgcgcgcggcatcaccgggccacctcgaatgggtccgggagcattttcttgacttgttgacacctgcggaacgccggctgttgatagggctttccaggcgggtgatggacaacattgagccggaatcccggccctagcgcgtcaacactcctccgactgcggcagccacggcttccttgatcctgccgtgcagggcgcgcaggccgctgcggtccgtgcggacttcaacgatgctgcgcccctcgatcggccgtgcgagggcctcggcgagtgccgccgtcgtacttaccgcgcaatgcccgacgccgtatgccgccgcgagggctgcgaggtctactaagtgcggggtgccaaagaggcgttcgacggcgtcgccgtacgttccggcctcacgcacggcgccgtgttccagcaggtcgaagatggccccgccggagtcgttgaggacgacgatccgcagcgcaggctgttcttctccggcgccgaggagcaggccgccgacgtcgtgcaggaacgtgacgtcgcccagcaggacagtagtttcctgccggccgccgatggcgatgcccgtagccgtggagatggtgccgtcgatcccggcgaggccacggttggcgtacacggtggcggctggctccggggcgggcaggccagcgaggtccacgtcgcggatgccgttggacgaacccaggagcagctgcccgcgggcgtgcttccacaccagcgagcccactgacgggccagtcgcgggagcctcagcggaaagtattccatccagggcatgctgggccgccgaagccgcgagcaaccaggtatccagccattctgcggtcccccggccggcgaagtctgccaggtcggcgaggctttccagcggcagctcggtgcggcgcccgggctcgtaccaggccaccggtacgggctggtagagggctgcctggacatcggccctggccagaagcgcggcgaccgggcgggacagcgtaggccggccgaagaggaccacacgttcaatcggcatggccgcgccgggaccgaagtgctccagcagcagccggtagggaccaaccgcgttcggcccgaagcgggcattggaggacggctccgccagcagcggcaggccgtgggcgcgggcaaacgcctcggcgacgggcccggcgtcgtgcccggcgagtactacggtgcggcgctccggcaggtcggttgacgctcgcggcagattcatgatgagcggctcggtgccgatccggtagtgctgccgttcagccgcaggcggcagctcctccccctgcgacggaaccagcggatcgcggaacgccaggttcagctggaccgggccgggcggcaggtccaggaacgcgccggtggcggcggacaggccggtctggatagcacgccgggggtcggtgccagcggctatgtcgacggcgaagcgtacctgctcgccgaacaggtcaggctggacggtggtctggttggcgccggttccccggagctcgtcggggcgatcggcggacagcaccaccaacggaaccgcggcatggttggcctccattacggcgggcatcaggttcccgacggcggtcccggacgttgtcagcacggcggcgggcgatcccgtggccagcgccaggcccagcgccgtgaacccggccgaacgctcgtcgatccggaccagcaggtccaccctgccctcggcggaagcctcggcaagggcgtacgccatgggggccgaacgggatcccggcgagaccaccacgtgctgcacaccgccgtcgatcaatacccccacggcaatccgcgccgccgccaacgcactcagcccagccccgtcaccggaagcctcgctctgctttgggtcagaagaggcgtcagaagcggcgtcaggcgtggtgtccggggaaggctcgttcagcgaagtcaccaaaccagtctgccacccccgacgctctctcacttgatgtcggtccaacccaaacgctctatcacttaccgcaggaaaacccgaaacgctctctcaccttccgcctggaatctggcgaacggtgagagagcgttggtccaaaacctgcagcaagtgatagagcgttgccgaaaaaccggcgttaagcgagagagcgtcgcaggggttaggaggccggggagcttaggcgtccgtgcggaacacctggatcacggacgggcggggcgcgcgcgcctggccgggtgccggcgtcgtgccttccgcgatgtagtccgggaagaaggaaacctgcgcgtcgaaggtgccgtcctcgccagggtgctgcaccgcaacgaacacggtgcgctcctcgtcgtggatgatcgggccgcaggtctcggcgtcgcgcgggacggccaggaactgctccaccttgccgcgttcggcgccgtcgagggtgactttgaacaggccgtccgcgcggccgatgccggagggggcgccgtccgtggagatccagaggttgcccacagagtcgaacgcgaggttgtccgggcaggagatgggcgagaccttgtccaccgggaagccggagaagtaggtgacgtcgccctgggccggatcgccgcagaccataagcaggttccaggcgaaggtggtggaggtctgcccgccggtctcggtgatctccacgatgtggccgtcgcggttctggttgcgcgggttgacctcggtggcgccctcgttggatccaacgccgcggttggagttgttggtgcaggccacgtagaccttgccggtgtgcaggctgggctctacgtcctcacagcggtccatcttggtgggtccaaccttgtcggcggccaggcgggtgtacaccaggacctcctcgacggtcatgcccggaacagcggaagctccgtccaccaccagcggcagccactcgccgatgccgtcgaaggctccgtcggcgggcacagccccggttccggtgatttcggcggccggcgagttgcccgtgaacctggcgacgtagaggttgcccgcggacagcagggtcatgttgtgcttgcggtcgccctcgcggtacttgtccttcgagacgaacttgtacaggtagtcgaagcgctcgtcgtcgccggagtaggccacaacgtgcccggactcggcgatgatcacattggcgccctcgtgcttgaagcggcccagcgaggagtgctttttgggcttggaggtggggtcgaacgggtcaacttccacgatccagccgaagcggttggcctcgttctcgtacccggtcttgcgggtgtcccagcggtcctcgtccagttcccactggcgggcggtgggcttgctggtgattccgtaccgcttgtccccggcagagatgccgttgccaacgaaatagccttggaagttttcctcaccggacaggatggtgccccagggggtggtgccgccggcgcagttgccaagcgtgcccttgataaggcggccggtagggtcttccacggttttgaccagcgacgagccggcggcgggaccggtcagttcgtacacggtgttgttgaggtagcggcggttgagcggtgcgcccttgacgtacgtccacggcttgttcttgttcttgcgctccagctccaccacggagagaccgtgtgcggctgcccccaccgcgcgcatctggtccgcgggcatggttgccgggaacatgatgttctcgttggtgtactcgtggttggcgaagagcaccgcgcggcggcctttgctgcccgggatctccaggatgtccgtgtagtcgttgttgtagccgaactgcttttcctgcgcggcggccgtctggttgtgcaggtcgaactccggcgtgccgttgaagatggggtcaccccagcggataaccggctgccacgtgaagccctccgggacggtcacggcgtccacggcggcatcgatcgacgggatggccgtgaactgcagcttggacttgcggaagccttccttcgcggccttggacaggccggcggcgcttgcggattctggtgaggttgcggcggaaccgaggacgacggcgagcgcaccggcggcgccgaagcccagggcggcgcggcgggacatggtggcggaggcgatgtcacggaagtagctgttggagctggtgttgcagacgtcgccggcgcaggcgttgtcgcacttcagcgcgcaggtgacggcgctgcgcttgcccttggtatggccgagcatcggcagcagggtgaacttgcgggcagtcgtttcagacatgggggccttccaaggaatttctacgaggtcccgcccaccctttcagccggtttctacgcgcagtagtatgccgggtgaagttccggttaaccgcgtgtgacctgcagaaacgtgagagagggtgtcaggaaagccgacgttaagtgcgagagggagccaggagcgcgtggacgcggtgcaggcgtgccagccaccagtcccggcgttccccggatgccgcataccgctcaagcagcccggcgtcggcggaaacgtcgcggaggcggatggcgccgtcgtcggccaccaaaggatccgtggtgatgtccgattcaaacagggacaccgtccccagcccgcacgcatacggcaactcgggcagggcggccgccagggccaggccggcgcggatgcccacggaggtgtccagcgcagagctgacgacggcgggcagcccggcctgcgccacgatgtccagtgcacgccgcactcccccgagcggcgccaccttgaccaccaggaggtcggccgcgccggcccgcgccacgcgcagggggtcggactccttgcggacactctcgtcagcagcaatcagcacgggagtgcccgcggcccgcagccggcggcgcacctcggccagcccgtcgatggtgggcacgggctgctcggcgtattcaagcccgacgccggcaagccgggtgagtgcctcgaccgccccgggaacgtcccagccgccgttggcatccacccggatggcggcgtccggcagcgccgcgcgcacggcggcaacccgggcggcgtcgtcgtccagggtctggccgcgctcggcaaccttgacctttacggcgtccacccggccaaagcgcgccagcacctccggcacccgttcggcaggcacggcaggaacggtggcgttcacagagacaacggaacgcagcggcgcgggaaaaccctcccaggcagcctcgatggcggcggcaagccagcgggacgcctcggcgtcgccgtactcggggaacgggcagaactcgccccacccagccgggccccgcagcagcagcgactcgcgctccatgatgccgcggaacttgacccgcatgggcagggccaccacatgcgctccggccagcagttcctccagggcaggcaaggggcgagggtccgtaggcatggacccaactgtacaagcggaggcttgccctgcagacctattgcaatcccaacgtgatggcagccttccaatacatatccatatggatatatcatgtggacatggcacgcgcagcaaccactacagacgccttcaacgcggtagctgagccccgccgtcgggagatcctggacgccctcagccttggcgaacggccggtaaacgaactggtggacctgcttgggctggcccagccgcacgtctcgcgccatctgcgggtgctgcgggaggtaggcgttgtggatgtccgggacgaaggccggcagcggctgtaccggctcaatccgcaggccctcaaacccatccacacctgggtttccaagtatgagcacctctgggaggagcgcttcgacctgctggacggcgtgctcgccggcctccaggaagacaccacgcaagaaggagcagggcaatgacacagacaagcaccatggacgtgacctatcccggcgatcgggaaatcctcatcaccaggaccgtggaggcgccccggcatctcgtgtacaaggcatggacaacacccgatctcgtccggaaatggtgggccgggcgccgcggcgagatgacggtcgtggacatggacctccgggagggcggcgcctggcgttacgtcatggtagcgagcggcgggtttgaggtggccttccacggcacgtaccgggagatcgtaccgaacgagcgcatcgtccacacggaggtcatggagacggcgaatgtgggacgggacagccaggaaggggcggtggtcaacacggtcaccttcagcaatgccgacggcggcgccaccctggtcagcatccgcaccgatgcgggcagcaaggaagtccgggacatgattgcgcagtccggcatggagggcggggtgcgggagcagtttgaactcatcgaggaactcgcccagaccctgggatagccatcgcatccgcctcgatgcgccgagcccgccatgtgcggcgggatcccagctttgtgtgacaccctttaatcgatgacttttcaacggcaggcaacgagcagggccgcagcccgacccgcaacggggtcgggcttcctgttcgtgctggccacgttggcgtgtgtggccgggctgatggccacctactactacttcgtccagaccaccacgggccagttcatcgatgagtccgctctcgtggaagcagtggaactccatgggccggcaggcaaggcgaccaccaagttcctggacctgctgcccaccgtctccctggtgatggccgccgtcgtggtcctgtttgtgaccgtgatccgcaagcactgggcggaggccgggattgccgtggccgcctgcatcggggcgaacatagccacgcaggtgctgaaggatctcctgccggcccgcccggacaagggggtgatcacgctggagctgaactcgctgccttccggccacaccacgttggcggcgtcggctgcggccgcggtgttcctgatggcctcgccgcgctggcgtccgatggcagggttcgtcggcggcacgttcgccatcgcctccggggtgtccacgctgatcaaccagtggcaccggccggcggacgtggtggcggcgttcctgctggtgggcgcgttcatgattcctgcgggctggctcatcatccggcgcgggtcgtggaatgcgtgggacggctttggcgggcacatcggttcggcccggatctggctgacgctgccggttttcatcgggctggcgtcggccgcggtggcgctgtactcgctggcgcgcatcgccccgagcccgtggcaggagaccagcaccacccactatttctgggccgggatctcactgattgtgatcgccgggtacctggccacggttgccacgacgtccctgtttgcgtacgccgcacgacgacgtgtcccgtcaaggcgctgagtccccaaggccagtgaaaccttgaccgaaccttgacgcattactggtgagtaatttgatgggcccggtggatagtagtggctgtcaggagacgggcagcggcagcaggcaagcagcaggccatccagccggattggattgcagcccatcactctcctggcggcgtcttgaagtgggctccgccaggtatcaaaggcctcttgcccggctcctggcagccgtgagacggcgagtacattagtccccctgcaagcggacgcgtgctcctcaaacatcccggcgccgcccttccccccaagggcggcgccgggatttccacgtccgtttgcccgggtcaggcccccgcggctggtccggggctgacggcctttcccagcacatgggccaaggcgggcgacaacggaaggacggcgaaattgaagcgccggctgcctaccggaacaaagccggcctccccgatggccgccactgtgtcccggtttggatggcagccgccggcgaaccgctgccatgcaggcgccagcagatcctccactgccgcgaacagccggttgtccgaacggacgtgttcgtagaacgcaaggatccccccgggacgcaggacgcggcggatctcggccagcacgggggcctgctcgctgacgctgcacagaaccaggctggatacaacggcatccacgctggcgtccgctgcgggaatgtgttcggctgcttcggcacggaccgtgacaggcaccggagcggaggctgctttggcggcggcgatgctcctgaggtcgtcgtccggctcgatggccagcacgtgggtgacggccggcgggtacagcgcgaaaccggaaccgtccccggcgccgatttcgacgacggacccgcgcagcccggcgagcagatcacggcggtgttcggtagcgccgcggcggttcatctcctccaccgcccgggcgtaggcccgtgcgaagcgcgggtgctgcagttcagccggcccgcgctcccccgaagagccgcatgcctggccgccgccagtcacgcgtctcagttcgccgggccggcgctgccgctttggctgacgctgccaccaaggctggcgagggccgcgcggagccgtgtgtcggcgtcgtccgctacttccttgaccgccgggttgtcactgagctgcaccatggtttgcggatcgatcgcctggatggtggtttcgctggcatcgctgccgcggcggaccacaacgttgcagggcagcagcgcgcccatgtccggttcggcagcaagggcacggctggccagattggggttgcaggcaccgaggatgatgtagtcgccaacggatgctgcggcctcaggccccagcttcgcctcgaaggtggcgcggacgttgatctccgaaaggatgccgaaaccctgctcggccaaggcgtccttcgtctgctgcagcgcctcgtcccaggcaagcggaacggtgatggtgtgcgtgtagctcatggtgcctcctcaggcggtagctcctactggtgggtacgccgccatcgtatacccccgggggtgttatggctacgggggtgttatggctacggggggtccgccgtccgcgggagatctcccgatggctacacgcagtagagcttgccgttattggtgccgacatccagcctcaaagttatctcagcggacgcctctgtgcggttttgataggtcgctgttgccttcaccgccaacaggctcattgcacggttctcggcgataacttgtgaattctcattcagaacgatgcttcctgaagcgccggcgcccgccaccgtatggggaggtccgtatgttccgtctgaccttttggcggaaagggtcagagcaacaggaacctcgggcaggacgtagttgagggcaaccgccttatccgcgttgtccaccctggcgcaggcgaactgctggaaagcagaccccggccagttcgctgctgcggtgacggtcatggtcgccgtcgcgctttgttgccacaacgcagacgctgcagacccgccaaagcccagcagcacggtgagcatgaaagccccgacggcggcggatgcgcccggcaggccttgaaaacgccgcattacccggcctcagtcacggcggccagcttccgcgaccctcgcactgatttgtacaccaagatggtgccgtacccgataagccctatggcggagagcgtggtccatagtccgcggtcggcattgccaagtgcgttggcaacgaaccccacctggggaacggcgtaaaacagcttgcccttgacctggatttcgcggaccggctcggcatcgttggcgccgttgttgtcgcccctggtgatgagtgtcttctcgccggcctgggtggcgccgaagcctacgatccgatgggtttccacctccggccttccggagtagagctggaacgtgatgacgtccccgtacttgagctccccgaagggtgccggcttcatcaccaggaaggtgccgggcggaaatttgggtgccatggaattcgtgagcacggtatacgtgtgcgatcccgtcgccgccggcatcacgatcaggaccaatgccgcgaacagcgcaatgagcattgcagccatgctggccatgcgtcccagaaaggcaagcgtctgggcaccggcactccccctctttgagtacgacggcgacccggccttgggtgcgtccggaaccggagcggcggcttgggttagcgggcgttcagtcaggtcagcagccaccgggcaccccacagagttggcgcacggtgagcggaagggtgatggccactgcttgtcctttcacggtggacggggctgaagagctgagggtcacctggaaacatatgacggtggaaccggatttgggaacggctggtgttgcgagtccggaggcgcccagaggtgcgtatccgctggcggcgctgcagtctgctgccgaggctgcggcctttccactgacactcaggtactgggagagtgccccgccggacagattcgccattgcaggctgtcccgccgtggcgactgtgttgaacgttccgccggcatcggtgctgttggtgacaaccactccggcgtaaacggacattccgggcagcagcgccgcgtccggcgtcagagctaggttggccggcctgccgtccaggagggtcatggtggtgacctgcccggacggcgtggcagtgaggttgacggtgaacgaagcagaagagacacttcccggtgctgcgactgcggtagcgctccagagtgcgtaggtgccctggactgtcaggaggcccatcatcactgccgcggcgatgaggccggccgcctgcagtgtgcgcttgatgcgcattgagtccccctggtcatcttctgtctttgtagcggatggcggttcgtccgcccgcccagattaggaaaggccggactgggtgacctgcgtcaactggaaagcaatgttgttgaagttgtagcttgcggtcacgtcgctgcggcccgcagtgcccgacaggaactcgaatgtgatggtcgccgtgacggtctgcgccgacccagtgggcttcagcgggttagctacggctgcgcccgcaacggtcagtgccggagccgaaactgccacgttcgcggaactgaaaccattggtcgcggtgatgccggtggtgctgatgtcagccgccatcttgttgcccacgagggtgactgtcaggtcctgcgtgtaggtgagcttgtcgcccggaactaccttgtaggttgtgatgtcgatggtcgcgttgttgcggtccttccacacgcctgccgtcgtggcattgaccacgttcaggtccccggcaacaatggtgcccggcgcctggttagcttctgcgttccaggcggccagggttccgccgccgcccagcagcagtgctgcgccgacggcgatggctgcggttcctttgatcaaggtgctgtttttcatgatgtgtcccctcagactttgtgtgtgtttgtggatctgaggatcactttgcaaggccaatctcaggacctgataagggatttgatcaaggttcgcgcaagaataaagcagcaggtcagacgccggtaagcgctatcccacgtctccgtccagccggtcagccgacgccacatgagcggccgacgcgctggtcagaccggcagccctatccgcactttaggaaccgaacccgcccgggcgccccggctcgtacagatcgatgatgggcaggtgcccgtcggtacggatggcgtcgccgccaccgttgcggtggtggtagccgctggagtagttgaggatgacgtggaccgactccaccgcgtcggctgcctgcagcgtggtgataatgaagtcgcgttcctcgtcggtgcggtcggcgatcttgtgcgtgatctggaaggtgaacagggacaggcccacgctgcggtcgtacgttccggcgcccacccagtccacggacaggccgccgggcagcatccatccgggcgggcacttccagaaccggacgtggtgccgcttgcgcggattcccgtcgatctcgcgctggaatgcgaggtcctgcctgttgccaaacacgtagagccagctgaccggggcagccgggtaagtccggccaaggactgtcgaggtgagggtgtgccaggcggtggccggcgtgatgggatcggcctccacccagccggcggtgcgcatggcccggcgcagttcctcctccgtccccaccacggcgaggttcacgggatcgccgaggacgccgtcgcccgtcctggccctgccaatgaagtagtccggaatgtagaggctgctcaggatcttatggacgcgcggcagcagcgcgtacgccaggatcagccagacgggcaggaacacccatgcctgctcaggaccgcgcgcgaggcgcgacagcaggaaaaagtacacagcccagccgacggcgattgtcaccaccaggtacagcacccgctgcagcacggccaggacggtggcccacctgctttgccgccgttccaccgcactggtggagggcgaatggtcgggctccgccgccgcgggccgcgcctgagcgtgcccgtcggggccgggccggcggtcggggccgctgtcggagccgggccggcggtcggagccggagccgcccacctccgagtcgcccaggtcaggggtcacggctcgtcggggttcagctgctcaacgatgatccgcgccgtctcaggatcacccaaaatcat
